United States Patent 6,812,339 (POLYMORPHISMS IN KNOWN GENES ASSOCIATED WITH HUMAN DISEASE, METHODS OF DETECTION AND USES THEREOF) - sequence listing, part 78

SEQ ID NO: 17255 - DNA, 22908 bp, Human
ctagaggccatctctctcagaatacagggtgactggaacgaggcaactcatgtttctttggaaggagtaccacaatttcccccaatcatcttaaaagctaccagtgtgcctgaggcaggctgagctgctaagggtgtgcagaaagaaataggagcagggaagagaacatactgcacacattctgctgccactcttgtagtctgaacttgacacaaatgacaaaataacacatgatttccctcacttctaaaatatttccaccaaagttttgaatattgatttgttcctaccttaccaagccctcagactgagaaaagaagaaattaagatgagccttgctgctattttttgttttaatcattacacacaatgctcctccctctcccagccaccacgtggctaaaccccctttggcaatacaggcaaagacataactttagacgttaaccttgttttaaaatgtgcctttcggcaaatagataagtgagaagagagatcaggatctgggggtgttaacggcataaagtgagatgctcctgaactgaacgagcaagaaaaaatattttcttgaaagcagtcctccagaaagaattcttatcatagataagggtgcagtctagtggcaaacttcatgaaatgcagccccttctccaaaggaaagttagaatacttctcaagggaggaagcacaatgtaaaaggtgtaacagcccacaccaagtccacccagcaggggcagtgacattggtcatttctctctgacttgcctgtgaggctcatggcccactcaggtcaatttcagaaaaagctaaaaccaccaccttcctatttcaaggccttagttttctttcattttattaaagaggttctagtggcatgattcggttcctggtcaggacctcttccaagcaggtcctgtggccctgtcagctcatattcctgggatgtgcctataagcaccaactaacctgtcaacctatcacaaggtctcctccagctactctgccacccactccctccagggatgtggccctgcccaatagaaatacctctgcaaagtgacagagagggaagtgtcactccaatccacctttcttccctctaagaaccccacacacaaggacactttaggccaccatgcaaggttttcagacttagcatttcctccaaagtgtccatctctgcaactcactgctctcaataatgctgttgtatgaatgtccattcctgcagatacacaacacacacacatacacacacacacagagagagagagaaagagagagagaacctccctggccaacgcagctgaaggcaactggtcacctcttcatcatgagtactgaaaccccctgattaaatcctcttctccagacttttaggggagaaattcaattttttcttcttttttaaatttagctcaccagacatcactggccattctacactacctgtcccccaaacacacacacacacacaccccacatggaaacagacaccagcatacagtcaattgcagaagcttaggaagatttcttgggcacggtatatccagttggctaataagaaaatacgtctcccttcagcctgtgccttgactacttaaaggataggagggaaggggagacgaagttactctcctcattgtgttcaccctgctccgaagaactctgtcttccactggcccctccacctcctccccattctcggtagccccagcctgtcccccttgcccctttcttacattccggggggaggagggcgctgttcagaggggaggagggcgctgttcagggagcgaaggggagcccccttgtgtctagaaggcctctccccacccccaccccgtgtgagtttgtactgcaaagctccttggcatccttgcctgagttgggtgttgggaagctcaaattgcagctacaaactggctggcagccaggggccggctatttaaaagcgcctgctctcccggagccccgtagtctctttggaaacttctgcaggggaaaagagctaggaaagagctgcaaagcagtgtgggctttttcccttttttgctccttttcattacccctcctccgttttcacccttctccggacttcgcgtagaacctgcgaatttcgaagaggaggtggcaaagtgggagaaaagaggtgttagggtttggggtttttttgtttttgtttttgttttttaatttcttgatttcaacattttctcccaccctctcggctgcagccaacgcctcttacctgttctgcggcgccgcgcaccgctggcagctgagggttagaaagcggggtgtattttagattttaagcaaaaattttaaagataaatccatttttctctcccacccccaacgccatctccactgcatccgatctcattatttcggtggttgcttgggggtgaacaattttgtggctttttttcccctataattctgacccgctcaggcttgagggtttctccggcctccgctcactgcgtgcacctggcgctgccctgcttcccccaacctgttgcaaggctttaattcttgcaactgggacctgctcgcaggcaccccagccctccacctctctctacatttttgcaagtgtctgggggagggcacctgctctacctgccagaaattttaaaacaaaaacaaaaacaaaaaaatctccgggggccctcttggcccctttatccctgcactctcgctctcctgccccaccccgaggtaaagggggcgactaagagaagatggtgttgctcaccgcggtcctcctgctgctggccgcctatgcggggccggcccagagcctgggctccttcgtgcactgcgagccctgcgacgagaaagccctctccatgtgcccccccagccccctgggctgcgagctggtcaaggagccgggctgcggctgctgcatgacctgcgccctggccgaggggcagtcgtgcggcgtctacaccgagcgctgcgcccaggggctgcgctgcctcccccggcaggacgaggagaagccgctgcacgccctgctgcacggccgcggggtttgcctcaacgaaaagagctaccgcgagcaagtcaagatcggtgagcgcgctcagtgtgccagtcagttacgcggcgcacgggcgggggacacgagaccggctgggcccgcgcgctttgcgcagcaagtggcttcgagctggggtgcagctcgggagtagtcggggagggtccttgcaccccggaattggagccctggaggatcctgctacccgggggaactgtctagccgagtctatcccagctttcgctctttctccttcctcctacccacacgttgcccgccccctccccctactctgtccgaatactgattctgagctcttattcggtcacaaggtccaaatcccctggtaccctatctacagtctgaaagagtgtatgttacattatcaactccctcctccacccccctcgcgccccgcataggtttttttctgaacttggaaaaaaaatctcttttgttaaaatattattttaattgcggcctggagagagaggcattacctatcttctgagctaattccacctttgtccctcttggcccctccacccccgtgcctccagacgtttctatccctccacccctacacacacaccacaaacaccccacatccttggtagctaatgcctttcgggtgggagccctgaagcccctcccatgtgcataaccattgctttttattgaagatgattgcctgtggtagatggtaaaacatatttaactgcaaaatgacttttattttatcccaggaagggaaaaaaatactttaggagtgcgggggtgcggggtgggggtggggaagagtagaaaggaagggtttggtattctgtgcctggtgttcgtttctgaatctaattccttttccccctctccaattcagattttacctaggatgaaaggtggacatagggctgggaggcaaaaggggatgtgagattcagagctttcaacttcctcgcctatgcagattcctggcaccaccaccacctccacccccgccccgcaattcctccctccgcaatccccccaccccgccctccccaatctcttaaaccagatcacaagtgggtgtggattaagtgcatgaggggccctggaaacgcagaatgcaaaattcagggggcggagacagaaaagccacgcactgggagcctcgcctccgcttgccccgcccccgggttgcgccgcccccaaattctcggcgccaggagtctagggttgaaatgattgacacagctacttgttcaatcagaacagttctacccccttagactgagtttctttttggaaagagttacctgatctttagttaaaaaaaaaaaaagttaaataaactacataaaagtctgggttctaagacgtcaaactggctattgattctctccaaaaggggttaaaacttggctaaacaatgtttatttggcgtagtttagttacggagacagtttagttacgggggcaatccccttctccctccctgtccctttccgttactcacgagcaccctaacatgagttttctgaagtgcaaatttcagtcactatagtgcaggagaggagtgcgtccgcgcttgccaggaggccggagagcttcctgtgttcagcctcagtccccgcaaaccctgcagggtttgagtggcgcaggggccagcccctctagctttgcaagaggtagtcgatctccaaacctgcaaaaagtcgatctttttgcaggttgcagcctgcaaaaagaggaaaaggggaggatgtgcaggctctgggaaccccagagaccggcttgtgagattatttttattaagatccacttttcaaaggcggtcctgcccgccttcatcttgggggatgtggatttggaaaagcctagcggagaaggaaaacattaattgatttcccggcttgggagccaccgccctgggtaacaatccagtcacaccgaaagaacgtaaggtgtcactcagccgcatcctggctccacttattatttaccaagcgtgtagtgtgatgtggctagtgtgaagggtgtacacgcagagcgcacgcgcgcgcaattgctaggcgagcacggagggcgcatcacacacacacacacacacacacacacacacacacacgacacttcagtcccaagcaagatcccctgtagaattccctgccgccccttgctcaacccccaccttctgagtgcctttgggccaacccgaagccgcctcttctacccgccccctccccagcactcctctccgactccaccccgccgaaggcaggtgcccggccggctgctgttgcgggttggcggcgctccaccgctgctggtgccgacatcttcttcccgaacagatgggatgggagtgggcgctcctggaaagggcgttttagccggacaaccactgggcgggtccccaaaaagttggagatggtgtagagaccgttcttaaggagagagaaatggacagagagagggagagtgcccttttggtcctttagccaaaattcctgcttcccaacacacctcctacctccctcctctcccccacccccgccaaaatctgagcttgcagatatggatttgccccctccctcccgcagttgcagcatacacacacacacacacacacacacacacacacacacacacagacatattatatctatataattatatattgtatatatggtatatactatattatatatatttatatgtaaccaaacatgtagaacccaaaaaaggtgcatttctggaatcagaaatggggagcagaagagagtgaggtggcaggcagccaaagcctctgggagggaaaggagagggcggaggagagggtgttttgctaggctgttgctgagcaactggagagggagtgggcccgagagcagggtgctgagagcgagcctggctctgcatttcattctggccagttcaggagcagagatagatacggaaaaaagaatgtgtgtgaggctggagggagatgaaagacgggagttatttgatgggcaaagctcagtaaatagcggtgagtggagggagtcaaggaagtactgggtttgctttcgggcatttttggtggggaatgaggtttgatgggctggtccccagcatagataccggggttcgggtaggtctcctctgtgctggtgagacattcagtttaagatgtagggagccgtgggttctggctttcggttctgtcattaagaaatgagacaccgtgggacaaaaaataggcttctggaaaagaaagcaaaagcattacctaaataaaagtgaattcagcctttgcttctttgaggggtttggcctccatcaccctggcttcaactccaagcctggtctaaaatgccatgttgaagtcgagttccagagttaggtttattggccaaatttatgtctgggttgagcaagatcatggaaaactgaaggagccaaattcctttcccacccgcaccccctccctctgaaacaagtctttgagaggatggcgtgccctgagccaaccaaaacgggagttgggaagacgagatggggctttaactggacttttctcgccacctccgcccaccgcccccgcccccgcccaccccgccccccctcccccacctttctgctgtgtcagctcagactggaagaacaagcagagttagccctagtgagagctcatattctttccatttctctttttcccctttctcacccctccctcctactcttccctccgaccttctccatccaccccccgaccccccaccccaactctaaggcatcccctgagggcttgagttttaagtcagagcagctgtgagttagtcccggggcttgggctggatttgagcaggcaggtgggcctgcagctgcagagggtggaccagcctgaccctaggagccagaggtcatcgtgagggttacagcaaagggcatgggagcaggaattccctgcagaagccctggcccccttaatggagcgaagaagaagccagcgggaagggaaggtaatacttgtctaaagtttctactttgtacctgagcaatgcctatgaaacttttaagatatttagtgtgtggaaaataaaactctggagaagagatcaccacactccagacccactacatccagaaactggaagaagatcataaagagcaggtaccaaccaggggccagagcagaagggaagagggtgggagaatggctgcgttgagtcaagcaggcgatttggaggggtttgtttagttttacatttgctttttctctacagttggtccaaaagctgcaattcccagagactatccttaaattgcaatcaggacatgttattcaaaacagtaagactgattacacattgattacatacttgcaaaaataaataataaaataaacaaggatggcagtgtaggcttctactcccctcccccaataccagtgaaatcccccccttttatttccagtttcatttctttccataaattctgttatgatgtcatttctctctctctctctctttttaaaaaatataaatccagaggagtgactgaaaatctctgtgaggaggagaggttatattcccaccttggccactatgctgttggtttagagcacctaaccaggttagttagttagtgcctggccactcagcttagctcagtcctagtgtctctccaggaattgtctgggtattggccaaataatgttaaagctggaaggaacccatagccatcatcacagtcaaggtcctagttttagaatgaggatactgaggccctgagtgggaagtcacttgcccaagatgtggcagcagggttagagacagacaaggggctgggactcagctctttcccgcaggggctccagcactgcattcagccattcctggctttctcgctagtcactggggctcatgcctggacctgggctaacctgcagtaaggcctttggcaaacactgccagatgctatcactccatgacataagaacccataatctgaaggcgctctgttttaggggcagtaggaaaaggagtgaagcggccccaaagtggagagggccacactctcttattttcacactcacttctgtccctttttctacacagtcttgcatacaagcctggcttaggctagtggtttggtcagagaaagaggaccaagagggtgtgaaggaggggtgttcaccccagctttcaggtccatgcgccaaacctcattttctacatgacaggaagctctcctgatgtggagaggcaggcaggcctggctgcctctgagctgtgcagcggcctgtagtcttgaagaacatggtgcagaagtggcccgcttccaacagcacagtcctcacgtggtgccaacagaaagcagagatcgagagagggtgtggttggatggggtgagtgcagtaactaggaagttctgcatccgaaggagagaaggaaaaccatataccaccaaagctgataaggaagagagcatgagggccccctggctttctttcataggcagatgtgtctcagatctttcagcaggagaggagagatgtgcttccagagggcagctggggacttctggttgtgctgcaggaagtgctgagacccattctaatacatcctggaggccgtggcagctcctccttctgggatgcttaggaaggaggcagataagataggcccctttttccggtaagtcagacctgccaggtgaactataggaacattttaaacgaactcagttatctcatgtttgatccctcaacctaaaccatcaggcccctttccctggcctaaaataaggtcccactgaatctgcactcagagccaggcctcagatgacctctgctgattctctgagttgtttaatgtgggttccagttatcccgaactgggactgcgacacccctctgtcacctcagccaggatgactcttcttccagatcatttagaacagcacttccaattgaaacataatacaagccatatttgtcatttttaattttctggtagccacatcttttttaaaaaggtaaaaaaaacagggaaattaattgtaataatacattttaactgaatatatccaaaatatcctttcaccacacgctcaaaataaaacaattataatgagatattttacattctttccttcatatttagcctttgaaatccggtgttttttacacttacagctcatctcaattcagacactaaattttcattggaaatacttgatctgtatttagatttcataaaatttacagttgaaaaagcagagtcacatacctgaggcattccaaacatactttaaaatctttccaataactgagttgagtatctgtttttaaatttaaactaattaaaattaaataaatattaaataaattttaaaatgtggttcctcagttccccgggccacatttcagatgttccgtatgtatctgcacatggttaatggctaccagcaaacccctctctcacctgagaaggcaactgctgtccccactctttccttttgctcccaaagactcaaaaaaggggagtctcagctttcgttgacagacagggctcccttgtttggtccctagcagagcctgggcaccttcttcggggcctcaggagagaagcgtaaaccctacttcctccctgccgcccccttctggtcatgcagaactttggggggatgtggctgtggctggcaatgttctgaactggctgtgatgggtcatgatgggaaagtggccaggagaaaagctgcccagtgcttcctccagaggctgctccccacctatccccccaccattaccttctcatttggggaatgtatgaggaacagacagacacttctactaagcatgctcccccttccccaactccaaaagaagcttggctggagattctcagccagggacttgtgcatcagtgtgtatttcctatgtgtacagttatcgccagctgcttcccagggaccaagaaatgtgaaccagagtcacaaccccaaatcctagtttggcatcagaaaacaacaaggagcctctctttacctctggtccctggacagtggggcagatgtaagggggacctcagccccttactctgtgaggtgtcaccttcccacctgtggcatctacactgtggagggcggtgggcccccttttctctatatatcttcagggaaggaggctaagtgcccttaacgcagcatgaaggaatggggttaggcagaggaaggactcccagggggagctctctaagtggagacgggtccggagagcacctgtgccaagtcctcacctggtgttggccaacagacccccagagacaaaggtcgagccaacactttctggcagaccttcctgcagtccaaggagcctcagatcttgtggtctacaagtaggcgtctgtcaaccaggtgtcacagcaaccaaatttttagttgatgattcgaactagggaggtggtaggaaacagcactacaaaggcagagacctgttctgagagtgaattagcatgcatcaccctgattaatcctcagaatataatggagaaggggccattgccatcctccccataacacaggtgagaaaactgaattggaaagaggaagaagaaagtaaggtctttgggaggctgaggtgggtggatcacgagctcaagagatcaagaccatcctgggcgtggtgctgcatgcctttagtcccagctactcaagaggctgaggcaggagaatcatttgaacctgggaggagagggttgcagtgagccaagatcatgccactgcactccagcctggcgacagagtgagactccgtctcaaaaaaaaaaaaaaaaaaagaaaggtcaaagtaaatctgtaccaaggtttgtttatttatttatttttagaaacaaggtctcactctgtcacccaggctggagtgcagtggcacaatcatggctcactgcagcctccaactcctgggttcaagccatcctcccttctcagactccccattgctaggactataggtgcacactgccacgcccggctaatatttcattttatgtagagatggggtcttgctgtgttgccaaagctgcatcaaggtttactgagctattgtcaacagcttcatcttcctcccagaaaggacagctgaaggtttagggtggcacagtttgctgtacctattcagtagtggagctgggatttgaacccaggtggtctggttcctgattctgaatggttatccactatactacatggtgtctgtatttctctggtaaggatagagatatattcccagcttggccagctttgctgttggtttagagtacctaaccatgctatttctcccggcctaaaatggggtaggggggctcagctgggtacacctatagccctcatcatccagtcagtagttctctaagtctgctcaactcccctccggggtcttcctcctggctttcctccattcttacagctgctttttaggatgacagctttgggttttttttttttcttaaaaggttagtgctcatttcctcctcagcccataattcaggttaaaaagaacccggaacatgcatgcctatttctgacgatcaagtaaaaacaaaaacaaacaaacaaaaaacaaaaacaaaaaaaaatgtcttctgagagagactggcgccaggcagctgctggtcagagatgggatgggtaggaaaagaaatgatgttgccacttccctggaagtgtccacagcaccttccccctgccacaaccactgtggcctttctccttctgcaaatgcacacacacaagcgcagaaaagccatttgacatccacagctgggaaacagacttcaagagactgagacatgtcttacattttttcaaacagtgaacagccaatccctcatgcttccaccagccttgtgttgtagggaggggctggtggctgcaagttggctagggacctagggttggcaagggaggagggggactgcagaacattctagactgggcctcagtattttcatccatacccaggcacaagtcagtgccgtcaggccagcactgaccaggactttctgcaatgatggaagcgttgcaggtctgcaatgtccatatgtggccacgaagtccttgaaatatggctagagtgactgaggagctgaatttttcattttatttaatatttatttaaatagccacattggctagtggctaccatattaaatatatacttttttttttttttttgtcacactattgcccaggggggaatgtagtagcacgatcttggctcactgcaacctccgcctcccaggttcaagtgattctcctgcctcagcttcccgagcagctgggattacaggcacacaccaccatgcctggctgattttttatttttagtagagacagggttttaccatgttggccaggctggtctcgaactcctgaccttgtgatccaacctccttggcctcccaaagtgctgggattacaggcgtgagccaccatgcctggcctaagtagtacattaatatatagtagccttaggccaaagagaagcccagtgaatccaggagcacccctgctgtttctcacacccatgacgctcatctgtctgcttccctgtgccctgcggcagggttatcttgctccagggcaggagcatggatgagataacctcccaaggcatgcactgggctctaagccccagcttatattacagaaatacttccagacctacttctctttgcctcttgggcagatttacacatctctccatttaaaggttatttattgaatactatatgctggtgagacaaagagaaatgacaaagctctgcccgtaagaagttggctgtttaaattccacaggggggactagaatgaaacccagaacaaattcagctccctttttcattctttgtagagagattctaggcgtcctcatcttatcttctgtctagaaaaggagatgggagaatctccccaggtctgggtggcctggcaaagcccgacactcttcctggactgtgaatttcaaggatgcctctgtttcttcgatttttgtaagctaaggcacaatatctgggtcacctagttttctcttacaattgattattaggtcaagtgagatagagtgataaactaacaccagcccaggaacaggctgttaatagcaccggggtgtggctaagaggtccgggggcggggggtttagattttaggcaggcaggtctcctggatccatccattgctgtgaccagcaagcaaggtggagtcagaacccttcagactctactggaagagaacagccgtggcaaaagggcaggtttggagaaagtggttgagcttgggcagggtacatgcgttgtgcaattgtgcagcatggagtatttctcaccctaagatgcctctgggtctgtagcagctgggcttgcatcatgacactctctgtgtttgccaggacatagaggatggtgcaatcctcaaacacgtgttcatgttaccatggggagaggctgatgtactgtgtgtgcctctgtggatgctgctgcactggggtgtatggggaactccttatgaatgaaagaggactgagttggccacccaaatgtggcaggggccagaggcattggagagccagtgggaaggactggaggtattatatagaagccagagatttagatcccaccccaaaggtaaatactgtatccagataatattatcatcatcccctcccttagtcattgaatagggttatgaaggtaaggtctggcctccatagatcccagcaggagaaatggatgctgagcattccacatttcccatcctctgcaaaaacctctcagaacagcatctcatgggcggggaagtctggaatatgtctctcttccttcctggatcattttccagttggaggttacagaaacagcagaatgccatgcacaaacaagccctgttcccctctccctcacctgccttcactctcccacacatgggttctctccgggcctcgcttgtttgtctccctgactctttaaatatatcctgcagacacacaaacagaaggaagggatttatttgaatgattattgcagaagtaggagagggaggcacccaaattccagatttattttttctttgagacagggtctcactctgtcccccaggctagagtgcagtggagctatcaaagtggagcaatcatggctcacctcagcctcagcctcaacctccaatctccaacctcctacctccaacctcccaccttccgggctcaagcaatcctccggtctcagcctcctgagtttctcagactagaggcgcacgcctctatgcccagctaatttttgtgttttttttgtagagacggggtttcactatgttgtccaggctggtctcgaactcctgggctcaggcaatccactcaccttggcctcccaaagtgctgggattagagatatgagccaccgctctcaattccaaattccagattttaaaaacacttccaggccgggcttggtggctcacgcctgtaatcccagctctttgggaggccaaggcgggcggatcacgaggtcaggagatcgagaccatcctggctaacacggtgaaaccccatctctactaaaaatacaaaaaattagccgggcatggtggcgggcgcctgtagtcccagctactcgggaggatgaggcaggagaatggcgtaaacccaggaggcggagcttacagtgagccgagatcgcgccactgcactccagcctgggcgacagaaggagactctgtctcaaaaaaaaaaaacaaaaaacgcttccagtccctagaagtgtgcccatgctgtgtgggtgtcagtctcccacgccctctgctggccacatggagatattgacctgtttgtcaaacaggttccagagcagactgttgagttcttttgctgttcacgtgcagaacaatcttcaccaggaagtcctcccgggtatcctgcctagatcccttctgcaacctcagttcattttctcttgatgaaatagctccagagtagccagtctacttgttccttcttgttttatctaaaacgcaaagccttccacaattgaaagcctatttatgactcagccacagagcagctgagtcgggctggctgcttctggcactcagctccagtcttactttccagccctttaatctccatggctctgccctggctcccctccaagtttccgctgtctctctggagcctacaggtgaccacaagaccctgattagtatcttcgacactggactctgctgctgcctaaggaataggtcccatggggttaagtggcaccagaaaccaggaggcacatcaaaatgttaagcctgctcttcagaagcagccaaaaagcttgcaaagctggggaaggtgtgccctcaggagacttgccttggggaggctgggaaaaggagagagtttgcaaaagcattttgagttccttaaatgaagagagatacaagaatctacattttgtatgccagtatcatggttgcttggccccggggcagtacttgaacactttcaaagaaaagagtaagagaggtcaaaataaatttaccccaaggtttatcaaaccgttgtcaacagccccatccccctcccagaaagggtgactcaaggttaaggacagcccacagcacttcttagaaaaagtcccaaaaggtgaaaggtcttgagaagagctgttgagggaaggctgtgggccaccatgcttctgtgtcccccaaggccaaagagagaataagctaaaatgacagctggaaaagggcaccctctgaccaaatggacagagcctcccccaacaggtagccagaggaggatggaatggcacccccatttcagatgtccttaagaactagagagatagatgcttatttctgcttggacacagggggatggactaaatggcctacggaaaggattccaggaactgctacaccagccacaggagagaagccagcttcccaggctgtctccccttgaagaggtgacaatgtgttggctctccaggccaggctggggcagcccactgaaggagacgcatagacgcatgcgctggtcagcagccagcccactcccccacctgccctcactttatccagttacaatcttgattgaggaaggggtccaggcttctccaatctgaaccccctccaggctttcagtagccaccatatcctgtctgcccctccccctacagtagtcaactactttttgaggattaaaatgcgtggtgatgctgaggttgagtggcacggctccagtccctccataagacgtgcccaaaagcccttctgtgcaatggttagcactccctctccctactccctcttctccaagatctgagccttggcgtgaggcctgtgttactagataacggagccccagcctttcaatttgtacaaagtccccaaaccagccatgcttctcccttcctcctgccaatctcacttgcgctacaaccaagaaaagtcaatttaccccagaacatgacccttttaactaatccctagaatcctgcattccacctaccagagatgtcaccctattgatgagtcgtcacagcagggtctgatagagcagaatcgaggtactgggacatcaagacatgactgggaagagggggtgagagtccagaaggggtaccaggattctcaggttgaattttatttagggagagcccacccaccaccttgctatttgctttccccaagtcatcatcttcctctccagtaattacgtcccttcctttcctgtgaataaatacccaaagcaactcaccaccaggaacgctgcgaacctttggaggcttctttagggcagggaccttctctgccaaggccttaaagaccagatacctatttcattagacttgacaaatcctgagccaagagagaaacagatgcttgggtgcttcctgccacctgccatcctgcccaggttaggccaggtgtccaaatgcctttcctaactcacacctggaacttgcccagggctgcaagctcagaagtcaggttctatacctgcccagaggcataaaacagcgtcttctcaaaaaagcttctctttccttgcaccccacccccacttcctggaattctacccacttcttctgttccccatcccagatgtctggcggtcactgttcctggacatcccagtgatcatggagtagatggagaacagaattttctttcacctcatttcagttatttaaggtcactcaaagctctattttctctttccagtatttgaaaaaagagggaggcaatgaagacagggccccccacctccactcacccctgcatctggtcccactgtgaggcatcctggccacacgctgcccgcctggaaacaacaatctaaagttcccccattctggttcctctgaggctgggggaggtcaaggatctgagaggagaaggggacccagggatggatgcctatgagatcagaatttaggggaaaactgcgcaccaagaaaaggccggacgggtggaattaaggatcaacaaatacatcaacaaagtctgacttctctaaaggtcaaaagccagctaagtatagactgtcagcaagccactcctatatataactgtcccggtctcagccagctgtcggcctctctcagtccagagctgagtaacgtcccagcctcccaggcccccgagcaccgcgccagttctgagccagagcaggagcaaggcctccgacttccacttggccccacgccggtcccctccgggcctacatttctggctctcccctcccctcctcctgccgcttatgaaggtcctcaccaccctgctgctccagaccccaggaccccctcctcctaggttccccaggtccaaagagacctcaacatccagcagctctgaaagtgcaaagatctcactaacaggacagcctttgcccttctcgtccacgccctgactgtgtcatctgcctccatgggcccagattcccgggttcctacttctcagccccacctccagccatgtcccatctacttggccatcccccagcaagcaaaccgctcgctgccaccttcatccttgcagaggccattttccttgcccttcctccttactgcccccagaaggcctgctccgtcctcacccatcagtctgtcagtctctcgattctcctcctctgtgaagcctccctgcctgcactctctgcttgactccaagcatgccagaaacttcctgccacttaaatgagcattccctctgcttcctggttcttatccccctgctttcagggtgtgctccaggagggcagagacacatctgcttcagcctttattactcccctcaccccaaactgcccagccctgggctctggccgtgtgcaccttggcccacgggggctgaccctccggctccttctcctgcagagagagactcccgtgagcacgaggagcccaccacctctgagatggccgaggagacctactcccccaagatcttccggcccaaacacacccgcatctccgagctgaaggctgaagcagtgaagaaggaccgcagaaagaagctgacccagtccaagtttgtcgggggagccgagaacactgcccacccccggatcatctctgcacctgagatgagacaggagtctgagcaggtgcatctcggggattccctcattccctcccagcttttgaccttttcctgcatctaaatggacattcatggcggcaggaggtgctagactagacccagcagaggacctacagcccaccatgtggctcagcttaggacgtgggagtagagtttccagagcatacacttgtcagggccaagggcttgtgcaagtaagtgggaatagaggcggtgctcatttgaggagagtgtgtgccagcccagcggccacgtaccaggtacctgggccctgcagctgtgtccagtccaaggcagagactgaatattctcctagagcatctagaaatgggcacctctggacattgttactcagcagaagagaaaagctgcaggggagggggtggactggaacacaaaagagaaagtatgactccgtacctggccaaaggcaggctttgtatgatcccagcgcacgtgacaggtgacagggaggaaagatctttggtagcagatgattagaaccaaaggtggtgactttcctccagagacccttcagcccccaccccctgggccattcgtcagcgcagctgggtggttttcccttggtctcgccacgcctctcaccctcctgtccacacagggcccctgccgcagacacatggaggcttccctgcaggagctcaaagccagcccacgcatggtgccccgtgctgtgtacctgcccaattgtgaccgcaaaggattctacaagagaaagcaggtacgtcccctgccctgagctccaggctcagactgctccaaaaatggcacctgccaggaaactccaccttgggcaagtgcctaaggtttccaccgttaaccacttagtgtttcctgggcctcagatacccattcatataccacgatcatgactttccacattccctactatgctgtaatccatttcctcattctctcctatgcggtaatccactatgctttccacaggtcgccttagctacatgaattccttgcaaaaggtaactctgtaacactatcgcacagcacgtatcattggtgcaccgcacactcaggaatttaaaccatattttctctgtgaaccacctgaaatcagttcatgtcccttcacagccaggctctcctttgggcaatggttcttagatttccaagggcatcctatccctggagggcatggctgatggctgggccccacccctgcagtttctgattggtagacctggggtggactccggggtggacacgtgaccctgatgctgctttaagggcaccaataatctaaatgtaagagccaggccacactggggcaaatcttggctctgccacttactagctgtgtcctgttactcaccatttaatgtctctgtgcctccagacccttgtgtaaaatggtgaatgaggagtgagtgattggtctttgtaaagcacttagaacagtacctactgcctaccaaacgttgagtggtgtctactacatgataacaccacaaatcatgcctccttctgttattattattaccatcatcattattattggatcataactctcttgagaatccctgcagagtttcacgttgggggaactcaaatgggtaatatttaaaacgggactataagccaggcacagtggctcacgcctgtaatcccagctactccagaggctgaggcaggaagatcacttgggctcaggagttttagaccaacctgggcaacataacgggaccccatgtctgaaaaaaaaaaaaggaaagaaagggattgaaggagcttgccaagggtaggctgcctaaattcacattttccctgggtctttccgtgaaatggggacaccagaaacccaagggtcgggtctagtgccctcaactctctggggatgagagtcttgccttggggtagacaagaggcagggcagggaggagcagagccctggggtgcggccgtcctcaccgcctgttgctctactcaccccagtgcaaaccttcccgtggccgcaagcgtggcatctgctggtgcgtggacaagtacgggatgaagctgccaggcatggagtacgttgacggggactttcagtgccacaccttcgacagcagcaacgttgagtgatgcgtccccccccaacctttccctcaccccctcccacccccagccccgactccagccagcgcctccctccaccccaggacgccactcatttcatctcatttaagggaaaaatatatatctatctatttgaggaaactgaggacctcggaatctctagcaagggctcaacttcgaaaatggcaacaacagagatgcaaaaagctaaaaagacaccccccccctttaaatggttttctttttgaggcaagttggatgaacagagaagggaagagaggaagaacgagaggaagagaagggaaggaagtgtttgtgtagaagagagagaaagacgaatagagttaggaaaaggaagacaagcaggtgggcaggaaggacatgcaccgagaccaggcaggggcccaactttcacgtccagccctggcctggggtcgggagaggtgggcgctagaagatgcagcccaggatgtggcaatcaatgacactattggggtttcccaggatggattggtcagggggagaaaggaaaaggcaaaacactccaggacctctcccggatctgtctcctcctctagccagcagtatggacagctggacccctgaacttcctctcctcttacctgggcagagtgttgtctctccccaaatttataaaaactaaaatgcattccattcctctgaaagcaaaacaaattcataattgagtgatattaaatagagaggttttcggaagcagatctgtgaatatgaaatacatgtgcatatttcattccccaggcagacattttttagaaatcaatacatgccccaatattggaaagacttgttcttccacggtgactacagtacatgctgaagcgtgccgtttcagccctcatttaattcaatttgtaagtagcgcagcagcctctgtgggggaggataggctgaaaaaaaaaagtgggctcgtatttatctacaggactccatatagtcatatataggcatataaatctattctttttctttgtttttttctttcttcctttctttcaaaggtttgcattaacttttcaaagtagttcctataggggcattgaggagcttcctcattctgggaaaactgagaaaacccatattctcctaatacaacccgtaatagcatttttgcctgcctcgaggcagagtttcccgtgagcaataaactcagcttttttgtggggcacagtactggatttgacagtgattccccacgtgtgttcatctgcacccaccgagccaggcagaggccagccctccgtggtgcacacagcacgcgcctcagtccatcccattttagtctttaaaccctcaggaagtcacagtctccggacaccacaccacatgagcccaacaggtccacgatggatccaccagtcccaccccagccttttcctttcatctgaacagaatgtgcatttttggaagcctccctcactctccatgctggcagagcaggagggagactgaagtaagagatggcagagggagatggtggcaaaaaggtttagatgcaggagaacagtaagatggatggttccggccagagtcgatgtggggaggaacagagggctgaagggagagggggctgactgttccattctagctttggcacaaagcagcagaaagggggaaaagccaatagaaatttccttagcttccccaccatatgtattttctaggatttgagaggaaagagaggaaaatgggggaatgggttgcaaaatagaaatgagcttaatccaggccgcagagccagggaaggtgagtaactttaggagggtgctagactttagaagccagataggaagaatcagtctaaactggccatgctttggaagggacaagactatgtgctccgctgcccaccttcagcctgcaatgagggactgaggcccacgagtctttccagctcttcctccattctggccagtccctgcatcctccctggggtggaggatggaaggaaagctgggacaagcagggaacgcatgattcagggatgctgtcactcggcagccagattccgaaactcccattctccaatgacttcctcaaccaatgggtggccttgtgactgttctttaaggctgaagatatccaggaaagggggcttggac

SEQ ID NO: 17256 - DNA, 18249 bp, Human
aaatattttttgtagagatgaggtttcaccatgttgtctgggctggtcttgaactcctgggctcaagccttccacccaccttggcctcccaaagtgctgggattacaggcgtgagccatcacacccggccaacaaattggttttattatgagtagctagtaatacatgtaatttctcttttactttttaaaatattatgaaaaaatttaaatgtgcaaaataaagaagagtagtataataaactcccatgcaccaatcatctgcctggcccttatgtttcatccacaacccaacccacttacctgactccaggttattttaaaacaacttcaggcactatagcatctaattttcagtaatttaaaaaagagtgtataagaatgctttagagattacaaggcaaatgcttacacattatctttttccattctcataccctgttctttggcactttaccgaaaaggaaatgagaagggttcagagaaattaaatgacttttctttggtaacatgcctagtatacatgtagtcagaacttgaagcttttgcttttttttttttcttttttaacatcaactttcgtgcttagtccagtgtataacatcacaggcaaattcaaattgagaataggaatcagttgttctttaaccgtaacccttctaacttttacttatcctaagaccgggtagcaagtagggcaggagccttcatctagagggatggtgacagctctgataggggaaaattagcactggtctttccttccaaaaagccactctggctgctgctgttgacacaaggctcctggcttttgagacattatttgagtgctggattccaatactttttactttctcataagaaaaaaaaatgtgaagcatctaaggatatctcctgccttattgataaagtaagcctcaggctgaatccaaattgctgagctccaatagaactacagggcaaagcatctacacagggaattgccactcttctccaaaattaggctttattaagaggcaaggctatgttctcctcatatatatgtgtgtgtgtgtgtgtgtgtgtgtgtgtgtgtgtgtgtaaaaagtaaatgttttacacagatccccataagggaaaagtgggctatagtaatacagtatttttttgtttttcttttttttgggggggggggacagtttcgctctgtcacccagtctggagtacagtggcgcgatctcggttcactgcaaccgccgcctcccgggttcaagcgattctcctgcctcagcctcccgagtagctgggactacaggcaagcaccaccacgcccgggtgattttttttttttttatttttagtagagacgggtttcatcatgttggtcaggctggtctcgaactcctgacctcaaatgatccgcccgcctcggcctcccaatgtgctgggactacaggcgtgagccaccgcgccccgccaaatacagttttatcaggaatcaaaactgtgctctcttctggactctcagctttagctgtttggagcgtttagtctaagccttaccacttacattgtaatgtgaagatcaaattgtaacgacatggcaataataaggctcctattggttgggtaccaccagtttatgccaggcattgtactgattcatgtctttaatcctcaaaacgaccttccgaggtcagcgtttttattctttttccagaggagcaaactgagtttctgagaagtcacacccaacttggtggcagagctgacgctggcatggggttgactccaaagctctctacgccacgagggtgggaaagacaacgaaacacaagcgagaagaataatgagaactgggatcgcaacttcattaaatgagaagccaggaacaggtggcggagggcacgcggttcgctgcacggagtcgctcaggctctttgaaacaccgcgcgggggagcggggcggtgccggaagtcaggccatggcttccggttcttgcgtcggaagtggccggtcagcgtcgctgccggtctccggcggagacggactctggagtttgggcggcccgggcggccactaggtactctgatattccgtactaaacacgtctgcaagtcaagatgtcgcacccgtccccccaagccaagccctccaaccccagtaaccctcgagtcttctttgacgtggacatcggaggggagcgaggtgagcggagtctgacgctcgcggaaaagccccgaggaggcgggggttcccgggatttgggggattccaagggcggaatgcggctccggccggtgactgctcagtttcgcggaggggatggctgcctaggctggtccgccggagcaggcccggagatctagggctagatcgatccagcgcccttgtatcaatgccatcggtggtgcggaagtttctggaaatttctagttcgggaattgtggcgtcctttaggtttgcctcctgatttggtggcacttccacgccacctttgcactaccaagttagcatgaaatattttatgtttgcaatgggacagttcggaaagcatatcctgggatatgcgtctgctgggccccaggaaactatatttgccacatgagataatatatcagcacgtgctgtgttatttatacgttaaagggacttgtttgctcattgcttttgccttattactgattcttaatttagaggtccgttcagatgagcaaacattttctcttaatttgccattgggaaaatgcgctcaacgtagtgatggtgttgcctaggttacatagccgctcagaagttcctaaggcctggtgaattagggagcgtgttgctttgtaactggattggccttgttctggaacacgttggaattgctggccaggcaatgtgtttgaatgcatgtacaggacacacacacgtttacacgtacattcagtttgttgcaactagctagggctaggtttaatctcacctgtcttagctgctatctagaggaggaatttttacagcttttgcttcagaggttgcatgaggcagtttgctcagagcacaaaggctgcaggtatacgtaacacgtggcaagtccgcccacccaaagactgtttaattttctcccgttggttgcttggtgattggaaattctcagtacctcttgaagaaattactcaggatttaaaactatttgtatttaatgatatctcttacatggtgctaatcttttggctactataattggttatgatccttagtgtaatgtttcaaatctgtttatatacatacatgacagtaggtagactaaatttgaatattagaataaaataagattcactaattctagtgagtatattcaaaggaaatgaagtttgtatgtcaaagaggtatctgcactcccatgttcattgcagcattattcatgatagccaagataatggaatcaaactaggtttccatctacagatggattttttttaaaatttgatatatgtgcacagtggagtactattcacccataaaaaataatgaaatcttgtcacttctgacaacatgaattaatatggaggacattatgttacatgaaataagctgggcacaggaagacaaggcatgatctcacttacatgtggtttctaaaaagttgaccttgaagtagagaatggaatggtggatttcaggggttgggtagatgttgatcacgagagacctaatttcagttagaaagggggaataaatttaagagatctattgtataacataatgactatagttagtagcaatgtgttgtgttcttgaaattgcaaaaaagaaaaattacagtaaaggggaacttggtaattcatgattgatctgctaccataattataccaaccttctttttatcatttgtctatttggttgttttgcatactgacaagattttcttttcttttagttggtcgaattgtcttagaattgtttgcagatatcgtacccaaaactgcggaaaattttcgtgcactgtgtacaggagaaaaaggcattggacacacgactgggaaacctctccatttcaaaggatgcccttttcatcgaagtatgtgtaaattttcttaatcttgttattcttcatacagacaagtcctgttctttaggatttggggaagaaaacactaagtaggaagtgaagcttaaaaagtactattagcgtccatgtctgaggcagtaacgcagtttcgtaaaggttaggctgtgcgaggtggaattacttatggtactaaggtttatctatagagaaatggactcccctagctttacccatcctctcattctccttcactctaagatgatttgattgagaaaggaaggccgtagtcaaccaaccttaggtagcttcattgcctggtgacaaaaaagttatgcatagaccgggcgcagtggctcacgcctgtaatcccagcactttgggaggctgaggcgggtgaatcacgaggtcaggagatcgagaccatcttggctaacgcggtgaaaccccgtctctactaaaaatacaaaaaataagccgggtgtggtggtgggcgcctgtagtcccagctactcgggaggctgaggcagtagaatggcatgaactcagaaggtggagcttgcagtgagccgagatcacgccactgcactccatcctgggcgacagagtgagactctgcctcaaacaaacaaacaaacaaacaaacaaaaaaatgcataatttttgggcctgagtgcttgggaaggcagcagatttgaagattcagtgttttgggcacatgggtgatagtgtggtcaaaatatgccatttcatactgcttattacactttgtaatgaatcatacttttgtttagtgataatggttctcccaatagactgcaggctctatgagttcaagaactgtatgttttcaccattttgtttttggcatctaatacagttattgagtaagaactcagtaagtatttgtttaataaataggcaaataagcaataatcacaagagcaacattttttaaacgatttattaagaaaaaattaactttttaaaaatatttaaaatgtttactttcatgtttaataaaaacttgaaatatgctaataaactatatgcagaaaatatttaacatagcaagtgtgagactgctatctttagaaaggtctgcctgcaagagtagcacttgtttggagtctgggaacttgacacttgtaccatttcctaaatagtaatggtgatttactatgcctagcctatttgtacaaacatgaatgtgtgctctcttttggggagtctggaattttggtacatgctaggtagagtgtgcccaataaataccttgggtgctgagtctctaattggctctcctgggcagaaatactgtgtacatgttgctgcatttttgttgctgggggaagtgtgtgttctgtagcacttcatgggacggagaaagcataaggaagcctgcacatggatttttccagactctgcctgtgtctttcccgtcatctcgctgtgtatccttaccactgtgatccaaccacatactgatttgtgtgagctctagggttctctgaacatgaaagcaatcttggtaacctttgacacaaagtgatatatttgctgaaaattttccattagggtagaacaaatctactgggaatcattggtctgtattcagcagacattattgagtaactaatatgtactatgtgtacatgcacatagttataaggatgtaaaacaatacagttggtgtacttaaggagatcattgctggaaggggcagatcataatgccatatgttatgtaggcagagtcaagatactatgggagaaaaattaggacatacagcttagggatttcagtgacagttttataggggaggtatcatttgaaccgattttctgaatgttagcagggatcaggcagtgaaaataggttggattcagatggtgaaaagcctgaagcgtttggagttgcggagacgggtggggagggacaaacaggagagagacatgactagagtcatgcactacaaagttgtcttacgtacgtatccattagtaagcattgctaaaggcatccatgtctcagtcactaatagccattttccttttttgtagttattaagaaatttatgattcagggtggagacttctcaaatcagaatgggacaggtggagaaagtatttatggtgaaaaatttgaagatgaaaatttccattacaaggtaaagtagagaaaatgcatgttattgctgataaaaagattgttatatatctggaatacttgttggattaagacaccaaaaaatgtttcaagtgtgcttagattctccatttcttgtaataggaatcacttttgtaaataatggttctttaatatggaaaagttttcattcagtaatgattaattcagcattatttcattgtgatccagtttttatatgcttcagttaagccagtgagtttttaaatgcgaccagcatctggcaaaattgtttccaggaaaaatgtttccattgttggaaggatggtaacttgtgcatccttatccttgaatttgaagagcaacaaaaccatcactaatatccaggatgtcaggggatttgcacactagcagatatagttaaatgtccaagctcctaaaggacttcagtggtgcctgtgccttcttgtcttcgttgtcccaagatgtaattggggtatattgcatcattcaagttataagaatggacatgtaagtacaaaagtaaagtgatatttttggaaataaggaatatgagcaagggtattaggataatttgaaaaaatgtcgtcagtcttccagtcagtgtttattgagccactatcactggcaccaaagggtttataaaaatgaaaggccttgatgacaaggaatttataatcctacctcagagacaagattaagatacatgggactactggagaataatagtatataaataaatgctaaattgattgaatatccttgcttgtataacattgctaatactgtctatatactgcaggagaaagatgtgatttatgcagtctgaattattatggaagtcattgaggaggaatggctacttgggctgtgcagactgggtcttgcaaggcggcaacatgtctgagatttggttaggcaggaactgtagtattgatgcagaatttaaaaagggacgtcggtgaggaaagacaaaggcaagagacgttgaggaaataaagttctagttactgttgtaccaaaggaagctaccagaaggatgaaaactaaaggtgatgtgatgatcacattgacatagagaaaaggggcctatagacaagacacatgattcttgctttctataaacgtggtggccttaaaatctgaatttgatttagactgaggggagtaaaaggcattttggtggggtggggggtgtcatgaaacattatataacatgagagttacggtgcatgcaccaacaaggaatacatttagaaagcctaggagataaagtgaaaaggttaagaaattgggtttcatagatcctttgacaggattatgccaaggtagaattttgatttcaagatgtatgcagcagtttcttttgagcactctccgaagaggtgattcatctgggatgaaaacctaatccaaatcctgtatgatttggattcttttgagattaggaaagtaccaaactgaatgtcttgggtaaattcagtatcccattattgttccagtttattgatgttttgtaaaggaagacttatactgtaggcatatttatgaatttggaagaccgttcaggtcttcccagaaaaaaagagcattcatcataaagagggcaaaatatattacaagagtttcataatgctgcatcttcattttaaaggtgaagtgtaagtattttctcatggccaatttagaaataaccctccccccgactattgtttctgttacctatttactttgataaggttttttaaagtttaaagtgattaagtgccccatgttttgtgaattaaaggttgcagtttataaaaaaataaaaagtaattaaaaaattttataagtgaaaagtaaaaaaaagtagtttgatctaaatggtagtatagtgcaccccagttttatgttcagtaaaagaacagttcagactaacacacaattcagaaaagaacacatctaaccttggttttcttttaatttttatttctacagcatgatcgggagggtttactgagcatggcaaatgcaggccgcaacacaaacggttctcagttttttatcacaacagttccaactcctcatttggatgggaaacatgtggtgtttggccaagtaattaaaggaataggagtggcaaggatattggaaaatgtggaagtgaaaggtgaaaaacctgctaaagtaagtaaaaagttacagtgaaatacacttattatcttagttgctatctttttgagacggagtctcgatctgttccaggctggagtgcagtggtgcggtctcggctcactgcagcctctgtctcccaggttcaagctattctcctgcctcagccttctgagtagcagggattacaggcgcgcgctacaacacccggctaattttttctgtatttttaatagagacggggtttcaccatgttggccaggctggtctcaaactcctgaccttgtgatccgcccacctcggcctcccaaagtgctgggattacaggcatgagccaccgcacccagcctgttagttgctatcttaaagaaatataagtaaaaggatcaggtgattattagctggaaaaatgttataataattttgggtataggagccaggatctgccacttttttttttttttttttaacttttctacaatgggaaagacaattagggtagttttaaaggagatttttattatttcaactttcatttggtgatctttgctagtttacgttaagtcttcctatacctgcaaaactgttcagttggtatgtatagtagtacatagtggaatgaggataataagcccaaaatcttgtctggattgtagcattaactagaggcttggccttgactttgttacttaacttttccacacgtgttttctcctgtctaaattacttatgggtttagactagattatctctgaagacccttgtgtacttaatgtctgtgaatcaaaatgaccttaatattggctgggcatggtagctcatgcttgtaatcccagcactttgggaggctgaggtgggaggatcacttgagaccaggagttggaaaccagctttggcaacatagtgagatgctgtctctattaaaaaaaaaagaaaaaaagaaaaacccctaaacgaccataatactacccagcctaagtgacagggttgtgagtgggagttggaagctcagttacttgtaggaggtaggctgtcactcagtgtatgacaagaatagtagtaaaccggaagctcatgccccacctaatgccacttacatagacaatgataaaattgccaacttattctgtgtttattgagctcctgaatagcaataaaatgcttatgtaaatactaacattgtcgtattagttggaatgtataaaaacagcattatagtacataaatgagccttctcacataaatctgtgaattggacagtgctgcacatgacttcagctgtatagcttttatctctcattattacgatagtgcacttctacaatttagggttatttttacagttgtgcgttattgcagaatgtggagaattgaaggaaggagatgacgggggaatattcccaaaagatggctctggcgacagtcatccagatttccctgaggatgcggatatagatttaaaagatgtgagtactttcagattagtcaaactttaattaatttagtaagtgaaaatatttagtactaaaagtttgagcttttgtttcagtctctcatatgatagaatctagcattaaaccacattacttactaaaatccaacatatttgtatttttttatacaggtagataaaattttattaataacagaagacttaaaaaacattggaaatacttttttcaaatcccagaactgggagatggctattaaaaaatatgcagaagttttaaggtaatattatttctaacaaattatttttaagaaattataaattgaattataaactaaaattaagaattgctcattatatttttgcaaattacttgtggaataaccaggtgtgttgaaatagttgcatttccttttttttccctcagcttgttttgagaaatttcaaaagacagaagttgaacgagtagtacataattactcataagttttacttacattcaccaatttttaacttttgctgtttacgtttttacagaactattttgataggaagttgttgatactgtgatactttaccctaagtatttcagcacgtatttcctaagaaacaaagacattctgcataagttcaataccgttaaaacaccccaaagtaatattgatagataatatcaatccatatttaggctgggcatagtggctcatgcctataatcccagcactttgggaggccaagctgggcggatcacctgaggtcgggagttcgagaccagcctggccaatatggtgaaaccccatctctactaaaaatacaaaaattagctgggctggtggcgcacgcctgtaatcccagctacttgggaggctgaggcacaagaattacttgaacccaggaggtggaggttgcagcaagccgagattatgccactgcactccagcctgggcgacagagtgagattctgtctcaaaaaaaaaaaaaaaagtaatccatattccaacttccccagttgtttcaatttcttagaaaaatcaagggtccaaactaagattatgtgttatatttagtggtagtatctcttacgtttcctacctcccctggttttttattcatttgcatttttgtggagtccaagtcagttgtttttatagacttccatctgtatgtgtttgtttccttaagattagtttgaggtgaaatattttggcaagaagacttaggtgttgttttgtattacctatgatatcacatcctgaagacacatttcgctttggcctgtttgagttcacacacatggttaaagtagtgtcagccacaagcatttgttagtctgaggtggtatcgtgaaattgtatgaatttctagtccccaacaacttttcacacagtggatcttagcatcattgaaaatccatgcctgaatctgttatactgaacttctaagtttatcatcgtacagttattaactagcattcttctgtttgcgagagcctcccgcatattttttaagtatcactatagacctgtggatatttttcttttctttttttttccttttatagaaacaaggcctcctttatattgcccaggctggtctggaacttttgggcccaagcaatcctccctcctcaccttcccaagtagcagggactagaggatatcttatgggtagttttcaattccgtttgttagtacgctattattgtcattctttttcatgcccaaagggttccaaatttgttcagtggaaggcccctttcctttggcatgttcctattagtctgcgagcacttgcttgctctaagctcatcttgccttactttcagatctgatatggcagtttctccaaggacctctgatttcttttagagaaagaaaactttagaaaccaaattctgggggccaggtgtgctcagttttggggcccttttcagggacaatgcaaaatcaacacaatagagttctccttcatctttcctctactgaattcccttctcctattatgagaatcctggttccaaacataattatgttggaaagtacatagtggggacctgagttttaaaaatagaaaagtgttactagtgcataattagatttgggaattgctcttaaattggcctctttgaacactttggggaacaaaaacaattttttttaagccttcttaaaaattttaaaaagtgtgatcattaagattattaatagcatttttagagctttttatatcagaaatgacataacacttctggacatagagaagagtaattcctgtttatgtggtctttcatactgcttttattaatgcattctgcagatacgtggacagttcaaaggctgttattgagacagcagatagagccaagctgcaacctatagctttaagctgtgtactgaatattggtgcttgtaaactgaagatgtcaaattggcagggagcaattgacagttgtttagaggtaagtctgtttgattttgaactttttgaataagttggattaagacttagtttgaatagtagcaacttttatatacattaatatatcttattgcataggacctaatgaggcttaagaaaacattttgtttctaaatattttggaccctcagttctttctctacattcattttgcttataactctgtgtcacttaacagctatgaagatccttgcctttttttctcaaagcacatatatcagctcatgtattcacttaagagcacctattgtgtgttaggcattagaagacaaagtcagaaatgattaagatgtgggttatggagtcagtcaggcatggcttttttcttcttcttttttttttgagacggagtcttactctgttgcccaggctggagtgcagtggcgcaatctcggcttactgcaacctctgcctcccgggttcaagtgattctcctgcctcatcctcccaagtagctgggattacaggcatgtgccaccatgcccagataatttttgtatttttagtagagacagggtttcaccatgttggccaggctggtctcaaactcctgatctcaggtgatccacccgccttggcctcccaaagtgctaggattacaggtgtgagccaccgtgaagtagttatagagagttatataacacaatgtaaggcatttagtgtagtgcctggcacattttaagcacctaacagagacgagttattttaattaaaagatccataccctcaagaagcttaataagtgattcaggataggagggggtcagtttcaatttaggttcatcaggacttgtgtatggagaatgggttctattggaacaggtcatttatctttaggaggtcatccaggtatgctaactgataaagctagaaaggtggcagttttaccttcctcaaatagagcaattatgactctcttccctgttgtatagtttgaaaagttttccaaatgaaactttaagaattttacatattaagccaggcacctagactagctatgctcagagcaagtagaactaaaatgagatcctaattttgtagggtagatggaataagggataggaatatatttagaagggatcatacaacagaggaaaaaacttatcaaaagaaaagatgggtcttcactctgggtttttttttgttctctgtcacccatgctggagtgcagtgatgcaatcaaagctcactgcagcctcaacctcctgggctcgggtgatcctcctacctcagcctcctaagtagctgggactacaggcccttgccaccatacccagctgatttttaaattttttgtagagatgggtttttgacgtgttgcccaggctggtctcttaactcctgggctcaagctgtccacccgccttggcctcacaaagtgctggtattatagttaagagcctctctgcccagcctcgatctctttttgacctgtgaggcaggtaaaatctgagtattggccattaaaagatgttacataaacaaaagataattttaaaatgtttgttctaggggagagacctgatgcataaagtctcttaggttaaaagacctgttgtaggtaagaacctaggttgggtatggtggttcatgcctgtaattccagcacttagggaggccacggcggcgggcagatcgcttaattccaggagtttgaaaccagcctgggcaacatggtgaaaccctgtctctaaaaaaaaaaaaaaattagtctggtgtggtggcacatacctgtagtcccagctacttggaggctgaggtgggaggagcacttgagcctggggggttgaggcagcagtgagctgtgatcaggccactgcactccagcctgggccacagagtgagaccttgtcttaaaaaaacaaaaaacaaaaacttaagagtttataacttaagagttattaagttattaatgttcctaaaaaacttataattcaagtaaaaagtgtatacaaatgtttcttcaaaatgattttatcttaaaagtgttagttcaggcccattcgggagattgaaaccacagtggggagcatattggaaactagagaaatgtctttctcctccatgtccattcagtgccctctgctgacaaaacttagtgcccactggcagaggagagctatttgcatgtttcagctccattttcacagagcagtgaaggatgggtttggagttgataggcaatgaattgaaatctggcatataagcttaatactttgatataaatactagctttatacttttttgtaggctcttgaactagacccatcaaataccaaagcattgtaccgcagagctcaaggatggcaaggattaaaagaatatgatcaagcattggtaaattttgttccaaatgtttaattttttaaaatagacaactacctttataaatcatacacctaacttaaatgtttttttccaattaaaggctgatcttaagaaagctcaggggatagcaccagaagataaaggtaagttggcagcttttgtagtgaaagttaattttgttatttaaatacttatcctcaggaaccattgttcactttgccagattttagatgtttgttcaacagacactacagaatgcctgctgttgggccaggcattatcatatagcaatgaacaagacagtcaaagtccctgccctcaaagagcttacattctactcccattcaagaatatagtagtttttcacgttatttattcttcaagttatcatctctgtagttttttatatgtctaaatactgtttgtcttatggtatcctttgagactgtgttcctattctggttagtctagtcgagagctcagcattgtaagacacagtattcatggtaaatttaacatttgggaccattcaagttgaatgtggctataaccttagtattgatgtactggttatatgttttaggaaactatgacaaaaataagcttgtttttcaaataaaccaactatgaatagtgacactagatctgggtattacaaaatgtctttggtctcttattactaaaatgaaacaagggaagcaattactgttctctaatgtagaggcagaaggcaaatcttgatgtacttgagttctctcagttgacatcctctaaaattacgtttcatttctgtgtttgtgtgattgctcagattttctgttactagggcttagttactttgtagagaagttttttcaaggggtagttaacattaaaatagtttgttagtcaccataattttttggatattttgagaaataactcacattgcatatttattttacagctatccaggcagaattgctgaaagtcaaacaaaagataaaggcacagaaagataaagagaaggcagtatatgcaaaaatgtttgcttagaaaggattcagttttgcttattgtgtgttgattgtataaatgcaataagaaaatgtaaaggtttttgtctatgaatatgatccctaatgtgtttcttttgacaccttagttccttactgtttacagtttaggagtactgataggggttcatgcttaataaacatgtcacaatacagtaagtaaagtggttttgtttgtttctttgagatggagtcttgctctgtcacccaggctggagtgcggtggcgcaatctcggctcactgcatcctctgcctcccgggttcaagcaattctcctgcctcagcttcccaagtagctgggattacaggcacgtgccaccacgcccagctaatttttgtatttttagtagagatggggtttcaccatattggtcacgtcacgttggtcttgaactcctgaccttgtgatccaccccgccttggcctcccaaagtgctgggattacaggtgtgagccaccgtgcccggccaagtaaaatgttttttaaaatggttatgtgcattattcataaaaaataatggtgtccagtctttttaaacttgtaaagacacatcttattgaataaagagatgagagcttaagtttgtatattgtttccttcgattctttgatgtatccatggtggatgatgctaggttttcatacttatagataatacacacacacacacacacacaaacttgttcagggatgggcatacttcttctgcaagggccagatcataaagtttttaggctttgtagaccatgtaatgtcacacccactcacctgcacagttgtaattcaaaattagccatagacaatgtgtaaccaatgggtatggctgtgtttcaataaaactttagtctagaatatatattcatttttatatttgattacttaactttggcaagtcaaatgtaaagtccagtagtgaattttgctcttggtactgaatctctgaagaactgaagaggtaggaagatgctgcattcttataaaggttatttaaaagcaatacccgtaatttctttatgggacaatcttacatatagtataaaatttttatttgataatcattttgtgactattctgttcagtaatatgcagaaagacattctgaaatctgttaatctctaaacattttaacgttagcttgccatacttgaaagaaactggctagctgcagtttacattccattgtaagcaggtcctcctccaccttcaggtaccacccagttaatattctgacttggatctttaatatcacatgttttacaatgtacacagttctgagcatttatctgtaaccgaaatccatcaccttgttccacaggtacaaattcataaactcctgaaaagtaaaaataaataatattgaagtgcctaactttaaaaaatttttaaattcaaaagtaaaaattaaggaaagagtagccacagaaaccttaaaggttgctttctgaatgcttacccatagagattatgaagaccttggtgcattgctattgatgtgagtgtaaattacatgtacataataaaaggaggtacagcggtattcagctgagttgtctcactatcaagggtactcgacactgagtgtttgagttccacacaacctcgaagtcctcccttattcacagtcatcctctcattcacaggggacaagttccaagatccccagtagacgcctgaaacctcaggtagtactcaacttagattgtcagtcagaacacgtttctgttcatgtatttcacccacaaatgtgatgccttttccatcttaaggaagcacttgccacactctggccataacttctacagttcgaggtccaacagcaaaacgcacaaatttctttttcctctttcacagaagatacagtcttaccatagaccttagcaacctcagcataggatttttttctctttatagagaactttctcctttcacttaaaggaagcactttatggcatctctgaattgtcagcatcactactcttgcgttgtggggatatttctaaagggttactggacacaagtatgataatgtgacagtaaatctgataacttagatggctaccaagtaacataacgaatgttaggtgtgaatatgctggacaaagggataattcacattcagggtggggcaagcccgaatggtacacaatttaaaacttaacgtgcacaatttaagactcaagaattatttgtttctggaattttcttattttcagaccgtgggtgactgggggtaagaggagcctaacggtacagctaaaaaaccaaatttaacctcagggagttttcaacccactgtaatgacaaaagccaaaagaccaagtcacagtgtatcttcttttgtgaatgtactacttttcgagtatcggaatactattttgttctaccatatcatttgagacctggttcctattactgtaatttcagttgaaagctcagcactgaaagaatattcatggtgaatttaaagtttcagagcattccttggactgaatgtaatcataatgtgctgttctagtacatgcacccaaatacatacagatgagctgccatgacagaaatgactttaaatagtcacatg

SEQ ID NO: 17257 - DNA, 38503 bp, Human
  misc_feature (1)...(38503): n = A,T,C or G
aaaattattacattggaatcaggcgtggtagctcacagctgtaatctgtaatccctgcatttgggaggctgaggcaggaggattacttgtgcccaggaatttaaggttacagtagtgagctatggtttcgtcattgcattccagcctgggcaacagagtgagaccatatctctaaatacatatatatatgattactttggatttgagagtagagtcagagaatttagaggaaactaggctgtggttttcacacgatatttttctttgttgcttttgcctttatgcaaagttttcctttgtctttggagagtagaaaaactgtggatttttttttttttgagacagagtctcactctgttgtccaggctggagtgcaatggtgcgatcttggctcactgaaacctctgcctcccgggttcaagcgattctcctgcctcagcctcccgagtagctgggataacaggcatgagccaccacgcccaactaattttgtatttttagtagagacagtgtttctccatattgatcaggctggtctcgaactcccgacctcaggtgatcagcccgcctcggcctcccaaagtgctgggattacaggcgtgagccaccgcacccggctgcaaaagacatactttataaaggtccaaggataatggaaatagaagacattaatgtaatatgttcttgggaactaattggatacaccaagtattatctttgactagtttctggacctctgcttcattctgcaacctgcagccaactaccatggtgtccatctattattaggcgctttaaatagctccttaattcacatttactctcttcaatcgatgtgtcagactgtgggggccacttaattcccattccaaattcttgggaaaggaatttaattgggttgagcttaggtcaggggcttactgaaagagcaatcaactggggcccagggacagggtgcactgtgtgaatgaggctgctttttctgcaaatttgtcaagtagaggcagactggactagctacataatttgcagggccctgggcaacatgaaaatgctgggctccctagttcaaaagtttcattattgtttccaaaagtttgcaattgcagacaatactgcgattaataaacttgtgtatgtgtatttttccattgtcggagacctagcccgagtactattttctgcagcgagcctttgacgttgtttcctttttctgatgagccacagcatttatagtaggaatttgttcatataaaatttgctctttcgctagataccagtaactggacttctctaattgctttgggtatttcattggagttctgtatgactgagctccgggaaactcagtccacccctcattccaattctttttcacagtctttttcacagcgtccctgtcaacactgtttggtaaagggtaaaaccttagataataaggtttttattatcttaacacagacaggcctaacatatgttgtcgtacctttctgtaggatcaatagcatatctttacaaatgagaaataattttcacgagaccgaaacaccctgcaacgccacctacatacagggtaagtacgcgccttggtgaggtcagcggcgctacacacccgagcactaggggacgaccttccctggtttcttgcattagcaggacttgtccggaacctttcctgcggagtctgaggtagcccgcccggacaacgccgctgaacacacaacagggcaagaactagtaggttaactgtatgcctggaatttctacctcacctacatgttcccggagcaaataatcttaaattgtcgcgctatttaaagtccctagtgacgataacattgttgtacctcagcaaagatcataattaattgtttccgagagagtgtatgcttgattttggtcaggcatatatttgggcagcccacctgaaacgaacaaggaaggcgggggaagaaagcggaagccgcggggccttctaaggccgaaagtcttcggagcttgcggcagtctcttcgcggcgtccaccacttagacgcaagttgctgaagccggccggggagaaggtgttgttgccggagctgagaccgggcggccacagtccgcagggatgaacctcgagttgctgggtgagaagggctgtggctgcgttttagagaagcgttgggtactggaaaggagggaacccaggcgggaggggagtcaggctgcaatcttagggacactgttcggctatggatcactgggcacacctgatgtggagcagcagcgggaggaggaagcccaccttctgcccgagtaggttgcattgcccctcccgaggccactttcatatcaattatggagcgatggggacagacagtttgtgacttagctttgattatgaggatcgcaggtgttgaagtacccagagcagccaggaccagagttgttggagatggaatttgaagaagtgaggcttgggatgaagctttgaagacttgtcagggaattgggtgcctgaacaggttaatctttttgtagaaaagagaagtctaaggaggggacttggagatcttctggtagaagcttctcattgaacagatgaataaaggctcagagggtaatggctaggcactaagcaagtaaatggcatagttggcactggaatccaattatcctaactttctgtttaaggtcctttgctagggacggtgtgtaaaacactgaggtgtgaaatacggagggagttgtcttttgtcgccctcactttgagtcattgcctccttacctcctatccagattatttaaaaactgtaggtcctttctcctggacttccattaggtgacatttagcatggtattctaggggtagctgaggttttcaaggacttctgcactacttgctgttcctaatggttaggtttctcttttaaaaaagtcagaagatatgttaattgtcaaaagggctacaaagatacataaaaaatggtctttgcccttaaagagcttttcattaagcagggagtttaaggtgattatgtaaaatagctgtaggatattgcagaatgtaggcaggcctgaaagagtcattaccagttgctaagaatgtttggaacagagagtgaatgtctttggggtaaaggaagaagtcaaccaggaaaaacaaaccccccaaacctgtggaggagttggagttttaagtggacttttttttttttttttaagacagcctcgcgccgtcgcctaggctggagtgcagtggcacagtcttggctcactgcaacctctgtctcctgggttcgagtgattctcgtgcctcagcctcctgagtagctggtactacaggtgcgcactgccatgcctggctaatttttgtatgtttagcagagatggggtttcactgtgttggccaggctggtctcaaactcctggccccaagcaatccactcacctcagcctcccaaagtgtccggccttaagtggatttttaaggttggtaaaatatcaacaggctgaagtatgaaaatatgggagggatgttcagtaggcatcagtgagagaagacctaaagaattttcctgcttggccaggttgtggataaagagaatgccaggggatgggatcggtgccatctattttgtgttggttctcgaatgcctagctcaaaagtttgggctttttagggaaggtagggtagatccattgaaggattttgacttagtaactcaatcagagctatgagtttgtaaggtttgtctgacagcaatgtggagttgagttttggaggagtgtaaaaccagtttggaggggtagattatatgagtgatgaggaaggcctgagctaggaaatagaaaagacattgaggaggtagggatgacaaatttgagaatagattgcatatagtgctgatgagtaagagagtgacgtgaaaaatggtgagagcaaataatgatgctgttgataaagtgtaaggtcattggaaaaagacagctttggagaagctgaatgtggtctaggggtcaggagacaggtttggatttatgggagagatttgtattctttcagatgggctcattgaaaccttgtgaatagaggacatgatctagagaaaaagtgggagggggagaaaagaaaattgccaagcacacaatctgtagttagaggttaagaggaggaataagtggagataataagttagctaacggttataaagtactttctctgagctaggcagattttcaagtgccttccatgtattaatctatgtagaggaagaagagagtacagattggtgtggcgtcttcatagaagccaatcagagcagttgagtctgagggctgagaatgggttgctctgtttagtcctttggcagcttgggactcctcagcagctggaacagaaaccagattacaatgattttagaatggtgtgggagacaagggcaaaaggttgacgcttacttgtaaaaacttaaggatggaagaaaggtgataacgctagtactttgaaagagtagcaggatcttgcaaaaggcttttcttgaatgatacagaaggttcattaggataaaacttaggaaggaatatttatttttatttatcttttgagacggagtcttgctctgttgcccaggctggagtgcagtggcacaatctcggctgacagcaacttgcgcttcccaagttcaaccgattctcctacttcagccctcccgagtagctgggattacaggcacccaacaccacacctggctatattttttgtatttttagtagagactgggtttcaccatgttggccaacctggtcaggaactcctgacctcaagtgatctgcccaccttggcctctgaaagtgctgggattacaggtgtgagccactgtgcccagccaggaaggaatatttagcactggaaggttagacaaattaaagaagcctgggtccgaaagataacaatctctgaaaatgactctgcattttaaagtgagaaagttaatgattatagataaaaggaaaggaacagaagtaatgtgattgtggaagcctactgaaggacatctggccagatgaaggaaatgaatgacaatgtatttttaatgtggttagacaagtggctcataggtagacactagttttacttctgcaaccactttttgagtccctgctgtgtattcaccagtgtgcaccggagatataattaaataagatcatttgtcaaacttatttttaccacaaatcacagtaagaaatatatattctatcacagttcactatatatacctacacgtgtaactaagtttctcagaattatatttaatccttgttatgttcagtgttctctgatagtttcttttcttttcttttcttttcttttttctttagagggagtcttgcttctgtcgcccaggctggagtgcagtggcatgatcttggcgatcttggctcattgcaacctccgcctcctgggtttaagtgattctcatgcttcagcctcccaagtagctgggattacaggcgtgtgccaccatgcccaactaattttttttttatttttagtagagacagggtttcaccatgttggctcagctggtctcaaactcctgacctagtgatctgcccacctcggcctcccaaagtgctgggattacaggcgtgagccgctgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtaatctcagcactttgggaagctgaggcaggtggatcccttgaggtcagaagtttgagaccagcctggccaacatggtaaaaccctgtctctactaaaaatacaaaattagccgggcatggtgccacatgcctgtaatcccagctgctgctcaggaggctggggcaggagaagcgcttgaacttgggaagcagatgttgcagtgagccaagattgcaccactgccctccagcctgggagacagaccgagactccgtctcaaacaaacaaacaaacaaaaaaaaccaggccggtcgaaaaacaaaaaaaaacccaaaaaaactaaaacaaagaaataaagagaatttcatgtttaatcaactgctatttgctgttgcaacctaaatgctgttattagtcaggaaggggtgtgatcgctgcttttgttaaaggtttcaaggtttcaaagagtaattgtgataatttgactgatatgaattgactcttgcctttccttgctctttttctttttgttttgagacggagtcttgttctgtcgcccaggttggagtgcagtggcacgatctcagctcactgcaacctccgtctcccaggttcaagtgattctcctgcttcagcctcctgagtagctgggattacaggtgcacaccaccacacctggctaatttttgtatttttagtagtagacggggctttcaccattttggctaggccggtcttgaactcccttgtgatctgccgcaacttggcctcccaaatttctgggattacaggcgtgagccaccgagcccggctccttgctcttaccttagtaaatttggaaataaattgtgaaatgcccaaaaggtgtgatggagaaagactgttgctaacttggatatgtcaacagttctcaaactttttagtatcaggatcctattatacttttaagaagtagagggtccccagagagtttttgtttatgtaggtgatatctacctaccagtgtttaccaatttagaagttaaaactgagataatatttttaaagcatattatatagaaataaccataataaatccattacatgtttatgtgagtagttattttgttttcaaaaacaaagtatttagtgaggaaaatgccactgttgtgacatttttacaaatctcttcaatgtttgcctgaatagaagttgggggacttctcacatctgcttctgccctcactctgtttcaatatcccaggtcatatagtctcaggaaaacgcatctgtatatttccgagataatgagagtaaacaagtcatcttagcaggatcttgaaaatccgtatggcctcatggaatgcctgaaagggcatcatatcccccttttcgttttgtcagccactgctatacactgttcgtgagttgtatgatccttgctatgtggtacatgtgccatcaactctttctttgctttgttgcagagtcctttgggcagaactatccagaggtaagagtatagtattgtggtgattttaggaacatagtaacttctgggtgtttatgttagaacagaaaatactttttgatccttgtgttttgacagagaagcattaagtgtgataatatatcttatgctataataaggagctagtgtacaattttgatcagggaggaaataggcaatgtgggctagaaatcttaccatgatgttgtaatcttacagttcattttcctttaaataaaagaaaaactttcattgaaggatttttcacaaacaccaccatcataggtttgtgcttttctcgttttgatcaatgtttttatgtagtaaagcaaaatgtatgctatagatgtgctttacttttttaattgtaaaactattttataacacttgaatgtttgaggatagacattgtggttattttaaatagcttggtattgatatgaaataatttgacttctctaatgttatgcattgtaggctattccagggtttttcttttttaattatttaaaaaattcttttaaattctttttgtttaaattctttttgttttaaattcttggaataaattcccagaattacaatgactgcatcaatagatatgactttttaaatacttctgttatattttgcccatttgccctccagaaagtttatacaaagttatagtagtgatgtaagggattgatcacatctgtttccagaatccatggttagctttaataaatgttccttcattttggctattttaatagatataagaagacacagagagattatttggtatgcagtgtaatttatattcaataaaagtatcacaagtgataaagaacctttaggaaataatttggatacctggctattgttgcctctattcttgtatttgtttcaatttttaggaagctgatggaactttggattgtatcagcatggctttgacttgcacctttaacaggtggggcacactgcttgcagttggctgtaatgatggccgaattgtcatctgggatttcttgacaagaggcattgctaaaataattagtgcacacatccatccagtgtgttctttatggtaagacattttttaattaatatttaaatatgaggagaatgaatgatgactatatatttgcaaatctcattgtagatattttaatacttagatttttaaatattcagccattagtaatacagtttatcatggtttatgtagatcctgagtccatgctgtccttgaagcacctttcttgggagaaattcattgtattatggatctgtatcaggcgctgagaatatctcaatactgaaatgaaatattttcagattgtaattgtagtataattgtgatattgacttttcatttagaataaaaagtctcggttaggacagaagcttggaagtcatcgagtccagttttgtgcagtttactgaattccagtaattttagtggtcacaagtatgactattccttcaatgaaatatagttattaaggctttatagaaaacgtaaaaacagttgaaatctgctgtaacataaattcccattgatttcactcttgctctctgaaactatttgcttcagaaaattttattttggggcagcattttttttaaatgaacttggggccaacaaaaggacctaatcagatcaaggttaagtctatctccttttgtctaaatggtattataaagcactggattgggaggaggcctgaatcacagtaaagtttggccagtaaagtactggtggcctgggccaaaacttttctttcatatccaataatccaggaagcactggcctggatgatctcttaggttccttccaccgcctttctgtttcttttttgttgtattcttgcaataaagattcaaatagggccaggcgcggtggttcacgcctgtaatcccagcactttgggaggctgaggcgggtaggtcacttgaggtcaggagtttgagactggcctggccaacatggtgaaaccccgtctctactaaaaatacaaaaattcgccaggcatgttggcgggtgcctgtaatcccagctacttgggaggctgaggcaggagaatcgcttgaacctggaaggcagaggttgcagtgagctgagattgtgccactgcactctagcctgggcaacagagtgagactctgtttcaaaaaaaaaaaaaaaaatacacatttttatgtgtgtgtgtatgtgtttcacataatataaaatttcgagtgtacaattcacaagtttttatatattcagagttgtgcaaccatcatcacaatataattttagaactcctggcgagatgcgttggctcatgcctataatcccagcgctttgggaggctgagatgagaggattccttgagcccaggagaccaacatagtgagacctcatctctacaaaaagtaaaaaaattagctgggtgtatggtgcacatctgtagtcctggctacttaggaagctgaagtgggagaatcacttgaacacaggagttctaggctgtaatgagccatgattgtgccactgcactccagtgcctgggtgacaataaaccttgtctcttaaaaaaaaaaagaactcttacctattaaaaatatgtgtgtttttattatatactaatatatacttattctagaaaatcatggaaaataaaacaaaatagaaataactagtattttctgtagtcctcctaaccagatactactactttgtacgtatagatttttgttgttgttgctgagacagggtcttgctctgtggcccaggctggagtgcagtggctagtcacaggcacgatcacagttcactgcaaccttgaaatcccaggctcaagtgatcctcccgcgtagctaggtctacagatgtgcgccaccatgcctggctaattttaaaaaattttttatagagacagggtcttgctgtgttgctcaggcttgtcttgaactcctggcttcaatcgatcctcctgcctcagcctcccaaagtgctgggattacaggtgtgagccaccatgtctgcccagtttctagatatgattttttaaagcatagtttgtaattgtgctatattctgtattttgcttttccctcctaatactgtctcgacatttttctgcttgagtagcctttaacaactttttaaatgactgtatattgtctgataaaccataatttacttaaccattttctgttttttttcctcaactacatagtgtttagtgaatgtctttgtgccatagtttttcttatatattcattcattcatttattcagcaggtgttgaccatgagttatgtaccaggtgctatgttaggctctggggacacaaaaacaaatgagaaattctagatgattagtgggaggtggatttgcatacaggtacatatactaaagctttatatgtcctatacaagaactatatttaagatttagtggagatgaaagcacaaagaaggaagttatcaattgtagtgaaggggaataacggtcagaaaagccgtcatagatgagataatttataactgtattttattttaatttttttgagacagagtcttgctctgttgcccaggctggaatgcagtggtgcgatctcggctcactgcaacctccacctcccgggttcaggcaattctcctgcctcaacctcctgagtagctggaattacaggtgcacaccaccatgaccggctgatttttgtatttttagtagagacagtgttttgccatgttggccaggctggtcttgaactactgacctcaggtaatctgcttgccttggcctcccaaactgttaggattgcaggtgtgagcctccatgcccagccagataatttataactttaaatttgtaagataagtagatgttgccagatatattccaagcagagggcactgcacaggccaaggcatatcagcttgaaacaagtatggtacaatggggaactacaggtatcaggatagctggattgtggtatgggacatacgatatgacaagagccaaggtaaaccaaggtcctcatggagaacctcgtctgccatactcaggaatttgattcctagctcatatgtactctgaagtcattaaaagattttggcaggaaagtcacatgatgagcttttattttagaaagatcttcaaagcaacaagtagaaaagagattgaaggggcaacagtaagtgaacataggagaactgctgtggtctaggctggagataatgagtgttgcagtaagaaaggagccaagttagacagatgtgagaaatggtagaaataagaggacttagtcattaatttgattggggtgtgagtgaaatggagaagttaagataattcttaggtttctggcttggttgaagatactcattaatggaagatttgagggggaagtggtgagtttgagattatggttgcatgtctcctattattttcatgttagtttattgcaaatatttgtgttagagtatcttccctgtaagatcttaagtgctgtttgagtacaaaccttgtgtgccatttcactgctatgttctcagcttctagcgttgtacctgatatacagtagccattcagatacttgtcggatgaatgggaaatgtcccaataagcatctgagatgcccaaagggcatttggtctatgagttctcattacagtagacttccagaagtgttattagtcagtcaaaggatataaagtaagagatttttcaacccctccctccaacatttttaatattttaaaatcacaaaacctatacttgattatttaaaagttttttgttttttttaaattttttcgagacagagtcttgctctgtcacccaggctggagtgcagtggcacgatctcggctcactgcaacctccgcctcccagattcaagtgattctcctgcctcagcctcctgagtagctgggattacagaagcaggccaccacgcccggctaagttttgtatttttagtagaggtggggtttcaccatgttggccaggccagtcttgacctcccgacctcaggtgatctgcctgccttggcctcccaaagtgccaagattacagtagtgagccaccgtgcttggccatttaaaaatattttaaacacctaaaaaagaatatataaatatgcaaagtaaaaaatgaaagccctttgtctacttcttagggtaaccactgttaaagagtgtggaatatattctatctataagatatctatatctttttatgtgggaaataattaatacatatatccacataatatgtttttaaacaaaaataaatatattttgttctgtagcttgcttttccacttagcatatagtggatatttctctgtgtctccttattttatatagttgtgtctatagagtattgcacagtatacatgcatcatagatttaactgttccttatttgagcatattagggaacaaattttaccaagggaagttttaggtaggcatgatagctgacttcaactattagtaaagttgatgtatgaaagagagaaaaaatggcccaggatgtagaagcagaactggtaggtactggctgggcacggtggctcatgcctgtaatcccagcactttcagaggccgaggctcaccaatcacttgaggtcaggagttcgagaccagcctggacaacatggtgaaactccgtctctactaaaaatacaaaaattagctgggtgcggtgacatgcgcctgtaatcccagctactcgggaggctgaggcaggagaatcgcttgaaccggcatatggaggttgcggtgagccgggatctgcctgggcgacagagcgagaccctgtctcggaaaaaaaaaacccaaaaaacaaaacagaactagtaggtagtgaacagaagttagctatagggaaacaaagttaactccaagtagagaggagctcccaagcagaggtgctgtgggtgggattgactgcccaggagagagctatctgagagctgttcctgcctgagcttgccaccccccttgttaggatgctgcagaagaaattcaagcactggatgggggccataggtagactttagcacattggaatcagtaaagacccatctgtttttgggaaagaagctgtgaaaaagtataattcctaattcttgaggttatggaatttggaattgaagaataaatttttttttagtttttacttttgtttataacttaatttttagttagatttccctccattatgacagaaatacaagcttgctgtgaaagaaaacaaaaattatagtgcagtagcagtaggttttttttcttttttttttaccccacccaccccctagtacagaagagtttagagggaaaatagaatcatagctaacattttgttctatagtcaaattgtgctaacaggcctacaagaatagcaacgaaacctgttccttttttctcctcactctcagtcttgtgccattcccagtagacttctatttttgggggctatttcttctgctgtttagcttcatatttctgatataatgtgtattgctttttcttggtttgttaatttcagaaattgggtttcctgttacagtgtatttgaattttaacttaccctttaccctcccatcatccacccttttaccctcctatcatcatcatcatccagctattggcttttttattgtgcacctttgcattttaacacctttaggcctctttagagttgacattctctagaaggactcactgattgcctgactacaggtattctagacccggtagaagagacacacagagtccttttgtgtgcaggctttaacttaatccctctatatttataaccttagcttacccctgtcttcctctgttcctagagtcctgagtctggcagtatatttattttgtctctgatataaataattttttgagcacttattatgtaccaggcattgagcacttattatgtatcaggcattgagtacttattatgtgccaagccaagaattctgtatgtattaaattctttcaacagccttctgcaggtcgataccgtttttattcctgtgttatagatgaggaaattgaagcccataaagcttaagtaacgtgctaagatcacacagctaggaggtagtaatgtctaggcttgagtagaagtctgacttttgagccatattcttaaccatggagattatattgcctgctgagtttctcaatagcacctcctcttgatttcaaaacctgggtaaagtatcggttttgggttacttttttacttgttccatttgttttttgtttttgtttcctgccttcctgtgggctacttggacaagtttttagaattccattttgctttatctgtagtgttttttgagtgtatacccttgtgtagctttagtggttactaggttttacatcatacatttataacttaccacagtctactggtgataagttgtattggtgaacattttaccagttcaagtgaagtgtagaaaccttaccttcctgttgtccccttgtcctttcttgtgtgtaatataattgtcttaaatatttgctctacatacattgacacccacataagacagtgttaaaatgtgtgtttcaaacatcaaaactcaagaagagaaaaagtaattttttttttttttgagacggattcatgctctgtcacccaggctggagtgcaatgctgcgatatctgctcactgcaacctccgcctcccaagttcaagtgattctccagcctcagcctcccgagtagctgggactacaggcgtgcactaccacacccagctaatttttgtatttttagtagagaccgggtttcaccatgttgaccaggatggtctcgatctcttgacctcatgatccgcccgccttgacctcctaaagtgctgggattacaggcgtgagccacagcgcctgcctttttttttttttttttgagacaatttttgctcttgttacccaggctggagtgcaatagcgcgatctcggctcactgcaacctctgcctcctggtttcaagcgattctttagcctcaggctcccaagtagctgggattataggcatgtgctaccatgcctggctaatttttgtatttttagtagagacgggttttcagcatgttggccaggctggtctccaactgccaacctcaggtgatccacctaccttggcctcccaaagtactgggattataggcgtgagccaccgcacctggcttagaaaaagtaattttatctacccatatatttatactcttttcattgttcattcttccttcctgatgttctaaacccttcctttaatcttttccgaacattatgtagccattctttagagtatgtctgctagcaacaagtgtctcagtttacccgtttattcctggaatgacagttcttttctttcagtgcttgaaaaatgtgccacttccttctggccttcatggtttctgatgagaaatcccttttcattcatattgttgttcccctatagataaggcatcatttttctcttgcagctttcaagattttttcattgtctttagttttcagaagtttgtatttctcggagtggatttctttgggctcatcctagttgatgttcttgaatctgtaggttttgtatctcttgccagatttaggaaattttcagccattatttcttcaaataaccttaacatcccagtctgtattctctccttccaggattctgatgacatgaatattacatcttttgttatagttctacaggtctctgaggctctgtgtgtatnnnnnnnnnnnnnnnnnnnnnnnnnnnnnnnnnnnnnnnnnnnnnnnnnnnnnnnnnnnnnnnnnnnnnnnnnnnnnnnnacatatatacacacagacacatatatatatatgtctatggtaatttttattccatcttccagtttgctaattctttccctttttttcctccattggctgctgaattcatctattgagtttatttctgttactatatttttcagttctaaaattcccatttggttcttctctgtatcttctgtttctttgctaagattttctgggcttttttccccatctgtttcaggcatgttcataattgttgaagcatttttatgatggctgcattataatccttgtcagataattctaacatttatgtcatttctgtattagtgtctattgattgtcttttcttattcgagttgagattttctttgttcttgagttgacaagtgattttcagttgaaacctgggcattttgggtattatgagactgtagatcttatttattttttactttttcttgagacagagtctcactctgttgcctaggctggagcccagtggcgccatcttgggtcactgcaacttctgcctcccaggttcaagtgattctcctgcctcaagcctcccgagtagctgggactacaggtgcacaccaccatgcccggctaattttttgtatttttagtagacaacggagtttcaccatgtcggccaggctggtctcaaactctgggcctcaagtgatttgcctgccttggcctcccaaagtgctgggattacaggtgtgagccattgcgcccgtcctatagatgttatttaaatcttttagtttagcaggcctcctctgatactgcacagggaaatggagtgtaccatcttgttattgccagaggtgggtgaaagtccaggtttcttcttacttggcctcattactgctgggtgggattggaagtttaggctctccactaggtctctgctgataacatcctgtctgggaaggataggaattccttgttccttctctctatgtgtccttctctgacaccatggtggtgcgacctcattactgctggtggtaatgcaaatctgattctctactgatccttctctgacaccaccccagtgaggtggggagggtgccttgttatagctggataaaggtgaagtctaggctatctgcttcaacctggctaagagggggatttgcatttcttttctgtgatgtttggctggcgtaggttggttattgtcttaaagttttctgtcttgctgggctgtccttttctggtcccttagctcttcttggggctttttatgcgtgcccactggcattaccaggttgttggcttctccttcacccagaacggggaacatgaggcagaaaattcagggatttcactactgtgtcatccttaagattctacagtctctggcttgcctgtcctttgtctacctttcagaaccttttttgtctgttttatatattatgtccagtgtgtttatctgtacttaccaggaggaattaattctttctcagttcttttaaaattattttaaataacagatacttatcatttttttgttttgtttataccatgatggtgctacttctgagatgacttcagaaagttcaaatatatcaactcttaaagcgcagctgattttttagactcttctaagatgttttaatctcttatttcactgagtcactttatagttttatcttgaaatattatgagcttccattactagatagtaaaatgtcatgaaaaccttcttattaattgcctagttggaaaagcttatggatttgagtatacgtggaacaaaaccaaaaacattgttgacctgtgcagttgcagcaatgtgtgtgacttacacagtttattcatgagagtggtatgatatacttagaatatgtgctaaattaccccttttttttcctcagctggagccgagatggtcataaactcgtgagtgcttccactgataacatagtgtcacagtgggatgttctttcaggcgactgtgaccagaggtttcgattcccttcacccatcttaaaagtccaatatcatccacgagatcagtatgtttaagctatttctctcctggggtggggtctaattctatatggattagctctgggctcatgataattttagtttatggttttagaaggcaaatacacatctcttcaaaccttctacataaaataatctttccgtctaggttggctctactgaatacatttctttctttctttctttcttttttttgagacagagtcctgctctgtcacccaggctggagtgcagtggcgccatcttggctcacacaacctctgcctcctgggttcaagattctcctgcctcagcctctcgagtagctgggactgcaggtgcgtgccaccatgcctggctaatttttgtatttttagcagagacagagtatccccatgttggccaggttggtctcgaactcctgacctcgtgatctgtccacctcagcctcccaaagtgctggaattacaggcatgagccactgcgcctggccctgaatgcgttttttttaatttaaattttaatttttttgagatggagtctcgctgcgacgctctagctggagtgcaatggcacagtctcagcttactgcaccctcctcctcctgttttcaagcgattctcttgcctcggcctcccaagtagctgggattacaggtgcaggcaccacatccggctaagtttttgtatttttagtagagatggggtttcaccatgttggccaggctggtctcgaactcctgacctcaagtgatctgcccgcctcagcctccccaaagtgctgggattacaggcgtgagccactgcacctggcctcttacttttttttaatgatcatgttttattttgtcaagactaattttactcagaattttccctgttattagacctgtggattttatgctttttcactgtttcaaatttgcttgggtgggagaattgatgagggtatggacagggatcagggaaaaggacagggaatcagcttgctgataccaaagcaacagccaatgtactgttcgtatttttaaacaggaacaaggttctcgtgtgtcccatgaaatctgctcctgtcatgttgaccctttcagattccaaacatgttgttctgccggtggacgatgactccgatttgaacgttgtggcatcttttgataggcgaggggaatatatttatacgggaaacgcaaaaggcaaggtaagcctaaaagctggcaaatcaggcatcttgtacactggctcatttaatgtttacttgttttgtttcttttgaaaattgtttttattcttggactaagcacagctcctttctgcagcaaatgtagtctaattttcttccatctcttaataataatttttgttctttggatttagagtgatagagattatttgacctagaaaagcatgggaggacctttactggatgctagtaatgaagggccattatgaaattataaaatttcaatgtcatgttatcagctggaacactgctgatcaaaatttctcaatatctggttttataaaagattgtataattcaggccagcttaacttacagtactgagacttattcttctttttccttcaaacttctgactttgccttttggaatgtgtaggcccttttctctggaatacattgtagaaggtgtttcttctgtggaataagaagtcaggttaggtgaccttttaaagattcttttcatgcttaggatagttccactgggcatcttgatttatttttatttttattttttgactgtggcacatgggttagtataatttcatggctattttagaaaggcaatttttcctttttttttttttttttttgagatggagtctcactctgttgcctaggctaaagggcagtgcatgatctcggctcactgcaacctccatctcctgggttcaagcgaatctcctgcctcagcctcttgagtagctggaattactcctgacctcaagtgatccgcccacctcagcctcctaaagtgccgtgattataggtgtgagccactgcacccggccttagaaaggcaatttttttttttttttttgagatggagtttcgctcttgttgttgcccaggctggagtgcaatggcaccatctcagttcaccgcaacctctccctcccgggttccagcgattctcctgcctcagcctcccgagtagctgggattacaggcattcatcaccacacctggctaattttgtatttttagtagagacggggtctctccatgttgatcaggctggtcttgaactcccaacctcaggtgatccacttgcttcagcctcctaaagtgctgggattataggtgtgaaccaccgcgcctggcctagaaagttgatttttaagaaattgtgataaaatacacacagcataaattttaccatttcagccatatttaactgtacagttcagtggtaattaatgtacattcactctattgtgcaatgatcaccatccatctttagaaatcttttcttcttgtaaaactggaattctgtacctattgaatcataatttcccattccctgctctccgccagcccctagaaacaccctttgaccttctctctttatgaatttgactactccaggtacctcatataaggggaatcatatagtatttgcccttttgtgactggcttatttcacttagtttcatgtcctcaagcttcacccatgtgtgtagcatgtgtcagaatctttctccttcttctcaaggctcaataatactccattttatgtttataccacttttgtttatatggcttatctgtggatacttgggttgcttctatattttggttattgtgaataatgctaaacatcatattttaagaatagattggccaggcgtggtggtgaatgcctgtaatcccagcactttgggaggccgaggtgggcggatcacctgaggttgggagtttgagaccagcctgaccaacatgaagaaaccctgtctctactaaaaatacaaaattagccaggcgtcgtggcgcatgcgtgtaatcccagctactcaggaggctgaggcaggagaattgcttgaacccaggaggcagaggttgcagtgagccgagattgcaccattgcactccagcctgggcaacaagagcgaaactccgtttcaaaaaaaaaaaaaaaaaaagactagattaagaccttgtcttacttaaggaagcaaaacagcaataccagttaatcaggtcaaatatatgggaatagagacatttgcatttttacccagtctttacgcagtattagaaacaagccaaatcaattattgttagttattggaacacttacttttttcccccctcctttaaactttagattttggtcctaaaaacagattctcaggatcttgttgcttccttcagagtgacaactggaacaagcaataccacagccattaagtcaattgagtttgcccggaaggggaggtgagtgagatcttaccttttaagggacagttttaagagtgaatagaatgcaaaaatacatggagatttgcagttttcatgtatattatacttaagcattttttaaaaatgtacttaaggtttttagaaacttacaatatctggttttcgagttcataacatttcctgccgtagttacatcttccttatctggaggttatcaggcggttactttacagaaaaataagtaagtggtcagtgcttaaaaccaaaatgcctggcatatagtaagcactgggtatatattaacttattatcatcaggactgatgtcatcaaattcacattgtaactgaatactgcctatttacccttttaattttggatgttattctggtaggtttggttacctagttagaagtcgtagaatatatcaacagaaataggaaatacgttgtcagtaagaggtaatagtcctcctattttgtttaggaacacccatacatgacttagagcaggggtccccaacccccaggccacagaccagtattggcctgttaggaaccctgccacacagctggaggtgagcattaccacctgagctctgcctcctgtcagatcagcagcagcattagattctcataggagcacggaccctattttgaactgcacatgtgagggatctaggttgtacactccttatgagaatctaatgcctgatgatctgaggtggaacagtatcatcctgaaaccataatcctcccaccagcctgggccgtggaaaaattgtcttccacaaaaccagtccctggtgccaaaaatgttggggacagctgacttagaggatattaatgttcaaaattctcttgaattaagaaaaggttatagtcagtgaagtctgcaagaaagtgatgaaataactaatatttcatacagatttctaagattttcaatgtcattacagtaaaaatgacattttaaaatgacatatttagtttattacctcatttaaaaaatatatattatgtgtaaaacaggccagagagatgaagtatttatatccatttcactgtaaacttgggaatttaggaagctggtttcagtagagaggtcttggaacttagttaatgctgacaatttgtatattttgggttcagggatacacaggaagtataaaacatattcccacttaaaattgtattttggtttgggagatgacaagtagatatataaatattctagtctattactttgatttttcctcaattcttccctagtttattagtcgttttgtagtactaaggaacagatttctgacctctggtgttgatatttttatccttcccgtagttgctttttaattaacacggcagatcgaataatcagagtttatgatggcagagaaatcttaacatgtggaagagatggagagcctgaacctatgcagaaattgcaggatttggtgaataggtatgtatcacaacctagaagaatatgtgatcattcatgacctgggcttgagttccagctctccttggtactttccttgtcctttaggaccccatggaagaaatgttgtttctctggggatggggaatacatcgtggcaggttctgcccggcagcatgccctgtacatctgggagaagagcattggcaacctggtgaagattctccatgggacgagaggagaactcctcttggatgtagctgtgagtacattaggacattgcttttgttagtcacataatccaaaaaatctaaaatctgttcttaacaacctgtttttctttccttcactaaaatttagtggcatcctgttcgacccatcatagcatccatttccagtggagtggtatctatctgggcacagaatcaagtagtaagtattctattttacttgcttcgaaactagttaccccttctttttatcaaagaaccttatacataggaagctaaaaattacatttttattttcttttgcatatgattctcgcaacctaaattacataggttcagtgcatctagttgcactttattttggtgggaaggtcttggtcccaagttggttttctggctcttttcagggagaaactctattgaactttctgttgcatttttctattatttatttgagataacatttttcttttgcttttcttactttcagctcagtttctgttttacatcttaattttactttgaacacctttaaattatgtttgtaatcagtgtacttacaagaaaatttaacattttacctctaaattcctaaaatgaccaaagaaggcagtgattcaaaagagctacagttaataacttagcttatcttaatgtttaagatagaaaatacctaagctagtaaaacttacagatacccatttttttcttgtctgccaaatttaatctaagaattgtgaattcctttcatgctcacatctttcattttatcattaatgtgtagattacagattattgctttcacatatggttaagtagtatatcttgttgtataggaaaactggagtgcatttgcaccagacttcaaagaattggatgaaaatgtagaatacgaagaaagggaatcagagtttgatattgaagatgaagataagagtgagcctgagcagacaggtactatttctaaattgcagacaggatttcctaaagggaaaatgattgctttacttaatattcttcatttgtgttgtaaatttatttcagcacttcatctaaaatgcccccctccaccccacacttttttttttttttttttttgagatggaatttcgctcttgtcacccaggctggatgcaatgatgtgattttggctcactgcaacctctgccccctgggttcaagtgattctcctgcctcagcctcccgagtagctgggattacaggtgcctgccaccactcccagcgaattttttgtatttttagtagagatggggtttccccatgttggccaggctggtctggaactcctgacctcaggtgatccacccactttggcctcccaaagtgctgccattacagacatgagccactgtgcctggcctatgaaccactgtgcctggccttcttttttctttaagcttacacaatttccacagtatttggagagccttaatttataaggtgtttactaagggcttatatgggtattaccagggctcaagcagctctcttaacatatcattgtgtatttcctgattaattgcagatgactaagtgaggacatacatgcagcacctagcaaagaactcaccatgctaagagtgctcagcttttcccatgtattctgtcactcctttgtcagtaagagaagggtcaagaacctgggctctgaagtcagactgccttgggcaaaatactgcttaaactgaatttcctcatctgtaaaatagggacagtaatagtacctgctttttagggttgtggggagtaagtgaaataattcatgtaaagcatttaatatatgcctaggccataataagcactaagatattaatttccattatgattatgactgtgattttatctcttctgaatttctagataggagctccttgagaataaagatttgactttttaatccccgtggtgtctaacacagggctttataacatagtaaggtttgtgcgggtgaatgcttaggatgcccagttggcactgtcagtgagtaattaatgccacagattattgacccccgagatacttgatggtgccaggaatcaggattgggaatgaggttgattctgtttagtgtcaaagtgctggtcctcacttttgtgatattagataacttgcatgcctaatgtgttttaggaggacctccagggaagtagaatgttctagattatagggttatgttctgtcaaaccttcccagatttccacataaattgttcctccttcccatatcctgagcaagttacacataccattactgtattaaattgaaactgtctctctgtctccccagttagactataaaccttttactgaagagctgttcccaactttttctgggtcattgcactattttcagtgcctaggatagggtggaaattcagcacatatttgttaaatgattaagtgaagtgaactgtttggttttcctcctttgtttctctggaatttcaacttatgaaaaccttgaagctgcaaataaaaagcagtttttcacttcttctcaaacatctcctgtgtttctgtcctgcaggggctgatgctgcagaagatgaggaagtggatgtcaccagcgtggaccctattgctgccttctgtagcaggtgagccggcccggaaggctgggcaccttggctactgctgctcctggcctctgggggagtactctgcagtttccctggctatcccttcattcccgtctgcttattagctaaaagagataactcgtttggtgtacaagaaatccaatgtagcctttcttctctagtcctatgttcctttcacttctccctgatagagaattttaaggaaccaaaataattcatttatcctgtttatttttatcaccaattttatcaattacattgtttgattcccttttattcttcttggctttcttaaagttctagatccatacctgttgcttatgcttaatataggtgatagaggaagggctcatggtttaagcaactatctcctcttttttccaatcccttgtctgatcctgctccaaatagtgatgaagagctggaagattcaaaggctctattgtatttacccattgcccctgaggtagaagacccagaagaaaatccttacggccccccaccggatgcagtccaaacctccttgatggatgaaggggctagttcagagaagaagaggcagtcctcagcagatgggtcccagccacctaagaagaaacccaaaacaaccaatatagaacttcaaggagtaccaaatgatggtaagagctacatcttctccctctggcctggcagacgccactttctactcactccccagcgcaacctggtaatttcctgtttgagcgatttcaccttagaggaattttcccatgagtctgttttatagtgttttacaactttataatgattgcgtctgtgttcacttctctcttaaaatggagaaattctgcccttcagtactttgcctaagatgctgcactttaattcttctgacagccggctcagagtttattataccattcttcttttaaatgtttccccgtagagtggttttattagatgtaaaatactagttagacttggacaatcatttcatccttcctgccaccttttagagtctgacttgggaagcctttattatcatgtcttgggataagtagggatggatgggggtgtgtgtttaccattgagcatccttcttcctcttctcttttatttttatttattttattttattttatttttttgagacagggtctcgctctgttgcccaggctgcagtgcagtggcatgatcttggttcactgcaacctccgcctcccgggttcaatcaattctcctgcctcagcctcccgagtagctgggactacaggcatgcaccaccacgcctggctaattttcatatttttagtagaggtggggttttgccgtgttggccaggctggtctcgaactccagacctcaagtgatccgcctgcctcggcctccctaagtgctgggattacaggcgtgaaccactgcgcccggcccttcctcttctcttttagctaactgcagatcacattttgcaactacttattttcctgatgctatcgatttctgtgtctactctgtttcagacactgtttggtatatgtaccattgctgacttttacatcaaccctgcaagttgttttacctgctttttaaaggagaaaatttaggctgaggttatgtgtaagaggttctgtaaacttgcctaaagtctcacagaagtggtggggtcaggattctcattctagtctctctagttccaaagtccattctctttctgctctcacatgcctctctgtgtatgtgtgtgtgcatctgtgtgtgttccttcttctggcttggtttgatagtattagtgcatctttcagctacttgttcagtttagagttactgtggcttggcatgaacatataagccaggggtgtccaatctttgacttccctgggccacattggaagaataattgtcttgggccacatataaaatacactaacagtaatgatagctgatgagatttttaaaaattgcaaaaaaactcataatgttttaagaaaatttatgaatttgtgttgggccacattcaaagctgtcctgggccgcatgtagcctgtgggccacagattggacaagcttaatataagccatgtgtgccttttggccaaggaactatctctcatttaatgaccactgttttatacttatagaaataagacaaacttttctctttataattattaattgatctgggacacaaagcaacattctttgctcaacaaagttgtggttggggtgatgagactggtgtcatgtggattcctttccatgcctgtctgtcctacagaagtccatccactactgggtgtgaagggggatggcaaatccaagaagaagcaagcaggccggcctaaaggatcaaaaggtaaagagaaagattctccatttaaaccgaaactctacaaaggggacagaggtttacctctggaaggatcagcgaagggtaaagtgcaggcggaactcagccagcccttgacaggtaaggacacattgggagcattgtctggcttgcttcgtggccttgctttgtgtagcccttgacttcatttaactgcaacattttttccccctctcttccctcgtttttcccagcagcagataatttctgaattttaagctgctgctaagggcaggctaaaccagatttggcttaattcagtggctcttaaccttgggtctgtaaatagttttcaataaatctacattcccctgatgttatatgcaaaatattatgtgaatatttttctggggaagatgtccatagctttcctcagattcctgtaggaattcatgacccaaagaagggtaagaacctctggtttaattcatttcttcatccatatttgctcttaggttttttgtttgttttgtctcaaagagccagacaagtagccagaagtacaagcttgttttatatagtccttgactggttcactgtggcatcttttctctccctcttcaaattgttcaaatcccacaggtagtgctttctctctcttagtattccagaagcaataatgaaattgttagtaccatcgtgttaaggaagaagatggggtttgttttggtttttgatttttttccaatatctgaaaacaggaggagatgatcaaaaagacagaaactacagtatctgtgtagtttcttaacacctaagccttttgatacataatatttgagttttctcacttttatattactgagggatttttattgggggacagaaaacaatttctgtttcttaccaaatacttgtgagcctaggctaattggtctcttgtttagaaaatgttaatcaaattagaatccatttctgtgtaaacattgggctttggaaattgtttttttgctttatatagaagcactgctttagttaatacagtattctcaatttttttgtggctagtttggtagactcaaaggtaggattgataacgtatcaatggttgtattcaggctcccccgactttaaaattttaatctaaatgtgtggactagagtgcaaaacagaattctttgtttaatttataacttacatcatttaatcattgtctgtaaacatgaattctcttacagagaagctgaaatagacagttattcatcattttgagtattccatctcgagtttactagatttagactttagtttttgatagcccaacaccataccactgagtaccaatatttttttcccgacaacatttatggtggtgcactgatggttaccacgtccacattcaacccacctaaggctgtgtttgtgtatatatacatataatgctgtgtgtgtgtgtgtgtgtgtgtgtgtgtgtgtgtgtatatatatatatatatatatatatatatatatacatatatatatatatatatattttttttttttttttttttttgaaacggagtttcactcttgtccccaggctgaattgcagtggtgcgatctcagctcactgcaacctctgcctcctggttcaagtgattctcttgcctagcttcctgagtagctgggattacaggcgtgcaccaccatgcttggctaattttgtgtttttttagtagagacggggtttcactatgttggtcaggctgatcttgaactcctgacctcaagtgatccatccacctcagcttcccagagtactgggattacaggtgtgagctatcacgcccggcatgtttgtatatattgtaaagtagcctggagcagtcgtgggcattgccaacaaagattgcagaatgactagatgtaaataagagcaatccttccaaacccacttcttgcacacactgatgccactacagaagaaacgcaatttaaagtttaaatagatttccctggcctggagagctaaaatattttaagggtgatttaaaatgtggccaaacataattaattaaaacactttaggacataatctcctagcttcttaaaacgtgtctatccctaatcatgtgcttttcaaaaggaaattatggtaaataaggctcacgcctgtaattctagcactttgggaggttgaggcagaaggatttcttgagcccaggagttcaagaccagcctgggcaacatggtgagaccccatctatgtaaaagccaatcaaacaaacaagaaaaaaccttgagctgggtgcagtggctcatgcctataatcccagcactttgagaggccaagacaggaggattgcttgagcccaggagtttgagaccagcctgggaaacaaaataatcaaaaaattagccaggcgtggtggtgcacatctgtggtccacctggtaacataggaagctgaggcaggaggatcgcttgagcccaggagtttgatattgcagtgagctatgatcacgccgttgcactccagcctgggcaacagagtgagaccctgtctcaaacaaaaataaaaccagccaggtgcaatggctcacacctgtaatcccagcacttggggaggctgaggcggtcagattgcttgagcccaggaattcgagacaagcctgggcaacatagtgagaccctgtctctacaaaagaaaaaaataattaaaaaacaacccaaaaacctcaaaggggcattgaggtatagttccaagacttccacagaaggattacatctggctttattgaccagctgcagagtggtttggatctttgtgaaggttgaaaattttggggagagtgatgaaattggatatcacagataattccatcaaaagtctgttttagggcaacctatcatgtttttatatgggattgtttgggtgagggtagggctttatccagtaacgtggtcgtcttggagggctctgagcaagctaagtcagactggtacctgctgctgatttgcatatggcccatcaagaccactcagggaaactctggcatttggatctcatattcttccacaccttggagattttcagtaaaagccaatatatagttattgtagattttccaccaggtattaagaaaggaaacctgatgcaaaacttctgaggccaaaccatcttcaaaaatcactccggtctgagggttgtatgtgtagattcaaggttttggccccctgccccatggacaacttcagcatttgagtcaaatcatttgaaggtaggattatagttgtaggctgtgttactacccaagttagatgaatgacaactgtttgttaatatctgtagttgaccagttactgtagaaactgttccataaactgattagccctaacaaaactaccatagtctgttgtctgttgcaacaggagagtatgcatttcaagggaaaattggcagagagaccactatagagataatctggccatctggaatctggggctatagaaaattgtttcctgtcaaacagcttgtcagtgttggctagcactagagggcccacattcatgtggacatttttctatgtgaatgaggacccaaagtgaagcttggtgagggtaaccctgagcttgggacttttgggaaggaccaggctaacatagtctgcgctatctatcaaatgcttcttagttactttaaatactctccagaggacagtcctgagaccagaaacttgagatgtgagcagaatcaccagtcctagttgtctgtgattgctcaaggattgcccaagagctagggctccttggcagtaaaaacatcagtaataaagtgggacaaaggtgtggtcggttacatacacgttctaaaggcctcatgggatggtagacatgaaggggttggtgcacacctgggtctgttggagatggcaagggccaaagtgagcagaagcgacatttctgggagtggacaggcaccatgcagatttccctgtcttgggctgcgctacaccactgccctggtgccagcccatcaccctaaggctctgaaccacctccaagtcacttactgaatctgtgatttttttttttttaatgcttggtagttttgttttctttttttctctctttgtttttctctcccctccctccctcctttccttcttttccttcctttccttgtgaagactaatttatgaattcctgctagaatcaaggtagtctttctcactctgtgggatgttattaactaactaaggtagggtttgaaatcatgattcagtgttctcttaggccaacctagattgggctgctactggaaagtaccaataatagctggtcattttgagctgaattttcctacctgttacattactggagatttcctttatgttgtagctaaataatatgtttccttgggggcagttgctgcgtcaggtctttaaattggctggagtcttctatattgctagttctgtgtatcttatcttgctcatagtactgcttgctctggttttgatttgttgcctgatgcctcaacaagcttttgttttgtttgacttttatttatttattttgtctattcagaaaaacaaggacggtatagaaacatgagctgccctccagtataaggtagctcattagtcatcttgagtgcctattactaatgctgttgattagtgatcaagccactttctcctattatgatttaggtttaaaatggcaatgttgtattcatttttagatgattaccactaaattggtcagggtacctgtgggaatagttggtgaaaattgccttaaagtggtaaggcatgatattgagtcttgtggagtggatttttctatcacaggaagttttttaaaaatcaatgcagctgggcacagtggctcacgcttgtaatcccagcactttgggagtccgaggcgggtggatcactcgaggacaggagttcaagcccagtctggccaacatggtgaaaccccgtctctattaaaaatacaaaacaattagccaggcatggtggtgggcgcctataatcccagctacttaggaggttgaggcaggagaatcgtttgaacccaggaggcggaggttgcagtgagctgagatcacgccattgcaatccagcctgggcaacaagagtgaaactctgtctaaaaaaataaaaataaataaaataaataaaaaatcaatgcaaggaattcattgtgatttatgttgagagagatctgaaaaaccattgctaagtaagcttttaatctgactgaactatggaaaagtttaaatttgatttttaacagcataacattcagtagaaagtttgtatctcattgtaactttagtctgttctcaggcacatgtgaatatatttttattgccagttttcatttgtgcaggaacttcaaaaatcaaagttatataaatgggtacttttctttcatagtttgggcgattattttttaaccattataccttcaagtggcatgctctctgccattccaaatgacacctgggaggattttcttcaccttcttctctttttacacttcctagttaatatttcacagcagctcatttaacgatgtctctcagaggttgagcagcttctatggaataatcagggaagtgttcatttcattgtactattcaggatattatttatcgatcattgttggtgtatagcaatgtagacagtagctctcacgaacatttcaccatatttgggattctaaggtgataagtatgtcacttaaggaactgtggtgctgggaaaagggtttcttgctcacttgttaatcatttagtgactaatcaatctttaaaatatatgaagggttgaaaggtgtggtaccctaaaatttcttctcctctcctcattgcactttttggaatgttaaacattatttgttagcaccttagagcatggttagcagcttagaaaaaatagaactctgatcattttgcttttcccccaaccctttgggacagtactgaggaaagtattggggtggggggtttggatttggattgttttttgttcaataaagagtaattgggagttggagttggttatgtattttcttaaaaaggggaatttcttggtccacgtgtgcttgtaatgcatcatccagcattcagtatttctgttcttacaagtaactggtctaaattgaagctaaaagaaatctttttgtgtctaatctctttagcaggaggagcaatctcagaactgttatgaagaccttcgaagttcttcattctttctcactttgccatcatgtggcctctggacactgtggtcagtcatttgaaaattgactttaatttaaaacaaaggcctgtgcctcccacccaggaggtgggagggtgaattttatgtttaaatgaagaagtgaattatggaagaagagtatacgaccttcccttccctttcaagcataagtccaaatagactctcaggaatgaagatttgtgaagacatcagataggaattttgactcatttaaactttgatgcttagttatgttgctggagaaaagatacttatgttttgctcatctaacttcattgtacccagcgtcattttgacatgtcatttcctatctcccatttgccttcggtcctcaatgcatgtctttgagtgacttcttatctgaaattttgctactggtatcctaggaaagcttttgttggatactctcattttaaacttctcctctccccagatacctcctatatttccatattgtgtgcaaaggatgggcagaaaagaaagtgcttgaaagatttcaaattttcagaaagggaacaacgaaggccctctcttcctctcataccacgttttgctcaagaagctgggctgtaacaattcagggttttcccttgttttcctctcattgcatgtttccctccaatattggttcattgtcatcaatcatggtttttgaagatagctagttttatccatctccagcaaagaatcatcaatagtttatattgctttacctgtgctggcttccagagatggaaacaaacccaggtgtctctcaacaagctacttttttactggggtgggggaatctatgcaaggagtaaagtaaaaccatccagaatcaaagcagcaaccacatagttcaaatcaaagatcaaggtgaattttttgtatcactgcctgtggaaatctatcctcatcagtcattgcatttttccctgcctatacctgtgctcctttttcttactgtgttttcagtcacttcctttctgtgaaaggttgcttagctttttttttgacatttgttgttctttatataaaaataacagattggatagatgtgtacatttggtgtttgaaattctctgaaaatcccattaggaaaccaggtgtgaaaagggctcagtagcttctctgagtggcgtttttagctgactggaagtgcttaatctggatcgtcttttttttttttttttttttttcaatattttaaaaggagaatttaaatactgtgcttactgtgaaatatatcagttggtgagccgggcgtggtgggtcacgcctgtaatcccagcactttgggaggccaaggcgggttgatcacccgaggtcaggagttcaagaccagcctggccaacgtggtgaaagcctgtatctattaaaagacaaaaattagctgggcgtggtggtacatgcctgtaatcccagctacactggaggctgagtcaggagaatcacttgaacgtgggaggcagaggttgcagtgagtggagatcgcaccactgccctccagcctaggtgacagaatgagactctatctcaaaaaaaaaaaaaaaaatgatatcagttggtggatgctcctacaggtagccaaacacattgattacctgttagattttaggatagaaatcaaagtagagcacgtcagcaagagcctctttgtctcactccatcatttaaaaccagtatattcagtagttgaagaaagagctctccctgagtcagttgcaaaacgtctatatttttagatgccactacttttttcttaaatattcattttgagactgtcatgagttagaccagtggttgagattagtagatggctcactagacatgtttttgttttgcagacattatatccattccagtcctctgcactgtacactgcagcagtgtgcaaactatgggacttagagggtttctgccatctttccatgtgtgaagtagcttggtttcctctgcctgtgcatttggatgtttgtgctatgtccacctcctaaactggctactgagaaaatcatcttcagccctgtcagattgtctctggcagtagctcctaataattatttatgtttttggaatttttttttcaacttttaaaaaaccttctatccatttcaatttgaattatttgatttgtacaatatatgtatattctcttcttcctttttgtcatccctgccctgccacccccaaaattttgtttttaaaaatattctgggctgggcatggtggctcacacctgtaatcccagcacttggggaggccgaggctggtggatcatctgaggtcaggtgtttgagaccagcctggtcaacatggtgaaaccccgtctctactaaaaatacaaaaattagctgggcgtggtggcgggcacctgtaatcctagctactcgggaggctgaggcaggagaattgcttgaatccaggaggcagaggttgcagtgagctgagattgcgccactgcactccagcctgggtgacagagcaagactccatctcaaaaaaaaaaaaaaaaaaatctgtagttttgtacaagatgagacttagccttgggtacttcttgctgaagctttaatgctttgtaaataaaatcggatgtttattaaagaacaggtgtagatgtttatttgtaaacactgctcacttctggaactctctggccactttgctttagtacaaaggaaagtgtgatttcctgtgttgatactagatctttcggtgtggaaagatagatctggaaggggtagggagtggacaggtagtctagatttctgcctctagatgagattgtaaataaatgatgcaagtggaaaagttgttgatcaaaaagatcatctaggaatgatctgtcttccaattatttaactcaatatagttttgcaattactctgaagaggccgtagggctaggcattctggaggttacaaaaatgcatgctaggaagttcctgtcttccaaggacctttcttcaagtctaagtaagtacggttgaattcttattagcctttttttttttttttgaatgaagcagctttaaaatttattaaatgctcgttgtctcctaaagataagatgtttcacaaagtctatgtaagtctttgattttaatgtcaaatttgagggtctacttattaatcttatgtgattgagaactccatctttgacatcatagctgtttcatagcaaccttgacctacgtgaataatgagctctattctgtaggataaagggagtaggccaagagtcagggagcatcatgcatcctctcactc

SEQ ID NO: 17258 - DNA, 71651 bp, Human
  misc_feature (1)...(71651): n = A,T,C or G
gtcttggtgtgactttctttttagctatgtgagcacagacaatttgtggacctaagatttagtttgtatatttgtaaaatggaggtgggggagtagccatggctcacaggattaataatgaaatgctgcttaccaagaactaaacagaatcatgtgtgcaaaagtaccctgaaaactacagagtactttacaaatgattattcttactgggtttagcctcccacataagggagggagatctgtgagggatggggatagggtgggatctgagggccacatggagtagggaatgttttgggaccttttctttcttgctaaggaaagagtagtgtgacaataccaaggtaactgctgtattccttgggtatttttctttaaatagtgttggcaggatgggaactgggagagaaggaaaggatgcctcatgatatttgtaggaattgaggagggataaacaccttccaaaggctggctactgcctatagagaggataatgctgagctggcaagtaatgtaatcactaacactcactgatgtcagccagctagtaaatgatagaggtgggatttgaagcaagcagtctcactccttaccctgtgttcatagcctcagtgctactcagagagatattgggtcttgggagaacagaaagggacagcaaaattgtggagttcattctttttgtttgttcttgagacagggtctctccctgttgcctaggctggagtgcagtgggctcaagtgatccttcgacctcagtccccaccctgagtagcttggactataggcatgcaccactacatgtggctaattttttaagtttttgtagagatggggtctcagtatgttgcccaggctggtctcaaactcctggcctcaaaggaacctcctgccttggcctcccaaagggttaggattataggcatgagccactatgtccagcctcagaattcattttttttttttgagacagagtctcaccctgtcacccagactggagtgcagtggtgtcatctcagctccctgcaacctccgtctcccaggttcaagggattcttgtgcttcagcctcccgagtagctgggattataggcgtgtgccaccatgcctggctaattttttgtatttttagtagagacagggtttcaccatgttggccaggctggtctcgaactcctgacctcaggtgatccacctgcctcagcctcccaaagggccaggattacaggtgtgagtcaccatgtccagcctcagaattcattcttaatggattccttgaatgcccatgagacgtcaccagcctgggacatctcatgggcatgtaggcataataaatttttctgggcctcatctgcttttctatgcatttttatttctatgtctaccttccaaggaaggaagagatgtgggataatctgatcaagtcatattgctgccttctgagcaacactaatagaaggtttgggacttggaggatcctggggaaattaaggcagatttcttgttttggtattttcatatctgctttattttgcatctgttttataaaatgaaacttgagggactattcttgccttttttttttttctttttctgttgagacaggatttcactatgttgcctagactgatctcgaacttctggtctcaagtgatcctcccacctcggcctcccaaagtgttgggattacgggcatgagccacctctcccagcttgttcttgcattttgtaagatcacatagagtatcaaaactggaaaggacctgggccatcacttccctgagaaaaagtgactttctcaaggtcatgcagttagtagcaatgctggaactgaacgcctaccccgcagatcacaacatgacccgtgaaaggacctatcctgcaacactttggagtttcgtgccgacccaattagtggctttgtctttgggaaatttacttccccaaaacactgggacattgggatggaattcactcaccccaaatcatcaccctggttaaggagactaaagaatcagaagacatttgtgctttggggagcagaggccctcagggtatagagaaggaagaagagagaggttcactgtagtcctgaagcagaaataagacctgtggctgaaggaagccttagcaattcactccttcctcttcctgagaactctctgtaggaagtctcacctagcagaggcttcacagtatttcagagaagccaaagattgtttgcctctttggaaactgttatccttccatcatgactgtgtcactcctgccactgttccaccatagaggtgggtgcctaatattagagagttgtttcacacacgtggctcattcctcaagcctcgctaagccaagcccaccaggaagaagcttgagtggaagcattctctccagccacatctttctctctttctctcatactagatggcgtcctttgcagcaaaccgtaagttataaggatgagggaagaagagtagagggccaaaaggattccattttgaggaaaaactacagtttgccttgccaggtagaagaatcaggtatgagttctttttgtctcaggtaataaactaagcaaagcccagatagtagtaatgatggagcccttcaactattgacgtctccctaagagccctcattttctgaaagcagagtgtttgtcccattcctgactcgccatgctgtgtgtctcccagagagtgaaagaaattgctgtgactgcgagcaccagtagagtggatttaattctcaccaagaaaagggaggtggtttgcaaatgggttgttttgggatcctgggagaggaacattgtagccagagatattagattttcactctagactttaaggaggcagatttttttttttttttaaattaaaagataggggccaggaatagtggcttatgctgtaatctcagcacttgggagactgacatgggatgatcacttgagccaaggagtttgagaccagcctgggcaacatagcaagaccttgtctctactaaaaataaaaataaaaacaattagggtgtgatggcgcacacttgtggtctcagctactcaggaggctgaagtgggaggatcttttgagcccaggagtttgaggctgcagtgagctataattgcaccactctgattgcatccaggtttcactgtagcctgggtgacagagtgagaccctgtctctgaaaataataataataataaagagcttgtacaattaacttgagaggagccaaaatttgagtctaggtcaggaaacctctagaacctgtgttccttctgtgctatgctgaaggggactgtgagaaaaaaaatgttcatgaggctcgagtcctgaatgagatggagcttccccaagagccagtaatgacacaagtggttcttaaagtcatttctggaagacaataggatcacaagggtttaagtctatcagatcatgttaaaaaggaactcattcatttattcattaatttgactaacatcttgattgtttactagtgactttaggtacttttaagtcattgagtgggggaaatatgggttgccttgtgaactcatcagtggggcctttttgatggtcagacttcttggaggaaattaagtgtttgcagagatctgaacaatgagtaggaattggggcaggatggggaatggagtgtggtgaatgaggtgaactgaaagcagtttaatctcaccagagccactgaaggagtttgcattttatcttttgggcattcattccaccattgtacattgaatgtgcactgacactcttctacgtgcacagcagtgaagaggacaggtaaaacccttgcctagtgcttggtgttctgagaaaacttagttcactcatagttcttagtccactaagagtagttcactaagaattaaaccaagctttttaatgttactgacaggaattctatactgatagatagggaattacttggagagattctctagttgaatgcaaggaaagtttgagaaggactctcatgataatcctatagattatacagggtagagacaaaaggtgggttaatgattggttgattgttcattcagcaaaaacatcttcagtgcctcttctcattcattcttacatttattcactcatttatcaaatgactggcagtgcaagtttggcagatggttaagagcacggctttggagccagattacttgggttcaaagcctggctccaccacttacaagctgtatgaccttggaaaagttatttaacttatctgtgcatcactttcctcatacgtaagatgagggaaataataataccagacaaaatttgttgtaaaatgaaatgagttaattaatgaactacttagagcagtgcctgatgcatgtaaatggtgactcaacagctcatggttcttgtaattattattcctcaatagcaggtttgtgctaaattctaggaatacaaccttgaattgagtgtggtccctgaccttgagggaaccacattgcacccccctcccacccaaaatgcaggtaaatggatgagtttcttcatggagtggggtaatcctataagctcaatatgaatcgattgtgataaggtgccccaagagttatatatatacagtcttaggcagcatttcccagcgtcttaatatatagtcttaggcagcatttcctagagattatagaaactagaactgtggtgtttattattttggagatctctaaacttaagaatctgataaatgctgtggggtgtctacttggaaaaatacattacaattttgccttcaaacagcctccaaacctctgatcctatgatgaggagctgttaactcttctcctctgggttggtcagaccacgctgagaacacagtattaacagttctgtactggagcatgtacttcgtgtaaaacattgtgctaagtatcctgggggagacaaagataaatacgaggtaatccatgcggtttaaaggcttagtggaaaagaatgttttgtatgtaatgagatgtttgtagatacatgttgaaatgataaaagtaagaatgttcatcttgagcaatggaacgagatttatctatacaaaaatttaaaaattagccagacatggtggtgtgcacctgtagtcctagctacttgagaggctgaggtgggaggatcacttgacctggggagtttgaggttacagtaagctatgattgcaccactgcactctagcctgggcaacagagtgaaaccctgtctctttaaaaaacaaacatagaggctgggcgcagtggctcacgcctgtaccagcactttgggaggctgagaagggtgaatcacctgaggtcaggagttcaagaccagcctggctaacataatgaaaccctgtctctactgaaaatacaaagattaactgggcctggtggcatgtgcctgtaatcccagctactctggaggctgaggcaggataattgcttgaatccaggaggtggagattgcagtgagcggagattgtgccactgaactccagcctgggcagcagagcgagactccatctcaaaaacaaacaaaaaaccaaacaaaaaatgaaggatgttacttaaaagttgtgttggtaactgtgttaataaataaataagaggtaatctttttttgagatggaatctccctcagtcgtccaggctggagtgcaatggcgcaatctcgggtcattgcaacctctgtcctccaggatcaggcgattctcccacctctgcctcccaagtagctgggattacaggcacctgccttcatgcccggctactttttgtatttttgtagagatgaggtttcaccatgttggccaggccagtcttgaactccctacctcaggtgatccatctgcctcagcctcccaaaatgctggaattacaggcatgagccaccgtgcccagccatctttattcgttttttttttgttgtgttttgttttcttttttttttttttttttggagactgagtctcactctgtcacccaggctggagtgcagtggcactatcccagctcactgcaacctccacctcccgggttcaagtgattctcctgcctcagcctcctgagtagctgggattactggcgcgcatcaccatgcccagctaactttatatatttagtagagacagggtttcaccatgttagccaggctgatctggaattcccgacctctggtgatccgcccgcctcgacctcccaaagtgctgggattacaggcgtgagccaccatggccagcattattcttaagattagtgggctaatgtctataaaagtgctttgtagctataaatacctatacaaataaaagctattatttttattctagtcactagtagggataatccaaagcagaatgcacataaatgcagtagagcacattacaaattataaaaatattcaaaagagcaaagtcacttttattcatggggggatgggcacgcactgctcttatattacagccatcgcacatcccccatgaataaaagggtgcagtggctcacggctgtaatcctagcactttgggaggccggggcaggcagatcgcttgagtttgcaatcagcctaggcaacgtggtgaaaccccatctctaccaaaaagacaaaaaattagccagttgtggtggcgaccacgtctgtagtcccagcttctcaggaggctaggatgggagaagatcgcttgggcctgggaggtggaagttgcagtgagccaagatcctgccactgcactgcagtctgggcgacagagcaagaccctgtctcaaaaaaaaaaaaaaaggaagaatgacatgatcagagctgccctgtaggaagattatcctggcagtggagagcagatactttagggggtcagcaaggagacagactagttagtggtctgtttcaatcattcatcattcaggtgagaaaaaggaataataatttttttggtgcccaataaaataatttttcaggtaaaagaataatcattcaggtagaagaaaggaataacaaattttttggtgcccaatatatgctttatataggttatttcacttaaagtcatcagaggtttggaaaggaatggaccaatttaagagagattagaacaggaaggctgggggatttcctttcctgaaggattctaagaacgggagagatagctgggtgcagtggcttacccctgtaattccagccacttgtgaaaccggggtgggaggattgcttgagactgggaggtcaaggctgcagtgatccgtgatcacaccacttcactccaacctggatggcagagtgagaccttgtctcttaaaattaaaaaaaaaaaaaaaaagactggaagactggttatagctcagcctgggaagagcactggagagggagtctaaggacctggactcccacttctggtctcacctctatcactgaccagctatatgacttcacacagtgccccttgctcattggttctcttgtctaccaaactgtggggtgtgtttgtttgctttgcttgtttgtttatttttatgtttatttttttgagtggcctgggagagtgaaatgttctgggatgggggtgtggagagcatggaggtgttctagaataatcaccaacatcagcttaaacacttttttttttttgagacggagtctcgctttgtcgcccaggctggagtgcagtggcacgatcttggcttactgcaacttccacctcccaggttcaagcgattctcctgcctcagcctcccaaatagctgggaccacagacatgcgccaccatgcccagctaatttttagtatttttagtagagacgggctttcactatgttggccaggatggtctcgatctcatgacctcgtgatccgcccaccttggcctcccaaagtgctggaattgagtgagccaccgcgcccggccatcagcttaaacacttaatcaaatgtgatgtgcctgggtttccacaacaggatgggaaaaagaccatgaagtttgggctcacacacatttcagtttaactcttgattttatcatttacaagttgtgtgacctttgggccaattattgcatccctttcctgttttctactttcctcttccataaaagaaggatgataacatccacatttaaggattgttgtgaggactaaataagacaatacctggcacaaaataccagaggggggaaaaaaaggtatatttccttccttctatttctgtgatgctcatatgcatgtagtcttccctcctgtctccccacttctctgccttccttctctttccctttcaccagcacaaagtgtaacaccctcactcccgttgctacagtgggctgtactagtttcacagaccttgaaatggcacatacacgggaaaggtgtttcgacacagttcctatggactgttggtgccggatgcttacacggtcacaccctggtcgctcatccagcttaagcagtcagtgaatccctgctgagaatgacctctgactgttgctaccctgggagacactgggcgagggtcacatgggcaaggggctggtggaatgtgagcatgctatactgtgccagtggttcaccctttgcttagtgtagacttaggttctgtcttaaggacatctgtctctcttgggaccttcctgtgcaaactggggggataagagatcggagaaaggcatcagggcatgtacaaagcaacatcaaaactaattgacatgattctttgctctatacccctccccctcgctaaagtcactttcttttttcaaaatcttcatgacccataaccattccatgcacagagatgcaaaaatggtcagttaatatccaaagcaaaagcgttgctcttgttccccaggcgacagggccaccatttttatcagtgtgaaacacagagtatcagggtattaaggagacactgagaataaaagtgaggagatattggaaggcttaaccagggaaggcttctgaagatcgttttttttttttgagacagggttctctgtcacccaggctggagtgcagtgtctcaatcatggctcagttgagcctcctatttcagcctcccaagtagctgggactacaggtacatgccaccacacccagctaatttttgtgttttttgtaaagatggagtctatgtttcccaggctggcctcaaacttctgggctcaagcgatcgtcctgctttggcctcccaaaatgctgggattgcagttgtgagccactgtgcctggcctttctgaggatcttgaattcggatggaagcaggagagagagaaagcaggaggaagagaaaggcacccccagtggtagccatggctttggggccctaagagtcaggtgcaaatggaaatagggatggggagtccataccacgctgtacgtgcaggtgagcagggctaaggggaaactgaaacctacggctgcaacatgtctaggggtgaccaggctgacatgggcagtccttctgggatcccctgtggtctggcaccatcaggaccactgccttcttcccattccccccatcgagatattcttcctgtggtttgaggattctgggacaccacaggcatcttggagaatatcttgtttctcagttcttttttttttttgagacagagtgcagtgcagtggcgcgatctcggctcactgcagcctctgcttcctgggttcaagagattcttctgcctcagcctcccaagtagctggtgttacaggcacccaccaccacaccagctaatttttgtatttttggtggagacggggtttcaccatgttgcccaggctggtctcgaactcctgacctcagtctgcccacctcggcctcccaaagtgctgggattacaggcatgagccactgcacccagccttcagttctctcttaaggcgttgcatcctgagtagggtttctcctttgacctggctaaagtagaatccttggtcttccggctgggttcagtgtccttgactgaccctggagcaggatatccttctggcctgctaccagggagaatggaggctcccagcttgggaactgcatggctgtaggcagaggaccgtggccacctggatcaacctgggctaagaatagccaaggccagggtttggaggggtcagtgccttaaaggggcaggctgcccagtgggcagcattgtggggactgtactctagaggggcaagaggttcctacactcaggagcagagaccagggggaggccatggagctatggggcctaacattagagagcaccccccccccccgtcttttcatggctcattcctccctgggaaaatagaagtcttaccatttccagggcctgttgggttgggtgctcccctccttagattctgctttttaatgcaaatggccctgggagggactaacaccttgacctctcacacccctgtgtaaatgagtatcagatgtttaggggtgtttcatttttctgtttttctctggattgaaagactggaactgcttgaaaaccggtgtccctttcctttcctaccctggtctgtggggaccccacggcttctttacaccttcctgatttagggaatgaccggccaccctggggggcctgccagaaggcctgggggcatttgggagagggctcttgtgaagctcttctgcctgaggctccttctgtggcattctctttgcctgagtgccctcagcctgctggaacgcagagaacagcctgcttggggaagggccggagctgccccctggtgctgagagggcctgttttcctttttcttctgggtttaaccttttttctcagacttctttgccagtgacactaagaatgtgacctcggcgtggtggctcatgcctgtaatcccagcactttgggaggcccaggcaggtggatcatgaggtcaggagatcgagaccatcctggctaacatgatgaaaccccgtgtctactaaaaatacaaaaaattagctgggcatggtggcgggtgcctgtggttcaggaagctgaggcagagaattgcttcaacctgggaggcggaggttgcagtgaacggagatcacgccactgcactcagcctgggcgacagagcgagactatgtctcaaaaaaaaaaaaaaaaaaagaatgtgaccttatgggtctaggccagcttcctctcttctcttctgggagagctggtgagggagtgagtgagcaggagggtgtgtgtcgggggagagtagggtgtgtatggggagggtgtgaggggtatgggataagcatgggaggtgtgtggtgtgtatgtagcggggagacatagatgtgtgtgtggggtgcagggggaaaagtatgtggaggggttgggggttacacatggtttgtgtgatccctatggcttcaggcccccaagagtgactgtaatctattagggattgccttgatatttgaggagttagcattaactgaagatatcctgctttatcattagactctgagtctagcttgctggttgaggaacaccacgatggcacagggacagtgggctgggctgtgggcacgtggtggagagccttcctatcccaagggaggaaagaagcatggcgcgggggctggtcggcgccttagccggttcccatgaatggctggctctgcctttttctgcttgacttcctttggcccttctcagagctgagcaggtggctgtcagctgccggcagcccaccacccacacagcctggccctgcccattggctcctgcacccaggcttacaggcagtcacccccatcctccccacagacagcaccaccacctgggagctgctggccctgcctcctctactcttatgtgtgtgatccttctgggtactggggctctggcatatctgtgctgagtgtatacttgcaggggagagcacagggctggggccaagagtgtttctgagtattcccaccatgccagcctcccttcatcgggtctacaatcttttcccaactctggaacagctccagtaggagagacagtacaaagtcacttagcctgagtggtcctccctctcatctgggacagaaaggaggaccctgtcttcaagaccagagagaaccttttggacatctgagaaaggtgctaccagaaagcaccctaacaatcattataattgaacaaattggagacgcttgctcaaaaagccagtgtcagcccagcaaggatgtcttccttctggaggatggtctcactggcattattcagtgctctctggtcagtccagtgcctctgcagttaccccgacgtacatcctcatccccttggaatggggctgggccctcgtttgaagtacgcctccacactgcctccttgctccttgcagacctggatgggttagcccggccccgccgagcccagtgcagaagacctgcggaggcagctcctctgccgtggcctctcctgtcctctctctgatgagccctccaggcagagcagagccttgttgttatgttgtttcctcactttggtgccctggctggatgggaacagctgggacttgctttatggactctgctgaacaggctggcatcctccagggagttttccccacccacacaggaatgaatcctgcagaactggattcccaagggcatgagctaaggaagctgaactgaggctggaggtgacagtggtgacaatctgggccttgcagaagacctcagtttataggaagcaaatgctgtatcgaggcaaagctgaggaggatggtagatgggggaggccaggcctaaagagagctactgtgtcttcgtctctaactccacccattttctgtgtcctctttcagaggacctttgtttatacttcacagcatctacagtattttcagagcgtttagggtttcctaggtgttgctttttggaaattctgtggttgtttttctgatacaggatgggctggtgtgaaagttgtgtgtaaagaagttccctcggtggtctcctcagctggaggccaaggttggtcaggggaggtcatcctgggaccttccctgtccccctacctttctctggaaggccaagaaagctggaggagtccctcataactaccatgcccttagagggaacctggggtgaactggatgagaaggattggttcttgggtgagggaagaggggaggaggaagcaggaagtaggaaccagacagagatgtggctgctctggctcctgggatgattcctgggttagaaatacacgtactgccaaagcttttcttccttctttgccaaatgttccattcagttgattgccagcttctggttcctgaccctgcaatcaaaattgccagctctagaggaaggaaagtttttagaggagccacaagctgcctcacctcttccatcctggtctcctcataacacagagcccacagtctacagggtatgtagcaggagctatgatctccaaggattctatgtgtgtgcatgagaccaaatggtttctgagctagaatcggggtctctgagttggagtcagcagtgcatgcagacctgactttatgtagctgtgtcccacaggctccaagcttctgtccctctgattgtctaggacccagaaagacttccactaaactcttgtgtgcactttggcttcaaattaatggagagtccagggtatggtatgcccagagagtagaataatggagagtaagtcctggtaggaaatgccagaccatgtgcggctgctttagtttagctatagaggtcactagagaggggatgtataagtgggaagaaaacacaagctgttattttgtcttctcacatttggaactagatgagaggcacccagagggcacgcacactagagaagagaaagaccttatggatgcatgtgattctgtaatagacctgccatcaaaaaagcttatagagctgtatacaacctgtgggttttccataaggaagcagggatcagatgcacatctgttggaggctgggggagccggcttgcttgaccttaatacacctccctgctgtaggagtcggattcctggcagtgtgttgatgttccctgttagagccgggctgtgggaggggcagttggagccagcggcatgtgtgtggagtgagatgcgaggcagggtccctggctgcaaaggaggtgggattgggggtatgggtgagtgtgggtgctgggggatggacagaagtggaggtcctctctgaagagaaaaacctggacaccaaagggtttaagtcctaatggcctctgactccctgaccctgcctgtccttaggggaagtgctgagggtcccttcctggggaagtcctagagctgagtctcttcccttagtaaaatctactgaaaatcaggatgcccaagactgggggcttgaaaccctgcatattcttcaccgccttgcttgagagctttccattttccctgcccactgaagatggtccaagacatgcagtaccttcttgcttcctgctttacaccccaagaggggattgaattctttatgtatgtgtctgccacctttgctagattgtaagctccctggaattgtgccatagtcatctgaatacttgtagtctttagatatgtatgtgcctggcctggcatgtagctggtactcaacaccctttgggatccaatctgtggctcagggtatggggaagagatgacccagacccctctagattctcccagtcccaaggagaacaattctgttagggtgccttccagcaagacagcaggaaccctcaccacccactggctccagtggtggcccctgggctcctccctctctggcacagggactaaacagagccagctccactggagggagtgccctctcctttctttccaccctttgactctgaaccattgtgtcactctgtcctgaccccatttcctccccggctagccctcagccatctgtgggcagctgtgagactgagtttggtgcctggtgcagctcagaccctggcaccgacctgcttggccataggcatgtcctcttgtttcttcagctgactggtgctttttggggtgcctctacccaggtcttcttgtcttcctgagagttctgaaaccctcttctgtggggtcaaacctggctgcacatttgaatcactttaggggctactgaagcatccagcatccagggactcaccctactgagtcagaacttccagaggagaggtcgggaatgtgtatatttttaaagcttcgcagatgacagttgcggtcactcaaatgtggagtgtgcattagataatattattgttgtcaatgttaagttttgtgggtgtgctcatggcattgtgttttacataggagaatgcccttgctcttagagattcaggctgaagtttttagaggcaaagtgtttcttacaaacactttgcaaagggcatcttacttttaaatggtaaagcagagcaagaaagagagcaaatgtggagaaatgttaacaattattgcaggcaggtggtgaaagaaaactggctgtaacagaccttctggacgatttccatctgttttctaagaggtggacattaggagagaacgcagcctgaaccaccaaggtgtataactccaggaggcaccattcacatggttttcatttttgtggtcgggggtatcattcacatagaatacaatgtgtggggtgccccctagagttgtgtgacatagtggcattggccccagccatctctccctggatgggctgcagagtagcagagacgcaggccctgatctacccttcctctttcaagggaccgacatggctatttgtttttatacagaatccctagtagcccttgaagactaagggaatggagcaatcttaatttaaatttaaatttaatttaatttaatttgagacagggtctctgtcactcagactggagtgcaatggcacgatcacggctcactgtagcctcaaactcccaggtccaaacgatccatccacttaacccttcccagtagctgggactataggtccatgccaccacacccagctaattttttttccccccatagggatggtcttgaaccctgggctcaagcaatccccccgcctcggcttcccaaagtccttgggattacagacatgagccaccacgcctggccctagagcaatttctaatgtagagcctgacagagagagaactgaattggggaagtggggaggcaggaaacatgaaaccctgattcctaaaatactttctgcgtgtcctctagtcctggaaaatgaaatctagggcttgaatttttagaggaagccaggtcgctgtgtttcaaggtcgctgggactggttgctcctgtgtttccatctctggagttccctcgtgtctggctgctgctctctgaaccttcgcttcaccttgggggtggccttcttggtcctgtgggggatgctgtttgtcccatttcctcactgccacctctcagcatcatagtgagctgagtgctgagcctttgggaggagcattgccagtgtggccctgggcgtgagatctgtcagaggggtgggcttccttccctgtgtggctgagacagtctagtggtggcctggcccagagccaggaggatggtggttagagaggggtagctcgcctttcctctgtctgaattccagtctgggaagagcttcaggaacagtgcctgcttggatcaccctgggacctttccttctctttcctgtgactttggagtcctctgagagatttgacctaaggaatcagtaggttggaatcaaggaatcccagagctggaagggactgtgtgtggttttcttgccatccttgcccctgccttacagatgccaatccaacctggttagttccaaaacccagtcctgtgtctgaaggatactaaggagcacaccacctacatcctgaccacccatctccatgtctgaaaattccccacctcccagaaggttctgccctgacattccagttcaagctcagtggaaatgatgggaatttggaacttgaggaacatagtaggggtgatggatccataaacatgtcaattttgaataaaatatcttaagcctgtgtttgagatatacactggttgctattgggagccaatagcaaatagcaaattggaacaatttgaaccaagtcacggaggtatcacatacgtggtcatgaatggttggaggtgagagggagagcagggcaggagagagtcttatagagaaatcagagagcctttgaaatatcttaggcaggaagcgaggtgatcagatttacattttaggaagagccctcaggatgttctgtgaaaaagccttgaagaggccaaggttagtagggggaaggactattaggaggccattgtaatagcccaaatgagagaagataagggcttgaattagggcaaccacagttaggatagaaggaaagattagctttgggaagtattaaggaggaaaaggtggcaggccttggcaattagagagaggggtgaaaggaagggggactctaggatgactgcaggatttttagcttgggggactgggtggtgccattcaccacaatggggaaccaggagcaaggagcagattgtggggaggaaagaagatgatagttgagttttggacatttggattttgagatatgagtgggcatgtaaacttgaaggagagatacatatttggaatcatcaacatgtgagtagtatggataggaaacaagaatagatgagattgcccaagcagagggggtagagttaacagtaagctgagaatagaatcctgagccaacaccaacatttcaggggtggacaaaggaagaggaagacaaagaaggaggagatggagaacaagaaaaaaatatcttcatgaaagccagcgggagagggtttaaggaagaagggaatggtttggagagccaaatacagcagcaatgtccaggcaggtggaaatggctacggaaatgggcagcccaggcattgttgctggagcagttttagtgggatgtggggggcagacaccagattacaatgagttaaagagtaaatgggaagggagaatttggaaacatcaggtgtagtccattctctggaagcttggctgagaatggaaggatgaacagagaggacaaaaagtcaaggggagccgggcacggtggctcacgcctgtaatcccagcactttggggggccgaggcgggcggatcacctgaggtcgggagttcgcgactagcctgaccaacatgatgaaactctgtctctactaaaaatacaaaattagctgcgcgtggtggcgcatgcctgcaatcccaactactcgggaggctgaggcaggagaatcgcttgaacccgggaggcggagcttgcggtgagccgagatcgcgccattgcactccagcttgggcagcaagagcgaaactccatctcaaaaaaaaaaaaaaaaaaaaagtcaaggggaggtgtttagggttcggagtttttcctttcttgttaagattaggtgaagcatgtttatgtgctgaagagaaaaaccatgttaaggagaagagattgaagatacaggagagggaagggaaatccatggagcattatcctagagatgaagtggatggggcaagagcagaagaggattgtgcctcagcaggaggcaggaatctgcttcccctgggccaaaaggaagaaagtgaagctgagtgcaagtatgcataagtgggtgttggaagagaggcttgaagttgaaaaagattatttccaatggcctgaattttccttctcacaatagtgcctgctaaggcaaatcttaatactctgcttgtcctagctcagcgctgaaaatacacagtcattctctggattaacatacttaagcccaatccaactttgagcatttatctggtatctcctatctataaggcactaggccctccttttcctgggactagtctcccagctccaggcagctaggttctggatatctccatctgcttatgctactcctttgaatttcaaatagcaagactccctcatacccactgtggataaaaagtgatctgtaaggagctgtggaaaggcagagaaattaagttaacagtgaactgctttagatactctgaggctgggcttgggccggtctgtccttggtgaactaattcctaagtgcaatagttgtcagattcactgagccagaacccttcagaccagggtcctgtgcctatacctgacagatgtaccagggtcctgggagggcaccccagggtaagggatacctttgacctaacttattttgaatctaagcaacttgccacccaagagtctatctgagcctttttcctattgatgttttcaacattctaatcatgaggtgtaatttcatgtttgttacctgttgggtgaagcagtacaatagaatgaacattttctgataatttttatgaaactgtcaacctcttggctgctgatgctaagagtcagaagtgactacttcacactggtctcccccaacctaatcacaaacacacattcatagatccacagttctgaggttgggctacacattagaatctcctggggagtttttaaaaaataccattaccctaccacagagcaattaaatcagaatctcttgagagtattcaggcttcagtactttgttttttttagacagagttttggtcttgttgcccaagctggagtgaaatgatgcactctcagctcactgcaacctccgcctcccgggttcaagtgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccggccgggcttcggtactttttaaaacttcccccagtcgggccgggtgcggtggctcacgcctgtaatcccagaactttgggaggccgagctgggtggatcacgaggtcaggagatcaagaccatcctggctaacacggtgaaaccccatctctactaaaaatacaacaaattagccgggtgtggtggcggctgcctgtagtcccagctactcgggaggctgaggcaggagaatggcatgaacctgggaggtggagcttgcagtgagccgagatcctgccactgcactccagcctgggcgacagagtgagactccgtctcaaaaaaaaaaaaaaaagttcccccagtgttgctaatgttgcagctggggttgagaaccactgggccagactgaccttgtcgttaccaccatttgttgaatgcttctcaactctgttcacgtcatggcttctagagaaaaggataccaccgctgaagtaagtggaagcactggcctggagatccagtgtggcttcctgagggctgggggaaaaaaaaatcaatattttggcacacctgtaagacatcaggtagccgggtctcacctgttggcaagctttgttttattttatatattggtgtattttgggaggatcctagtgcaagctgagtaattacaaggtccgtttcacagggttctcttgtacttttcatttatagttttattgaggtgtaattgacatataataaaatacacagattgaaagtgtgtaatttgataagttttgacatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatcatgtgagaataccagtgaagccatgaccacaatcaagataatgaacatattcatcacctccaaaggttcccttgtgtcccgttgtaatccacccctctttccactctgtcccccagataccgctgatctgctttctgtcattatagatcagtttgcattttccagaattttatataaatggaatcatatgtactcatactgttttgtctggcatcttttactcagcaaagctattttaagattagccttgttattgcatttgtcaataattcattcctttttattgccaagtagtattcaattgtatagacatcacatttttaaaaatccattcactgttgatggacattttgggatattacaaataaagctgctgtggatattcatgaacaagtctttgtgtagacatacgcttttattttccttggataagtaggagtgatagttgaatcctgtgttaggtgtatgttgacctttttaagaacctgcctgttttccaaagtggttgtaccattttacattccccaccagtagtgtatgagagctgtcctcttcaaattgactggagaagctttgcttccatctcttcttcttggctaatagaaggtgcctcttggctgggcgtggtagctcacgcctgtaatcccaacactttgggaggcctaggcgggtggatcacctgaggtcaagagttcgaaaccagcctggccaacatgacaaaaccctgtctctactaaaaatacaaaaattagccgggcgcagtggtgggcgcctgtaatcccagctactagggaggctgaggcaggagaatcacttgaacctgggaggtggaggttgcagtgagccgagatcgcaccattgcattccagcctgggtgacacagcgagactccatctcaaaaaaaaaaaaaaaaaggtgcctctctctctttttggggcacaaatgacagaggtgagtatagggattagggcgcagagatgaggcatgtagagatgaatggatggatagttggatataataaataggtaaagttgtcttggtatcccttttttcctccatcttcctgtacattccattagttgtacacaacgaagaagcaggcactggcccagataatatcacctaaattggattattatggatgattagtaaatctctctttgtgactgattgatatttttacccctcacctgcaggcgcccagacaccatgtcacaaccctccagaactgacgttggcaggaagtagagactttgttgcctgtgtcccccatcctcaccatgtcttcgactcagggcaatggggaacactggaagtccctggagtcagtgggcatcagccgcaaagagctagcgatggccgaagccctgcagatggagtatgatgccctgtcccggctccggcatgacaaggaggagaacagagccaagcagaacgcagacccctctctcatcagctgggatgagcctggggtagacttttacagcaagccagcaggaaggcggaccgacctcaagctgttacgcggtctctctggctctgatcctacccttaactacaactcactatccccacaggaagggccgcccaaccactctacctcccaagggccacagcctggctcagatccctggcccaaaggctccctgtctggagactatctctacatttttgatggttcagatgggggagtctcttcgtccccaggaccaggggacatagagggctcttgcaagaaactatccccacctcctctgcctccccgagcttctatctgggatacccctcccctgcctcccagaaaggggtccccctcatcctccaagatctcccagcccagtgacatcaacactttctctttggtcgaacaattgccaggcaaactgctagagcatcggatcctagaagaggaagaggtgctgggaggtgggggtcaggggcgcctactggggtctgtggactatgatggtatcaatgatgcaattactaggctcaacttgaaatcgacctatgatgcggagatgttgcgggatgccaccaggggctggaaggagggccgagggccgctggacttcagcaaagacacctctggaaaacccgtggccaggagcaagactatgccccctcaggtgcccccccgcacctatgcctcccgctatggcaaccgaaagaatgcgacgcctggcaagaaccgccggatttctgcagccccggtgaggaccttcttgtgtttcttctgccttcctttctccatgtccttcagaaacagggactagtctctgctgttctacatccaactctgccaagtccttacccctttaggcctctcctaccctctttgggaccctggccctggtgggggaggtccaggggaggcttgattaggggtggacaccagtagagggagggctccttctcagggccaggtttcatgtatcttggccaaaacggcccttctggggcaggcatttgggaatcctggttcctagcgtgtgcctgcttcctgatgtaaggactgaattgggagttatgggattcattattgactggctgaatggccctctggaccggagcaagttgcttccgcttgctctgaggccctgctctgccaaaaacgctgcgtggcgatgaagatcattcacaatagtaaccacttgtttagtgcccactgaatgccagaccctggtccagatctccacaacaacccttcctgatagtccaaagccacacagcaagcaatagcagggccagcattcagccctggcctctctcgttcctaagccttctctctcctcctctccttctccctttctctctctctctctccctgctctgttctttattgtgataaaatatacgtaacgtaaaattcgccaccgtaaccatttggaagtgtgcagtcagtggcactgacgacattcacattgtcgtgcaacccttgcattattcatctctactcattctcttctcacaatgaaaatatttagaaaaaatatgcagtatgacaaatagttttatttttatcagtacatagtgtaaaatagcgaactatctaggtcaaagcccccaggcaggtgccagggcagctctgatcttttttctggtttaggggagcttcagcagcatctcctgggtaggaccagaaggcctatttgtgtttcatccttggtccctggaaaccctggctgcaaggagtcaagagacaagtgacacccccatggctgatgccttcttttttttttttttttttttttttttgagacggagtctcgctctgtcaccaggctttagtgcagtggcgctatcttggctcactgcagcctctgcctcccgggttcaagagattctcctgcctcagcctcccaagtagctgggattacaggcacctgccaccatgcccagctaatttttgtatttttagtagagacggggtttcaccacattggccaggctggtcttgaactcctgacctcaggtgatctgtccactttggcctcccaaagttctgggattacaggtgtaagccaatgcccctggctgctgatgccttctgtgacagcttagcattctacttcattccgtcctggtttcctccttagccattgtttaaggggcactggggttttcccaccttgtgtctagcctttgggaaccttcccaactctgaagagctacacagttcttccttcctccgcttctgctaagagagtccccccaaaagcagaatcagctcctgggataagccacatccctagagctcagggatttttaaaggccctgctctgagaggtggggctgttcccgctatttatagggactgggagattcctgttcccagctctgagttcctcacacccagctgggcctgctcactgagtcagggcaccctggtaggtggtcacctctgtcactccttctctctcctgcctcccctactccctcacccttccccatcccctgcatgtcatcagagttctgagacagagctcagcccagaatctccttgaagaagcggacacaaagcaaaaagctcttgccagttctgagtggggaaatgcggccttggtcctccccggctcagcttgttgcaggggctcagcctgctgggaggggggaccccttgggccctcggcctataccaccgccccgctttcgtcgggcttccagccagagggaacctccttatcccaggccagcggagccagctctggaactggctggctccaaatgccagcctgatacccctgctgccagcctctgcccggcagactcccccagccagcatcgggtgatgccaccagggcctgccagctgggcaaacgtaagtggcttttgttttcttatggtgccagtgagtggtacagaaaggacatgagagtggccttcagtgaccactctgttctctccctctcttgccttctcttccctccccccactgtctctctctctttctctttttcttcctctctctctcctttctcttgtgggttaattgctgacagtggtgctattgttttgactgggacacaggcacgaacttggcagagccagggcctcacatgccaactgtccccactgctgccctcccctctgtgcacccccaccccccgccgcccatgcacacccaggggagcaagcctaacaagagagggtcaaccagaggaaacagtctggatattcaaatgaggagctcagttgctgtcatctgccccaagaggcagagaggacttgagagtagccaagaggttgggtgagagatgtgaggcgttgctatgtgcacaggccggagctagactccccccagaaacagctgttggaaccacatgccggccttatctccatctgagctgaagcctcgtccctggtgtggcctcccaggctgccctgagcagacccctcaggcagaaacctgtcatgcaccagctctccctccccctcacttccttctccctagggctgggctacaggccttgctaggggcttctttaggaaccctcctgggtgactgaaagcagctctgggatgggagaccgtttgggaccttgtctgagaatcctaccaccacacacgtattttgagagaggaagtggggccaaggcaggctccctgacattccggccgttcagagccggctgactcggaagccagaggagccaagcttctaccaggtcctcccctgcccagaccactgctttgacgctttcttcctcaaatagcatttacccagaaggcacatgtgtctgagtcatctcctctatctaagggttctgggtctctctctgctttgggtccatggggcttgtggatattgaggctttagaccagggccaagcttccctgggcaccatttgggccgcccacctgctctagcctcagtagaggggctgggaaaaacagctgtctgctctgctccctgtcacgcctctgggagaatcccccggaaagcccgtgttgcaggagaggcccaacagcactggattgccttactggctgcctcacgcttatcagactgtcccctcctgaagtggctttggccacactcttgtccatctcagccagagcttcgcctccttcttcaacttggctcctggtctcctaggacagcagatacatgtattcccggatgtcccatatgttcttgtgcccctttcattggatgtcgagtgactagaaagtcttttcatctagagtttgagtttaggtctggagtacctcatagggaggggacaccacgaggaaaaaggcactgagtcgtctgctcttctcttaaaggtgggctcccggccccacactgttgccaatggccatgagttgtttgaggtctcagaagagagagatgaggaggttgctgcattttgccacatgctggatatgtaagagttaaagaatggggtgggatttgggagggctatgggggatggggaggggggccatccatttccgaactttctttaggagggaagaagcaccataataagtaaatctcagttcatagctatgaaaatgcttcctacaacaagtgtctgcagggtttttgaaatcttagaagtctcacatttttagcaaaattcatgaaacctccattgaatggtcaaagtatcctgatcactctagagtctgaccctcagttgcccttaagagcaaatgcaccccagctggcgataagagtgttatctggaactaaaagagaaaggaaatggattcataaaaaattttccattaaacttagcatggaaagctttgtcattttagaactatttgtactgttcaatggtgggaaacattttgcaattataagagaagtgtcaagaagggggtttctcagagctgctaccccactgcccccatcctggcctgcaaatttggagggctgggctgagtggggacagaggggctcttgagcctcagagcatgaggttcccaacagatgtcttcttgactactctcttctaaaggcacagtgagggttttttttcttcctgtacagccttcgatctggctctgacatccaagactacttcctcactggctatgtctggagtgctgtcacccctagcccagagcacctcggggatgaggtcaacctgaaggtgactgtgttgtgtgacaggcttcaagaggcactcactttcacctgcaactgtaagttagtgaggggggagaggatgtgagcatcccttgaagtggggtggggatgactgtgttttggactcgatttccacctcatcttgtggcccagatgaagggcagtgaggatgctcctttgggggtgaggggctggctatggggccagcattctagtacagtcactttcctcaactctgaactacttgcctgctttatctggttggtgatggtgctggagaatacttagctggaaagggggatcagggtggggaaactgagacccatctgccttgacatccatcatgattgctccccctaccttacccttcacaggttcctccactgtagacttgcttatctaccagaccctgtgctacacccatgatgacctgaggaatgtggacgtgggtgactttgtgctaaagccctgcgggctggaggagttcctgcagaagtgagtgaatgggtgggaggtagcccctgccttcctggtagtaagagtgtgagggggcttcatgggattggtgctgggaccggcctggcagctccgccccaatcccacagtcaagactcctgctttctgggcacactctcggccacgtagcactttccccaggagctctgtcttccagcagggttggctgacgtcctgagccaagtctgctgtggaaagagcttggagctgggattaggcaaagactaggtcatatctgcttgcagattctgcttatggagagatgtgtgtatttgtggggaggggtgggcttggggagactatatgggtagtgctgtatctcctgctctagattatgtgtggtgtttttatggctggggcaaaatgaggactgggcagaagttcccttgtggagcccaggggagaaattacaattactgtctctccccattctcctgccaacaagtcttttccccagctggcccgtgcagctagttatcctcctcccaaaggcgtgcctccagctcctctccatccagtgccctctctggaaagcagcctccctggaaagtctgatgtggaccagctgaggcaaccccctttccactaccctgggctctggagggctgcagtggaagagaggcaggggcaaggttatcacttctcagatggtacagctgtgtgacagcagacagataagatctgctttcctctcttaggcttcagagccgctcctgcccccagtctctgtccacttggaggaagcacgttttgggaatagagaaaggagagacctgtgtctcacttcttaggagtgccctataagtgccactgcttgctttttctctctcttacattcaggtctagatgcaaggatggttgatctatgtctagagcataagatttggcagtcaggatggaagattcatttctggacttctttctttttttgagacagagtctcactctgtcgtgcaggctggagtgctgtggcgccatctcactcagctcactgcaacctccgtctcccaggctcaagcgattctcatgcctcagcctcctgagtggctgggattacaggcataagcaccaccacgcccggctaatttttgtattttttaatagagactgggtttcaccatgttggccaggctggtctcgaactcctgacctcgggtgatctgcccgccttggcctcccaaagtgctgggattacaggtgtgagccactgtgcccagctatctgggcttatttcaaatttaaggatattgtggggtcctttctggcctctgcctcctcatctcgaagctaagggaaaggaaagaggcagggttctgtatggtacaactccagggtacccttcaaatgtgccccacctttaaactcacttatgtacacacttttcccctagaggaacaggaggggtcctagactcagggttgcctggcagagagagtgccaggtggcctgccactgttagaagggaaaaaggggacatagtggataagttggagctcctgctgacgccattacacaggtttgaattcggacttgccacttactagttgtgaaggctgattgatgctcagggccctctgtaagctgcagtgagggtgaaatgtgagaatgacctgtgagcaatcagtaaataccagcagggaaggagcagcccacggagagaagtcctagggctctgggctgcacagatactgccatttcccttgcagcaccccaaatcctggagcccctgggtccggaggtagtgggagctgtcaagttctaccttcctgctaagactcaggtgaaatattcttagtgaggtgggacagggtcagcggtcctcagatcacacccctcatactctcacttgaatgcacagagaggaaggccttccacagagaagatcaagcaagtccccaggggacctgtgtgcatgactcctggcctaggagccccactcccacccaacagaaaagcacaatgctgtctcctggcccagcccccagacccccaacacatgacaactgcctgggatgggggtggaaaggacgctccgggggttccagaaatctgctagttcccaaggaagccctgagattttctacccctgcctggcaggaggggctgatactgagggggtgagtgggttcaggatgcaggctgctctcagataagaaccttgaggcagtcccgtgggagggttgggtttcctgccacctcccccagccccaccacactcttccttcctcccaggctctcccaccaggcccagccccacagcccagcctcaccacctccaggttttggctgcacttcagtcttagatctgagagggtctagatcggagatttggtcctctcaggatgtggagaacccctcactcgagccctcatgggacctagacgaccctgggccctgcacctccgccagcttttacatatactgccccccttatgctcctgtcctctcctctccatttctggcctagattcccagctctgctgaggaaggaagtccttttccggcttctgttacccagctgctgaggccaggcccaggcctgcagtgctggcctggaggtagttctccctctgcccctcctcttgggtttccttgctgttgaaggtgtgatttgggagagaggaagaggttggatcgccgagggctcctaggccttatctctgaaagggggagtctcacacatgggtgcttgagcaggtgggactggcatgcatttgggacttttcaagaagtcatagaaatttgtaaggttattcacaagcaggcagggccaacagatggaaggcagaaaaagaagttgggtggggacactgatctggaggcttggtaggcttgccccaagtttttttggcctcagcaccctagttggtagcattggaagaggggtctctcgctgagctcccaccctggagcctgagcacaggcggactccaacatgtctcttcctggttgtcccctatacagaggcccagaagatagggcttcagcaactgctccctgtgatgtgcctctgtttccccgctctctccaacagttcccagccctggagtgaaccagtgattaccacacgggtaataaatatctaagagagtcaatatttataccggccaaggattaagtatattaggtggcttttgtttagatagacctctgttccttctcctaagctctaccgtgtcattttctaggagccaaagtagggtacaacacgggtactacccccttacctaaaccttctttctgtatgtctctccccaaggctaaggtatgtatctcccttcccactgagtccccaggatgctaatggtcttgtccctctaccctaccagcaagcatgccttgggcagtcatgagtacatccaatactgccgcaagtttgacattgacattcggctacagctgatggagcagaaggttgtgcgcagtgacctggcccggacggttcgtgtgagggtggtggagggttgcccagggctggggaggtggaatgggaatacaatatagaacacatcaggtgggaggggggtaggagtgctgagctgagataagggcaccgcccctctctgaataggtcacttcttatacaggtgaatgatgaccagagcccctccaccttgaactacctcgtccatctccaagagaggcctgtcaagcagaccatcagcaggtgagtgtgggcaccatcttggatgtgctccaaacaagaactgtgcagggatcccatcagatgtgcctgcttgcctttctgtcagggctaagggattcttgcaggtgtcaggggttggggcccacacatcttatcagagaagatccccactccaggcatgtttcatctcttccctctggaactttgccatcattctctccaggcgagaagtggcagaatagaaagactctccctccttcagtcttcacaggacatatagaaagagtgggaactcctttaaatcagagtgtgagctgaggagagggagggagaaaatgggtttcccagggcactgggtctttcatgacctctcctgtggtttttccctgcccccaactcccaggcaggccctgagtcttctgttcgacacttaccacaatgaggtggatgccttcctgctggctgatgtgagtacgaatccaggggctggccctgctgcccgaaagctcctcctctccccttcctcagtcctcctgggatcacccagcactatgaggggtctgggtggagcctgaaaatctgttggcagagcacttctttttaacccctcgctcatgggcaaactaagactactagatgttgggcaacggcaagtgcgtagtcagggattctgctcctctatagaagaagcaggtcggaaactgcatgctggtcccattctctggaataggatgtctccagagctaaggaacctagagctgtcaccccccagctgctgcacttgatgtacactggagcatgcatcctatgagcaatgtcagaaacctccagtttgagaggttctgttttgctgttatcgcaggtaggaaaccatcaggaggtagaaggtttcacatgtagggagggccagagccctccccacttggattcatgcggagtctcaagcctcaaaaccatgagagtcaacatttgtcttaaatgtcacaacgccaaagaaaatctgacagtgatcttcaaaaacaatcccttgctgagtgtgatggcccacgcctgtaatcctaaccctttgggaaactgaggtgggagaattgcttgaaccccaaagttcaaggccagcctgggcaacacagcaagaccccatctctacaaaaaatacaaaagttagccaggtatggtggcacacacctgtagccccagctactctggaggctgaggtgggaggatcgcttgagcccaggagtttggggctgtagtgagctatgatcacaccattgcactccagcctgcgtgacagagtgagaccctatctcaaaaaacaaaacaaaaaccaatccctgtctcattgatccagttaatagtagtcataaacgcttcctttttgaggggttcagcattatgtctagtcactgccagaatcccttctccagcagcctgtgcttgaacatttccagtgatgcgggggaagctctctgaacacctgtgctgtgctggtctggccctttgctagtggctacgatgggtagagaagtgtaagaattgtcatagccttggccaggtgcggtggctcacgcctgtaatcccagcactttgggaggctgaggtgggcgggtcacctgaggtcaggagttcgagaccagcctggccaacatggtgaagccccatctctactaaaaatacaaaaattaactgggtgtggttgcaggcgcctgtaatcccagctattcaggaggctgaagcaagagaattgcttgaacccgggaggcagaggttgcagtgagccgagatcgcgccattgcactctagcctgggtgacagagcaagactccgtctcaaaaaaaaaaaaaaaaattgtcgtagcctttggggagcttgtgttcttgttagaaaaattgaatagtaacacaaagctattagtagacagaacaggatggtaataaattaattaagggctcctggaggatgctagaggaaggggattggccagggagggctttatgcaggaggtagaattttagctgctctgtgatttaaatgtacataggtaatcagagctggacaggtgagggaattccaggagcataattccagaggggaggttatggctgtggcatgtctgtagaaatgagatgagatctgtctggaaattctacaggtctctgggagagaccctgtatatatgtgtatagtataagtagactaactatagagagaggctagagataggaggagcttcaaggggaacggctgaaagaattggggcatgtgggcatggcccattgaattcagtgggagagattatttgctgatgatgaatatttgaaaataaaatgtattgcacatttacccctgaggatcatgaatctctctactcttcccaaccctttcctttaaagactggggtggggaggggttggagaccaagagcatgagagcagagcctgccagcctcactgtgccacctcccacagggagacttcccactgaaggctgacagggtggtccagtccgtcaaggccatctgcaacgccctggccgccgtggaaacccctgagatcaccagtgctctcaaccagctgcccccctgcccctcccgcatgcagcctaaaattcagaaggtaaaggggcccagggtgctagcaggggaaaggaagagagggatactgtcaggtaactgagttgcctgttgctagagtgtgtaggtgttcactcactaaaaaggggcttctctccacctccatcttttatgtttaaggaattcaaccgcaagagctcttcagaaatggatgccaagtgtgtctcctcttcctgaggttgagggagagctacctgggactgcttgttgagagcccaggccagtaaaggctttattcacagtcaccaaggcattgcctgacagtctgcatatccatcagggtgcaaaaacaaaccaggaggaaaatctctctagagccaggggctccaggactccagcaggggctgtgtgctctgcagacagggccagcaccataggcactgtgatctgcagccgagtagcctgagggttgggatatctcagaagggtggacccgatgattgctatcctccgtcagctcactctgtccatcatacagatctggtacaaaccattactctctcctctctggggattctcagctactcacatttcagcccattctggtccagatgagcgcagctgtgaaaagcccttcttccagctgtgacgaaaaaggctatggccctgaagctcccctccctcttctttttcccaacaggatcccagtgtcttggctgtgagggaaaaccgaggtaagggaactgctctccatcttcatccagtcgggctgccgaaaactgcagtctctgccccgattcctttttctgcctgggccccttgatttatgtgtcggagttcggctgggggtgtgtgtgtgtgtgtgtgtgtgtgtgtgtgtgtgtgtgtgttcctatatgaggtgtggatacagctggagagcacatttctttccacaaagtgttttcttattatttttcctagtcattcctcctggtgtccctgggagatgatgatgagggggtagaagtgtgggagtggggtggtggggcagcactagccctgtgatccagatgggaagcctcccacttgggtagattgtgattattctcccaacagctcacacttgctacctttccgatttagagtgggccttgggagaggatgagaaagaattttccctacgatttttctaggattcccctgttgtgcccttcaagctgaactttgccctaagactgacctatatccctgggattcctttgttttggttttgttttttgttttggcatccctgggattcttatggtgattcccagtcttttggatttcatagaccagtaaaatgtcccccaaagtatttgggggaccaagagagaattggcagccttttacttggccaaacttttttgacttttgcttttttgaagcaactgacaataattattaacgctgtttcctaaaagaaaggacattttaatactaagtagcaatacgtaaaaataaggattatgtttaacattgtataactgtcattttatgaaaagctcatgacatgcttctgcttttttctcattttaccgcagatgggtgaactttgtcacagctattagagactgactagcatttggggaccactgtcttaggccatcccattctagccaatgccatggcaacaaggtagggcttgtggaggcctcatgactttcccttctgaccccttcccttcccagagaaggtcgtggaagccctgaccgctgccatcttggacctggtggagctgtactgcaacacattcaacgcagacttccagacggcagtgcccgggagccgcaagcatgacctggtccaggaggcctgccatttcgccaggtccctggccttcactgtctatgccacccaccgcatccccatcatctgggctaccaggtgagcccagggctgagtagccgctagggagcaagctgagtttgacctccaccagggctttttcctatctgcatgtaataccactgtcctaagtcttaggatgtgtggcattgtgtgacattgtggtgcaatggggctgcgggggtgagccaagtgcctgaggaggacttgggctggggacatcctagaggagagaggaggtcccttaggagatgaagaagatcctgttattccctcttggtgctggctgcctctgcatccctgccccctccagatccaagaccagtggaaggagacatggcaacagatggccgattcccagatagagtgcacgctccctggccagtgggagggggtggggaggtgggattgaccctttgtctggggttctctaggcctgcaggggtgggtggaggaggatgttcttttggtaaaatcctcagcgcctctgttgggtccccagcatccaaggcctgagggaataggcactgggccctaccccgcccctgccggtcccctttccccaacccccttccccttctctctttgttcctcacttaatgtattcctctgggcgattggcagagaacaaaggaggcagcctgggaaaccggggccttctctgacctcttctgtcaggcacctgtcatgagccacagggacccccgtgtgttggcattcatgtcggcatatgtcgtcttcctcccccacccttctcacttgcgcatgcacgtgcacgcgcacacacgcatgcacacacagacgctccatgggctggagctttctataaagaggctgggtggccagttcccattaaaggaagaaaaacaacaaggctcagaatggagcctaaaaccgagcagaggaatctagattgagttgctttggcctgagcacatttccttacatccagtttggctgtcctatccggagatcctgtgttacagccctcagagactgagagttttaccaggggaaatggattttggccttagagggacgcataggtttgggtgattggttttgggagctgggtgtcctgacctgctccctttcttttatagctatgaagatttctacctctcctgctccctcagccatggcggcaaggagctgtgcagccccctgcagacccgaagagctcacttctccaagtacctcttccacctcatcgtctgggaccagcagtaagcccttcccccaggcttcagtgcccaggccactgtagacctgctcagcctctgaaatatccctggggccagataactagtccaggactaatgataaaaccaggctccttgttaaccctaactggacaagtcattcaacctcttgagtctccacttccctgactctttttttttttttttttttgagaggcagcctcgctttgttgcccaagctggagtgcagtggtgcgatctcggctcactgcaagctctgcctcctgggttcacgccattcttctgtctcagcctcccgagtagctgggactacaggcgcccgccaccacgcccagctaattttttgtctttttagcagagatggggtttccatgtgttagctaggatagtctcgatctcctgacctcgtgatctgcccgcctcggcctcccagagtgctgggattacaggcgtgagccaccacgnnnnnnnnnnnnnnnnnnnncgtgagccaccacgcctggcctccacttccctgactcttaaaggagccaagtataattaccacttctcaagttgtcatgaggatccaatgagaagtatctataaaggctctttgtaaaccataaaaaacatataaattttagttgttgaccaggcgcggtggcttatgcttgtaatcccagcgctttgggaggccgaggcgggcggatcacctgaggcagggagttcaagaccagcctgaccaacatggagaaacctcgtctctactaaaaaaaatacaaaatagccgggcatggtggcgcatgcctgtaatcccagctactagggaggctgaggcaggagaatcgcttgaacccgggaggtggaggttgtagtgagctgagatcgtgccattgcactccagcctgggcaacaagagcgaaattctgtctcaaaaaaaaaaaaaattaaatgttagttgttaattttaataatactttattttttgatcttgtctcccttaaagagtttaactagttggagggcttctcatcctctcccttcttccctcagttcctgtagactatggagaggagactgtgcttttccctttatatatagagaagggagggttgtctagagaaagaatattgagcttggattcccaggagtgagcctctatttctagctctgtctcgaatactactttctctctattctttctgtgcctcattttttcaaactgagaaatggggacattggtttcactcagaggcagttatggcgtcgagatgagataggtgggttataaatataaatatgaaaccaaaagcacaaggtagtattaatcaccacatgtaaacaataatttggtgtcgggaaggtaggcgtcagccaagcaaagcaggaaggaaacggaggagagggtgccttgcttgaatgggggcaccgcaggggttttcctgccctgtgcttcatctgtgctatgctctaccttccttccagtcagtcagaaaatcccctgtttgctgcccccggctttgcttccccacactgactatattagagtcctcatttgcagagcagcactgcaagctaagtatttgtagcacagattaaagagactgaggagggtcctggggaggccgaggatgcaaaataggtagatgaagaatctggagatgctggaagaggtgggtccttttacagatggacaactgggaaaatggaccctttctcatgcccttcacacttaggtaattcttagagcaataaaggtgtatatggctgggcacgatggctcacacctgtagtctcaccgtactttgggaggacaaggcgggataatcacttgagatcaggaatttgagaccagcctgggcaacacaaagaggccttatctctactaaaaaattattttaaatgagctgagtgtggtggcgtgcatctgtagtcctagctacttaagaggctgaggtgggagagtcacttgagcctgggaggtcgaggctgcagtgagccatgatcacaccactgcactctagcctgggcaacagagtgagaccctatcttaaaaaaaaaaaaaaaaaaaaaaggacatggggtgtgcattaaaggtccttaagcaaacaactgccaggacaggagaaactccttgcaggcagaggatagctgcattaaatggcccttgagttccaccattcccttgggattttttggtcacaattactgctgctgtcaagagaaggggtgccagcctgggcaacaagggagacccaatctctacaaaaaatacaaaaaattagccaagtgtggtggcatacacctgtggtcccagctacttaggaggctgaggtgggagaatcacttgagcctgggaggtcaaggctgcagtgagtatccagcctcggcaacagagcgagaccctgtctcaaaaaaaaaaaaaaaaaaaaaaaaaaaagggtgctgcacagtgttctggcccaggaggaactttaaaaaattggccttaaaccctttactcatacagtatcagaggtagagaggcagcccagcctgccccatgagtttcattttgttccctgagatccccaccttgaattttaaaggggcagtcccctgcctagcgccttgtgaagggcactatcttgcactgtccatccagaagccccgaatgagacttcttggcccttcatggtcaagaccaggacatttgggggaaggcgtgccagcgttcagaggacagtctttgggccagtcattctctccttcctactgtagttgcagcctggggcaggtctttcaacctagaatggtagcgataatagggcctaccctacaggattgtttgaggagcagttaggacactgtaaataaagtacttggcacaggcttcttagctggggagccctcttggttttggtttctctgttccaagtgactgacagactggctgatacatggggatacgtgcgcatgaaaatactatctgtataagccagtgccagtgcagtaaccacagcatcacatagcaaaaagtacacagtctgcacacacatcatgcaagtgaagctatgttccccttttccctgatgagaaactgaggcacagagatgggaattaagttgcccaggattgtgagtggcagaaccaggactggagccaaccagcacattccaggaatccttcctggaggaggcagcctgtgtgatatgatgttgttgaatgggctgcaggaaggagaggggtttctcagggaggaaggtaagggctgcagccaacataatggttatcctgaccagccctgggtgaagatctgtgggagaggttgtggaataccagatatacccaaggactgaagggaagagggccttggctggctctggtttcactcataaagtcttctcactccccttttccttaagacacgaagctggaagcttcttccttgggtgaaaagaaagggctcaggaccagctccctctcccctttgctatggggtcagctgattctctgccccactgtagcggtccagggatcagctaactctcaaaataggctcagcagccgtgctttgtcacctccagccaagccctggcctggcatgtctgctggctgctggaggggccctaattatagctgtgggcccccagggtagaggcagctgggacagagcagggctctgccagtctgtggtgggctggagggagtgcctcacttaggtggagattcctctggaggacagcggtggaggcaggctgctttatcatgaaactgccaaccttgggggtggccgccctgcctctgcgctctctggcatagaagttgctgggccctgggctggccaggagggtgtgacagtatggactttggcccagggacagcttccccgaaaggtaacgtgggtcctccctgcctttccacagctcccctcccctgtgtacttcaccccacccagcagttccttatcctgagcttagagggagtggctaggtgtgattcagactgagggacctggagagaacttatgggcttgaatagtggtggggcttatgtgtctcagttctcttggccctgccattggctttctcaccactggggtacttggagaaacccctcctctttgtccctttggctttgaagctgtttgggggtgggggtgagaaaaacccagtgtgtgtccctggggctaggtgaaggggactcctatgaggacaagtgagagggctgtgggggagggtgaaccgagggcagagaacatggtgcttcttcctggtggctctcagcagcaagaagtgggggagggatggagactgtcaaatggaaaaggaggacaaaaggagtagctttgcggaccctctgcggaaatcctaaaacaaggaaaggagcaaggctgacaacatgggacgtgtcatcacctgaactccgaggtggctctgctaagcaagttctgtccaggcaccacgggtagcttcaaaatcgggatgttcgcctcactctactgcaaagctccaaggacaccacattgtgcttctgggaacatccagtgggggttttgcctagtttgggacctctcctggttctgcaggaggagggcttcctcagggagtatgtctgaaccctgagagggaggctgtatcctcagcctcagcctcagcctgacttcctgggccacctgttgcttgaagccacaggagtggcccctcctaatttgacttcctgtcctccataggatctgcttcccagtgcaggtgaaccggctgcctcgggagacactgctgtgtgccactctctatgctctgcccatccccccaccggggagctcctcagaggccaataagcagcggcgggtgcctgaagccctgggctgggtcactaccccactcttcaacttcaggcagtatgtgagccccagggtacagcttcttggccttggaaagggaggagggggacagagaaaggggcctggctgctgcactggccagtgcaccttgggagagttggccatgtggggctcactggtgaagtccagaggatccccaagcacagaactggtgaccaggactattgatgtaaccaagagccactgagcggttctggtggcacaggaccatgttaaggatacatggaaaagcaatgcttgggtaatagatcatctggtcttgtcattggaagaaccttagaggtcatctagcccagcctccccacctcatgaaggcatccctgccaccaagtcatccagaccagggtgtggttagctcacaagtcctcttggagggcgtaagcttttacaggacttgggagaaggaagaggctatggtccacggtgagaatgagaggggagttggatgatggcttcaaacagaaaaggcagatttttggattgggggagcagtagaaatattctctgcttagccactttagcagctcttcccactctccctccttcttagggtcctgacctgtggccggaagcttctgggtttgtggccagcaacacaggaaaatcccagcgcccgttggagtgcacctaatttccaccagccagacagtgtcatcctgcaggtgaggctttagcccttccctcccagtcaccagcaagaccattccagtcaactctacatttttctcctggagatttgggctgggacagcaggagagagtgctagaacttcaagcgtgggaggatgatgtgactgaagcaactgagggaatatggttagatgtggattgtgaggtgagctctggggtatccatctcccatctcctggaggttaaattgatttcgtggagcctgaagatggggtctgagaccctctgcattcagggctcagcttctgagtcccttgtattgaatcttcatacgtctaagtctgatcaaacctgacctgtgtcctcttggggcttgaggggacacctttgcccctgccagtgactcagtgctttggcaggatggacctattctccagggagaagaggaggagctggtcacgcccaaggtgcacttctcagttcccagcttccccttcttgtggttatgagatactttggtatggagtatgaatgttgacatagaatgaaagctccctgaggcaggtttttttttttttttttgagacaggatctctgtcacccaggctggaatgcaatggcacaatcttggctcactgcaacctctgcctcccaggcacaaatcatcctcccacttcagcctcccgagtagatgagactacaggcgcacaccaccacgcccggctaatttttgtctgtcttatttgctgctttatgcccagactctagaaaatgcctggcacatgttaggattcaatagatatttgttgaatgaggctgggtgtggtggctcatgcctgcaatcccagcactttgggaggctgaggcagggggatcacttgaggtcaggagtggccaacatggtgataccctgtctctactagaaatacaaaaattagctgggtgtggtggcgggtgcctgtaaatcccaggtactcaggaagctgaggcatgagaaccacttgaaccggggaggcagaggttgcagtgagccgagatcacacccctgcactccagcctgggtgacagagcaagactctgtctcaaaataaataaataaatgaataaataaataagttttttgaatgaaagaaagtagacctcctttggagacttggctcactcagctctgatactttagtaggatgaacatctggtggcatagagtagggaccgagtgtcccagggccttctcccagtgtgtggtcttgcctcccctctggcagcagtgtcctctggcaccccatggaagtcaccccggactcagcctggatgcaccctgtgtttcagctgggtgacacctctgttcagagttctggctggggcttgtcccctcacccctcaccaaggtgcatctccaccgaacctcttcctcacatgtccattctttttctctttttgtttccctctcattttttgctgagagttatagctggaaaggactttagagatcaccaagtctaacagggctattttacaaagaacctgagggaaagtgagggagggacaaggccggaatgctggggtgagagaaagaagctgggagtccacacacgctgcctgttttctctcctcacatccctgatctcatcccccagattgacttccccacctcggcctttgacatcaagttcaccagcccccctggagacaagttcagcccccgctatgagtttggcagcctccgggaagaagaccagcgcaagcttaaagacatcatgcagaaagagtccttgtactggtgagacccgggcccccactgaatctgtcatgtttcatctgacctcccagcactgagtctccgtcctcctgctttgggagtggaggtgggaaggggtgggcattgccatctcagcaggaagtggaggcagcccccaggcctttctccatcagctgacactaggaaaagtggagaggtcaaggtcaggaaattagatctgagaatacccaagtccccaccccagggacttggtccagactcagctacccaggaggaccagagctctgccccacatcccagatgtgctatctactaccttctgtccactggggcagctggccccaccaccctgcccccacctcttgctctcacctcctgccccttccacaccaacagcctttgaatttttctggccctgtcactttccaaaaaggatcaggtgtcaaggcaagctggcagctctcaggggtacgcgagtccaggctgatctcatccttggggctgctgctttcacaggattggagaaggaggggtgagaacagaactggaggagctggagggacctggttctgctgtctgctctctgtttacctctctggctcctgcgcagccctgtgcgtgtgttgtgtgtgtgggggcatgagagagatggggctcatctctgtccctgatgtccaccccaagtagctggagtagctgagcgaccgcagacctcccttcccccactctgccgactacacttcattagaccctcagctcccttctcccattagacacctgatctcaggcaaggcccaattagctgcaggtccttgaaagccgacagctggtccctggaggccccaggaggcctctcagcagcacagaccctggtgttgggggaccactgccctctggtggttctattgagcgtggtgccctcagggcatccgcaggaggggtagcagattcggtgcccttggcccatgcattctccatccaagatgtccctgagttgggatcaaagataggatttgggctctggttcccaaactttgattcatattggaatcacctggtgatctgtggcatagactgatgcctggcttccccagccatttggacttaactggtatcaggtgtgacccaggcatggcgagggggttcactcagcccctcaagtgggtgtcatatgcagcaaagcttgggaaccgctgaattgcagtgtgtgcagcactcccttgagggtaagggctgcaccccctggctgatgctgttctctctcactgccccctaccctcccaccaccttctcctttccgtgtgcccaccaggctcactgatgctgacaagaagcgcctgtgggagaagcgatattactgccactcggaggtgagctcgctccccctggtgctcgccagcgcccccagctgggagtgggcttgcctgcctgacatctatgttctcctgaagcagtggacccacatgaaccaccaggatgccctggggctcctgcatgccacgtgagttgtaacatctgccttttctgactatgtgttcttgtagaagccagggcacgacactgcccatcagtgatctgagccagccctggggaaaatggtaaagtgggtgtggatattcagggattttccatttctcctttttgctttttctttctcattttcccttcaatgttatattgtcatttttcaaacatacaacaaaattgaaaattgtacagtgaatacccatgtgcctaccacctagattctattgttagcatttgctctgtgtgctggattgtgtacatttcatttatccatcgctgtatccatccatctatccatcttattttttatgctttttttttttttttttgagacagggtcttgctctgtcacccaggctggagtgcagtggcatgcatatggctcactgcagcctcgacctcctgggctcaagcactcctcctgccccagcctccaagtagctggaacaacaagtgcacagtgcacaccaccacacctgactaatttttaaaatttttttgtagagataaagtctcactatgttgcccaggctggtttcaaactcctgggttcaagcaatgctccctccttggcctcccaaaaatgctgggattataggtgtgagctaccatgcccagcctttttatacattttgaagtaaattacagacaccattaaactccctgctttggcatgcacatcattaactagagctcgatgtttgttctgtttttttttttttttcttttggggcaacatttatacataagcaaatacccaaagtttacctgtacattggctgagttttgacaaatgcatacgcctgtgtaactgaaatccttattacttagttttattttaatcattgcccattccctctttctcttgaagggttctcttgggacccaaggcttccagtcttagatctgttagggctgccttttctagatggtacccaggatttcctgcttatttctcgccactctcagtaatcaaaatgtacctatccatgtgacctgccttaaggagtttttgagccaatggttttgttaatctctgctaaactaattctgccaaggtttattggcttatataaaatactgtgattttctgttatttgcgtggtacattttgcattaaaggatgttaacaagacaaaataatgcttttacccacatcagggccctccaatggcaggaatttctggcacagtgggagtcaagggagaaatctttggagtaaggttgaggactttgtcccattttctttaaatcctccaaggagtgagagtggctacctagttgttcccccatggctcaaggcagactctaaccgtgaagaaggctcattcccaagggttgctatccagggaagttgctaaggattcttctagtgactttagcagaatctagggccattgcattttctttctccatgcctctgaagcccaggtgtgagggtgctgggctcacagctgtgcctcaacttgcagctaggttgtcagggcactgggctctgttttgcagcttcccggaccaggaggtgcgtcgtatggctgtgcagtggattggctcactctcagatgctgagctgctagactacctgccccagctggtacaggtgggtggattggtcctccctccagttttgctggtcccatccccagtatcccaagtgagtctgcattctgccccttagaaaccagagatcccagtgcaataataataagtgtaggttacaggcagttaatgaagcttcatattctctttctccctttcttcaaaacaggccctgaagtatgaatgctacctggacagcccgttggtgcgcttcctcctgaaacgagctgtgtctgacttgagagtgactcactacttcttctggtaaaactgcatgtagaaaagtgggaggtagacacgtgtctttcacgtaggagtatttcactcttaggcacgcaagggcaaggaactgagttgtccgggcttcagtatgtgctgacttaccctgtggccttggaccagcatcttttcctcaggggtctcagctcaccccatgtaacatagtgaggattatgttatcctgtctctcctctacccacacatggcagaaatagaaaggagaaacaagatgcagaggggctgtgaactctacttaaagacagagtgagggcacagactggggtatgggcacaggtgagcatctccatatgagccgtacatacagaatgtattttccctcccaagttcggggtgggttttgcagtgagttggagctgggcctgactctgtctccccctgtacccttgcctttgatccctggagtgccctgactcctgactccctctgccttgcaggttactgaaggacggcctcaaggactctcagttcagcatccgctaccagtatctgctggcagccttactgtgctgctgtggcaaggggctgagagaagagtttaaccgccagtgctggcttgtcaatgccctggccaaactggcccagcaggtccgggaggcagccccatctgcaaggcaggttagtggggtgaggctgcccctacccatttctcatccagggctttggcagccagtttcttcttaggaatcctgaacaacaagattccacgtgacgatttttgattttggagcggggagcagctgactctggaaactaggccgtaaacaggcagtccacaagctggatacagcccgtggatgtgttttgtttgtcctgtaaaatattgaaatttatttagctgtttgttttaaaggctaagcacagttgtgtaagttgttcattgcacaagagcactcagccagaaggggcaagtgagggctgaaatccagccatattttgttcaccatgctgtgacccatggctcaggcctgatgccacccagagaggacacctttatctgtttgtacgaagacattgtaaccagccagcagtgttcctggttaacgacatttaaaaactgagagattttgtatcaacgtccagattgttagcttttcttggcagaagcctaaatagctcttcccccttgagagacagcctgccctctctgtgcactgtggcctgcttcatgctgttctgccatctgctcccctctagagctatttggtcttgctgttagcgtacagtcccaggctggggtgtagggggtcctcctccttaaggatcttctggagggtgtccacacttctcagggggtggttttcataccgactactacggagaacccacccctgggagaggtctggttctcagtatggaccctccatttcacccctgctgtactcctccccttctttccagggaatcctccgcacgggcctggaggaggtgaagcagttctttgccctcaatggctcgtgccgcttgccactcagccccagtctgctggttaagggaattgtgcccagggtgagtgactggtaggtttggggctctcagagtgggagggctcagtggaggtgaggtcttcactaaccaggcatgcaaggtcgaggagctgagttgtctgggcgtcagtatgttgctaacttaccatgtggtcttggcctagcatcttttcctcaggggtctcagctcacccccatgcaacatggtgaggattatgttatcctgtctctcctctacccacacatggcagaaatagaaaggagaaacgaggcagaggggctgtgaactctgcttaaagacagaatgagggcacagactggggtatgggcacaggtgagcatctccatataagccataaaataagagagagattaggaagaaaggcatatctgtggcctcttcccattcctaatgtgtatggacttttagaagcctgacagcttgcagggtagaggaattgggttggaggttgggcggctaggcaggtgtctttctctgatgatgttggggatgaagtcggaggtggtggtggtgatagcagctgtcatctgtcatttattgagcactctctgtgcccggccctgttctgagtgcttaatgttggttatggcatttcatcttcacaactcttaggatgttggtactattgggagtccccttttacagaggagtaaactgaggtgtagatgggacatgtgacttaccagaggtcacacaactagtaagttgtgcgcagaatgaactaacaggatgggaggttaagtgctggagctgaggtcataacaaactgaattgggatgatgactatttaacgagagaaggaaggaaattgggtttctgggaaatccggaagaaacaatgagcaggtcttgggtggaccggcagcagcggggaggcagcatcttggtctgaagtggagaggtcgttttcctttcctggcatgggccactctgaccctcgtcactatcttttcaccatggcaggactgttcctacttcaactccaatgctgtccccctcaaactctccttccaaaatgtggatcccctgggtgagaacatccgtgtcatcttcaaggtgagaatactttactcaagcctggtggaccagggtgggagagagaaggaggcagcctagagtggcattaagtagcccctgggtggttctcttcccactgttccatgctgtcttaatgtaggaaagatgatcaggtgaaaaaggatttagacgaattctgcatggccccagaggcctaacaacagagtgttaggtatagggaggcaactggcagctcagtatcccgaagtgctttctaggaggcagagctccctcaacaatgggttgggtaaggtggtgatccgcttgtcccttgggtattcaggcagaggctgaatgccatgtggcagggctgctgaagaggaaattaatatatcaggtgcaggtccaactagatgaaccctaaggtcccttctaactctgatgtatccacaattctgagaagtaaatgatagtctcagagcatataatctaatgggggagacaaaatacatgcatgtgacttagtaacttatatatttgctatgcgcaagttccaaatccaaagtctaaacgttcaagtttaaaaaaggcctgatggcctgggtgtggtgcctcatgcctataatcccagcactttgggaggctgaggcatgcagatcatttgaggtcaggagtttgagaccagcctggccaagatggtgagaccccatctctactaaaaatatatatatatatatatataaattagctgggcgtggtggcaggcacctgtaattccagctacttgggaggctgaggcatgagaatcacttgaacctgggaggcggaggttgcggtgagctgagatcgtgccactgcactccagcctgggtgacaaagtgagacactgtctcaaaaaaaaaaaaaaaaaaggcctgatggtcagaggggctgcatgcagaagcagaccgtgaatttaattcagatggggccatgggattgcaggacaagctggaacaacacatgggcaaactgggaagcttcctgggccatctttgacctggtgtgagctgagtgagcaggtcaggggtgtgaggctggggaactccctgtcactgttagtttagggccaaggttgagcacttgggagacctgagagctggggaggtagtggagattagatctggtcactttctccctccatccagtgtggggacgaccttcgccaggacatgctaacgctgcagatgattcgcatcatgagcaagatctgggtccaggaggggctggacatgcgcatggtcatcttccgctgcttctccaccggccggggcagaggtcagttgggagtaggggtgagggtggaggaggggacccctttgcttattgtccttctgcccattgccaacacaaactgtgtcctcctccaggaaagtgaaaagggcaagattatttcatgagaagctgtgggatagccttaaaagggaggcatgggagagagactgttataaagtaaaacagacttggtgccgtgacagccaagcatattgtgtagactttggatcctgattaaaacaaaccaattgtaaggaaatattttttgggccagacatgctagctcatgcctgtaatcccagcactttgtgaagctgagatgggagaattgcttgagctcaggaatgtttgggaccaacctagacacctcatctctaataaaaattataaaaaattagccaggcctaatggcatgtgcctgcagtcccacctcctcgggaggctgaggcagatggatcgcttgagtccaggaatttgaggctgcagtaagccatgatggtgccactgtacttcagaccaggcgacagaatgagaccctgtgtgaaaatatatatagagagagagagagagaaggagagagacagttgggggaagtttgaatatagattgagttagattaaagagtgattgttaattttttggatgtgacaatggcatggtgtctttgttaattacacttgaaatatttatgagtgaaataaagtatctgggatttgctttaaaatactccaaccaaggtggcagggagtggagaaatagggttgtgtgattagcaaacaagattagcaaaatgttgacaatttttgaagctgggtgatagttacatgtgaagtcatgataccattctttttattcttatatatattttcaaattcccatagtaaaagctaaaaacaaagggagcagcagctatgaactggagagaccaaaaagtcacagtatggaataggaaatgtgggaatgaccttcctttctatggttattctcttcctgttattatcagacttagtccaaatgccttacagcttaatttatagggaagcatgagcacagtccttgtagtcctctccctgcagtccccttcattctggtctggaacgtgacccccatttctcccctcacagggatggtggagatgatccctaatgctgagaccctgcgtaagatccaggtggagcatggggtgaccggctcgttcaaggaccggcccctggcagactggctgcagaaacacaaccctggggaggacgagtatgagaaggtagggttgtgggtggggagtgcgtctggtgtgtgtgtgtgcctgatgccggcacacagctctttaaccacaagacctgcacttgctcagagaggacagctcagctttgttggcagaaggacctaccctttcttggttgactggtgcctccaaatatctgggggtgactcactcaaatgcctcttgtaagctggctgagaaaatcccctgatgctggactgagaaactttcactgagttctcctggcagattaagtcttggaggaggcgccagcttttgagagcctatctgtatccctcccagttgtggatcctcttcaggttcccttatgttctcagagggttcagtggtactttctagaaaaagagttggttggaagagactttagagatcattttatgccagccccttcttttcatagctgtgaattaagattcactcattcattcctagttatggagctgatatgtggcaaggctgtaactcaaagctaggattgaggttagatatgagacagagacgagtgaaaacagggctggctggttcctgatgaaagaagattagattagaagtggagctttcctgggtggtagggccctggtagcctgctagggtccgtggcctgttcccagcatcacaactctagtctctgggttaattaggttgaggaaagtagggacactgggaaggaacaaatcacaataaccaaactcacaagagactggctataggccagaatgctaattcgtataattttaacttcaagggacccaaatactgatttatattgatcaatgtactttatcctggagggaaaaccagcatgggcagccaaggtataatcagaacattgtttagtgaatgtgtaattagatgatcttaaatggctttcagtgtttgtgttccccggggcttaattcctggcctgctgggccctctttgcactcttcttgtgccagctcatcctcttattacttcaactaccacctgtatcttgatgacctccgaagccattcctctagccctcttcccttcctccaggtggttctatagccaccttcttgctggacttttccacctacgtttcacccacgtctcaaactcggtgtaggcaaaactgagcctgctgtctctcctttgcctcttgaaacctgctttttgtgtttgctatcagtcaatggtgtgactctttctgtgcatttacccaagccaaagccacggtcttcctgatgcttccctctatctcacttctgtaccatgctctgtttattcttcttcccagctatctctcaaatctgtcctcttcttcctattttgttaccattgattttgttcagctctttgctgtcggtcccctgaaccactggaatgcctctcctccatctagagccagcctctgcttgatttcagaggtgttttgttgttgttgttgttgttgttttgagacagagttttgctcttgttgcccaggccggagtgcaatggcacgagcttggctcactgcaacctccacctcctggattcaagcgattctcctgcctcagcctcccaagtagctgggattataggcgtgcaccaccatgcccagcgaattttcatatttttagtagagaaggggtttcaccatgttggccaggctggtcgcgaactcctgacctcaggtgatccacccacctcagcctcccatagtgctgggattacaggcatgagccacagtgcccagctgttgtttttttttttaagtgtggataagttcttcaaagcctctgtgtatcctaacagatagcattgcacacagagccttttataatccagccctgctgactcctgtaatcccatccactgcaacctaccatcttatgctaacctatgctccagctaggttactagctagatcatgcggtgggggcagagggggctactactttcatttctgcagtactgtaggcagtaatatttcctttgcctggaaagtcatttcttcccttctcattcctcaaaactctgccactctatgctatacatttcaagaccctctacccttggagaggagtaatgatttttttcctttctactaccaacctcccatatacttactctttatgctaatatgcatttttcaggtattaaacacccatatgcagaggcactgtactaggtgctggagttgtgattactccctgccaatgtaatagtcatatatgtgtaaatgtatggaaataatactaaataataataaatgtacagatgaatgtataagaatataataaaaataaatgtacagaagaatgtacgagaatacacacagagagaaactaactctgcatgttcatgtttaatctcagtctttcaaagatagcttctctgcccttctagcctttctccaagaataatgctggtagtttctttttttttgaggcagggtctcactctgtcacccaggctggaatacagtggcacaatcactgcaacctccacctcctgggttcatgtgatcctcctgactcagccttccaagtagctgggactacaggcatgtgccaccatgcccagctaatttttctatttttcgtggagatggggttttgccatgttgcccaggctggacttgaacccctgggttcaagagattcacccacctcagcctcccaaagtgctgggattacaggcatgagccaccacccccagcaatgctggtagtttcatttgatgacttccagaagaaagaaactagaggtattttctcttggccacctactcagcaagagagtatcccacaccctacacatgaaacccctgaaatcagaggcagagtgtccctttatagagtgagacttcttgccagtaagtggctaacaccctgcataacttagggaggtgaaaagagtttagtcatttacccacaggcacacagctattttctcagccaaaataggattcatttaaggtagaaagagcatctgtgacagggagaggatttgatagagatccaggtcacgactgggagttacgcgttatgctccttattaagtgcttttattcatttattttactttctaagaaatagtctttttcttccagaagatgaatgctgtgatttctttataacctttccattcttagtttctggtggatccatcatcaggttgtaattcgacaagtagctgggtgggtgcattctgtgtggagctagttttgcaataggcattgtgaaataggcaagaagctgttaggagaacagatctgtaaaccccatgggactgaaagggcaaagtcagtgctgtatgaatggaggtgacagtgcatctgtaggggttcagaggaggagaagtcagtatgagcttggaaggtctggaaagttatgggactcaaggtcattgaaggatgatgggtggaaatttatggaaggaggcaaggagggcgggcattccatatctagtaagctttccctcattcctaatttcatgcattcctacctggctatgacgatcattgctctctgctgatgtctttcctgagttcttaggaattctataaacctcacgaagaggattttgaaggcaggagtggtctatttcctcattccatgtagtttttctttctggaaagacagataaggggatggatgttgaccagacaaaataagatggagtcaacccctcaccactcctctcctgctttaaactcagaaatatctctaacatattttaccaactaaagatgtcccattttcaagtgtaaaacactctctagacgtgttaagctgcctcagctcttctttggagtgcagtgactttaattagattagcatttagctgttaccaagaactctggaaatgggaattttatttggggcaggaagaaggatgatagaattctgagcagggtcaggaagagattcttaagttggcttcctcagtggctgtacttaagatcatcacggccagttggggaagttgtaaatgtcagtcttcccatctcttaaggtcccctcagtctgggctgatcaagactgggctcttggatcagtccactgtctttccaaccgatctccctaggagaaagaaaggagaagatggtattcagatgaagtggtgaagatatacatataaatctccatcttttccataagacatgggagatgtttctgtgtgtgtaagtgtgtaagttagtacatgatgaaggatgaacaggcagatgtgagacactattggggttcacagaagagagagaggccagggctggctgagttctgtctggctgtggcccctggagtccttccaagccagctttatgtcctctcctcccatctgccttgacccctcccaggctgtggagaactttatctactcctgcgctggctgctgcgtggccacgtacgtcttgggcatctgtgaccgacataatgacaacatcatgctgaagaccactggtcacatgttccacattgattttggccgcttcctgggccatgcccagatgtttggcaacatcaagcggtaagtgatctcctgaagccagattgtgagtgaagggcaaggaggtgagcaacagtggttcagagctgggacacaagcccatgatggaagcagctgggcctcagatcatggtcccagggctgagcagcattggaggagagaagacggataaagaggtcaagtccttgcagggccttgcagaagaatgcggggaccagctgttcttccctaccaaggactgaacaaagggaaatgaaccaaactgtagcaaaaaggaatgcaatcagatatccagaaaaaaatattgccagctcacagataaggaaccaatgaaggatatagagatcttttaagattaaggtaggaaaggaacaaagaaaaaagttagagccccttctatccagtgtgtccacgtgatgagggatgagggaaactgacccctgatgcagcccatatggtgggcttcctcctccatgttgaccttctacctgtatgttccccttggctcagggaccgtgccccctttgtcttcacctcggacatggcgtatgtcatcaacgggggtgacaagccttccagccgcttccatgattttgttgacctttgctgccaagcctacaacctcattcgcaagcacacccacctcttcctcaaccttctgggcctggtgaggagctccatccctttccgaataccttcttcttattatctggcatcatctttaagacttccctgtcttgccgcagaggatttctagagatttacctctctgagccccaactgaatacctgcctgccctagataaaggcagggacccagactacctgaggacaatgatgtctgtgtaggtgcctgactccctgctccagcccttcagttcctgtggccctccagccactgcccacagcatctgtctaccaccctctagaagggttagggagcctagctgtagaaaaccttgcctaagggtagagaagcagcaagaattctctgttgttacaggcaccctctcttcttctttctgctccttctagatgttgtcctgtgggatccctgaactctcagacctggaggacctcaagtatgtgtacgatgccctgaggcctcaggatacagaggccaatgccactacctacttcactaggtaaaatgattccctgagcgaatcagcactgcccaccctgagtaattcccagcctgccggattggcaggaggaggactggggaaaggtgaaaagcttagctcagatgctagagcctagagctgaccacgtggatacattgtcccaactttgcccgtgatttaggtaaatcattttgcttctctcagccttggtttcccatctgtgttttggtgctaacctttgcacacaagggtattgccatcactcttatctacattctcactaggtcccatcaaatactttgtctatggggcaatgtataatgtggcttttgtaataacttttaactttcttggtcagacgcttcccccttgccagaacatggagttccatgattcagtctcctcatatttgacaatgtttttaggtacactgtgtgtgaaagcaaggatgtgtttatctatgaatgcctgcaaaatgtggtccctgtagataatgttctccactctttttggaattcagagaattaaactttctctgttaggtctcctaacacaggacctctcccgctgaattgaaatctgagattgaacagtgcttggtgaggttctattgtaatgaaccttgaaattttttgatatttagacatttacacagagagagtgagttcctagttcctttctaccttggtttgatggtttttggctcaggtgggcagccaggggaggagataagaccctggggttcacatgagcaaattgcatgagattattgtgtgccagtcatttgctttatgaggatatgacacaggaaaatggtttgatctgagctgattgttagtctcaggagtcaggaatattccttggaacacccctgtcgaggcagcaggaatttgggttcatggttatatcctcttttcttatcctcctgccaggttgattgagtccagcctgggcagtgtagccacaaagctcaattttttcatccataatctggctcagatgaagttcacgggctcagatgaccggctgaccctctcctttgcctcccgaacacacactctcaagagctctggccgaatcagtgatgttttcctctgccgccatgagaagatcttccaccccaacaaaggctatgtaagtgttttctccaatctgaccccctttcctgctctctgctgaccctggcttgctgggatcctgactttttccacacttgcacagtgggcacaggagttgaccgagcgtcctgtgctgggagcagtcctggaccacttccctctcctttgctcacgtgatctgcctagaattgggtagctgaattggatggttattccctctgagtcaaggatcctggcaacatatgtgggaagtctgcttttagattcctgtgtatgtgctatcatctgtctccactcttgctctcttccttctggaatgtgcccctcccctcagcacatacatacacttccggacctttcctacacccttcactgggtgcagagggctcggcaggtacaccctaagatctggacctttgcagatatatgtggtaaaggtgatgcgagagaacactcacgaggccacctacatccagcggacctttgaggagttccaggaattacacaataagttgcggctgctcttcccttcttcccacttgcccaggtagctgccccctttactatctgcacagagggatgtcggggagggggaaaggatacgggatgggaggtggtcagggctgcaggggcagaaaatacccttttggactaaacatctgcctgctttgcttggcctggtatggagtttgatgacaagtgctccccctgctggccaagctctccttgcacgcaagagctctcactccaggcccactggccagaaaggaaggcatggttgaatctgatgtttcaaaatttctaattttttaaagagttacaccatttttcaaatggataagcaaaatgtcatatgtacatacagtgggatattattcagcatttaaaatggagggagatttcgacacgggtaacaacgtggatggaccttgaggacattctgctaagtgaaataagccagtcacaaaaaaacaaaaacggcacgattccacttatctgagttacctggagtagtcagactcctagaggcagaaagtagaaagctagttgcccaggtctgaggggaggtaggtgtggttgtttaatgggtacagagcttcagttttgcaagatgaaaagagctatgaagttggatagtggcgatggttgcatgacagtgtgaatatggttaattccacagaactgtacacttaaaaatggttaagatggcaaattttatgttacacatattttactgcaatttttttaaaaactacttttcaggccgggcgcagtggttcacgcctgtaatcccagcactttgggaggcctaggtgggcagattgcctgaggtcaggagttcgagagcagcctggccaacatggtgaaaccccatctctactaaaaatacaaaaattagtgtggtggcatgcttttataatcccagctactcaggaggctgaggcaggagaatcgcttgaacccgggaggcagaggttgcagtgagctgagatcacgtgactgcgctccagcctgggcggcaaagcgagactcagtctcaaaacaaacaaacaactttttaaatgaattttttggccgggtgcggtggctcatgcctgtaatcccagcactttggcaggctgaggcaggcagatcatgagctaaggagtttgagaccagcctggccaacatggtgaaacccccctctactaaaaatacaaaaattagctgggtgcggtggtgtgtgcctgtaatcccagctactggggaggctgaggcaggagaatcgcttgaacccgggtggtggaggttgcagtgagccgagattgcgccactgtactcccgcctgggtgacagagcgagactccatctcaaaaaaaaaaaaaggatttttacatcgatgggagaaactgagggctcccgagccatttctggggagccacaggactctggcctgctgtttggttttcttgtctggggcccttggaaatgtagtcatgagatgctgagcaggtgtcagacctgggcacagatgtgcagcacaggaggaattgtgagggtccctagaaatggaggctgctgggaaatgggtgctaggggactggaaacgcaaatgaaatgtgaaaaaagcccattgtgtccattttctttccccatcttcacctcctgcatccccgctgcctacgctgccacgccagcttccctagtcgcttcgtgatcggccgctcccggggagaggcggtggccgagcggcggagggaggagctaaacggttacatctggcacttgatccacgcaccccctgaggtggccgaggtgggtgggcttgcctctcctcctggctgtccaggctggtggggatggttggggaggcagaggtggaagcatccggaggcactaggagtcaggaacaggacttggcacttcggggtctgtgggctgaatgaccaatgctccagtctgcagaagacaggaggagggtgggtccagcctcacagggttatacacagaaatgcaattaaacagaaaggtgaatgcatcgaggcacatgggctgagaatgatgagaatgagcggagcctcagaaaggaaggctcctctttgaggaaaaagttttttgagcaggttgagtatgtattatcaacctagatttttttttaaacaaatagtagtataatggccctaacaaagtcatgaggaatcctattattaaatactttaacaaatcatctgcccctattgtccatgttcccttcctatttgtccatatgcaagcatgatttttacagttttatagtggttatagcttaagtataactctggattctgagcttttttcccttagcatttatagtatacatatgctataactttaaatatctgttccttcagacaccaacttgcagtaccataatcttaaccattttatttttgaaagatatttagagtatgtgttttttttccccattaatgttcaagtgagtattttcacacagtttgtttgttttttgagacaggatcttgccctgtcattcagtctggagtgcagtggcacaatcacagctcactgcagcctccacttcccaggctcaagcgatcctcccacctcagtctcctgagtagctgggactgtaggcatgggccaccacacccggctaatttttgtatttttttttttgtaaagacagggttttactatgtcaccaggctggtctcagactcctgagctcaagcgatcctctggcctcagcctcccaaagtgctggaattataggcatgaaccactgcgctcggcctgttttttctttttaaactttttagggttaaaactttcaagcatgcagaaaagtagagaaacaatataattagcacctatatatccatcacctaaacacttaacattttgctatatttgcttcttctattttttatgaagtattttaaaataaataacatgccaggtgcagtggctcatgcctgtaatcttagcactttgggaggccgaggcaggtggatcacctgaggttaggaatttgagaccagcctggccaacatgtctctaccaaaaatacaaaaattagctgggcgtggtggcgcaggcctgtaatctcatctacttgggagcctgaggttgcagtgagctgagatcgccccactgcactccagcctaggtgtcagagcgagactccatctcaaacaaacaaacaaagtaaattacagacatcataatactgtaccccctaaatactcactatgcatctctaaacaataaagtcttgtttttaaagtaactacagtattattatattatccagtccatagtccatattcaaaatttccctatcatcccccaaattccttttactgttggcttgttagagctataatccacataagaactgcatgttgttggttgttatatttcctaagtctttttacatctggaacagtccccttcctttttgtattgggccattgtcttattgaagaatggccctgtttctgattctgttccagtgtgatttggtgtacaccttcttccacccactgccccgggatgagaaggctatgggcaccagcccagctcctaagtcctcaggtacagtatcttctctgagaccttactgccaactcctctgaactaccccaagggtaactgcttctgccccaacctcttctcagttctctctccttgacttgcctcctgttccttttcttactctctgggaaatctagtttcccactcaggccgtggggtccatagttccttacctgggttccccacagggtggatattcagtcgattatatccttagacccatcccaacccaattaactctaatcacattcagactacacttatgtagatgcctcatgagtatcagaaatctgacatggagaggctggggcaagggggttcaggaagaaaacagaaacacctgcctggcctcttgacccttcatggtttcatttgtccctacagatggcacatgggcccggcccgtcggaaaggtgggaggggaggtgaagctgtccatctcctacaaaaacaataaactcttcatcatggtgatgcatattcggggcttggtaagtgcctgcacagccgtgattttttttcttttttaatgtttctttagctacttttttgggcagaccttctctgccgcgtgtcatatgggtaaccaccacagtctactgagcatccaccatggacctataaccatagcaagcctatggtatgactaggcaatacatgagacagctttttgtagctgtggtctttgacaagtaacctaatcattctgagcctcattagaatgaggaaaatgttagcacctacctcatagagtcattatggggattaaatgagataatgcttgtggaatacttaacaccatgcctggttttattagaataatgatttttatagtaattataagggagaggcccaaggggctcattacctggctataatgattgagcagccacgtgacatcctttgaatatgatcaaggcagtagtagataattactaaatttttggtacgagttctaagaacattgtgactagaagaggaagggaacttttttttttttttgaaatggagttttgctctgtcacccaggctggagtgcagtggcgcaatcttggcttactgcaacctccgcctcctgggttcaagcgattttcctgcctcagcctgagtagctgggactacaggcacatgccaccacacctggctaatttttgtattttttaaaattagagaccgggtttcactatgttggctagactggtcttgaatgcctgacttcaggtgatccgtctgtctcagcctcccaaagtgctgggattataggtgtgagccaccacgcccagccaggaagggaacttgaatacttgcattgtgctgcatcctatgttaggcattttatgtaggttggggcagtgggatatggcaggaggaacataaacattcatccatttactcttcattcaataaatgtttgagtgcctgctatatactgatacattagctctgggtatgggggaaaacaaaacaaaatccctgccctcagggggcttacattctagttgggaacggcacacaggcagataagtaaaatatatggcatagaagatggtagtaagagctatggcaagaaataaagcagagaaggaatgctaggatggaatgaagggagtggactttgcaaagagtgctcagggaaggcctcattgttgaggaggtgtcttagcaagatggagaaggtgagggagggagccatgtttatgcatctgagggcagactttcccaggcaaagggagcagttagatctgacagcccagagccaggagcctgccaggggtgcgtcagaaacagcaaggggccagcggctgaagccgatggagcaaagtcgagaggagtggatgatgaggttggagagggtatgatggaccagcacctcaccctgatagtaagaaccgtggctttttccctgaatgagatgggttttaagcagaggcatgacatgatctgacttaggttttaaaaggatcaggctgggtgaatcactagttggctgcccttgagcaagcagctcaatctctgtgactcatgtctctacctcttaggggttaagtggaccaaatgacaaaatagataaggatagtagatatggcaggaagatacctgggaacatgatggttcactcaaaacagagcacattatgggatgtcctgaggatttggataaaagtatagacttgatatcataggcaaaccaattgatgttttaataggacacaatgttatcatggtagatatttttatcagaatagagtgagcttggaagcagacaaataaattagttgtgcattgcaagatgccagatggcagatgagagtctggatcagagtgtgatcacaggaatggtggtgaagagacagatgttaaaaatcttaacatttttttggttctcattctattgtagcaactgctccaggatggaaatgaccctgacccctatgtgaaaatttacctccttcctgaccctcagaaaaccactaagaggaaaaccaaagtggcccggaaaacctgcaatcctacctacaatgagatggtgggtggggaaaatggtggggtagggcaggggttggcaacctgcgcctgttctcctagataaagtcgtattgaagaacgtattaagatgttgtattaagaacatggctgtacttgctgatttaggtgttacctgtagctgctttcatgttgcaatggcaggatcgagtagttgtaacatagaccatatggcttatcaagcctaaaaatatttactatctgtccctttacataaaaagtttgccagcccttttgggctgggatttcatggctggggtctggccctatcctgtgggaaggagaagcctgctggtcctgtgctgaaaatgagcagtggccccaatacaaagccctcacctgcttgaactctgagcaaagaacagagttcattaatgcttcccttggagtctgtgtaccttgtgtgccttctgtattacctgggactctgcagggtgagtgctagcctcagctggatcagcccccaacagactttaccatctccctctcgggttccctctggattcttcttgttccttctctcaccacttccctcacccatctctatgtttgcagttggtatatgatgggatccccaagggtgacctgcagcagcgggagctccagctgagcgtgctgagtgagcagggattctgggagaacgtcctcctcggtgaggtgaacatccgcctgcgagagctggacctggctcaggagaagaccggctggttcgccctgggatctcgaagtcatggcaccttgtgagcccagcagagccaccacccagcatcccaggctggtggcaggagctgggggagaggactctcccctgtgagactcctccttgtgaagggccagggccctgggcaggcctccagctcggtccaggtgattctggcctctgtggtaggaggcagggagagtaagacatgctctgctgtctcttcctctggagactgaacttgggttggttgtgatgagcagccccttggaggctgtgaggttgcagcaaagttttaagtttaccttgtgtcaagggagcaatgcttggtttggggagtgtgtggggtgggctgtatgaagtagcattttgggggtgggtgggtggatatcttaatttttatttttaaaaaatgaaatagtgatgttgtcctaactgggacaggaagccttgcgagaagggacgtacctatgccccagaaggcaagagaggaagactatttggactttttgtatgattaaggttcttattggacttttccctaggttttttttttttgttattgttgttgttgtttcgttttctagctataggaactatctggggaggggcccagtgggtcctcggccagagccctctctaaggacaggttggggagggttggggagggctgcctgtgctggactgaggcttgtgccactgggcctttctgattttgcctccaaaggagagcgctgtgatacctacatgtgtaaggaagggccttccgtattggggttctgccaaggacccgtattcagggacccatgctcttttggggggacttttcctcttgtcttccctactttattaggacttgccctgaataccattttctaccccttgcccctccattctcctggcccttctgggggtcagctggtctctatgaatatgctgggggtgcttccccataggtctctcccttcatttgtctctggtgggacaaaatactgactcagtccttagatgtagtttcacccaagagcatcttggccctgggaagaggtccctaggctgcagatgctactgactgcttgctaggtagcctctggaaagcattccccatccatcactccccacttctttctgctgtgctgcttccctcccaaactccatttctgtcaccctttttataagacttttcctcattctgtggggccataaacctatttagtctggagccaaagggatgccctatctgaaggaaaggggcatggggtgggggattccatcaaaactgttgttttttgccccatgatttttctttggtcagtaggaggctggattggagtggtgattattcccctggagctaagctcaggagcccgaagggagagactgagactgactcccttatctcttcatattctttattccctaccagatggatttttttttttttttttggagacggagtctcgccctgtcgccaggctggagtgtagtggcatgatctcgactcactgcaaaatctgcctcccgggttcaagcgattctcctacctcagcctcccgagtagctgggattacaggcatgtgccaccacgccaagctaatttttgtatttttagtagagacggggtttcaccatgttggccaggatggtctcgatctcttgacctcgtgatctgcctgccttggcctcccaaagtgctgggattacaggcgtgagccaccatgccccgccccagatggattttacatttgctcttttgtgtttcgctccaaagggttgtcttcctcgccaaaaggagggagggactttgaatttgatatgaatctttaaaaccagaattggctggatatttcccatgattgggaaaagagtgaaatgaggacattctgtaaactgtccctccctaattccaaggatcagaaactccccgttttgctgactcattccataactggagaaagaagctccattgaccgaagccacagggcagcatggaagtttaaattttctctaaaattaaaatgccaaggataaagctggctgcttccaggagggggaagaggagtggggagtgggcggtgaaacttttccagatgaacggaccataaatgtgttactggctttgtgcctgtagctcattttattatgacctatatgctcctgatttaaagagatctgtgtactgtttacttcccacttcccagaatcccttgtatctcctttctcgggaattgtattttctaataaatgacatttgagaaaaaaatgaaactataattttatttatttttttgacacagggtctctctcagtcgcccaggcttggagtgcagtggtgagatctaggctcactgcaacctccacctcccggactccatccatcctcccacctcagccttcccagtagctgggaccacaggtgcacaccaccatgtctggctaatttttttttattctttgtagagacagggttttgctatgtttcccaggctggtcttgaactcctgggctcaagtgatctacccgcctcagcctcccataatttttaaaagtaatttttagtagagccaaggtcttgctacattgcgcaggctggtcttgaattcctgagtccaagcaaccctctcaccttgtcctcccaaagtgttgggattacaggtgtgagccactgcacccagctgaaactatcattttaaagattggttgatgtttggctgggcagagtggctcatccctgtaatctcagcactttgggaggccaaggtgggtgaatcacccgaggtcaggagttcgagactaacctgaccaacatagtgaaaccccgtctctactaaaaatacaaaaattagccaggcatggtggcatgcgcctgtaacctcagctactcaggaggctgaggcaggagaatcacttgaaccagggaggtggaggttgcagtgagtcgagatcgtgccattgcactccaacctgggcaacaagagtgaaactccgtctcaaaaaaaaaaaaaaaaaaaaaaaaaaaattggttgatgttcacatgtttacattgaaacatctgatgtatgagatgaaaataataatagtggttttttataccaccacatggtaacttttatatgcactagtgcactgcactgaccatttttacatttgtcagctaaatctatcctcacaacaacttgatcaggtgtgtaccattacccattttacagatgaagaaactgaagctcagagggatgaagtaacttgcctaagggcacacagccaataagtcttggagtttgaacccaggtttgttgcactccaaaccttgtgcaacccctcctaggcaatgtttaatacaatcccttaagttggtctaattggtatttcgggtgctttttatacatgatatatatcatcttccattaccactgccctggacagtaagtatggctcattcatgaattctgcaacaaacatttacagttcttaccagtgctacctagtggcatgcctccattcataaaaaaatacattgtattgaatgcatcctgggccctgtactctaggtactggattggggcttaccaaggtaaattaagacagttctctgcatttaagaagttcactaccagggccaggcacggtggctcacgcctgtaatcccagcactttgggaggccgaggcaggcagatcacgaagtcaggagatcgagaccatcctggctaacacagtgaaaccccatctctactaaaaatacaaaaaattagctgggtgtggtggcgggcacctgtaatcccacctacttgggaggctgaggcaggagaatcgcttgaacccgggaggcggaggttgcagtgagctgagattgcgccattgcactccatcctgggcaaaaagagcgaaactgtcttaaaaaaaaaaaaaaaagaagtttactacctagaaatatttgaccaactccattttataggagaaaaaactgaaacttgagatgcctcaaaactatcaagccactacagcataaccatagcccagaagggaatcccccaagtgcaggatggaagtgaagtgacccttgttcaagcattgtacccagaagtcttcagaactctccagtggggagtcatgtttcatactggggaattctgtgggggcttccagggatttttcagtagtaaacagtaggaagtgttactgctttatttctaagtggtcttgaggtgtcactgcagttctgggcaagtccctatggactttttaaaggttagtacttgaatc

SEQ ID NO: 17259 - DNA, 28165 bp, Human
tgtcacccaggctggagtgcagtggcacagtcttggctcactgcaacctccaccttgccagttcaggtgattctcatgcctcagcttccttagtagttgggactgcaggctcgtgccatgcccagctagttgttgtatttttagtagagacagggttttgccctgttgcctagtctggcctctgttagaaataaattttcgaagctgcaaatgaatatcactcaaacataaatttaattttctcagcaaggcaattttacttctatggaagggtgcatctcacggatggagcaatggtgagagcacacctgaacaagggaggggaaggggttcttatccctgacgcaggtagcccctacttctgtgttgttcccgtattggctagggttggaccgcacagtctaagctaatactgatgggctattttaaagagagcaggggtatgagctggagtggctgggcgagtagtatggcgggaagaacagttacagaacaggtgactcaggatgactcaggtcaagggaggtgaccaggagtgactcaggatggagcaggtgatagaagctaggagggggttgtttactgaaacgaggggcaaggagatgaagagaatgaggaagttaaacttttaaagttttaaatgaagaacaaagaacaggggagctgaacatacagatacattggttttttggagagcatctcagaactcattgtacttaacaatttacaggctaaaacctttgaagaggaatttattaaatcctacatctcaaactcctgacctcaggtgatctgcccatcttagtctcccaaactgttaggattacaggcgtgagccactgcacctggcctattctagtcgccatttaccctttccctgatgtggcttgttagtcatcagttttaataattgttgccttttgttagaaaaaggcataaatgaaggttaacttaagtttatttaaaaatctattttccggctgggcatggtggctcacgcctgtaatcccagcactttgggaggctgaggtgggcggatcacgaggtcaggaatttgagaccagcctgaccaacagggtgaaaccccgtctctactaaaaatacaataatgagctgggcgtggtggcgtgtgcctgtaatcccagctactcaggaggctgaggcaggagaatcgcttgaacctgggaagcagaggttacagtgagccgagattgcgccattgcgcttcagcctgggggacagcgagactgtgtctcaaaataaataaataaataaacaatctatcttccttctctgtagcttttgtttttttaaggataaaaggtaggtgaaagattttcattgaactttactctgtatttcacttcatgctacatcttttctttgatggtatatgtccatctcggtttaacccattttgtaggtttgtaattgctgtgtttttttctggggttggtacatttacaagctgttttaactggtacttaaaatgttgactcttagttaactttctatggtcctttgtcaagacatgttccaacatgttgtagaggttttcctagaagtcctgttggaatcttaaaacctgtgacttaccttggtaaatccccagtcttgcatctagagagtgctctacctgataaccattggggagataatgatttgactttcagctaaaacagtttactgattaacatcagttggaggttggagcgtgcctgaaactgttactgtttcagccttcacctgagagaagcttggacgattcttactcttaattaaatcagaactagaaagtagtcagaagatatgcagaacctcagcaagggtatacagcatttgtgtacggtgctccattatatgtgtcatatgtgtcttttacttctgctggttgcctttgtgtgaatgctaaatagggaattttctgcattagaatagatgttataaatttttttttctatttagttttaccaacagactgcagtttcttcactaccaaaatgacatcattttccacctctgctcagtgttcaacatctgacagtgcttgcaggatctctcctggacaaatcaatcaggtaaatcattttcggtatttctagttttttggttttttttttttttaatttttaaaaagtttagctgtctcatgactgtaatcccagcactttgagaagtcaaggcaggaagcttacttgaagccaggtgtttgagaccagccttggcaacatagtgagacctgtatctctacaaaacatttctaaaagaaaaaattagctagatgcagtggggtgtgcctttagttctagctacttgggagcctgaggcgggatatcacttgagcccaggagttcaaagctgcagtgaattatgatcacaaccagtgcaccccaggctgggcaagagagtgagaccttgtctcttttttaaaaaaagtaggggaggtgggggttgtgctgggcgaggtgggtcatgcctataatcccagcacttcgggaggcggaggtaggcaggtctcttgagcccaggggtttgagaacagccagggaaacatggtgaaaccccctctctacaaaaaaatacaaaaattacctggatatggtggcgtgcacctgtagtcccagctactctggaggctgaagtgggaggatcagttgagtctgggaggttgaggctgcagtgacctgtgatcacaccactgcactccagccaaggcgacagagcaagaccttgcctcaaaaaacaaaagcggggggagctgtttaaagaggttctcttgttccatagtttcagaaacctacttgaaatgtaaatagcacatttattttatgtttatatcaggtacgaccaaaactgccgcttttgaagattttgcatgcagcaggtgcgcaaggtgaaatgttcactgttaaagaggtaagccatcaaataaaattctcattttttttgttttttttttttttgagatggagtctccctcttttgcccaggctggagtgcagtggtgcgatctcagatcactgcaagctccgcctcctgggttcacgccattctcctgcctcagcctcccgagtagctgggattacaggtgcctgctgccacgcccggctaattttttgtatttttagtagagatggggtttcaccgtgttagccaggatggtctcagtctcctgacctcatgatccatccgccttggcctcccaaagtgctgggattacaggcatgagccaccgcgcctggccaaattctcagttttaagaacagttgagaagtagaagccagtgaatatgtagttttgaaatcaggcctaagaaaggaagttctactcctgaggtatcagaggggcaacttatactctgttttaaagactgttaggttgaacatcatatttcctttcttttgaagtgtgttataagataaacataagatgaaccatgaattcattgatcgtagagttaaaatgcagagcaagtaaagattaaaaagacactgggcctggcaccatagctcacgcctgcaatcccagtattttgggaggctgaggtggagggattgcatgaacccaggattttgagaccagcctgggcaacatgatgaaaccctgtctctaaaaaaaaaaaaaaaaatacaaaaattgggcgggcatggtggtctgctcgtttagtcccagcagctacatgggaggctgaagtgggaggatcgcttgaacccagaaggtgaaggttgcaatgaggtgcactccagcttggttgatagaatgagagaccctgtctcagaaaaaaaagacactgtctgatttacaggctgtattttgaggcaggaattaaatgcagtagtttttattataaatgtgtcagatatggtggctcacgcctgtaatcccagcactttgcgaggctgaggtgggcagatcacctgaggtcaggagttcgagaccagcctgaccaacatggagaaaccccatctctactaaaaatacaaaactagcttggcatggttgtaatcccagctacttgggaggctgaggcaggagaatttcttgaacctgggaggcggaggttgcggtgagccaagattgtgccattgaactccatcctgggcaacaagagtgaaactccatctcaaaaaaaaaaaaaaaagtgtcagacactcttctgagcactgtgagttattttaaacacatgcatttaaataacttatttagcttctgaagttttttaaaaaacaatttgtattctttaagtggaaaagactcagtattaaaatgttaatgttgggaactgctttcatttggtggggtagatatctaacccttcctaaagagaagaaacaaaattatcaggcttttttttttttcgaacttaaaaccttcacacctatcaacactgccacactccagaaccattacacttctcaaggagacaaatctggaggcatttctgattttttagaatacctatattacttttacgattttaaattaagcacatcgttttggagtataaaatttgacacgtaagacctttttttccccaaacttattaaagtctggaattttttttttttttttttagttttatccttttattgaagcttacaatttcactgaacttttggccccaaatgaaaaaaatgcaaattaaaaaaagtattggcaaggagaggtgaccactgtcccctggagatggaagccgagcagagcgtggcaggcaagtgagggatcccagctgcggaggcagtagcctggccaaagatgcccagggaacagatttgtctgagcagggccagccccaggcagctagaagttaatacccaaggatttatgggtgtgatggaatccaagccactggtcccaggggcaaatctctctcatgcttggtcagattccactttggagaaaatgggctcatgtgacaggatggcctggtgagggaacacaggtgctaatggtaacaggccagtgaacactcgccactggcatcagggtggagctcagctgactggacactaactccattacaaggaccagaatctcctgcgtctggtgccaggctgtgccactcaactgctcatggccgtcgggacattcagctttcatcctctccttcatcaggcccctacctgtgtggcctcagccctggtcctcactatttggtggctgtgatgcaggactctcaaccctcttttggaacagtgttgcatcaagcaagggagaatgttcttctagagggacaggaaaagaagagagaggtccacgtacttctgtcactctaggaagccaggaaaggtccctggtgcactccactctccacagatgggttgggtcatagcatccgagctgtcatggtgacgacgtccttgaagctgagccgaatgttgccttgtacagctgtgtccttctcccggaaggcctctgtcggcatctgcagctgggtgcacacctggatgaagcaatcaagctgtctggcaggattgacagagcgtgggcagtagctggagaccagtagctgggtgaactgggggctcaggttgtagcccatttgggacagagcttgctgcagctctgtgtagctaatggagcctgagttgtcccagtcataactgctggaagagctgcttccactgctggatgaatttccacagggctgagaagccgtagacatttatgtggcctgattaggtcttgtcaaacatgtttatcatcatgaggcaggtctcatcattgaacaaggaccagttgcagttgaccagagcctgcttcacctccttcatggagataaagccactgtgatcagagtcaccgactggaaccaggagtaggcctcatccatattgggaggggagccaccctgtccatgaggcctgggctgctgggcaccgtaggaatttggaggtggctgaccataggggccccctggagctgtaccatcatttggtcctcctggagttccagaggggaacatcccaggattgaggtgtccatagggccctctaccagctggtggtccataaggccctccaggggcaggacccccatagccaccaccagggggtagcacgctgccatactgccctccactactggggggggtccaaggtagtagctacccggaggggttcctggcgcttgccctgcatctccagggcagccccgcccatacagatagctggctgtggcaattctgacgtcacacacaggcaaggggtaaagtctggatttttatatcattatagtggttatgatgaattatgccatctccttcatttagcatggcagagtttgcctgagtttacacgatgagctttctgttatgaaccttgactctatctattgcataaagggaatttcctgatttttattatttatttatttagagccagggtcttactctgtcacccatgctggaatgcagtggtggtatctcagctcactgcaacctccgcttcccaggttcaagtgatcctcccgcctcagccttcctagtagctgggactacaagcgtgcctcaccacacctggctaagttttgtatgttatgtagagacaggttttgccatgttgcccaggctggtatcaaactcctgggttcaagcaatttgcctgccttggcctcccaaagtgctgggattacaggtgtgaaccacttcagccgactaaatttttatttgataaacacttggattttatgttttgtccacttacaatgctgatggctcttattaaacattgtacttcatttgccaaaaagaattattatgtgaacacatatcaaaagcctaaagtcgtttatgtgccctggactgggaaaatatttttataatccaggcaaattacttctagtaatagaatagacttctttatttggacgtctgagaaaatttttaagaggatactaggtaaattcactgctttttctcattgtcagatcagttcatttctgtgctgaaaagtctgggtctgttaattgtcagaaagacaatgagtagatggacctagtagttgggagcggctttcctgttgtaggaccccttacacaaactttgacagtcttgtaaatatgttatttctttctttagcaaactaacttaccttacctcctctaatgaatttgtgtttttggtagcagctggacagatcacaacatggtattttattccatgcaggtcatgcactatttaggtcagtacataatggtgaagcaactttatgatcagcaggagcagcatatggtatattgtggtggagatcttttgggagaactactgggacgtcagagcttctccgtgaaagacccaaggtaaaaacagtgagggcttgcgtatctttttgggtgcttatacctagccacttaatttctatgggttattaatatttattacttcactcaacaaatatgtaagagcctacatatgttaggtagcctatgaggcactgagaatatggtaatgagcgacacacagtctgattttatggagtatacagagtagtgagtcagtagatgctcttgcccatcttagtcaaataatcacactaattcatggtaaacctacactatggcaagtgctacagaaaagagatacatgaagcagggagtgggtgggatttagagtgttagaggtcaagaaaatgttcttttgaggaagtgaaatttcagccaaaagctgaaagatagataattaagtagtcaatcagagagtttgaggttgattgaacaccatgtgtaaaggcctgggtaggaggaagcttgatgtgactaggttagaattttgtgaaataattgttggagagggaggaagagtgagcagatgagagaaatgtagaattgctgggcagttagaggttgatgatgagcctggtaagaatcacagtagggctaacctgacctgttacttttctccagctgcatggggtgtaagttattagcttatatagtcaaaagctaattagtaatttagaagctctctttctctatagctttgatgactgctgcttctgagctcattctgtcttacactaagacttcccttagctgggtgtggtggctcaagcctgtaattccagcactttgggaggctgaggtgggtggatcacctgacttcaggagttcaagaccagcctggccaacataagtgaaacgccgtctctactaaaaatacaaaaaattagctgggcgtggtggcgggcgcctataatcctagctagtagggaggctgaggcaggagaattgcctgagtccgggaggcagagattgcagtgagctgagattgtgccatggcactccagcctgggcaataatagcaaaactccgtctccaaaaaaaaaagactcccctccacccccactttccaattacaatgtgaaacttcagtcctggaaggaaggaatagtttccaaaagagatttccccacttggattactgttcgctaatgaaataaaatgtaaattaatcagttttttaatgggggcagagtaacacaggggcctgggcattaacatcttaatatttaaataattaaaaactgttctgggaaaaagattctgcctttgtatgccttacagagagacttgggagataacatcagaaatacatttaatatttaacggcaaaccactgatatcttcatagtggcatttggggttgttaattttttatcttctctctttaacagccctctctatgatatgctaagaaagaatcttgtcactttagccactgctactacaggtatgtcacatcatatttcttcagtctgtatcacagctttgagttcaagggggcaaatgatgggaaaacaaagaagatgaaggtggaaatggaatgctatctttggcatgactgggagaaatacatactacctgtcacacagaatgttatgttattaactttttactgaaaaatcaaacatagagtagaaggatttccactttctagacgtactgttaacgttttgtcatattgcttcatctagacacacttttaaaaatctctagcagataaggacttttttctccaaacattcaatatcattattacacataacaaatttaacatgtaattccataatcctatttcatagccagtttatgtatcatttcccccagttatctcaaaaataccttgtatttttgtcttacttgaattaggatccaaagtccacacattgcctttggttgatatgtctcataagtgtctttaatctataaaacttaactttccttttgttttcatgtcatttacgtgttgaagaaatgggtcatttgttctgtagaatttcccacgctctagagttggcagattgtatccttgtgattttgtttaatgtgtttctttaccctctctatttttggtaaactggtagtgcttgaataaattcaagtttaaattttttgccaagaaagctttataggtaatgctttgtacttctgtttaatcacatcagagtcatgtaaggtctgcctgtctattttagtcagtcatgttaataatctgtgggctcaggtggtatcagtctgatccatctgttacacaggtcactcaagaaccttttacctaatggctttagccatctcttatctgaatgccaatttgtctaaccctttgcttgattctagaccttctaaatactgctctttaactattaggtatgtataggaaactggctgtactggagtctggagtctccaaaatggtggtctgtaagagataggtaaataaactggacagactgaacatagccatttccaaataatgaaactttttccctctccactactacataaagcccttttgtgagcttcatattaacattgccctttgaagaaagcccaagttagtaatctttttagattgaccatctttttttcttctcaggttgcccaggctggagtgcagtggcactatctcagctcactgcagcctggacctctcgggctcaggtgattctcccacctcagcctcccgagtagctgggattataggcacatgccaccatgcctggctaattttttgtatttttagtagagacagggttttgctgtgttgctcaggctgatcttgagctcctggactcaagcagtccacccactttggcctcccagagtcctgggattatgcgtgtgaaccactgcacttggccactgccactgtcttttgatagtttactgaactgtcttttgcactgtcttttgatagtttactgaaataagtaggttgagaagaatccattcctttttatctttttctttctttcttttctttttctttttttttttttttaaatgtagagcgtcttgctctgtcactcaggctggaatgcagtggtgcaatcatagttcactgcagcctttacctcctgggcttaactcatcttcctgtctcagcctcccaaatagctaggactataggtgcatggcactgcactgcacctggctaattttgtttttttgtagaaatggggtcttgctttgttgctcaggttggtcttgaactcctggcctcaagtgattcttccacttcagcctcccgaggtgttgggattacaggcatgagccaccgcccccagacctaaatcaattactaataaagatttattctttaaaggcagagaaagagacattgctgtcataccgaaacatgattttgaacttactgaattttgaagcctgttagtctcattgagtcatatgcccacttcacatagctgtaaatttgagagtgaagatcctgcaaatgatacggcagctttattgaaattcaatcacttgtaaaatagcatggctttcctgcgatagtcactaaaggtttgagatacatggaggattttataattgctgatctactttttcattaaaatttgtttttggattgatctgttttctgaatatctataattctccttttttctctcattttctttcttgtactttctctgcagaatttaacatgccatataaagaatattttgttggttttgttttgttttgtttgagacaggatctctctgttgctcaggctagagtgcagtggcaagatctcggctcactgcaacctccgcctccgtggcacaagcagtcctcccacctcagcctcctcagtagctgggactacaggagtatgccaccacacctggctagttttttgtatatttttttgtaggtacaggttttctgcttgttgcttaggctggtcttgaactccaggactcaagcgatcccccttcttcggcctcccaaagtgttgggatgacaggcgtgagccaccatgcgtggcccatttttattttttaacttgtcgttttgaaaaaatttcagacttaataaagttgcaaaagtattgcatagagtttctctataccctttatccagagtccccaaatggtaacatcttacataataatagtatgatgatcaaaaccagaaaattgccccaagtaattctgattggttatctgttctgacttgcaattgcattggtgcttgtggatggccatctctgttgatttttgtgatttgggttgcttgtgttttatttgaaaggacaaatgagagaagtgcttttcatataattttatacctttgcaaatgggttaaacttttcattttggtcaagaagatgccattgtttaaaatggtagttcttttttttttttttttttgagatggagtctcgctctgtcgcctaggctggagtgcagtggcatgattttggctcactgcagcctccacctcccgggttcacgcagttctcctgcctcagcctcctgagtagctgggactacaggcgcccgccatcatgcctggctaattttttatatttttagtagagacggggtttcaccgtgttagccaggatggtctcgatctcctgacctcgtgatctgcccgccttggcctcctaaagtactgggattacaggcgtgagccactgcacccagcctaaaatggtagttctttctaaattgtctctccaaattttcccatgtatacaaatgaaataaatatgactaactttgtgtgtgtttattaatttttgagactgagtctcgctttgtcgactaggctggagtgcagtggtgcgatctcggctcactgcaacctctgcctcctgggttcaggtgatctcctgcctcagcctcccgagtagctgggattacaggtgcgcaccaccaagcccggctaatttttgtgattttagtagagatgaggtttcaccaggctggtgggttgcccaggctggtctcaaactcctggactcaagtgatccacacacctcgacctcccaaagttctgggattacaggcgtgagccaccacacccggctaattttaaaacttcttttttacattgtggtttcaccagataatttatttttgcttgtaactgttttaacctaagtaaggtagtaaggctttggaaatataaatgacagtaataggattgctttattaaagaattgctcctggcctgtgcggtggctcatgcctgtaatcccagcactttgggaggccgaggcgggtggatcacaaagtcaggagtttgagaccagcctggccaagatgataaaatcctgtctctactaaaaatacaaaaattagtcaggcgtgcgcctataatcctagctacttgggaggctgaggcaggagaatcacttgagccagggaggtagaggttttagtgagccgagattgcgccactgctctccagccagggtgacagagcaagactccgtctcaaacaaacaaaaaaattgctccatctgcattatatgttagtccaacttcgctttgaagaccactgtggtcagaaaatgctgtctctcaaactttttgttgtctccgtttgtccacaaaaatgtttctggaaataatgttttttataattagaattttgaaaatgtttgcttttttcaatagaaccgcattgacagatcagttgtaggatctgtatccttcctctagcagcctttatcagatggtgatgatattttccatattttatctctgaacctggtagtggttggtgaacctgacccacagtagacttattttgggtctatctcattcacatagcctcaaataatgaatagtccagattattaaattgtttgcagcttgatcttttcgtgtagccaagtttttgtcttttgttctacttgaaaaatttctttgtaagtccttggaatgcatttctcttttagattaatgtaatatctaagaatttctctgtactgtgttgttttccttggttctttttattggccttgagaaaaactttatttgctgctgcttcttaggaaatgtttatagtaactgggaaaaataagacaatgaaaaaaattaatttatatacaggtgatggtaatgggaatttaaaccataaaattatccttgacacttagaatgtcgctttagatgaagatgctattgttttatgaagcaaacggggaaaaatccagatttcaagatcccataaccctgtatgacttaacacttgaaagttgaaattaaatgtaaaaagccatacactcttttccttttgtttgtgagttaggcgaatttggtaatatataggaagagatgacaaaaatagactccattatgtcctgcttggaaccagttttcatataaaaatttaaaagcttgatatggaagaacatttttagctatttttcactgttttttttcccgattatattttggtaatatattttggatatggcctgtcttggtctttgtcatttttatcaattttgatttttcccttgcaaatgagagctttgtccagccaacatggagaagtacatttctagggactaaacctggctcccgggttgtttgctgaggtcctttttgtgtggaaagaatggttattaccagggaaggttttccttttgttttacttgctatccagatgctgctcagactctcgctctcgcacaggatcacagtatggatattccaagtcaagaccaactgaaggtaaaatcaccacacggtgacttcttttgttgtacagagtggccccttctctgtacctatggatcttggactcccaagacctttccctgaatgtggtaagaatttaataagaaaggttcttgggagttcacagaccagggacagagtgaaccttctctgttctgcccataacagagttccagtctctgaacctttctttgggatgtagcacttctgatcttcagttcttccagttgcatttttctttgggtttgtgtgtacctgtgtgtgtgtgtttgaggatattgctttattagattttaataggcgtgttgcagttaagttcatgtcaggccatttcctaaagcttccccaaacctggggaaactttatagtcatcttggtacgtggcgagggtttcatatgttttctgaattatgcctaattttgtagtagactggagggtttatacagatagcctgtttttaacagtagattttggcctttgtgcagaggttttttttccccccaggtttgggattcttctagctttgctcacagtgggttgaggagaggtgttgcctttatttgatgactgttgtgaacttgagttctctttcttgtgtgtaacccattgtgttgcacactaactggtgagccagaatggaactgctacatcccctggtctcagttatttctactgcactgatggacacctttcccttctttcagcaaagtgcagaggaaagttccacttccagaaaaagaactacagaagacgatatccccacactgcctacctcagagcataaatgcatacattctagagaaggtatgttttggattaaggctatatagacttttgttctcttcctcttccaacctttttatttttaatctctccgtatgtgaagtaggagagggatatgtcacaatttctcatccttttctgaaaacctttttatcagcctagttactaccattgttagctttgaagaggtagtgctattttagcaacccgtgagtactaggatggtgcaagacccttccatgagctagcatgctactagaaaatagctacacatttattgatttgctaccaggtgaattttctacatacatgaattcagctgccttagacttttcaatcttagtattcttgtatgtatatgatttggttagaatttttattttgatttatctacttgaggcaaaggccaattttcatacttttttttttttttttggagtcagagtttccctgggtcacccaggttggagtgcagcagtgcgatctcagctcactgcgacctccacctccttggttcaagtgattcttgtgcctcagcctcctgagtagctgagattacaggtgtgtgccaccacgcctggcttttttttttttttttttgagacggagtctcattcttgttacctgggctgagtgcaatggtgtgatctcagctcaccgcagcctccgcctcccaggttcaagccattctcctgcctcagcctctggagtagctgggattacaggcgcacgccaccacacccggctaattttgtatttttagtagagatggggtttccccacgttggttaggctggtctccaactcccgacctcaggtgatctgcctaccttggcctcccaaagtgctgggattacaggtgcatgccactacgcctggctaattttggggttttgccatgttggccaggctggtctcgaactactggcctcaaatggtctacccgcctcagcctcctaaagtgctgggattacaggcgtgagccactgcacctggcccaatttttacacattttgaagtttgcaaagatgacataatatacttaatcacaaagccaagaatgagatataagaagcctggtataagttgagcactctaaatttgaaatgttgagcattctcaatttgaaagatggtaatgctcttttagcaactcatgagtactaggatggtgcaagaccctttcaaaggatcttagaataagttgagcatccaaaatctgaaaacttgttttttttttttgttttgttttgtttttttttttttgagacagggtcttgctctgtcaccaggctggagtgcagtggcacagtctcagctcactgcaacaacctccacctcccgtgttcaagcgattctcctgcctcagcctcctaagtagctgggattacaggcgtgcaccactacgcccagctaatttttgtattcttagtagagacggggttttaccatgttgaccaggatgggttgatgtcatgacctcgtgatccacccgccttggcctcccaaagtgctgggattataggcatgagccaccacacccagcctctgaaaactttttcacatgacaccacaagtagaaaatttaacacctgacctcatatgacaggttgcagtgaaaacttagtttcatgcacggaattatttaaaatattacaaaaaactgtcttcaggctatgtgtacaaggtgtacatgaaaacttgggtcccattagccgggcgcggtggctcacgcctgtaatcccagcactttgggaggctgaggtgggcggatcacgaggtcaggagattgagaccatcctggccaacacggtgaaatcctgtctctacttaaaaaaaatacaaaaaattagctgggtgtggtggcgggcgcccgtagtcccagctacccgggaggctgaggcaggagaattgcgtgaacccaggaggtggagctagcagtgagccgagattgtgccactgcactccagcctgggcgacagagcgagactctgtctcaaaaaaaaaacaaaagggaaacttgggtcccatccccaggatatctcattatgtatatgcaaatattccaaatccagaaaaattgtttttgcccttggatggtagtcaccagatctttgccattccattagatatgttgtggtcaggctaatgagttcatccatattttccccaaaactctaaaaaacactttctaggctgggcatggtggctcatgcttgtaatcctagcactttgggaggctgaggcaggcggatcacctgaggtcaggagttcgagaccagcctggtcaacatggtgaaacactgtctatattaaaaatacaaaaattagccggacatggtggcaggcgcctgtaatcccagctactcgggaggctgaggcaggataattgcttgaacccgggaggcagaggttgcagtgagccgagatcgcgccattgccctccagcctgggggacaagagcaagactttgtctcaaaaaacaaacaaaaaaaacactttctaaaattagttttttgtttctgtttttgtgttggcgaagatgtgtaaaatcataaattccccaaagtcattttatggcatgatggcttctagtctaggcatgtggaccaatggcaggttaagcctctagttatgtctgagaaactttggctgctgaagttattttaaaagcttaaatttgaataagtttatcatgctggattgttttctttacattgcatttgagcataaactgaattttggtctacctagttactttgtaactattccagtctatatgatattaaatgtgtaattttattccttaatgcaaatccttgcttattttgtactcaaaaggcaattttaagatatataagaacatggctgggcactgttagaaaatcaaggctgggcatggtagctcgtgcctgtaatcccagcactttgggaggctgaggcaggggcattacttgagctcaagagttcgagaccagcttgggtaacatagcgagacctcgtctctacaaaaaatcagcccagtagaaaattagctgggcatgatggtgcgcaccagtcgtcccagctactcaggaggctgagatggaaggatcacttgagcccaagaggtggagattgcagtgagcggaggttgcagtgaatcaatatcatgtcactgcactccagcctgggcaacaaagtggtgccctgtctcaaaaaaaagttgggggcaagggcaggtatttaagaatagccaactcaaggggggatatgtagtttgtgatgaaaatttgggaataaataatagtattttcaggaagacctataggtagaagggacagaatttttatttgtggaaagaatgacctattttcatttccttcataagttgtagagctcgagtagggaagaataactttaatatggcaccatttcaagaatttggcttctgatagtttcaataatgaataagtggaaacataattgaagtttccctggccacagataagccttttagtcagcaatattgacataatttataagtaaatagggtaaccttatgttctggcaaggacccatgtattgcagaaattctttcaccatatgtacttcagcacacgttaaccccatggttgctatgggcaggcctaatgtattgggaggaggtagaagagaatgagaaagtaagaaaggagcagtagagcccaacaaaagactggagtatgggaaagaaaagagtatcatgtgataacaacagacttatgttaattagctgccctcagtgtcattcaaatgtacaatgtgagatcttttacttgaaataacgtggggtcttagtatttgtggtatgtctagatacttaactctaagagcccattgatccagcgagggcatatgtatgtatttggacaacctagagtttagtgttttatagtggttgttacctactaaaacatacgaattattgagaattgacccagaatatgtggtaccagtgagattgcctggacaaccttgtgatcacctattatggtttgtattgccttgctttgatcttaagggttagaccactatgttaccatcatttgcaatgctgttaatcaaactattatcaggcactatgtactagagcaagtaattctatagtttatacatggtaggagtgtttaaaataccagtaaatgcccatttagaaattcttttagcacaaggtcattgttcagatgcttttagagtcttttttttttcctgtcttctcatagaagacaatgcttttagagtttaaacttgataaacgatgatctgtttgtagtgtcattacttgctaatgaagtctaaacaagggaggagatttgagctctgccactaagacagatacttgatttctggttctttctttcttagaacaggaatttctttttacctattttataaagaagttttaagtattctaaagatagtcttagttattacgtattgtgcatagttatcattcttttcatttgacttctatagatgaagacttaattgaaaatttagcccaagatgaaacatctaggctggaccttggatttgaggagtgggatgtagctggcctgccttggtggtttttaggaaacttgagaagcaactatacacctagaagtaatggctcaactgatttacagacaaatcaggtaaatttcacatttgaagggaagtggttttttttcttttgaaagggtaacattcttggttactcttgaccacacattatattctctaagaattcttatttactcctatggcgttaaataccatctgtatgcatgtgatacccaaatctgtatctctagtccttacctcttccctaaatgcccaacttcagtttccagatgcctatttaactaacaactctacttagaggatttgacattgaacaatttcaaaatggagcctttggctgtgcgtagtggctcatgcctgtaatctctgggagtcccagcctataacactgggaggccgagacaggaggattgcttgagcccaggagtttgagaccagcctaggcaacatagacaccatttttacaaaaaattaaaaattagccaggcgtggtggcgtgcgcctgttttactatagtaataactgattcagccccctccttcctcacttcctgtcattcttctttgttcactacatgcgttttggatatactaggctcctttctgacactgtagcccaaaattgctgccttcctcaggcaccttaagtttgttctttactctttctggaacactgttcccccacattctttctttgccttctcatgatttaggactcacctcaaatgtaatttcttcaaagaggtcatccctggccacaaaggctattatgttacacagttccagtaggatccattcgctttttgttttggagctgtgtagctataggtggtggccctgccaaacccatccctagttaaaatagcctcctctctagccactcttctcttttatcctattttattctccatagtacttctcactttgtaaaaatattgctatattttatgtatgtgttgtctgtttaccactgaaatgtaaggccagggcttttgtattattcactactttttccattacctggtacctagaacagtatgtggcacataataggtattcagtgagtatttgtttaataaatggatgagtatttaatagtgtgcaaaataataaattgtctctcatgaatgttgtagaaaagcatgtcatgaaatattcatagatgaatgcagaaggttagttctatatggagttcagaaagtgtcaggacaaaaggtttgggtgaccatcagtatttctcatatttctttaataaacatccttgaccattttaagggaaagaatatgtcagaactaatggaatgttttgtagcttcttagagtgtcacctgtagaagggaatttagggaatagattctatttacttgagcaactacaagtccttaccttttaaactcttcagtactgtttcttaggtgttatacctgatttagtgttaaaagagaaaagtccatgcctgacaccattatatccatccattagtttatccacagtaggtgtcaagtagatatatgttgaatgaatacatgtccactgaataaaggcaagatgttctttggcgatgtagtgtgacgacattgagttttgggttcatttgtgttgtttcaacatctctgataaacctctgaatacagaaactcatgtttgttttttttctgttaggatgtgggtactgccattgtttcagatactacagatgacttgtggtttttgaatgagtcagtatcagagcagttaggtgttggaataaaagttgaagctgctgatactgaacaaacaagtgaagaagtagggaaagtaagtgacaaaaaggtatgttgtggaaaaattccatgttgattctgtttgtgtgctcatagtatcatctgttgagatttctttgtatctgtttttacaacagattgctcacataatcccctttttaactttaattaatttttcaatccaattttaagattcacattaagtaatgttaaccagggctgccttaaaagcccctacttagtcaaaagcagtaagctactcttttttcccctgattatagcaacaagctaccttttctctccctttgctaacaaggtaaggtgctaatcaagcttgtccaacccacagcctgtggaccacatgcggcccagaacaactttgaatcaacacaaattcataaacttttaaaaaacattatgagttttcttgcgattttttttctccttttagctcatcagttatcattagtgttagtgtattttatgtgtggcccaagacaattcttccagtgtgacccagggaagccaaaaggttggacacccctgttgtaaatgaacagcagtctgtaggagaaaacttatttcttggaaatcttgatagcttccataaccatgttgtacctaaatggaaagataagattatttctttgtagctattttagtgttaaaatagtagaaaagaggggagattgaactctgagtacatacatatggtatgtactcatgaagtactcatgtgtatggtatgtactcatgtacagatgaagagtcatacaggcaacttgctcaagactcagaagaaattggggaggagatccagtggccagcatgtagaagagtgttggtaaacatccatcggataaatacagcaaagaaaaaattgggtcatcctttttagttatttaagggattttcataagaattttgagttcctgaaggataccctagtatattcgttgtagtcaaatggtacctgggttctcttagactagttatatgggtagcattagaaggaatgcaggtggcttgaattaagacaaaagtgacatttggaaacttttatttatttatttttgagatgggatctcactgttttgcccaacctggtcttaaacttcttagctcaagtggtccttccacttcagcctcccaagtagctggggtcacaggcatgtgcagccatacctggcctaggaaacgtctatagagagagatgggacttaaaatacttggccatttgtgagaaggttgctgtacagaggttcataattgtttcataattggttttattctttttattggaccacaaaactagggctttaaatttttaaattctaaattttaaaatttagaacactccttacttttgaaacggactttttttgtttgtttctgtttctgtgggcatgtttttataggacagccagagtatcacataactagtttcacttttgaaagtgaaaagtaaatttttaagatactttgtttcattcttcctgtctgcttagataaaaaattgcacgtttaacaatttggagcttttctactctgaaattatttatttatttatttttaaattgttttagagacaagctcttattctgtcacccaggctggagtgcagtggtgagatcatagcttactgcaagccggaactcttgggctcaagcgattctcttgtctcagcccccaagtaactgggactacaggcgtgcaccaccacacctggctaattttttttattttttgcagagacagggtcttgctctgttgcctaggccagtttcaaactcctgggctcaaggtatcctcctgccttggcctcccaaagtgctgaaattataggcacctggctgtaaaatagccaccatgcccagctattttctttaaagtcataaatatgggcatcttctctcttctgaatgcaaaatttatttggtaactcttctgggtgcttttctgtcgtttgtgctactactgaaatgccaactagaagtacagaatcatgtgtttggtcttgcatttaagctgtctccttaagtgctagagatgggagaagaatgtgagttttaaattgaagcagttgtcttttttgcttttagttaattagcctcatctaaaacaagtaaacattactaatgagatgtttttgccttcacaggtgattgaagtgggaaaaaatgatgacctggaggactctaagtccttaagtgatgataccgatgtagaggttacctctgaggtatgaatctttagcaagaactattttgcaccagccccatcttcagatgatgtaatcccagcagttcacttgtgttgaagagtgctgtttacccctcatttctgtctcccttgcctagttgctaagtgatgttggtttctttacatttttttaagagatttttattggaacttaagaagggaaggggataatttgatcttatcctctccctaccttgaaaaggatgagataaatgcctctgtgtgcctttctccctgccatcaaatctctctggagacacaaagttattcaaaatagtcttgcactgctttccctgactcaacacctctctgcaatcccaaagacagacccataggctatctaaaattatttgttgaatataaaaataatattgtcattgttttcttaaaaagaagcaaatggaaaacagcttaatttccacacagattagtattaatggaggactattaaagaagacttgatattccactcttaggttaatagggatggatttgtcactagttgacaactcaagtctagacccaaatgtataccttgcttttttgttgctatttccccatgtttcttttagtcttgccacaggtaacacactatgggaaaaaggttggtggaggaaggataagaaggggattttacattttgctgcttggaaagagaaacatttttaggttgtttctggtgttgatccttcccccattcccaccacaccactgttgagcattatggtagttcattgccaatgatctgtgtgtagcttagtaataaagtaaaatatattggtccagtaagtgttcttgactgtaatacaaataacagagataaatgtttccatctgtttttttgagatggagtttcactcttgttgccaaggttggaatgcaatggcataatctcggctcactgcaacttccgcctcccggcttcgagcgattctcctgcctcagtctcccaagtagctgagattacagacatgtgccaccatgcccagctaattttgtatttttagtagagacgaggatctccatgttggtcaggctggtcttgaacttctgatctcaggtgatccgcccgcctcagcctcccacagtgctgggattacaggcgtgagccaccactcccggccatgtttccatcttaatcagacttctgtggctacttgggtgcagaaaacctattaagcaaatggactgtatttcatcatatcaaagatgccattgaatttaataagccctattattttatgtcctactaagaaaaagtgatgccaattaaactgtggcacaccatcactcatgaattccaaatctttatgaagttcctttgattatttgtatagcattttaaatgagattggaagatcttagactggcaagagtgttttgaggccatctggaatcccagtttaacacatggttgtgcccttgcctcagtctggacaattgagttatgacttctagacttgaagtgcttggcctttgacctaaaagtaatcaagttcagcttatgtcaaatcaaatcctgtcaaagccagttaaccgcattaaatattctttcttgttccctgtagctatttttgaattaagcaaagcatttaaaattcattgagatctagtgtctcctaatttgaatatggagaagtagggaaaaattacttggcattcaaggacaataacatttatttttcagagggcatgatttaggcatacagttacacctataattctgggtgcaatgagagtgcatgagtaaatttagtcgttttcaaatctcatttgttttagctttcttttttgccaaactttataacatttgctattagtgtagaaaagaatgacagagtattctcttcattcttcagcctcttgcccgataaaggagtaagttgtgcaaagaaaaataactccaaagaagcccataaggtacagcaaacaatgtaaatttcaccgagatgaggtagaaagccacctttcttaaagccactttcttaaagataactatatcagattttggcttgaaaatagcagttgtggcactatcagtgtaaaccttccaaagactttccttcatgtggctgtagaatttgctcaaatcctaggctagatcactggtgtggaatagcttagtgagaggatgtgaatgaatttgacctcctttcctttttctcagcatcatattaaccccctgagtattaattggcttcacttgtctttgtaggatgagtggcagtgtactgaatgcaagaaatttaactctccaagcaagaggtactgttttcgttgttgggccttgaggaaggattggtattcagattgttcaaagttaacccattctctctccacgtctgatatcactgccatacctgaaaaggaaaatgaaggaaatgatgtccctgattgtcgaagaaccatttcggctcctgtcgttagacctaaagatgcgtatataaagaaagaaaactccaaactttttgatccctgcaactcagtggaattcttggatttggctcacagttctgaaagccaagagaccatctcaagcatgggagaacagttagataacctttctgaacagagaacagatacagaaaacatggaggattgccagaatctcttgaagccatgtagcttatgtgagaaaagaccacgagacgggaacattattcatggaaggacgggccatcttgtcacttgttttcactgtgccagaagactaaagaaggctggggcttcatgccctatttgcaagaaagagattcagctggttattaaggtttttatagcataatggtagtacgaacataaaaatgcatttattccgttcacttaccacattatttgaaaatcaatcctttatttaattttatttccaacctgtcagagaatgttcttaggcatcaaaatccaaggtagctgtaagaaaaatactggagctaacaatgaagaacagaagtaatctgattagtcaaattattaagtgccatggattactttatgcagcagtcaggtacatagttaggtgaacccaaaagaaaaactcttgaaaacaagagatttcttccatgcacatttacaatattgaggtataattaacatgataaagtgtttccttctaacgagttgtagaaatctgagtaaccacccaaaaaagcaatagaatgtttctgtcaccccaaaacactcccttctgcccctcttcagacagtccttcagctatttcatggctctcaccctagttttttttttttttgcacttttttttttccgggggtataggggaggtgtggggcgacagggtctgtcttgttctgtctcccaggctgaagtgcagtgcagtggtatgatcatggctcactgcagccttggtttcctgggcataagtggtcttcccacttcagcctcctgagtagctgagactatagactagcataaccacactggctaattttttgtggagatgaagtctcactatgttgcccaggctggtctcgaactcctgggctcaaacaatcctcccgcctcagccttccaaattgctgggattatagtcatgaggcacctagtctggcccttttgcaagactttaatctgaaatctaaatttttaaaatttaagtacttacaaaggatatactatccaacatattgcatattatatatgtgctttaaagttttttttttttttgagagacggtctcactttgtcatccaagctggagtgcagtggtgcaaacacggcccacctcctgggctcaagtgatcctccagcctcagcttccctcacaggcattcactatcactcccagctaattaaaataatttgtagacggtgtctcgttatgttgcccaggctggtctcgaactcctgggtttaagtgattcccccgcctcagcctcccaaagtgttgggcttacagccttgagccactatgcttggctcaaagatatttttatgaaagccctgggactatagatttagctgattaaatttatagaaaaagtcctgtcatataaactggcaaagtctgttcttaatttaattagccaaatcagacttaacttccgtcagaacatgtcttggttttaattcagataaacacacaaacatacttctctggcacagccttcagaagcatcagtttttgttttgttttgttttgttttttgagacagggtcttgctctgtcgcccaggctggagtgcactggcacaatcacagttcactgcagcctcgacctcccagatccaagcaatcctcccacctaagcctcccaagtagctgggtctataggcgcgtgccaccaccatgcccagctgaattttgtattttttgtacagacagcattttgccatgttgcccaggctggtcccaaacttctagcctcaagcaaccctcctgcctcagcctctcaaagtgctaggattgcagtcctgagctactgccccctaccctctttgcgtcttaggagtcatttagattttttttgatccttttgtttagtgcctctggagctgcttacaccaaggcaatacgccttgatatactggatggttgagaggcagcctccttttttttttttttttttttttttttttggaggatagggagtatggctgttgtgaaaagggaggtaaagagaaatggtagatctgaagaggcctcatcagagcacatattttaggacaacacatatggaaattggacatctttaagttggtttccatagagctatgcatgtatccttacccccatgggaaaatgttggtgtgttctcaagggtatgcatgtg

SEQ ID NO: 17260 - DNA, 137956 bp, Human
  misc_feature (1)...(137956): n = A,T,C or G
gcctcctgtcagatcagccttggccttagattctctcaggagtgcaaaccctagtgtgaactgtgcatgcgagggatctaggtggtgtacgcgttacgagaatctaatgcctgatgatctgaggtggaacagtttcatcctcaaaccatctcttcctgacacctgtccatggaaaaattatcttccataaaaccagtccctggtgccaaaaaggttggggaccactgtattaaatggaatcttgttagacttctcagggttattacagtgatcaaaggagaaatgatataggaaggcactacttttaagtcccaagcaagcatgaggtgtgataagtatcaaagcacttgccattcccttagcttcagccttgggttggccgtctgtcctatcattcaggtctcagctccactgttaccccagagaagcctccagtaacatcatatctaaagtagcctccctctccctttcactctcaattccatcaccctgctttattttagtcaagacacctcacttacgaagtggtttaattttttgcttgcctgttgatcatgtgagacaagtaacaaacgttaagaagccatgcttgctcatttctgcttgtcagcataatttcacacagcccctgactctgtgaccacctgcagctggcggaaagacgctttgaagacaaaacgagatagaacacaggatcccccacgtctcttgcctgagcccttgccttttactgcacctaagataaagtctgatgaggttagtgattatgcttctgtaatctataaacagatgtactcttaagcccaaactgtgatgtgcttttacacatactgaatcttcaccaactgtttctaaattgagaagggaagttctgtgttggagggatctgcttgaatctctctaaaagactcctccagggctgtaggcctccatctctagtcctcagtaagacttctgaataaaactaactttcattctttaacagcttgatttttaaattttagtcgacaatcacttattgtctttctcctacagtagaataaaagtttcctaatggcagagcccttgcctcatcttccccaggcatgggaacagttcctggtataggatgcacacagattttgctgattcaggatagccgtgaataacagtggagactccagaggaggaagacctggatttgaagcccagcttctcaacccagcttctcaatttactagttgggtgacattaggcaagttatttagcttctctctgcctcacttgcaccgtatgtgaaaagggggattctgataatatacgcttcagagaacttttagtacatgtgaagtacctagaacagtgcctggcacacagttaagtcttacatgtgttttctactcttcagtgagtttaatgttaacacattaatagtgcacgtgaccctctaagtgtatcagatatgcactgccccctcgggtttcacaggaaaaccacttactcttttggtaaaacaggctgcatggctccactgccccgcgtcacccgcctggcctcccaccgcttagcggaaggggaggtgcggttcctaattccgacaggcacgtagtcttccacaagtggcactactcggggctctcctggctaggggcgttcgagccactaggggcgggtctcctgggatgggaagactggggctagggaggttcaacgccgcccccggaaacctaagggacgctccctgaaactcaccgggacgcgcttccgacccattccggtcacttgccttgaaatcgccgcagggctgcgcaaacctgccacccagggcccaagcgaccggggcggggcgatcgaggactgggcgggcctgcaggatcagaggcggggtagggcgtccacggggccagcaatcggggcggggcggggtgattgggggcgggacggggagatcagagggcggggcggggcgctttgctctggactctggggcgctaggctccggactccgcggcgcagactgcacctcgcagtctccccaggtccgcccagcagccgcgcttcagccaggtaagggcgccgcgggcgggctggggcggccccgggagtgcgatactccgggcgaggacgggtggggacggggatgagcgcggcaagaggcggcttccacacgcccctcgaggaacggggaaggattttctcccctccgtgccgcagtgagcgcgggtgcgccgtctctgggtcccctcttcggtccgggaaggagggacaggtgcgcgcagtggcgcagcctcgccttcctgccggcagtagattctccacttctccaactcccgcactgacctctcctaaggaacacccgcccctttttcttgaagttccaggcctgaggccgccctgcggcaagttcagcgttggggtcacgtcccagcggcgagcagggctgatgcctcctttcgggttgggcggcggcgcgatcttgattgaaatttggcagtgtcgagatagatatacctaatgtaaatgacaagttaatgggtgcagcacaccaacatggcacatgtatacatatgtaacaaacctgcacgttgtgcacatgtatcctagaacttaaagtattaaaaaaaaaatttggcagtatcggccaagatgttccgcagttgcacgtgactcacccagtgaagttcacgttctcttccccacccccccaataccccgcccacctcgccccgggaagttgtgtttgaatattgaaaacaggtgcccggccaatgtatgtacttcttggaaaaactagggccttgacctgggagtgtacactttcctaattttctttaatcctaaatttcttgtggattttattttattttatttttcccgtggacgtgtaacatggtggtgtgtaccaggtttggaaacaatctcatccattgctattctttggaaactggaatatttgattcgaaagattgatcttaatgttaacttggaacaacaggatggctggtggctaagtgggtttgaagattatccaaaatagttataagttttgcgcgtattccttgtatttttccagtgaatgctcattttcctcttgggaaattctgagaatttactcacttctagattattctctgctaaagagctgggaagaaacaaaccagcggatctcccaaataaagtttgggatttaacagtttaggtcgtgacactggtagctgcttactctgcaataatcacctggagtaagggatattaagatttatttctaaggggaaaatagaagtatgggtaactttcacattatgtatttgaaagtattttttagtttagttacattttcaatgtttacggaagacttacactttccccatactccagttaatctgatccatatattacactcttgccaacgcagatgcttactgtggtgtgtttatgttaatgatcttgactcttctcacaagggtgtgtacattctggtctgtggaactgtataggccaagtgtaaactcatgcagtcagtgctttactctagttggcaatacctttgccccacataggtccaactagaattttcacatcttcccaactaggaaaggatatagaatattaatgtatgctctagcattttcaacctactttattctttatcaagataatcatgttttctcagcagctagttactcaagggcagcagctatgttttaccaaaccgtggaaaataaagctgagataatggtaacctttgcttccttaagttgacccttgatagggaggttggaagggttgtgagcagtgtctggcctacttttacgcttggggaagaattactggcctctctgcctttctccgggtatccagagtgctgggagacagggccttgggcctccagccacacctctgcctacaggttcctccaggttgaccaggttggtgcctctcctccctgccccagctgttccagctcctcagcttccaccccacccctcccagattcttacccctagacaaatcaccatgttgttcagggcaggggtacttggtctgcagagtcagcatgagtgttgatcttcagcatggtgctggttccccgtggatgctccttggatgtctgctgcttcagagcctttattatgctcccttcttgtccagtctacagcaggcaaagtggagttactgaagtcaaacccagatcaacagttttgggggccagctgccttggttggactaattacgatcataaattgggcattcaagtctgttggaaaaaagtgaaattggctcatggtcactggcaattgtaaaattatcctgtacgatgtggttatgctattataaaaggtttgtggaaaaataagaaacaacccagaaggaaggggcctagtagttgcctccacctccaaacacgcctgtgcttgggcttgccttattgtcactaccccagctcaaccaattcttctgggattggattgtaacaattaatttccccaccatgtttgactgctcagagctcagatgaccgcagctactgtagtatagatgtagagaattacatactcttttgtttagagaaacaaggatgggctttttcaaaacagattgttattagggaaacaaagaaaaagcaaacaaatgtaaaaatgtgtgggcacagaagccaaagtttgttttgttatggtttatagttttaaacttttatccaagttacatttctccctttccagaaacaaccacttgtaattctttgccatttgtggcttatagttgatacttcttgatttttcaattttaagcattatctgttgacttcccactgtggaagatgatgagttggctctctttttccctccaacccccaacgcaagtacagcttccctattttcccattcttgcagtcgttaaaacagaatattgaataatggttagatcaaaattcacagctaagccaagcataacttttttttcgttttttttttttttgagacagagttttgctcttgttgcccaggctggaatgcaatggcacgatcttggctcaccacaacctctgcctcccgggttcaagcgattctcctgcctcggcttcctgagtagttgggattacaggcatgtgccaccacgcctagctaatttttgtatttctagtagagatggggtttctccatgttaatcaggctggtctcaaactcgtgacctcaggtgatctacttgccttgggctaccaaagtgctgggattacaggcgtgaccaaacataacctttgtatctttccttgcaagttaataaatggatatgtctataaaacacagattgggaaacatctgaggcttacataatgtaagtcatttttactatcatgaaatacgtaagttatcttactttttattcatcaggcagtaaaacggctaagtaacttgattcatacctagtatgtagctgtcgtctcctggcatcctagcagcagctgtcctgtctcattcctctgcccttctccctgcttccacataactactctgtcctgaaaatccttccacctcttcttctattatctcttctctctaaagcccgtagtcttattatgagctttctttaactgttttaattactccttctcaccttttacaatcannnnnnnnnnnnnnnnnnnntgggctcccaagtgctgggattacaggcgtgaccaaacataactttttattttccttggagttaataatggatttgtttgttcattttatttattttgtgctcttcattgattaaacccacagctcttggccagttttccaaattctccctcaattgaccaggtattttgtcaatttcgttttcctcaagaagctgttcctgagcctactggcttgctataatccagactgggtgcctttggtacattggcacacttgtcaccccaagggttccctttgtcatcattctggagattctcatcatttgtctcttgtgttggatctcctggtacttgtagcacatgtcttcctcagtcttggttgactcccttcttttggtagagcccatcctaaaggagcttcctggaataggatgcctagaggtctacttttctgagactgtagatgcctgaaaatatgttttcaactgacaattgatagtttgactgagtgtagatttctaagatggcaattttgaaggcattgttctattgacttccacattgtggtattgctgttgagaaatttagaactctactgattcctcagctttttcttgtaatctgtgtagaggttacaatttgctgggtcctccctgaagtttatagaattttctcttggcctccacagtcctaaaatttcacgacactgtgcctaggtttgggtctgttttcatgcattgtgttgggctctttgaatctggaaactttcattcttcagtttgggaaattttcttaaattatgtcattggtggccgggcgcagtggctcatgcctataatcccagcactttgggaggccaaggcaggcagatcacctgaggtcaggagttcgagaccagtctggacaacatggtgaaaccccatctctgctaaaaatacaaaaattagctgggcgtggtggctcacccctgtaatcccagctagtcaggaggctgaggcaggagaattgcttgaacccaggaagcggaggttgcagtgtgctgagattgagtcactgtactccaacctgggaaacagattgagactttgtctcaaaaaaaaaaaaaatatatatatatatatacacacacatatatacacacacgtatatatgtgtgtatatatatgtatatatgtatatatatacgtatatatgcgtgtgtgtatatatatgtgtgtgtatatatatacatatacacacacatatatatatatatctatctcattggtaatttttccccctctattttctgtgtctgtgagaagctcatattgttcagatattggctatttttgactgggccaaaaataagtttttcatgactgtaatcatgaatatttaaaatcaaaatctctatttttttggttgcctgaatatatacatatatatttgtatgtgtgtggtttgtgtgtctatttctttctggtttttgttttatagtgtcagtgtcttttcctttctccctaagaagcttaatgattttttggagcaactttttttccttcctgcacagattgaatttcccaagcggcttttgtcttttcatttgtttaggtttcttctctttcatgttagaagttttccttgtgtaactaatgcccttggttatctactcacacttcagagggggattaaaaagcagaaggtctggggttcaggcagggtggctcacgcctgtaatcctagcactttgggaggccaaggtgggcggaacacttgaggtcaggagttcaagaccagcctggccaacatggtgaaaccctcgtctctactaaaaataaaaaaaattagccaggcgtggtggcatgtgcctgtaatcccagctactcagcaggctgaggcaggagaattgcttgaacctgagaggctgaggttgtagtgagccgatatgatgccactgcactccagcctggcaacacagggagactctgtctcaaaaaaaaaaaaaaatgctgaagatgtggatgagcttgtcgactggggaattcatggtagggggaatctggctgggctttttatttggggaacctctgtggtcgttacctcttgggctggtgagagtcctcagagaagccttttccattcttttccccagagattgacagagagcctggttgtcagtaagtggaaaagaagactggaagtctcagcatccagtatgtagatgtgcatataacccctccatgctgtttgtgtacagaccccctgaagggtgaaggagtagggaggaaactccaggttttttgctggggtagagaaggggcagtcacctaactggttggagtggccagagggatctgtgggatccagctttttaaaaagactttaaaaagtcactaattttttagcccacccctctttttatagagggttcaattgcctttaattatttaaccttttggagattccatggtgtaaatcagattatttcttggcttctgcttattccaccaaaatgtttttgctattgtctcttcactcattctctccatccttgctgatttatacatgaaataaaaaaatttctttattgtcattgtcttaggctttcagaagggagagaaagtagaggtttttgtccagtctgctaatagtggctagagtataatttctttaccaatctctatccagagactggcaccattcagtcatagcagtgtgttgctgttttccccttcctctacccacaggaaacattttcggatcaggctgggccgctgagccgagtttggacctcagatgccttcatatacaactctaagtgtacactaccaattgatcatagttgtcatagggggcaaaacctatatcttaggttgggtggtacgtagattactggcatagagcccttgttcctgtttctttctttctttcttttcttttttttggcgggggtggagacagtctcgctctgtcacccagactggagtgcagtggcatgatctcagctcctgggttcaagtgattctcctgcgtcagcctcccgagtagctgggattacaggtgcacgccaccacacccagctaatttttgtatttttagtagagacagggtttcaccatgttggccaggctggcctcgaactcctggcctcaggtgatctgcctgccttggcctcccaaagtgctgagattacaggtgtgagccaccgcctggcctattgttcctgtttcttgaattcactttgtgtaggatgactctttctgccatcttgacctctgaatgttttacctttcagtgaagtgcagcttctattaagtccaatattattttaatctgaaagatgggattggtgtcattgatggccatgtggcctcaatggaagttatcattatttccttctggaggccagtttatcacacaactgccttaccagcagcagcacccttacttccctttccacttgtgccctccttggaatgtgcaccaagttcctgtttctggctgggctgatgtaccctgccgtttgtggatgatcacgacttttccaacgtcatttcatcagttgagtcattcctcaggctcccttaatgggctgtgaacttccagcatgctctcccagttgctttgtaacatcaacattctttatggttacacacatgatgacaagagtcagtttccacaaaagtaggaggataattgttcctaagccatcttatctgtgcagaaaaagcaaagctcgatcttcccatgatggcagctatgcattggcaatacagaaaacaggagtgctggcgattgtgacaatggagtgggtgcaacaattactttatctttggaggatgacagatggttaaaaaggctttttcagcaggtaccactaggcaccattgtgaacaaaagcttggctagtagggatactgcagagctcattcctcccactgtgcttccacaagcatccttcccttttctaaacgaagtctttgaagtcattggaacctcccttttccaggcagtatagtttttctgtaatgtactgggtcttcacagaagttctttcctagggaaagcatagtaccaagcaagtacttaatatactgaatgaattttccagacaattttggacactttatagttaagaaaaaatgatatttgggccaagagtggtggctcatggctgtaatcctagcactttggaaggctgaggcaggtggatcacttgaagtcaggagttcaagaccagcctggccaatatggtgaaaccccatctttactaaaaatacaaaaattaggtgggcctggtggcacgtgcctgtaattccagctactcaggaggctgaggcaggagaatctcttgaactcaggtagcagaggttgcagttagctgagatcgcaccactgcactccagcctgggcaacagagcaagactccgtctcaaaaaaaaaaaaaaaaaaaaaaaaaagagacatttggtcacaattacccaagttgtactcaacaatctaaattctctaaattcttgattagactttcacatcacttgtctatatatggattgaaatatagagcattcaatttaagttttctcaagtgtattgtttcttgtattatttagaaatattcttcactgaaaacattcttgaaaggacaacatacattattatcattattttccatctgtatattttttcttagcatagtgttatgattatcttagtttttatggctacaaagaatggattttggaggagggagggaagtaagtattcattatgttatctcatcagttttatgtttctaaaggaggaacacttttgtttggatttctacaatatatacttttgccttttgtaactatatgtcatttgtttttcaaggttaaagcttttaaccttgaaatgcttacaatagagtatcaaagcgacagactttaacttgtcatgtactatatgagatacttacaaggtgaaactccctgtcaagtatcctactccttttatttttaattttggtgacattataatgtgatttagtaggaaaaacctttgatttttcttctcttatccttcatggaattccaatgatatcttttgttactatttccttagaaactcttaatgtcctcacatactcctcaatattatgtttcaaccacgacttgtgggatttccacatgactgccccaaaaatgaaactggctttttttcttacaagagtgatttaaagtttcatttttctgccaatatgatttaagcatgcaacaaagttagtttttactattagggttatttttgatttgtagaaggcagttgatttcttcattttcctgcttgggtgataaaaatgcttgatccttcaaccatgcagggaaacagaaatacaatttaactgggtttgaatgctgtcagacatgtaaatttaggtatacatgcttttgaatttttttaaggattgtcagtgtctttgtcacatacttaaaccagttatagaagcattgcatgaaataattcttgttcataagttctggagtcctagccagaagacattttttaggctcagagctgttgacacaccatcttgcttcccccaggcaaaagtttgatctttgggtgccaccgaggttctcagacacctggtgtgctccttggactctccttgccatcagtaaaaaaaaattgtcattttgtagagttttatatattccttgttagaagatgtaaacaatactgaagcttacaaagaagaaattaaaaataaccctaaaaccattccagagagaatctttgtgaatccccttccagtcatctctattaccagctgacttttaataaatctttagcaatgttctagaaaataattaaggagcattatgttacaactgtttatgtaactccaaattctacaatctttatttatacacaggtagttactttatgacgttgtaattagtccatgcataattttctttgggtaattctgtcatgttagcatacggtggtattttgagccactccccagttgttggacacttagatttttttttttctttttttttgttttagagacagagtcttgctctgttgcttaggctggagcacagtggtgccatcaccatagcttactgcagccttgaactcctgggcttaaatagaaggtttgagcttcagcctctggcttcagcctcctgagtagctaggattgcagatgcatacgactgcatccagctcattgaaacgaaaattaagcagcgatgaggccttgctatgttggccaggttggtcttgaactcctggcctcaagtgattctcccacctcggcctcccaaagttctaggattacaggtgtgagccaccacacctgactgatttctagcttttattcatcagttttagaaggtcataaaataactcactagcaatgtgaagtttccattttttctcttttttgaccttttagaattacagtgtctctgttatgtgaggacaagaagagccagaatgcttgaggccatgttatgtacccagttataggtcagataaaactagaagaacctgacaggtcatttgcagagactgtgttcttgttggtaatgtgtagagcctcatttcatcttattggatgtctataggaaaactttccaaggatcagtaacaaaacatggaagagttgttatgtaactgtgcaatgacatttgacctcagtacctggtctagagtttatgaaactttgtgtgacccgggaaggcatcttatgtcctcaggaaactccagccttcctatccattgtgccatttctctactgcttgagtaatcatggcccagtaaggtgtgcaaggcaaccagcaatgttagagaattttgcattaatgtagtttcttgataaagaactacagcagagtgagctcctgttcagatttttcttttgacatctttctttttttttttttttgagacaaagtctcactttgtcaccctggctggagtacagtggcatgatctcgactcactgcaatcttcacctcctgggtttaggagattctcatgcctcagcctcctgaataactgggactataggcatgtgccaccacgcccggctattttttgtatttttagtagaggtgagcttttgccacgttggccaggctggtctcgaactcctgacctcaagtgatctgccagcttcagcctcccaaagtgctgggattacaggcatgagccactgcgcccagcccctttgtcatctttctagatatcatggtctaatgtttaaagccttgggtggatttcttttttcttttattttaggtttgggggtacatgtgaaggtttgttacgtaggcaaacatgagtcacaggggtttttatacatattgtttcattaccttgcatggatttctaagttaactattaactggaattattttcctgtgcttcaggttttgcatctattcaacaaactataatgacacataattaacagttcacttgagaaagattcatggcctaatacttgtaaaggactttgagcttctctgagagtgttttatacacagtcatgaacaaggagatggcttgttctatttggcaaagggcaagtatattatgcccattttatagatgagaaaagagagcctcatagaagataatggcttgcttagactcacggtaaatttaatgtagtgtctgtggaattttccttggactttgtggaatgaatgaaatctaaaataaattctacatgagtgtatgtgtagggaagtagggaaagtggatttatactgttttaagcaaatataacatttcggaggagagtctttccctttgaaagagggtaaccatgtcagacaaattcgctagagttcttaaagagaattaaataaataatcagggaagacagggataaacagattttccaagtgttgaaaagacgccacacaaagtctggtaagtaaattcagtcagcaataagttgggaaaaatatttttgaaaatcaggactcaggagagggctacacgatgaacaaaggttaggcatagctggacatttctcagaatgtgtatcagaatacagatatggttgaactactctagttattatttttaaaataaattacatacaagagggagtatacagtctacatgaaccctttgggacatgaaaaagctaaacagttgatctcaagtctatgcaaaatggcagagaaataaagaatgcatttagggctgggcttagtggctctcttgttatcccagcactttgagaggccaaggtgggcggatcacttgaggttgaggagtttgagaccagcctggccaacatggtgaaaccttgtctctactaaaaatacaaaaattagccaggtgtggtggcgcatgcctgtaatgccagctactcgggaggctgaggcaggagaattgcttgaacctgggaggcagaggttgcagtgagccgagattgtgccactgcactccagcttgggtgacagagtgagattccttctcaaaaaaaaaaaaaaccaaaaaaacaatgcattcagataaaatgaatcgatctgtacatgtagatgtacattccaatgcttgtttcaagaaagagattcagatattataaagtcttaactgaaaacattcactatatgacttggaacaaaaatttctagtgttagctgttggcacaaataattcattaaatgccagttttacccattttcatgttgcttcagcatctaagataattttttcactgctcattaatgtgtcttaaagacctaatggatttaaagaaagcaaatatatttatcaatggtatagaagattgaggaaaatacttccatccaaattttcagtctagaaaggtaaatgaggaggcatgtggacagggtgcaccctcttgtactgtggcaaactgacctaaataacacaaaggaaatcattcatttgtaccttctttattcccaagtaataaacatcccaaatatctattgggcatatatgatgtgccaggctccatgctaagctctttacctagagtatcaggtttaatcctccaggcagccctttgaggtgggtaagattactttcagcgttttacagatgaagagattgaagttcagggaggttctgtaacacttggtaagtggtaagtggtggagctggagtccagaagtctgctgagctctactcactgaggtatgctcctctcctctctttgtcatattttccctccttgtaaacagagctggacaacctagaaagaaatgtgaaggtctacttcaaacaaaaccaagcagttagtttctctggatatcaccccaagccccttaactatatagaccttaagatgtcttcaaagcagcactgttgaacagaaatattctgtaagccacatatgtaatttaaaattttctagtagtcaccttaaaaaaggaaagtgcaacaggtgaaattaattttaataatatatttcatgtaagccatatataaaaatattataatttcatgtaatcatataaaattattgagatactagaaataactcaggagaaatacagtacaggacatcttttgtaatgcagcagatagagtgaaatgtagttctaccaaacaacaaagttgtgattaatggaaaaaaaattatttactgcttaagttttacattttaaattcatatttattaaaataaaaaatgtggttcgccattcgcactggcttcatttcaagtgctcattagctattggtggcaagtggctgtcatattgaacagcgcagctctatagcaaaaggtattctttgtctcctaaggacccgggactcctagacactctatccccatccctgactcctgactcctctcagcatccatcttattttccctgcctatgcccagaactgctatatataatgtgcaggttatacactacaaaattctgagatgtcatttatattgtagacccagtggatttgcttatttactgcaacaggttttaggaagatagaagtaaagtttttaaaagaagagacactttttcctaatttatgcaaaaagacttttttttttttttttttttttttgagacaaggtgtcactctgttgcccaggctggagtgcagtggcacaatatcagctcactgcagcctctcgaccttccagggtcaagcgatcctccctcctcagcctctctagtggctgggactacaggcaggcaccatcactcctggctaatttttttttttttttaattttttgtagagacagggttttgtcatgttgcccaaactggtctcgaactcctaggctcaagcgatccaactgcctcagcctcccaaagtgctgggataacagatgtgagccaccgtgcccggccacagaggcattatttttagcagggtgggcggtggattgtagcccttctgtctcttcctcgcattctggtagttggtcccatggcattgttctgttgtatgctcagcactactccagtgccctgcctgtggctgaaagtgtagaagcagcctcagtcaacctctcctcccccagaaatactgtcacagagccatagtcattcttcatggtagtttaccttggagtcatatgtgtgttattcataattgtatttccagtgcttagtgcacaataggtgctcagcatgtttattgatttgaattgttatcttagctttgactctgtatttgggcctctgcattgtgtcctcagttgtccttaatgatacatgacccagggctgatttatccaaatgctgaccttgccctctctttcatggagtcacagatcacccttcatatggtacctttgttctgataatactaattgtcattattgttattttgataataatagctgccattgattgatcacttactttgtgtcaagcattgtgcttagcaatttatgtaaattatttcatttaatcctcccacaatatctataggaggtaggtactattttacaatgaggaacctgagttactgagaagttacattacttacctgaggtcatacagctagtaaatgtcaaagctgacctttaaaaccagttctgtctgacttcaaagctctctcaagtgcccttttggttatctggggccttcctgacaagtgactgtgctgtagtggactgattatttgtctgcccagactttcttcctttgggcagctactctgtccaattcatgtggtttgggtggagttgacactacccagggatgatcatgtgattcagccttggccaatccgagcagtccctccacttgaccaagggattggctcaggggttagcatgtgatccagtctggctcaatgggactcttctgctggcatttaggaaagggggagctcttcctctgggatttaacctggagcgatgtaacctggagctactggtggtcatttttccctgctccatggaggaagccgcaatacaagagaatgggaccgtgcagtgagaagcagcactgcacggtggtgagagcacactcagcattgtttgaagtgcaggagtcagctgtgccaggacttctcgattatgtgagccaatgtgttccttttgttgttgtttgcttaaatctaattatgtgcatttgaaagaaccctgcttataccgggttttcagaagatgagtatttttgtcttggattccctatgctattgtctgtctgcccttggtcatccactacttttttggccttcgtgcctacttggtgccttgcaggcctctcatccctgtagactctgcaccatgttcagcttgctgtgtcccttttaggtcagtaagccctgccctagtgaaaggaggtgccacacccaacacctcctcaccaacagcccccgcccctccatcctgccctatggcatagcccacaaatggatctgggtgggaaaaggattttgccatgagtggaacattagagaaatctgttcttcatagacatcggaaaaattactcgtcaacctactctttggatgctgatcaaagactattgaatgctaacctcatttggtctctgacaccatctgggatctcagccagtgtaggcggaggccttgcctcttatccccagtttttttggccaccagcctttctaatcaactgtctttctatgtactctcaagcctcctatgattttgaacttccattcttctgctggctgccttcccaaatctttccagtggccctttgagagcattgttccactgtgaatcaactctcccacaccacagcctcctcacagagtaacagcattgccttccctgtagctctctctgctgtagcctactcctagcttccctttgccacttctagggcatcacttttctgccttcctgcaaaacccctttgtcctttagggttcaagccattcatgcaggtaccctcctggtctctccttttgccaccaacctctttgtcattctccctgattgactcacctggttcatggtcatctctcccagctctgctatctctgcattcatagatacaaccaactttttatgtttgcgttagttgtgcagttgtcttggggttaatgggagtcgttaattatggcaggagtggaaaataagggagacttcataaaagagattacgtatgatcaggaccttgaaaaatgaataggatttcaataggtggataaagagggaggagccttccagagagaacaactcgagcagatacatggggatatgaaaagacctggtacatttgcttgcttgagtcctggaaaacaagtggtaggaaaggaaaagggaactcagattaaattggacatgattaggccaggctcggtggctcacgcctataataccagcgctttgggggggcctaggcaggtggatcacctgaggtcaggagttcaagatcagcctggtcaacatggtgaaatcctgtctctactaaaactacaaaagttagctgggcatggtggtgcatgcctgtggtcccagctactcgggatgctggggcaggagaattgtttgaacctgggaggtggaggaggttgcagtaagctgagattgtgtcactgcactccagcctgggcaacagagcgagactctgtctcaaaaaaaaaaaaaaaaaagaattggacatgattacatttatttaggattgaggaatgaccctaaggagtatgcaggtggaagaatgcaagagaaagaacaaaaagaagaggggcaggatgatcttgtaaatgacaggatgaaaactttattggagtgattgtaaaaggtgagaaggagtaattaaaacagttaaagaaagctcataataagactacgggctttagagagaagagataatagaagaagaggtggaaggattttcaggacagagtagttatgtggaagcagggagaagggcagaggaatgagacaggacagctgctgctaggatgccaggagacgacagctacatactaggtatgaatcaagttacttagccgttttactgccttatgaataaaaagtaagataacttacgtatttcatgatagtaaaaatgacttacattatgtaagcctcagatgtttcccaatctgtgttttatagactacaactctgggagatgttaacgaggttcaggggaaatagagtaagttctatgatcaaatgaggttgggaagcgctgcattctatatgattcacctattaaagcccctgagaaatgcatacaaggaaccaatttgatgttgtttaacccagcttttcccaaatatacttgtccattcattcatttgttcattcattcaacaagcatgcagtaaatgtgtgctatggtagtatgttttgagtactctgctggccactggtcctagagtagaataaagtcacccagtgttcctacatttatgagattatggtctaatataagcacatgttatcatcccacagctcctagtgttctgaggaacatgatttgggaagccttcagttaaggtatttaatattgctttttgtgctctggaatggaatgacatggagtgattgtctgcctatatctctgcctttatgtctctatcttacatcagtacctctgcctcttcacagaatgtttcttagacctgctgccttgggcagggatagagctgatgacaaggaaactttcaggtctgggaagttggtgactcacccaagatcacccagctagttagttgcagaaccagggacagaacccagctcttctggctctaggttctggttctgtgctcatttctttcttggtaagaagggacaacttgaaatgcttgaaaattaaaaaaaaaattaagcagactcaacagactcagtgagatactatggcctttgccaatttaatcaacaatagcaggattgacttaaggatcagcagcaccaccaccactaccactatcatcatcatcactaatgctgagtaattactataatccatgtgccatactaagcactttatgtatatttgcttatttaattcttacaactctgtgaagtcataattattaccctattttataaatcaggaagcaagctcagagaggtaattgtcggtgtttatacaactaataaggagcagagcaaagcttccattttaggctgttttcagagtccaggctgtgaactgcgttctgttatctagtgaaatgttttttctgctttagtattttcctctcagaatcagttggtcttttctctcttccattttagcttgccttgcttcttcgtctttgtaaaaaccagatcttaggatctgatttgtttattctatgtcaggtagcattcatccaatatttgcttctactatttcttctctgtaaaacccatagtcttattatgagctttctgaaaccattttaattactcctcctccccttttgcagtcaccccaataaagttttgatcttgtcatttacaatatcatcccacccctcttctttttataataaaggctgttatttctcttacattcttccacttgcatactccttagagtcctccctcaatcctaagtaaatacaatcatgtccaattcaatctgagtatttaatgaataatatgtgaaggaactgctttaggagctgaggacccagtggtgaatgcacagaacaggttcctttcctgtgaaacttacaaccagtggggagagtgcacaagaaaaacaacacataatcaagaaaagtgtcacacagagataagtaccatggaaagaattaaaacaggataacatagtgagaataactggctgtctactttagactgggtagtcaaaggaaggtctttttttgtggaagtgaatttaaactaaaatttgagttataagaagaaaactgcaagagagaaatgggtggggaggagggagaaagaaaatggagcactcttccaggtagagagaacattatgtgccaagaccccagccatgagtttgcagtgtttgaagaataggaagaaggctggtgtggttgaatcatagtgggccattggggagtggtactagatgcggttagagaagtaggtcatatactaggttaaggagtatgggttttagtttaagtgcattgggtaggcgttggaggattttagcagggctgatgacatagactgatttatgttttttaatgaatgtatttactgatgcatggaaaaatgattataaggagataagaaggaagtactgagacccattaggaggatattccagtagtcctgatgcgggataatgatggctctattagttattgccacagtaatcctgtgtaacaaacagtcccataaattcagcagcatacaacaattaggatttatttttgctcatgagtataggatgtctgggtaattctgctgatcttggctgggcttggttgatcttaactgggcttgcccatgtgtctgtggtccactgtgggttaggtaggcagctctgcaatattgcctgggttctctgatatgtttgaggggccagctggctgtcaactagtatagggatggtctcagctgagatgtctggatcaactctgctctcctccatatgtacattacatccctctagtaggctagtttgggcttaccctcaggctggacagttggattctcacggtgatcgcaaagaagcaagagaggaagtagaaacaaacgcacacgttttaaggactcagcttgtgtcaagtttgctactgtcccattggtcaaagtaagttacataggtatatccatagtcagtgtgggagggcattgccaaagaacaggaattcagacaggtgtgaaaagatacaaggagatatgaaaaattggggccattattccaatcaatctattgcactcatgggagagtagtgaagaatgagaatcttgaataggttcaggaaatatttaggggtacagtccaaagaacatgctgatgaattagatttgagtatgagagaaaagaatgaatcagagctaatgcctagatacttggctgagcagctggggagatgatgaggccatttacttggatactggatgaagagcaaaatttaggggactatctagagctctgtgttaagtggtgttgtgtttgagatacctgctagatatttaaataaagatgttagggttgcagttggatacagcaatctgaggttctggagaatgtcaaagctaaagatgtagattttggagttatcagcctatagatggctcagctggaattccaggatgcatgccttggctgggatctactgaaatccatcagccagtcaccctgaagtcttctagtctatgcgtaactgataagactcacatcgtgctttgaatgtgcttttctatttcactagtttaaaatattagtgtctacttgtataatttgtgctgtgaactgaaaactacagttttcccactctgccatgtacagccttctgatttggcagaaataatactgaaaggacacctgccagggtcttagtaattcttagttatagtaatctgagacatttcagctcagggttagcagaaagatcatgaagtcaagaagcagggcttaaatcagatgaagttggaatctccaaaggtaattacttcctttgtgaagccataggtctttgggactgtttcctgttaccttgggccattcagccaagtacaccataaaatacttggcctatcaggaaggcacatactagcatttaaaaaattttacaaacgtgctgtttaaattatattacacaatattaccatgaacataagatttacatttctgtcacatactggagagtgtatcttaaactgaatttcactcaagttttgccaaaagtggtcttgagataatatttaacagatacagaccaaggatcatattcctgatttacctatttctgtactttattcctatttcttgaattaaccagatagcaacctatttagctcagcccaggtaggaatgcctttactaaggctttatttactaagccattatgaaatgttaatataagaagtagcctgttgaggagcacttttgtgatttctgcccaaactgctgttgaagacattttgtaatatctttcattatcttttatgatcccataaactggtttctctttggagtttagtgacagggaaaatttttcttttgataagctggtgtgtaatttatcataaacattattattctatgaagcattcaaaaaattctttaatctctgatattttgagaagctccaaacttgacacacgattacacaaaatgtttcagatttctggttttcagtgtgtagtagaattgaagcatatatgaattaggggaattcaactctgtgggccagccaaaaaaaaaaaaaaagaaagaggagacaaagagagagaaacaacaatgtaaagagtgcagatgaacctattcatctttccacctgatgagtatacaccccagaaggggtgtgtactggaggcgtgtgaacctagtgctctctttgtctgcctgagtctgcagaggatatccatgagcatctcacagtgctcaatgtgatttgtggttaaagatacataccttgttatacaaactgacccctaggcccatgccagatactttagtcccaaaccagaaaacctaaaattgattattctgtgggctggattgtttgcaaaaaggcctgcatcattcccctcccagtgtctgctcaccttgagtagtcacctcccgtactgacgctgggcttgtgacttgcttttgccagtgaaacaagagcaaataaatgtaaagcattcagagacatgcaatgtgctgtgtactgggtgcgtgctctctcttactgcacttaggaccctgaggactgtaggagcaagcccaagttgtcctgttcaagaagccacgtgtgccctggctgatagcttataattgccagaagcgtgaatgaggccaccctagatatccaggccaggaaagcccaactgacctgcagaatcatgagaaacaatatgtttttattatttgtacaccactaattatggagtgggttttgtttttgttctaatcaaaagctaactgatagaacttccagtgcttctggacatttctgctgatactgtgttggacatatccagagagagtgtatcagtctgcagtgtgacctgtgtctcctgtggaagactcaaggctaattgactgtgttcagtttttaccctatgtgctgactgagaaccaacccctgcataagtctgagttccactctgttttccactttctgccttttggtttctgactcctccttttagttttaattcttgtctgtatatttacatgttgtacatgtattgtttcttaaattacttttattgagaataaattcaattaacataaaatttgccatttaaatcgttttacagagtagtctagtgatttttactatatttatgatgctatgcgtcatcgccactatctaattccagaagattaccattatctcagaaagaaaccccacacctccatatcagtaacccactttcagcctgtgtggatttacctactctagacatttaatgtaaaagtaatcagtacaacttgttgccgtttctatctggcttcttttatccaacataatgttttcaaggttcattcaagttgtaccatgtatcagtatttcattcctttttagggtagaataatatcatatttcattgtatgaatatataaattttgtttattcattcatcagttggcagacattgggttgttttcactttttggctgttgtgagtagtactgccatgagcattcacatacaagtttttgtgtgaatgtgtttttaattctgttgggtatatacctaggagtggaaatgctgagtcatacgaaaattctatgtttaacttttgaggaactgccaaactatttttcacagtgcctgtaccattttacatttccagcagcaatgtgtgagggttctgatttctccacattcttgctaatacttgttcagtttctattttttggattatattcctcctagtgtgtatgaagtggtatctcgtcgtttcaatttgcatttccatagtgactaatggtgttgaaatttttttatatgtttgctgaccattcatatatgtttttggagaaatgtctattcaaatccttcacccattttaacactgggttgtctttttcttgtttaacggtaagtgttctttatatattctggatactagaccattatcagatatatcatttgcaaatatgtttttcattctgtgggaacttcttgtaaccttcttcaataatgtcacgcaaaaatttttaagttgatgaagtcctacttacctatttttcttttcttgcttatgcttttgatgtcatatttaagaaaccattgcttaatctaaggtcatgaaaatttgtacctatgttttcttctaagagttctacaattttagttctttaattaaatctttgatccattttgagttaatttttgtatatggtgtgaggtagaggtccaaatttatttgtatccagttatccctataccattgttgaaaatatttttctttccgcattggatggtcttgacatcttggtcaaaaataattgaccacagttgtgtgattttatttctggacccttaattctgtattgttgatctatatatctatccttatggagtactacacagttttgattgctatgccattagagtaaattttaaaattgggagtgtgagtcctccaattttgttcttttttttttttcaagatagttttgtctattaattttactatatgggttttagaatcaccttgtccagttctgcagaaaaggttgttgggattttaatagagaattcattgaatctgtagatccatttgggaagcattgccattttaacaatatcatgtctttcatccacgaatgtgggatgtctttccatttatttaggtctttttaaatttatttctacaatgttttgtagtttgccgtgcaaaaatctcattcttccttggttaaattttgttcctgcatttttttttattgaaacatgtctcaatttctctctgtaggtagacaagataaaaatgataaatccgtaaaaataatttttcttgttttgagatggagtatcactcttgttacgcaggctggagtgcagtggcgtgatctcggctcactgcactctctacctcccgtgttcaagtgattcttgtgccacagcctcccgagtagctgggattacaggtgtgtgccaccatgccgggataattttgtatttttaatagagatgggtttcaccatgctggtcaggccggtctcaaactcctgacctcaagtgatctaccctcctctgcctcccaaagtgctgggattacaggcatgagccacggtgcttggcccaaagtaaatgtttttaatgtagctcttcagctattttaatgtagccagacttttttcctagaagtcggggaatgaggatactagatttctagtctcaaaggtgttattattatgtttataattttggctatatcatcttagcttttatttattcatttataaaattgtacctgtcaaagtgccatctactctgtccattttaatgttttagcgattaatagtaatagtaatgctatgaagattaagttaaaacagtaatactgatagcaagcacttaaatggcatctatgtgccaggtaactattctaagtgttttctgtgtataaacttacttaatgaaattaaatactgggtggggtgaagctttaaaggactgtgtgatttttttgtgtatgtgtgtttgtgtgtgtatgtgtatgtgtgtatacacgtgtacgtgaagtctttttggatgacatttggaaaactcataattttaatctagagttctcaaacaatagttatagtcaatgtttaattttttttttttttttcctggagaaggactctcgttgtgttgccaggctgcagtgccgtggcgcgatctcggctcactgcaacctccgactccctggttaaagcgattctcctgcctcagcctcctgagtagctgggattacagacacgcaccaccacacccagcaaatttttgtatttttagtagagatggggtttcaccatgttggccaggatggtctgaatatcctcacctcgtgatactcccgcctcggcctccggaagtgctggggttacaggcgtgagccactgtgctcggcctaatttttaaagattaagatattaataactgtattaatgaacaaagggagggaggtgatatctctcaactctgcctgtttgggctttaattatttcacctctcaattgagaagtttgaatccaatgatctctaatcttagagtgcctagctctcatagtcagctgtctaatggcttagatatgatatctctctgtcctgtgtgtggtatttgagaagaaggatgttgcaggggaaggctctttgaggaattagatcaaaactccacagaagtgtgagcttggggaaggcagagcttgtgttttccatgtggaatgttatatccctgtcacagtacctgatatacagtagagtttaaataaaatgttttgttgaaaaatgagtgaagaaataaacataagactggaaagaagtcattttgggtttgatatgatttggctgtgttgccacccaaatttcatcttgaattcccacgtgttgtgggagggacccagtgggaagtaattgaatcatggggcaggtctttccgatgctgttcttgtgatagtgaataagtctacaagatctgatgattataaaaggggagtttccctgcacaagtgctcctctctttgcctgccgccatccacgttaagatgtgacttgctcctccttgccttccaccatgattgtgaggcttccccagccacgtggaactgtaagtccaattaaacctctttcctttgtaaattgcccagtctcgagtatgtctttatcagcagtgtgaaaatggagtaatacagggttttagtttcttttaaatagtagaaacgtgtatatgtggattgagtgtggggagaggaaggagtattaaaatggatatatttaaattaatataagctgtttcttactttttgtatttcttcatactcatcttgtatttcacaacactgagcccttggcctgggatgtgcctttgccttgccatctaccaacttactcagctttttagcccagcccaggcatcacctttgctggttatctctctacctcttttttttttttttttaattatactttaagttctagggtacatgtgcacaacatgcaggtttgttacataggtatacatgtgtcatgttggtttgctgcacccatcaacttgtcatttacattaggtgtttctcctaattctattcccccaccagatccccaacccccaacaggccccagtgtgcgttgttccccgccctgtgtccaactgttctcattgttcaattcccacctaagagtgatctctccacctcttatctccaggcagagttgaagcttgtaaccatctgtggtctagcactgatcacatggtaatgaaattgttagcttctgttgtgtctgtcccttttactagggtatgagtatcttaatggccatgttttatgttttattttgataacatatctggcatttagcaggtgttcagttagcagttgttgagtgtgtaaatgtgaaccaatacagaataaagatgaggcaatgaccaactgaccaattgctttcctgagtgtttgctgcgtgtaaggaattttatgtgcatttctcttacttctcatgacaatcctttagagttggtatcatcatcatcctcattttacagataagaaagcagtctctaaggaattaagtaacttgtgtaaagttatgcagcaaataaatggcaaagctaagatttacagccaggttaagcagacttacctgtttaagttccttccactaaaatcagggtttttggccagaatttccagtaaaaataatgagtgaaataagatactggacatcaggtgacatcaggaaaaaaaagatcttcgggatgatgtttaaagaaccattgcttatgtcttctccagcagtctcaggaaatagattaaaaattgggtcttttaatatatcaaaaggtacaggcctgccctctcagtggttgaattttctgtttaacacagtagtaaaatgaggaacaagtgggtttctagatcaagctacgtagaataattacatttgggggctaaagacaacattagagctcatcagcctcagccccattaatcttacagatatcacaagacccacagagtttgtaagtttggtcctcagttgctttgtcagttaagggcagagagtgttcctttacatcatgaggctcactttatatattaatagaaaatttagaataatggtagataaaaacttgtcatattaaagagacaagagcatgagagcttggttgaaataccatcacttcacacattggagatagtatctctgagcttctggtccccctcagaaaaaaagaacttcctgcataggacagaattcatcatcaggggcatctctgagaaaaaaggatcctgtaagttgtttgttaacttatgattccaagactttgctaatttaagatgcaaatgaatatacaatggtccctccttatctgtgtggcttttgaaataagagttttctttcagatttgcccactgatagtaggaggaactacacatggtgaaagatctgaagtagacgcttctgttacctttgagatttggcttctgaagtaaataccagcaagctagataaagtgaaatcattgtcatccgataaatacttaccgaatacccaatatatttcaggcagtgttctgggtgctagatcaggccaaatattatattttattttgtgtggcttgtgtaagacagaatactcagagggaaaagaagacttggaaatatgcttttgagaaattgatatgtaatggaattgagatttatgtatacgtgtaacatgtacacaaacattaatttattttgttgtgggtccatattgcttatataagtaaatttgattttcagaatttcacacagcactggaagaaattggacattgacttattttaccaatgtagcaagacactgcacattaccacttttaaagtccttaatagattgtaatgtcatgcgttgtttttaaggtactcttttcccattcttctctagaacaaagatcatttcttgttcatctttgttaaccaccttagtgcctcatgcatggttcctaatacatcatgactgtgcaataaatgtcagaataaataatcatgaatgtctcaaattatttctgtggacaaattagctcatgaactgaaaatggtaaaaagatggttgagtgaagaagaggaaacatttgagggaaggaagaaaattgacgaggataagagatgaatgaaacaagaatgaggtggtcaagaatgctatcatatattatatgtcctggtaaacttctgctgtgttagaaaccatccaagacttaaagggatacaaccattttatcaccctcatgaattctggaggttaagaattagtgcacagtggggatgtcaaggctcttatcttggaaaactttaatggctgggggtgacttgaaccacaaagggctggaatcatttgaaggtctctcactcatgtgtctggcttctaggctgagatgatttgaaggctgggctcagcagtaattctgcaatagaactgtatgtgatttctctccttgcagtgagcttttctcagtatggtggctgggttccaagagggagaatattcaaagagctagacgtccaaaaaaatcaagcagggctacttgggcttttatgtcctagtctcaagacatttctactatactgtattagtcaaaggagtcataagcctactccaattcaaggggaggtgacatagacccatgagaagagtgtcagtgaatttacaggtatttaaaaaaaaaaacagaaacagcagcactacatattataagtggaccagataatgacaatgatgaatagagcaaagaacaggaaagttcattatcaatttacttcctcagagatgggacatatgacaatgtcattagacactttccaaacagtagttagattatgacatacatccatgatactttttgagtatagttgataatttttatttgttacaaatcatctatgagaatgttttctatcaaattagtgtttttaacagttttttttttcctgttagggatcaggtatgtaatggctggcatttcagtttttgaaattcttcattaactgagctccataagctttagaaataagggcagatacttgtctggtcaaatgtgcctttatgatctagtgtgttctgcagttccagttatgatgccgacctttggtaatctttctaatgattcttttataaaaagtctgccatttgaatatactcactttgcctgactgcccactgtgctttgggactttgttggtctgtagagaatctttttatcatgatgtagacttgaaaaagaacttcagctttcatgaacttgaacagggaaatggaaaggacatagagggaagagaggagttataatgagttcaactgttgcattagactgtggttttatttttgggagctagaaatcacatattcctttatgtctgagaagaggtagcgcagattacattagcacaaggctctgctggctcacaggaatcaccgggaccattggaaggtatttgtgatgaggtaggtagggcagtaataatggtccttggggaaggtgagcccatccacctttttcttgtgttgtttgtctgttttggtgcttttttccccctccctcctttctcttcctgcttttacccttttctcttttttcttatcaactctgaagtgtttgatgactgggacatggaaaactatgttattcctgtaaatatgttttaaacactttttattgtggaaaatttcaaacataagtaaaaataggatgatataaggaacccctagtatttatcactaaacttcaatagttatcaactcatgaacaattttattttgtctatactcttccatacccttcagattaggaagcaaatcacagacattattttatctgtgaatttttcagtatatatctttaaaagataagaactctgaaaaatataatcaccataccatcacacacacacacacacacacacactcacagagcaaatcataaacaactgaacactatcttaatatcatcaaatcctcatatcatcaaacaaatattaccgatgaaccttaatatcaacaatattgagttagtattcaagttgccataattgtctcatacatttcagttgagaggtctcttaagactaaatatatgtcagaccctcctgaatctctctcttttatttttgttcttaaatttttttttgttaaggaaagtttctcatttgtaaaaaaaaattgaatgtactaatgacttggactcttcattcctattttaaaaacattgagaaaagaatatatagacacggatgaatgtttcatattaaaaataacagaatactgtggccaaggaacaaacattggcatttgattatcttatatataatttccaaacattctttactctgatgctttctcctagtaaaaggccctgaaaatcactgtacccactgagaaatttgttttatcttattttcacttgtattgtttccctctgcagtagcaagaaatagacaaatattggttttatacaagaaattcccttatcagaggagaattggtgtcagaatttgccacttaaagtgaatccagttacatttcacagtaaacagtaaaagagaaaaaacctggaatgattcagactttatcctgaaaactaaagtgaaaatatgtttacctcatatttagaaccatttagattataactaattcataggaaaaagagtgaatctagtattttcttgatatcattttctgacaaaattttaatcaaaattttgacttcttttacgtgtgagtttgtcagcacaatttgaaagagagctttttttttcaaaagcattagaaagttttaccagtttttgcaagggttttcctgttccatagaataaatgttaaccgactataacaaagataccatgatatataatttctaaaataagatagaaatatacttgtctctcacaaagtaagtgaactagtctagcctctgctccattaagtcattccaggatcaggctccatcttgtttcttccccaccttcagagtaatgctgggatgcataagggaagttgagtctgccagtcggaggctggaaaatgccctaaatccagggaagtagcttgtctttaagttgaaaatggcctggaaggagtacatataacttctaccacacatctttttggtcttaacttagtcagatggccacactttactgcaaagaaggctgggaaatataaatatataaatacatataaatatataaatttatatacatatatataaatttacataaatttatatatgtaatgcatatatctgcatatggacaataagaaacaactattcctagggcagcactctcagtctgtttctaggttcacatgtcccctaatccagtgctataatcacctaccctatggtagtggactggggtaggggatatagtatcaggagagatgagaaatcagccggcctttcaacttttgccttttgtcctaagaggacttctcttatcctctctttagatgctattgatagtgaaagataagggttttatgcagatctcttggtgctgttcaaggtgtctaccttcaacaggttagcagatgaatactcaaaacgttatagcctgctgcatatcaactggctgaaaggagaaatatataagactttaagaaaatacaggttatcacatggtgcttttgtttaatagctcaggaagacagaggtgtacagtgttacttccttctgagcacgaaaacattgcctaatcctggaatagctccaattcatgacgttaaatggggagcctagaatgtactctattttgattgaactcatcctagtatttttttcctttgttgtatttctgctatttaatccccttttacaaaagaaatttggggctttaagctgagagtatatattgcagaagaatatgtggtaagatttattcttatataatagctacgcattttggtacttttgaattgaaatataacctgatactgttgacaggcaccacagcatttgatttctcagattaaggtcggtttgatgtttatttgcacaaatttcctaaaattgcaaacaaatagtaactttgtcacaaacttgtgatgagattgcaaatggtaactttgtcataaacctgtgatgagatgtgaaataaggtcacctgttctgatgtagaagtttgtgaactgagggctttaactaagttttaataatatgaggacatcaccaagtattaaattgaattatataatattgctaattctgtaggtaaaatactgctggatattggcaaaatgtggcacatagtaaatgacttaacctaataagatgagaatttcaacaacctctaatcactctttgcttgctcttataaatagtccatcctttccccactctgttatcagggccctttttttcttatttactatagtccattccataatatcatttggtaactcacagtcacttttgttttcttttgtctctgattttctttcccatttagcacctctgttctcttgacttaaaatagtatgaaaagtcatattgactaggataggctgttctagtcaccagctatttttttaaaaattattattttctctctctctctttttttttttttgagacagagtcttactccaacacccaggctgaagtgcagtcgcacgatcttggctcactgcaacctctgcctcccgggttcaagctatttgcatgccttagcctcccaagtagctgggactataggtgcatgccaacacgactgtattttcagtagagatagggttttgccatgttggccaggctggtctcgaactcctggcctaaagtgatctgcccacctcagcctcccaagtggtgggattacaggcgtaagtcaccgcacctggcctattttcttattttaattttattttttaattgacaaataataattgtacatatttgtggggcatatagtgatgttttgatatgtacaatgcatagtgatcagatgcagggccattggcatatccgataaaaaattatttgtttttaggcagaatttttcatgatgaaaaaggttttaagaactgttggctaaaattgctggactgtgaaactgagtattagtcagatattcagatttgcaacgctggatagacagtataactttggtggtttgtgtttctcaccggtgatacagtgacagtttctgttgtctacctcagaatattagtgttcaaagacaatgtgttaaaatgttcagaattttagcagttagccgccaaggcaaagggaatagtactcttgtgttcaactccaatgagatagaaaaggggtttatgttgcagtcgagttttatttaaaaaagatgtttgtggcccggcgcggtggctcacgcctgtaatcccagcactttgggaggccgcgacgggtggatcacgaggtcaggagatcgagaccatcctggctaacacggtgaaaccctgtctctactaaaaatacaaaaaaattaaccgggcgtagtggcgggcgcctgtagtcccagctactcgggaggctgaggcaggagaatggcgtgaacccgggaggtggagcttgccatgagccgagattgcgccactgcactccagtctgggcgacagagcgagactccgtctcaaaaaaaaacaaaaaaaaaagctgtttgtaatccttagtaacggctaggagagaaagctggaatcctgaagttttgtttcatcttcattttaaaatttagaacatcaaacctattattttctttctcagaggggacatctcccttcaattttcgtattaagagtttgttgtggctcttaatgatgccctgaaagtcataggctatctctgttgaaatctggagattgaatccaattgcacttagcagtctcctaaactaggagactggaagtgacacctcattaaactttttccttccattccaccttcctttccactagagaagttgtatagtgtagtgaagagtgtaggccctgcaattgtattgcctaaattaaagcctggctcttattcttaccttgtgatgtgtaaagtgtagacagtactagtacatacttcagaaggttgttgagagaatgaagtgattcaatacattgaaagtgcttagtgattgggacagtgccaagtagtaaaagcttaataatgataatgataatgattttttattatttttctgtgtgaatagtaattccatagggatactcctggattcccctatggtctgcttattcctccggatttcactgatcttatcaaaaggttattagattgacctctcaggacaatgatgtttacttttaggaaaatctaccctcagcctcctcccccattttggtccagatttcacagcatttagcaggtatttcatagtttgtagtttgggattgaaggctgtctttttatttctttgaagatgggattctcttcctctggtttttatgttttattatttagggtagaagagtagaacatatacctttccactgctattctccaatgatattctgattttcagagggaatcattttcattttttcaaactttttcatctcattgtatcttattaaacaaaaattatgggaggccattgttttggactgagctcctgtactaggccccaacaaaccagaccaaacagaaatggagtcacccatgctaaatgctgcataatcaaactgaagctttaagggagcaggtagatccccaaatagaccattttcccccctgaaaacagaagattacagtctacgtgaatcagtttaataaggaagtcccctctgttttaatctttaccaaaaaaagtaacctgaagtaacttgatgttactaatcagctttttttttttcctattattctgtttccttgttcccaccttataaaatccatggttctgccctggcccagtgggagctctcattctattttacagagtagaggctaccctgactcatgaattgtgagtaaaagtcacttttactaaatttgttgtcattttgtctcttgacagtctctaaacatgctttacattgctacttcttgctttttcaattgtagatattatttattggtttcctcctccttctcctctgctaccttttcctccttctcctcctactaccatggaggaaatagctctctttcataaagtactcccccacccacacgggagcatacttcctgctctcacacccaatgtatttatattggtagtaagattatcactattgtttacctgattatgacggtgtagttgttatttgtagcagaactctgtagcatacctgtgattatttttccttttctaaacaattttttgttttcctttggaattattttgttttttaaaattggctaaattttactaacttattataaatcttctccccatacattcagttttgtttcctagaagaattctttggaagaacctccttacttgatccaatccggactggttgtactcttggccagctgctcagtgtcattcattttgggatttcccttcatcatctattgggggagggggtccctttacctctttcttatgttggaatgtttgtttcctaaattcttgtggtttttgcttttttggtttcctgctttgttttggtattttggctacatccccaagtagctttttgagaaaggtggataagagaaaattgttaaagccttgcgcatatttgaaaaacgtctttattctcctgtcacttcattggcactttggctgagtatagaatttttgattagaaatcactttctttctgagtttttcttcattgtcttctactctctggcattacccttgatgattaccattctgaattttgatgctttcaatgaaacttacatttaagcttgcttaatatttggcttatccccatagttgtgaaattttacaagagttgccttaatttggtagtatttcaatctgaaaataaccttcagtttgaagaaattttcctaaaaattttctttgattgttttctcattctgttttctttgctttctctttctggaacttctggtttttagatgctgaactttctgagtgagttctgtaattccattatgttttctgcgtcttaattttttttttttttgggagagtttctcaattttatgttctaacttttccattgagtttttaagttctgtcattttatttttgatttctagtagctcctgtttttttggctctatttcttattttggctgtgtcttgaccttgtttcatgcatgtatttcccttaattctttgattttgttgagtttttttttaacattttctttttttctgtacaacttttgtttcttccaacttgccctttttttgcatttgttctttgaccttagattcatattataatttttcctcaattgtctggggtgatccttggctttctctcatttatcagagtgggactttaaaaagtcagttgagctgggcgtggtcatgtgcacctgtagtttcagctacttggggaggctgaggcaggaagttcacttatgcccaggaatttgagtccggcctgggcaacatagccagaccttgtctttaaaaaaaaaaaaaaaaaaaagtgtcaattggaagcttcatgcatggtagtgggccttgctgactgtgggcttaactatagggtagtctggctgtgccatttttttggggacacttctatgtctgtgtcttcaagacttttcccttagtccagtcctgatgtcctggagccagatgggagaagagagctgactagcctcatcattgatatggacacttgtacagtttcacttaagctcctccttttcagtgtggtattcccagctgcagctgcacttagtctctcccaggatagagaccctgtgttttatagtcttccgaaataaacctctagttttcttccagggttgaggagggttagtcacctagatctatggcatggaagtggagaggatcggggactctctttattaaactgatttgccaacaattcttctgctttaattccttctccatcacaacttctagagataccatattcttctgattcttgagctatttggatgttttgcagaagaaattgggttgtttccagccttccccttggtgggacctggcacatatttatttgttttccagtttccaaaattctattgttgtttccttttttgttttctatttccttgagagtcagttccttaacaacaacaatgtaactgtttttaatggaatttcaggaaggagccaatgcgaagtgtgcattcaacactctatctttggctggaagtctacatgaggagacttttccttcatttgtatctctctgaactttagtagatttcttggccaggacttcccattggccaatgaattataacaacagtggtgaactttagttgtatgggatagaaggatagggaaagcccgtaagtaggaactaggagacttttttctagtcttggcttgtgtgaccttgagtaagccatttaacttttctgaacttcagtttcttgagggagatagatggtgactaagattcctttcaacttaaatggtgtgattctgtataagagtagtaatcacacatatgtcagataaggtgttttttttttgttttgttttttttgtttttttgagacagagtcttgccctgtcactcagactgtagcacaatggcgtgatctttgctcactgcagcttctgcctccccggttcaaacgattctcctgcctcagcctcccaagtagctgggactacaggcacccgccacctcacccagctagtttttgtatttttaatagagatggagtttcaccatttccaccaggctggtcttgaacccctgacctcaagtgatcctcctgccttggtctcccaaagtgctaggattacaggcatgagccaccgcacatggacagataaggtgattttttttccccaggacattcaacatgaatgttttttctgcccctgatgttgagaccttttgcttctagaactgcatataagtcctgccccatttatcctttgggccttccaaaagtctgccttccatttgtttacaatggtattgctcactgtgttgggaactacatgtctacacatggcccgtttatgagagcatcgcttgctcttccctggtatccattctttgttgtttttttttcagacggagtcttgctctgtcgcccaggctggagtgcagtggtgcgatcttggctcactgcaagctctgcctcctgggttcatgccattctcctgcctcagcttcccgagtagctgggactacaggcccccgccaccacgcctggctaattttttgtattttttagtagagacggggtttcaccgtgttagccaggacgatcttgatctcctgacctcgtgatccgcctgcgtcggcctcccaaagtgctgggattacaggcgtgagccaccgtgcccggcctctgttcttataagtagtcattttcacccttgaaaatgtgttgcacaaagatgaaaatataatttccagagaaatggtatttgcattctgacagtttcttaggaaagaaggatggagtgccaaaattttaatatggaataaggaagaccaacttagatgcaaaaagggcaagagctttcctgtgactccttagcttaagttggctgttgggttaattagttctgtggtttagctgctactgagaggctactgtagacactgggagtgggataaagaggtacaagagttcagtgtcttcctttaagatagtggctctcaattctatcagtacatgaaatcatgatgctcagggctcctccccagaccaactgaataaaaaaacctggaagtggagcctagacatctgtattaaaatgaaattccctagattctaatacacacttaaggttgagaaccattccttaacagctaagtgagaattaaaaatacgtacattaattgctgtagacatagcagaatatgattagctctatgatgagtgatagaaattatggcccaggagttggaaggcttttaattaataggagccattaggagagactacatcaaggaggggaattttgagctggtatatcttcacaggtggaaagcagagagtccactaggccagggaatgaatgctgtgaggggaatctccggagatttggaagactattttgattggagtgtggtggaagtaaagatggactggtaggctgcagccagaatgtggacagtctctcgtgtcagactaaggaattttagctttactctgcaggtcgtggggaggcattcaggatttctgatgagtgaaatggcaatgctgaatctttgaagattgatccaatgggagtgatggataggtagtttgaataaaagcaggcaagaacttgaggaaatgaagaccaattgggaagctactctcatggtccagatgtggggtcataatgttctgagcgaggcaaatagccgtggaattaaaaatgataaacatttgcgtagtattttcatagtcagttcttgcccatatctcatttaaacctcacactgaccttgtggtctttccttccatactttacaaatgaaggaactgatgttcagagagaagctgttgtaaaggaaccttatagaaaatggaggggcctgattggatgatgaccaatcagtaataggaaattaaagggtgcattggaggtgttggattgggtgtgaagatggtagaattcctcagtggctaaccatgtccagtcaccggccgtgctgtctgagagccacttcatgctgttcatgtgactcttcttgcctctgtcctttaatatgcagttatttatttattattattattattattattattattgagacggagtttcgctctcgttgcccaggctggagtgcaatggtgcgatctcggctcactgaaacttccacctcccaggttcaagcgattctcctgcctcagcctcccgagtagctgggattacaggcacctgccaccatgtccagctaattttttgtatttttagtagagacggggtttcaccatgttggccaggctcgtctcaaactcgtgacctcaggtgatccacctgcctcggcctcccaaagtgctgggattacaggcgtgagccaccacgctcagcctatttattattatttttgagacgaagtcttgctctgtcacccaggctggagtgcagtggtgctgtctggctcactccacgctccacctcccaggttcaagtgattctcttgcctcagcctcctgagtagctgggattacaggcatgcgccaccatgcccagctaatttttgttattttagtaaagatgaggttttgctatgttggccaggctgctcttgaactcctcacctaaagtgatctgcccaaagtgctgggataacaggcgtgagccactgtgcccagccacagttacttctttaaaggcatagtggaggcaagagaaggagaggctgttgttaattcaacttgtctcaaatatgaatcttcaagccttttttgaatgtctttgggttttcagatagttaaattgtgttgaattttaaaaggctcagtctaggtatgaatagtctggagttaaagggctgagactttcttatccaggtggactctgccctgagcaggttaactatgactggtaggtttccatttctcttgtggtggagacaggagccatagggaagagaactctggagcatggtagtgtagacaccagagaacatccctgtggcactggtaactaggatgcttcattgagattacatccttatcagagctggagtatgaatcatatccaccaccatgctaattcattttgttcatgagttggctgtgtctgtaaggtcatctgttttgtgaaccaagatcctgaagcaattcaaatgccagtgtaaatcagccacacaggtgacgaaatgtgcttttccatatgagatacttgttccctgcaatcaaatagtaggagtgcaccagaaagctaagggtactaggaggtaaaaaggaatgaatcatcatcatgaagaaccttgattagatttttctcatgaaatgatgagatgtggaggagcaggatggaaactggaaaaggagaggagattgaatttttgtgccccaggcattctcagtttgggcacagagatcaatactcatctgctccagcaggggtgagggtgaagctgattttggtaattggaaatggcaacatccatagaaaattaaactgtcacattttaactgtttcttttttcactgtagaatactgggatcttcagtggcaggaggagtaatcagaagacggagatgaattttaacactattttggaggagattcttattaaaaggtcacagcagaaaaagaagacatcgcccttaaactacaaagagagactttttgtacttacaaagtccatgctaacctactatgagggtcgagcagaggtaagagacaatcacgatttacttttctgctttctatgtagataacgattttataatattgcctgcctctccaatcttattgaaaatgctttgggttaatgaagtaatgatttattatcatttggacttgaaagatgaatttcagagtatggatagaaattaacaaatctgttaattataggtttattataattaacctatgaattaatctattagattacattacttttagatcctcatggaatttgtaaggtgcattgtacatatggctctctcctgtaaaccgcctattatgtatcaaagtcttctttagcaaatataaattgtatccaagtccattactttatatgaatatttcttctttattaagtagaagttacttaaaactggttggtgatttggtggactcaacacgttatcgaagttgacctaaagcagagtttttaaacattcatttttttaatgataaacagctactacaaagtttcttcgatggcagcagggagaaagcagctcactaaaaaacctggccggtgagcacgtggcacagacaaatgtgtggttagcacactcctggcttgtgggtggctttagcttctccttccactgctagatgaggccttgaatgtgcaatcacctctggttcttttgcttctgacatgttgggtgtggcatttgctagtactgccacatactgccttctctgctagaaatatccttggtttccaggaaatgaccaggggctgggttgcccatggctaaccatatgctgttatgcaattggtttcagtggactgttggtgatcctggtttagtttttttttttttttttttttgagacagtgtcttgctctgttgccaggctggagtgcagtgatgcgatctcggctcacagtaacctccatctcccggttcaagcaattcttctgccgcagcttcccgagtagctgggatttacaggtgcatgccaccgcactcggctaatttttggatttttagtagagatggggtttcaccatattggccaggctggtcttgaacccctgacctcaagtgatccacccacctgggcctcccaaactgctagaattacaggcatgagccactgcacccggccctggtttagttttcattctgttttttttctagaatatcttcctcagacgttgatttagttgtattttttttctcccactgatttctctgtgatttggtttcccccaatttagatagaatggcattgtgtttcatgatggtcctcaactcttaatttctgctgtggctcgtcattgtgacctgtggtattctgcaggttcatgtaatttaggagcatactcctttatccttaagtccccaaaatgctgaaaaccaaaacctcaaaactcttagttacaaaacctgtgtgtgtgtatgtgtgtgtatctgtacatgtctatgtgtgcagaaatattaatgtatttaattatgtggagctgccctagtccctgctgggactattatgtaacatatgatatatgtgctatatttgctttgttaaatctaaaaaatttaaaaatccagaagtgttttagacaagaactgttaccagaaatgtgaattattttgaaacctaaaacagattttaaaggaaacatttacacatttttgctgtatggtaataatttgttataatttgattttaatatatagttgactcttgtcaatgtagggttagggacaccaacccttgtgcagtcaaaaatctgcatatagcttttgactccccccgcaaacttaactactaatagcctactgttgactggaagtcttactgaggacatgaacagtaggttaccacatatttggtatgttatatatatataacatactgtattcttacaataaagtaagctagacaaaagaaaatattaagacaatcataaaaaagagaaaatagatttactatttattaacgggaagtggatcatcatacaggtcttcttccttgccatcttcacgttgagtaggctgaggaggaggaagaggaggggttggtcttgctgtctcaggggtgacagagggggaagatgtggaggaggttgaaggggaagcaggagagtgaggcacactcagtgtaacttttactgagagaaaaatccctctatcaatggacccatgcagttcaagcccatattgtttaagggtcaactgcagtaagtctaagaaaagaagtgaaagtggtaaaatgcaatttttttactaatgaaaaaagtctcagaaaccgacattgtttggttcgcagtatgggcagttactattgaaatatattgcaattgctaactcactttgaagaagataaacatattgagtttaaagtaccccttttggtttagcttaaggggaataaggacaacagtggcatccctcttccttcagaacctcgctcaccatcttgccttggagcagcctcagccaccctgagaaccagaaaggacagaatgaggaggtagtcacaacacagaaaaacccagcctctaacacttcctggcagaatccacctcctttctggctgctgctgcctgggctagagagcctagtcctgttacttaattcctgccttcacccccactcctctgatgagctgggcgttttgatcccttctggtttcttctctcatggaccaacattcactggcatacttgtgacctatgccttgaaatgtggtcacagattcgtttgcctctcatagtaaaataattgtcagtagtaaaaaaaaaagaaaaaaaaagaaaaaaaaagaaactttgtaagaatctggcttcttaaaataacaaaagttctgacagtgctgggctgaattccccaacagctctccctggcttctaggcatggccagcaacaccttgttgctatgtttcttccatgtttgtgctaatgtgctcagttcactgtttgccgtggatcaatcttctgatttccatctccctatccctggaagctgtgattcggaaaagaatgtgagggccggtcgtggtggctcatgcctgtaatcctagcactttcggaagctgaggtgggtggatcacttgaggtgaggagtttgagatcagcctggccaacatggtgaaaccccgtctctactaaacatacaaaaaaattagctgggtgtggtggcaggtgcctgtaatcccagctactcaggaggctgaggcaagagaattgcttggagccaggaggcagaggttgcagtgagctgaggttgtaccacgcactccagcctgggtaacagagcgagactccatctaaaaaaggaaaagaaaaaaagaaagagaaaaaaaggatgtgacatgagtaatctgtgcaaatcaacaggtttttaaaaataatattttgttaaaaaaatgtgactctagaagtaaattagaaccacaggggccattcagaaataaaatagccctagagatatttatttttattgttcatagttctcctgttttcaatagaaaaacaatgaggaggctgtcgattgatctaataactatgatttatggtttctttgtggctaccaagtgccactaatactcgttaaaactctcagttcataatgttagacagaagacgtccatcttctccttattctctggacagcttcttcaacatgatgacagcaagcttttcttgaaattcttcctattatgtaataaacctttctgtgcttgttgaaatatgctgaaaaatcctattctagataacgagaaattcactcaaaccatttcctcagtctaattttgcaaaacttgcatttcagtttccgctgtgggtccttctttagtttgtcctcctttctttatggtagttagttaattcatgtgtatttccacatattccaaatgaactgaaaaaagatcttcctggaagtttatattatttgatcctattcaggataacacagagcaaaggacactggaggtttcataagtgatgttgctttctagtcacggggctaaatgacacaggggacagaccacccaatgtttcagtggaggctccatgggataatgaggtgggaaccaaggaagagcagcactggagtttgatcaggaaaaagatctacaaataatagtgagagagaaaatgaggaattgatttctataggttgagatgttgaatttaaaaaattgaagtagtatgtaaatttgcaactatcattagctaagaaatcaggaatttttagaattggactttggatctcttaatttggttggctttttgtctgttgtactgccccagcatggaagctggcaaataacttacaaagttgaaggaatggggaaactcgttgtgccagggttcccaactccacctgtacattcagtgattcactatgacagctcacaggactcagcattgagtcatactcacaactagatttattacagcgaaacgatacaaaacaaaatcagtaaagggaaaagacacatggggccaggcataagcttccaagaatcttatcctagtagagtcccagaggatgtgcataattcctccagcatccaattgtgacaattgtgaaatgtgctattagagacttggtgcccaaggtttttgttggaggctgatcacacaggtgtcctatgcctagtgtaccaaggttccagactccagaaggaaagcaggtcttcagcatgaactgcattgtacagtttaggtacagtgagccacctcatcagtgttggtaatagtgggaccctcccaaagtccaagttcccagatgccaggcaaggatcagccttgtaaacaggcctttcttgggacagcagcctcaagcctgctgtgttaactcttttctgcacattagtagtaaaaatgatacaacctattgagcactaactacaaattaaccactgtgctaagtactttacatgcattatttctcttatttctcaaaacaattctgtattaagtcttgttagacttaatttcaaaatgcagaactaaggcttagaaaaattaaaaacctgcacaacatacagcttacaagagattgcgcacaccttccagaaattgcaggtatatttcttcaaagcctatctttgaaataatcttgatattccaatgaaaatttgaaaaaaaaatctaaacatcttaaagttagcaccccataatacagataacattttaaaagtttcatggatatttttgtttgttactttcagttataacttctttaaaaaaattttctttgtgatggaagagaattaacacttgagagggtttttgtcctggatctaccactctctcattggactttataaaataattttctccaatctatagtttaaacatttttttgtgtatatattgtctttatactttcttcaaattaatttttaaatttataattgacacataatatcttttcaaactgttagctcctccgtttcatcagcatttcaaccccaacacacatctgatctgttaccagttcctgttgtattggtcagggttcttcagagaaactgaacctaaaggatatacatggcatatatacatatgatataatgtatgnnnnnnnnnnnnnnnnnnnnnnnnnnnnnnagaccccaggaaagctggtgatgtagttcagtctgagtctgaaggcctgcgaaccatgacagccagtgatgtgaatcccagtttgaggacaggagatgatgagatgggatgtttcagcccaagtagtgaggcaaggaaaaaggggtaaattcctctttccttaccttttgttctattcagggttggatgatgcctgctcacattggggaggtcagtttgcttcctgagtccacagattcaaatgctgatctcaccgagaaacactctcacagacacactcagaagcaatgtttaatctgggtaccccatggcccattcaagttgacacataaaattaagcatcatatcggtgaattttctctactgcaggcttattgcagctcccaaccccagttttaggtggattactgccctacttgattcaattcctggatcttcatctttcatctgcaaaatgcatagcttctctaggatcaagttaaaattccttagtttgggatacgaagtacttgatgcaattttttcttcttctcctcttcctcctcttctggctgtgtctcctacttacagttgccctttcacatcgtgcctttgctaatactcttcaatctatttggagtgacacactcctctgcctgcctgccaggatccatctatccagccaccatctattttatctttcaaaaatttgttgagtgcctggggaacacttactcatcttttctgacatagttcaatccccatcttctcagaagccttttctgtctccctcctggcaaaagtagaatggatcctcctcccctttgtgctctgtacacattattatggtatcttgactacctgactatttacatatctgtgttacctactggattttaagctcctgtgatagtgtagtataataagaaatatacattttggcaagcccctttcagccgtagctatgtttatgttaatgaggtgacttttggaaagtaataggttgactttaggatgggggatctggttgtcaggggagccaaccatgtgattagagggttggaactttcagccctaccctccaacctctagggagggcagaagcaccagaggttgagctaataatcatttatagccaaagatttaatctatcatgcctacgtagtgaagcctccatgaaaaccctaacagaaggggttcatagcgcttccagattagtgaacaagaatgtgtgcatgtgctagaggatggttggattagttggttctcacactgctaataaagacgtacccaagactgggtaatttacaaagaaaagaggtttaattgactcacagttcagcatagctggggaggcctcaggaaacttacaatcctggcggaaggggaagcaaacacatacctcttcgcatggtggcagcaaggagaagtgctgagcaaagcgggaaaagccccttataaaaccatcagatcttgtgagaactcacccactatcaggagaacagcagcatgggggtaaccgcccccaggattcaattatgtctcactgggtccctcccacaacacgttggggattatgggaactacaattcaagatgatatttgggtgcagacacagccaaaccatataaatggtataacccaaactccatggagacagaagcttctgtgcttgggacccttctggacctcaccctgtgtatctctttatcctgttgttcatttgtatcctttaaaatatccttgtaataagttgataatagtaagtacactttccctgggttctgtgagctgttccagcaaattcttgaacccaaggagggggttgtgggaacctccatatgtagccaagtcagacaggagttgtggtaacctggggatccactacttgtgattgacatctgaagcagagggcagtgttctgggagtgatcctttggtctgtggggtctgtcttaattctgagcagttagtgtcagaattgagttaaattgtaggacactcaattggtgtgtgccaagaattggagagttggctgttgtggaaaccccactccctgccacatatttggtgtcagaagtgctgagagagtataggagaggtatttttcttttcttttctttttagctgtgtattagtccattcgtattgctataaagaaatacttgaggctgggtaatttataaataaaagaggtttatttagctcactgttctgcagcctgtacaaatagcatggtgccagcatctgcttctgatggggccttaggaaacttacaatcatggtggaaggcaaaggggacctggtgtattccatgatgagagcaagcaagagagatgccatactcttttaaaacaaccagatctcacatgaactcagagtgagaactcattcattaccatctaggagggcaccaggccattcatgagggatctgccccccatgacccaaaccacctcccaccaggtccacttccaacagtggggattatatttcagcattagatttggaggggacaaatatccaaaccatatcaaactctttgagggcagggttcatatccatttttgtatttctgtgggcctagggcagagggagtactcagaacatgttgcatggctggatgcactggatatcctagagatgaggagatggggagaactcaatcctaaatgtatttaggaatttaagattgagttctccccatctccccatctctaggataaatttaggatttatgtatgttgtgaaccatgacataaatgtatgttgtgaaccaagacaatcagaaaggttgtcacactgctaataggtagaagaattagaattcgaaccttgatattgtgactcttaagttcagtgctcttcccaaaatgccacagatgccttgcagcgtccagccctatggggcttagcgagtgttctccccgtgtgtggagacaagagattgtaataaataaaggcacaagacaaagagataaagaaaaagcagctgggcctgggggaccactaccatcaagacacggagaccagtagtggccccgaatggctgggcttgctgatatttattgcatataagacaagggggcagggtaaggaaggtgaatcttctaagtgattgacaaggtgaagcaaatcacgtgattacagtatagggggcccttcccttttaggtagctgaagcagagagagagagagaaggcagcatacgtcagcgttttcttctctgcacacgtcagcattttcttctctgcacttataagaaagatcaaagactttaagactttcactatttcttctactgctatctactacgaacttcaaagaggaaccaggagtacaggaggagcatgaaagtggacaaggagcgtgaccattgaagcacagcaccacagggaggggtttaggcctccggatgactgcaggcaggcctggataatatccagcctcccacaagaagctggtggagcagaatgttccctgactcctccaaggaaaggagactcccttttgcagtctgctaagtaatgggtgccttcccagacactggcgttaccgcttgaccaaggagccctcaagcggtccttatgcgggcatgacagaaggttcacctcttgccttctaggtcacttctcacaatgtcccttcagcacctgaccctatacccgctggttattcctaggttatattagtaatgcaacaaagagtaatattaaaagctaatgattaataatgtttataataatgactgataattcttcatggtcctctctatatctaatttgtattatgactattcttattctaactactttctttattatactgaaatactttgtgccttcagtctcttgccttggcacctaggtaatcctccacccacagtgcctctcttatttaatctggttgtaccaaaattgagcattctcttgttacgagatgcttgaaactttaatattttacctaggttaacaaacatgatggtgggggcaggcaatcagttacaagtacgatgacatgagtctcaaacaccctgggaaatctctcatttgtataggctctcctgggtcatattggtttttttcttgaccaatcctgggaacctggagacttagtgatacagggataagagcctgttgaggttctgagatgatctgatgtttctcccttagttatattcgtatattaggtggttccccaagtggaaactgtaggtttattgggtccttctaatctttacctgaaggtttgtatctttcagcacttcctagggttctggggagttggtgtggaatgggaaaagaataatttcttgtactaccgggcaattggaagtatctgcatcaaatgttagagattaccaggcagtccaccagcttgtaaaaagtgctatgactctggcaggtgtggtggctcaggcctgtggtcctgacacataaggaggtagagagtttgagaccagcctgggcaacatagcaagccatcttctgtataacaacaacaacaacaaaagtgacatgactctaaatactccatgtaatcattagtgtgtgatgggattattctggctctggaaattctcaactatattatgccttgaaaactcatattcttagacaattgaatttctttgtttctgaaattaggtggtatcaactttcttctttgtgtctcaatttcctttcttgtatctcttctcccatttctgattcatatctgtgtttttattctactctcctagatctgacctttcttgtcattaatcacttcaagaggccatgatgccaggtccgaagtccaagggtcttacttactcctttaatttgccaaattgtttacctttctttaatgatattcactgtctttttttttttttctctaggaagctgaaatctatttaagacagaatagggggatactaacattccctccatccatacccctagacattcttttttataattacagtacagtgatcaaaattaagacatttaacattgatatactattattgaatctggagatccagagcacatttcatttattattccactgatgcctttatagctattcctcaccctccctgcccctccagccccaagtccaggatctaatccataatcacacattgcattcagttggtcaagacataaagttttaaaatatctatggtgagaggaagagataatacggaagaaatgctgtcctttgttacatactataaaatgccagctatctcatgactactcaatgatttcatgtaagagtccatacaatgacttcacgtaagagtccacaaacttaaaaatcagtgtagtctattctcctactttcattgtcatggttatcattaggagctgaaggtgtccctccccaccaaagaaattattgtagcatggttcactaggatgagtaaaaatcacttattactggctgggcgcggtatctcacgcctgtaatcccagcactttgggaggccgagttgggcggatcatgaggtcaggagttcgagaccagcctagccaacatggtgaaaccccgtctctactagaaatacaaaaattagctgggcatggtggcgggcacctgtaatcccaactactcgggaggctgagtcaagagaatcgtttgaacctgggaggcagaggtttcagagagctgagatcacgccattccgctcccacctgggtgacagggcaagactccatctcaagaaaaaaaaaaaatcacttgttactgtttaccatctctctcgtttcctccccttctagcttaattttttattattttgtattaaaacagttgtcaggcatgcagagctttttatggggtaattactactaaatgaagagaggagtttaatcaaaggtttggtcctcctgcaacttaagagtagaaacaatagacatattctagatcttgaaaaacactctttgatctggctgtgatagttgtgttttattcatttgattatttgtattatgatgagagaaaggctatatgaaaaatcagcattgttgttcagaaatggtattacttaatttaatttagtcataaaacttgtccgtcagcaatttttagtgatatcagaaagttgagttttaagcaaagttttatttagctatttttccactgaacatattcaagactgtgacataggaactgaaggcaattacaaaaagaatgattcctagaatatttggaaaatggcattgtagttgaaataaacatagtgtttctacccacccctcttctcctacctgtctaccttgaaaaaaaattgtcttaatttgaaatgtatgtaacttcttgcattttttttaaaaaagaactacatttgacatcacaatttgtgtaacttgagttgtatttctccttttatgctatgaactactgggctgaggaattcttagaaatctttgaaattacttccttgtaattaatagtttctagaaagtgtttattttgaagatagggatgatagcatttacactggaagacagtttaaaaagagaccaaattatgagtggaggaatccttggtggcaagagtatagacctgtatacagttttttgtttttttttttttcctggggcgtagagattggggaaggccacttggccaagggtgagaatgtgagcaatgatgggcagagagagtccattcaatgcagagggaacagcaggtgcaaaggccctggggtgaaaggggacttagtgtgtttgtggaactgttctgttctgaggcctataaagatttataaagcaaataattacaagaggataaatacaaggagatagttgatttgttagtaataaggaggaatcatgcaattttagagcttaaagagactttaaagaatcacctccagatttttcacttgtgaaaactgaagataaggagatggtttgctccaggtcacctagtgagctggttgttaagcctggacccaagctcatatcgaatatttctggatcatgctctctgagtgcactgccttagttctggaaaggatgtgtctgggttgcccagtggataaggactctaattctatacagtgtcaataatatggttgttataatggataccatctagtgactattcagactcctttgcttgcaaataccgatgctctttgtcttacgacagggttacctcttgataaacccattgtaagctgaaaatgtatttgggacacctaacctactgaacattgtaggttagcctagcctaccttaaatgtgctcagaacacttacattagcctgcagttaggccaaatcatctagcacaagcctattttatttatttaattaattatttttttgagacagggtctcactctattgcccagactggagtacagtggcgcaatcccagctcactgcagtctccacctcccaggctcaagtgattttcctgcctcagcctcccaggtagctgggattatagatgcgtgccaccacgcctggctaatttttatatttttagtagagatggggtttcgccatgttggccaggctggtcttgaactcctgacatcaaatgatccacccacctcagcctcccaaagggctgagattacaggcgtgagccactgcgcccggcacaggcctttttataaaaaagtgttgagtatctcatgtaatttaaaaaattattttaattagttttattttttgagatggagtcttgcttcgtagcccaggctggagtgcaatggcatgatcttggcttactgcaacctccgcctcccgggttcaagcgattctcctgcctcagcctcccacgtagctgagattacaggtatgatccacctcgcctggctaatttttgtatttttagtagagacagggttttgccatgttagtcaggctggtcttgaattcctcacttcttgtcacctgcccacctcagactcccaaggtgctgggattacaggagtgagccactgtgcccggcctaattatttttatttttgagacagggtcttgctctgtcatccgggttggagtgcagtggtgtgatctcagctcactgcaacctccacctcctgggctcaagcaatcctcccatgtcagctttcctagaagctgagaccacaggcacataccaccacgcctggctattttttttgtatttttagtagagatggggttttgccatgttgcctaggctggtctcaaaatcctgagctcaagtgatccacccgccttggcctcccaaagtgctgggattacaggtgtcagccaccacacccagtcctcatgtaatttattaaatactgtactaaaagtgaaaaacagaatggtagtatgggtacatgaagtatggtttctactgaatatgtattgcttttgcatcatcataaatttgaaaaatcgttaggtcaaaccataacttgggactgtctgtgcttgtcactttcctacctttgaagctttggtcctgctgtgcctagcagttctccttctcctgtctatttactcaagtctcatcccaaatccttttaagtgggaggctttgtacacccctctggttatacatgccttgccctttctgaattcctgtttaaatgtaatttcctgttaaatgtatatgtgttatgattattgcctttttttctcaccggctacataataatttccttgagggaagaagttgttttgtaatttaaacatatcacacacaatacctcgcacccattagccttttaaaaaagtttttgttggtagtaattacaatggtgatgatcagtaaatatttaaagtaagcaaaaagatctttaatataaagatctcacattgtgagagttactccccacataattttgttccattttattttttgaagtggtgcattatttaaatttagaaacagctgggcatagtggctagcacttataatcccagttactcaggaggctgaggtcagaggatcacacccagaaattttttttcagggacagagtcttgctatgttgtccaagagtttacgtctagcctgggcaacatagcaagactatctcttaaaaaaaatctaaaacaagggtatgttttaattcagtatttattagtattaatctctcccccaaactagatgtggacattattataaacaaagttatcaactgtcaaaagaaatcacatgacaatttaagaaagtgatactacattttgagttgtttctaaaactatttcagacacaccaactgttagccataggttgatgctggtcaggtacgtgtagaaaattatatgcagaaaggagcttagaaacacttgtgttactcagcaattaattctattattacttttttaggaggacttctgatgttattaccttttagttttgtgaatatactgtacttctgagataaataaatattaatgttcactgattactacttcagataaaaataccattttggtcttcttaccaaagctcttcatttaccttttttacttttcatattagaaaactttctcaaagtttcgcatgattctacattggtaagcccctgaaaagaaaatactacaaaatatgtgcaatattgtttgttaaataaaattaaacgagtaagcaagagactgaggtgaaattgcaaaatgatttttaatagattattggaaaggaatttttccccattacctagttagatgacatgtttcttattctatctttattccaagcaatcacataggcattgctgttaattttatttgcgactacgaaagtcacatggataggtgtaattccttactcataagattgtaaaatataaattttgtgcctttgagaggaatatgtttataatttcctggtagaagtatcttttatttgtaatatgggactcagctcatttgttttactttcttcatcacttgtacaacaaagatttagtgagtgtgtacccagtgctagggatggagtaattaaaagatgaatggttctggcctcattaagcttacaatctgattaagctatagttctacctctgtgggttcataatgacatactttgttatgctacctctgctgtgctatgaagggggtctcttgagacctggcgttcttaccttgtgtgccaccgttgtttgcacttgcccacgggactctcaacttcactggacattgggtttccaagtgtaatatggggcagttgtgcctagaggatttcaaggtttcctcctgttcttacattttacatagcacagatcccacagaaatatcagtgttttgtatacatacttgcattgttctgttgtcttcagtgccccataaagtataactgtaaacaacccacagatttgcccacggactattttacaagtgaagaaactaggggacagtgttctctgaagtgacatcccatctgaggaggcgaaccaagatgtcttatctttcgggcgagtgtactgttaaaccacactgttctacttcccacaaagggggacttccttaaacagtaacttcactgaccacctctattcatatgtttccttcctccttcccttctttggctgtatagataacaaaccttgcaacgggtgttcttttaccagtggttcatttatgtttgtttttttccgcactgtacccctgtgaggtgttaggaaccctgtgcatttaagtaaattagaattgtgcagaaaagagagaccagcagaaaaaaaatatttctgtgaatgcttttatatacatatatatatatatatatttttttttttttttgagacagagtctcactctgtcacccaagctagagtgcagtggcatgatctctgcttgctgtagcctccgcctccggggttcaagtgattctcatgactcaacctcctgagtagatgggactacaggtgcgtgccaccacgcctggctaagtttttgtatttttagtagagatggggttttaccgtgttgcccaggctggtctcaaactcctgagctcagacaatccacctacctcggcctcccaaagtgctgggattacaggcatgagccactgtgcccagcctgtgaatgcttatattaaagaagctgaaaagggttatgcttaggtggtaaggctcaagaactttaaagtgagttttgttaaatggtacatttcatatatactttaagtgattcttcttaaagaaaactcacaagtgactcaaagatgaatttattcacgttcattgtctatctcaacagcagagaaactgtcacagttgaagactcctggacatttactgcaatatatttgtaatttagtttaacactttagaaaatagtaaagtaagctcatttttgggttaacttatcctgactaggactgattgtagtacaatataaggataaatagtaaaactttgaattttcttggaaaatgatgagcagcttgatgctaatgatcagatataattaaaaaaattttttttgaacctcagagtgatttttttattttcagacttcacaatcactttctaatgataggtgttctgatgaaaatatctgcaggaaacaagaccaaaattcactggatgagataatatatttcttgaagttctagaatcagcttatcagctgtattctgttccttcttagttgtaggaaactttagctgtggtctaggtccatctctgagtttacagaatttctgtgaagttagggagtgagagactaagaggatggactcttgtgccagattatctgggttcaaattctaaatctgttacttattaattgcatgacctaggacaaattacttaatctctctgtgtctcacctttaaactggggagaataataatacttccctcataggtgtttttgaggggtaaatggatcagtatagataaagtggctaggataggtcctggtaggtaagtgcatgtaagcagctgttattattatatacataaggtaggttgcattgttgcccattgtgtctttacatgtttcagtctttgctcttgcctctgttttttcccagatatcaatgcatttgcaatgagtgtaattgtgtcattgtgttattaggtcactaatcacaggtgattcactctttaaattgatctgtggtgctggtagtctggttatgttttggagttctggtaactggtggaaatgcatacctcgggtaggttcatgtgtttgacatctctgaaccatgttcatggaactctgttgggggtcgtctgctgtggatgtttttctctggatgtttgccagtggtacacatatcgatagggtgccagttgtggtaactgtggtgttgctttctcagttttagtttttctttcctccctcttcctcctcctcctcctcatcatcctcctcctcctcctcctccattttttttataaagaggcagtctcattctgtcactcagactggagtgcagtggtgtggtcatagctcactgcagcctcaaactcctgggctcaagggatcctcccaccttggcctcctaaggaccaggatgacaggcacgtgccactattcctgctaattttttgtttttagttttgtagagatggagtcttgctatgttgcctaggctggtcttaaacttctggcctcaagggatcctcctgcctcagcctcccaaagtgccaagattacaggcataagctaccgagtctgaccaactttacatttttatgacaacagaggtgggtctgctatggagttaaagaaaagtaagctttaggctctttcaattccatagcccttcctaaggcctctggaagggccccagagcttttgcatttatgattttgcattttagttttatttttaatttttaattgacaaagatttctcctccaaagtgtttaagcttcagatccctcaaaatctggatctgcctctgtagagcacataacatttcatttgttctaatatctgacaatttctgcaaactctgacagtgaaatactctcaaacatttccactgtaaaacagctaataaacaagcatgtttacaattggtttatgttctctaagttcttcctttgaaaaacaaagtggtgtgtctctactttaatctgttaattttatttccctgaatagagttaaacagttgttgtttttgaagtcctatacttttcttgttaaatgtattcctattttatagttttagctactcttgtgaataggtttttttccccatgatatgttgtaattattgttaatatatcatcaagcttgattttttataaatctattttttttgagacaaagtctcactctgttacccaggctggagtgtattggtgtgttcacaactcactgcagcctcaaaatcctgggctcaggccatcctcccacctcagcctcccgaatagctgggatacaggcgtttgctaccatgcccaactaattatttgttatttttaatttttttttgtagagatgagctctctctatgttgccaggctggtctcaaactcctgggctcaagtagtcctcccacctcagcctcccaaagtgaggtactgtgcctgcctacaaatttattttgtaaccaaccattatactctgctacgtctgactgttacatagagacatagttttctatcatcaacttcattatggaagggttattttctactgaatttaatccaaattacgagaagaaaaaaattaaaaaaaattaaaaggtattttaagtgctaaacaagaacattcaaaagcatgggattaaaactttctgtgctgagaaagttataagctgtgtgttctggagggaggcattgatggggagtggtggaggaatatatctacccagtaaccttaaattttctgaattgaccgaaatacaaatttagaaatagagaaatctagatttataattcatagtgactaccacggtgggataattgaattcaaacccagcctatctaacttggaaggcacccacagacatctctacttgaatttcttagccaccacccccaattcttttttacttgaatctgttcatttgacaaaaatattttaagcacctactttgtgccaagtactgttgtaggctctgtggacacaatagtatagaaggtaaatgccctgctgtcctggaatttaccttctaaaggggagatgcagacaacgtacagataccagtaaatatccccctgccatgagaaaagtaaagccgcatgagagagatggggccttgcctgctgtttctgtaggtagggaatagagaacttaggaagagcagggcaggccacggagaagccaagagtacaaaggaccccagggaggtgggaaatgctttattgctcaaagaacagcagagagggaaaggaactgaggtggaatggggtgggcatgggaggggaggaggccagagagctgggcaaattcatttttttgtttgttttgtttttgttttttaagtaacaggcagattttggagggttttgagatgggagagacaagatgttgctaattcatgtatgttgccacgccagggcacagtgaaacatgaactggcagttagaagcttggagttagttctggctctgctagccagtgtgatcttggagaggtcagtccctcagtttccaccctaaattgaggaaattagactgtgatcaccagaatccctttcatggccaaatattatgattctcagatggagaaattgttattaagcattcatatgtgctggccacagttgttggctaagtgggatagaggagacctgccactcccaccctctgctcagactttggctctttgcctcacccctgcctctgggaagccaagttctgagcctgcctggaccacagatgggtgtatcactctgttctcactggggtcctcatcggtaggtgtgggcatgttgacttactctgtttgccttggtcttctttcttccaaatggtgttgttctctttcattcaatttcctcttcttttcttctattaggatttatacattttaaaaaatccttttcctatcattttagtggagtgcaataagggaaaggagttaagagcttgtgatcaatccattatgcttaaattctggatttttgtttttttattttgagacgaggtctcactctgtcgcccaggctggagtgcagtggtacaatcatggcttactgtagcctcaacctttcgggctcaggtgatcctcccacctcagcctcctaagtagctaggactacaggcatgtgccaccacgcacggctaattttttttttttttttttttgtagagacatggtcttgctttgttggccaggctggtctcgaactcctggactcaagtgactctcctgcctcagcttcccaaagtgctggaattacaggcatgagccaccatgcctggcctggaaattctttaacatgtttattttataatgttgaaaacatattttccttgaggacgtcttgaagaatgcctttcctcagaggaatacaaggagcctaaaaggacatttgggaatgagacacacagggtttgtagttacaagcagtatcccagcaactcaagacctgaagggttaaagcacctgatgcctgccagataaattccagaatcactagtctgtcaggctgtcttctggggcctcagtctaccttttcagcttcattccatattttttcctcatggttctctgctgctgcaatcaaactgtctgattcctgttgaactctattttcatgttcctaccacctggtccattcttctgacctggaatgcccatccttttttgcctacctaaaccctacacattctttaaggcatagttcaaattctacctttcttggattcctgtcaacggtgcagaagatctctgtctccttcctttgaacccttgcccctcgttctttatttgtggggtttttttgtttgtttgtttttgtttttgagacttagttccactctgttacccaggttggagagcagtggtgtgattatggctcatttcagccttgacctcccgggttcaaccaatccttctgcctcaccctctctggtagctaggactacaggtgcatatcaccgtgcccaactaattgttttcatttttttttttttttttttttttgtagcaacgaggtctccttatattgcccaggctggtcttgaactactgggctcaagcaatctacctgttaagccttccaaagtgctgagattacaagtgtgagccatcacgcctggccaacttttcatattttacacttttaaatattgctttctctggtgtgtgtgtagtggtatttcactatatttttaacttgcatttctcttatcacgaatgaaaatgagcaagtctacatgtgttcactgtccattgacatttagtctctatcgaaatacctatttctacattttgtttcttaggttttctgttcttttcttatttgtttttaaaaggtataaaaaatatatatattctgaatgaagctcatctgtgtgtgctttgtactttgtggcttgtctaactctcttaatatctcttttttcttattgtggaaaaatacacataacataaaatttactcttgtaaccattttagagtgtacaattcagtaacattaagtacatttataatgtcgtttaaaaatcaccactatctagttccataactttttcatcaacccaaacagaaactgtcccccttaagaagtcagtccccatttccttttcctcccagcccctggcaaccctaatctacttcttgtctatatggatttgactattctggatactttgtataagtagaatcatacaatatgttacttttgtgtctggttttttccactaagcataacgttttcaaggttcattcaagttgtagcatatattagtactttgttccttttcatggctccattgcatgggtagaccacattttgtttattcattcatctgttggtggatatttgggttgtttccaccttttggctactggaaatagaaccgatatgaatattcatgtacaagtttttgtgtagacatatgttttcatttctctgggatataggagctgaattgctttggctttgagtatgtttaaccttttgaggaactgttagactgtttcccaaagcagctgtgacttcttacattcccattagcagtgtgcaagcgttccaatttctccaaatccttctttacacttgttattttctcttttgttgattgtagctgtcctagtgagtgtgaagtggtatctcattgtggttttgcctttccctatggctaataccattgagcaactttatatgtagcttattttaaaaaatgcatataggctggaaaacctcctgtctggtgggaacctcctctttatttgatttttaaaatgcaggggacagtgatgtgctaataatagtatatatttagcaactgggagtagaggaagaagccctgattttcagcatttgccaattttcatggtgttaagtactcccactatggcagatctccggcccctgcatgatgtcatggagcacagagctgggaacggcatgcacagtgggctctcatgagctgtcatgagctgactccagcacaccagtgagtggaagggagaatcaggtgaagtgagcctcactgaggctgcctgctattatgcaggccaggcactgcataaccctagagggtgccattcacatgttagtctaaagagaaagggatataacatttattgagtgtctacaacttatttaatcttgaccacagtcttctgaggcaagttgtattatcttagttttcagagaaatccaagggttagggagcttaattaactaagtcaatgatttgcaactaataagtgtcaaagttggcatttaaaccaggtctttcttacagtgaagctcattctagttcaccaactgtgtcaggggtggggatctccaagaccaccgccaggtttgatgatttgctagcaggacttacagcaggggtccccagcccctgcaccacggactggtaccggtttcggtgcgtggcctgttaggaactgggctgcacaggagaaggtgagcagccagtgagcaagcaagcattacccactgagctctgcctcctttcagatcagtgttggcattagatcctgataggagcacgaaccctcttgtgaactgcacatgtgagggatctgggttttgtgctccttatgaaaacctaatgcttgatgatgtgaagtggaatagtttcatcctgaaatgatcccgctcaccccaggtccatggaaaaattgtcttccacaaaaccattccctggtgccaaaaagcgttgcagattgctgacttatgggacttagataatagctgtactcatgactgtcatttattacagtgaagagatagatgcaaagcaaaatcagcgaaaggaaaaggcacgtgaagtctggaggaaaccaggtgcaagcttccagagcttacaggagtcctctcccagtggagtcacatagggtgggcttaaaacctccatcagtgagctgtgacaacaggtgggatgttgcctaccagaaaactcatcactcagtgtccacggtttttaactgggagctggtcacttaggcccctctgcctagcatgtgcccaaattccagactcccagaaggcaagcaggtgttcagcatgaaccattttgtttgtataaaccgttaagaccccttgtggcactcatcactgctagaaatcatgggaccctccccagattcaagtttccagatgccagtcaagggccaatctagaaaggcaagtaagcctggctaagaatagcagtgtcaggcctgctatgttaactgttttctgcacattgaccaaatgcaaatataggaaagcaaattgagaaggagatcctgtctgcttatcattgtatcctccttcccccagtgcctgcacaggacttgatatgtggtggtttctaataatggctccttgcgttgtacagattcccatggatactcagctcctccctgtgtctgtgctgcctgtaaagcgagtgcctctgtgcttgcaagtttctctgagttagcccaaagtggctgttctttcaaattctgatgaattatgactgcttattttagacatctcagtgtagcttcatgaacccctactatgaattctcagtaacttttctctgctaaaaagccttcatttgaaatgctgaggcctgctctttgtgtctccggtggaaatattggttctttatttccagagccccagacaccctgtctcagactcacttatacatcagtgagctttgactaaaagtggaacagtttcctgcacctgaccccagtgtctgggtcacatggggaccatcatgttggggttacaccttcctttgctctcatgggcagggctgactgaatggtctgcgcagtatgcatttgtgagaagcacattgcagggggctctgtgtagaggaacagttctgagaatgagcaaactggtgctaccatgagctgtctaaaccccaagtttttgtttttgtttttttgagacagagtcttgctctgtcacccaggctggagtgcagtggtgcaatctcggctcactgcaacctccacctcccaggctaaagcgattctcatgcctcagcctccccagtagctgggattacaggtgcacaccactgtacccagctaattttttctatttttagtaaagacagggtttcactgtgttggccaggctggtctcaaactcctggcctcaagtgatccccctgcctcagcctcccaaagtgttgagattacaggtgtgagccactgtgcctggccataaaatccaagttctttttattcttagttactgtgacagaccgagttaaagaaaacaaaaggaactcacctcgcctttgtctggctggttccctcagttctcaagtgaagtgaaaattattttcctgcctgcagctttgcatagttattttcccattgcttactttaatgtaatggccagcaatgttcttttctatagttaggaaaagcagattttctgaaaccagaagcactagttctgatgtcagacagtcagtgttcaaatcctgggttctgtcactccctagcttatatgatgctgggcaagtgagcatagccactttcttcctcagtttcctcatctgtaaaacagagacaataaatagttactacctcaaagggttgttatggggatcaattgaaatgatacaactacaacatgcactaaataaatttaaagcaaaactggcatatggtaagccttgaagaaaagttagtaatattgccattgttgttaagtttcaggatataaaaatccattttttttttccttctgccacccaggctggagtgcagtggggcgattttggctcactacaacctctgcctcctggattcaagcaattctcctgcctcagactcccaagtagctaggattacaggcatgcatcaccacgcccagctaatttttgtatttttagtagagacagggttttggcttgttggctaggctggtctcaaactcctgacctcaagtgatctgctcacctcagcctcccaaagtgctgggattacaggcatgggccactgcactgggcctaaaaatctattctttttggtggttcacactgatttgagtaaataaaatttcttactctctaccccatatgcctttacacgtttatttatttaaaaatgaaaaactgaagataattgtttgaaagaagttccagtgtggtaggtggaaacctgtccaccttaaaataagccacagtacgggcgcctgtagtcccagctactcgggaggctgaggcaggagaatggcgtgaacccgggaggcagagcttgcagtgagccgagatcccgccactgcactccagcctgggcgacagagcgagactctgtctcaaaaaaaaaaaaaaaaaaaaaataagccacagtactttggaatctggcagcctggggcttcccctgtgactctccctgcctttgtgagctgaggaaccactgactgggctgttggttctctggggagaaagggaatgatttctcctcccctcctctggcatggagatccctccacagtctttccccagcttgtctctccaggtggaggctggaacatgcctcctacctcaccagactcataacattctgcttcccgtccccttccttagcctccttctggctgtctgtcatgctcctctgagagcccgtgtccttgctcttagaactccagtgagcagctctctctccctactgcttcggtagcccacggcccttcttgcttgtgcaataaataattagtgtgtatctcttcttgtgaaatccatggttttcctgtatcctttctggccactgcttgtctccttccagggctgccctttctctgcccgcctctcacatgtgcgtgttcctcagggttctttcgtggggtctcttttctcactctgtgcttgccttagaagacatcatccgttccagtggcttcagttaacttctgtgtgcagatgactttcccagtctttgtttcccagcctgatatctattctgaggtctgagttctcacaggtatctcaaattcaaatgtctgaaaagaatctcaagatgtcccccacccctgtaatctctagttcagtaattggtaccatggtctacccagttgcttgtgccaggaacctgagagtctgtctcaacttatccctctcttcaccctctcttgtctggactctcaacaggttctattggttccaccttctaaatatatctcagtcctgctctttctcctcccatctgtgccaccaccatgatccaaaccaccattacctcttcttgggtgaatacagcagcctctgtatcagttaggattgggttatgctatgtaccacacacaatccctaagtaatagtttaaacaagataaagtttcttctttttctcagtgtggaaaaaccaaaccaaaaactggaagtgggctgtctagaactgctatggtggatacaatccagggatcctggatcctgtctttcctctccatagtcctagcttatcttttgtttttgccaaagatggctccagccatcttgtctgaattgcaagctggaggaaggaagaaagacagaaaagcaagaagggacatctcccaccagagtcagatccctttagcagctttgccttatgttccatacaagacttctgccaatatctcattgaccagaacttagccacatggctatacctagtagcaaagggaggctgagaagtgcagtcttttattctgagtaccaaggtaccacctaaaaatcagggttccattattagtgggaaatggatgtcataagcagacagctagcaatttctgccgcatcctaatgggctcctctttccactcttgctcctctccagtctgttgtacccaatggctgagtgatcttttaaaaacacaaatacgatcatgtatctctcctgcctaaaaccctacaagaaattattatcccaattttaatctcaaaagtcctcaacatggcctatgggacactgtgtggtccagcagcctgccagcctgtccacattgatctgcaattctttctcctcactccccaccccccagcccacctgtttttcagttcctcgaaggtaccacctccttcccatgttgaagcatgtacattacctatgtcctttctctagaacccgtgtatcccctcccttgaatggctaacttctccccctctttcaggtttcagcttaactattacttccttggtatatttgctgtgatcttccagattagattagatttccctgtataatgtcattctgcacttttactttgtaccacctatctctattttattttaatacattattaatacaattagtttttcagtctctttctctcattctcatttataagcttcacaaagcaggtgaaggcatcacttaacccagtactcatcctccttcagagggttgttatggggatcagttgaaatgatacatctacaacatgcactaaataaatttaaagcaaaactggcatatggtaaaccttgaagaaaagttagtaatattgccattgttgttaagtttcaaaatataaaaatccattctttttggccaggcatggtggctcatgcctgtaatcccagcactttgggaggccgaggcgggtggatcacgaggtcaggagttcgagaccaccctggccagtgtggtgaaacctcatttctactaataaaatacaaaaattagacaggtgtggtggtgcgtgcctgtagtcccagctactcgggacgctgaggcaggagaattgcttgaatctgggaggcggaggttgtagtgagctgagatcgtgcctctgcactccagcctgggtaacagagtgagactttgtctcaaaaaaaaaaaaaaaaaaaaaaaaaaagaaagaaaatcctttctgtagcccagactggagtgcagtggttgttgagtgattgaatggaatccaggttcaaggaaaatatgatagatttgttttgtgtcatgtgaaagagatgtaaatgaaagagataaggagagatgtttgcctgggtagtttagagatacagatttaagacgcaagtgagaagttggggttagagaagtaaatttggaatcattggatctggttcatttaatgctgtttatcctaaaaggaggtggcttcctgagaggacatgctgtgggctttgaagccaggcagatctgctctgaatctggatctgtcattaccagctatgaaattgggcagttgatgaaactttctaagtctcagtttcttcacctgtaaaaggagaaaatacctgccctgccaggccatttgtatttaagcctctggccgatagaatattagaaacctttctgtccattggcttcaaagatgctttaagaatgaaaacatttctaccttaaaaacagagacaatggaaaacattactttctttatcatctccttggtacctttgaatatacattttgcacagtgaaaatcaagactggcttctgggattagaaacagaagggctctgtggccttttttagtttagttttttcttttttcttaaatttaaatatacttctattgtgtgaaggagagaaaaaaatatattttttccccttgcctatcttagtttttccagctggggccttttaaattagaccaccaaaagagagattaacaggagaaaagcatagaatttttatttagtaatttttacatgtacgtgggagccttcaccaggaaaataaagacccagggaagttgtaagggttgaaagcttatatattatgttggacaaagagtagtaaattggtaaattgtaaagatatgacagggaaaaggagttggggctattttgagagcttctagctaatgggattccagtaccaggttggctagcaaccctgtcctgatgggaaatgcagggtagctggacatgaatgtctacagtgtccctttcctggggtacttctttagcctggaggatggttttatgcctagttagcccacctggaacctggggactccctcacatggggaacttgtttatcttatttatctggcagccactgttgtggctcttgtctgacccatgtccagcttacacctgcctgaccatcgccctggcgccgggagcctgacttgatattccccccaggatccctgggaaagcatggcctgaggcagctgcagccactggttcttcagatgaaaagtggaaactcaatacatcaccaggtaggaaatgagttcagagatttttacttacagatcttggacaggaagggcggaatgggctgggagggcagtcctccatctccgggttgcatgaggcaggaatggagtcaggcagagagagaaaatgcatgtgggaattggcagtatatataaggggtagggtgtggggtcactttgagttcctgggcaaaggcctaaatggtgcttttaagggaagcttcgataaagtggggaaccctgtctgctagataggagagatgcctttaaattcttatctctggctgctggcctgagccatttgggtgtggtgtggaactagaactatcaagggtgactgagccctgctttgggtatgaaaaagttgaatctattcaaaatggatgctgaggcaacatgaaagtataagaattcacttcaggactaggacagttaattgtggaaaagtagcaagataaggactagtataacaaggtttgtacagctttccctcagcctcagctccccatctctggtgataagaatgaatgtctttcgtcctcctggtataaggagggcacctttttcatgggagttaatctcatgctttcaagaagaacaaggaaggtcacagtgcccttcttgcatgtgctgttttttttaagtgcctttaactcaatccatatgccgaagtagcatatttttgggtgcttaccatgtgccaaacatggtcttatatgctttttaagtattaactttaatcctgtgaactgtttgaggcagatacagttactattcccattttacagatgatgaaactaaagaacagagaggttgagtactttgcccaaggttgcagagtgagcatgtggcagagctgggaccccagcccatgcagcctgattcccagagctctgaaccattgtactgcactgcctctggatagctttgtgatattttttgggctaccaaattgtgtgtttatagaaggatcaaacatatattaatctttatattcaccggaatatgacttagccgtcaagacagcctgacaaaccggcaaaatatgtctttgtaacattactcttgtgctttgaagaggaatttttgaccaaagatgctccctgctatcgtgtgttaaatgctgtgagttaccagagatcaattgttcctaacgtaaaaaggaagtgctaatctagtcactggctggctcagtattggtttcatactgtaagatagaactaaaataacagcctcgaagggtaaaaatagtggagtcacatgaagcatcaaccgtcattttaaaaacagaattgtaagacccatgaggaaaggttaatttctttttctgtttgaaaagagtggatgttggtagacactggtcgtttctattacggcctcctgtaattttagaaaaccgatatttgtcatgacctgaggaaacatctcattcatggcttttataagacatagtcaaattcagcatcaactctcagaagatctttcttggagtctagaaggtaggtgtgaggatcgtttcttaatcaaaactagtggctctcgcttttaggtttcctaagggctagtatgcttttcaaaaataatattagtagctaaattgatcaagcacttaaactgtttgtcagcgttcttccaaaagctttacatgaattgactcttcgaattcttactgcaatcatatgaagttctggtgctattattcatcccatttaatagctaatgaagtgtaggcacagagaggttaagtaacttgttcaaggagatacagtgagtaagtagcagagctgagattcaaactcagacagttgggcttcagactttttgcttttaagcagtaagctctattatagaggcctgctggttcttagcccagggagatctaagacgtgtaaaccagaatgcctgcccacactgagtagggatcttccccactcagtctactaacttgcatgccagtctcctctggaaacaccatcacagacacaatcagaaggaaagctttaccagctctctaggcagtccttcttccagtcaagttgatacctaaagttaaccatcacaccttccaagactggttgctgcataggtgctataatgtggtatctctgtaccaccagaagggaggtgaggcgggggtaaggaagagaaaagcagacagataaagcttctgttgcaggtgctggtgggcactcagtgagtggcgtggctattggacagtggggattctgtattttgcactgtgggggcatctctcagaatggccagatattctgcaacagggatgaatgagagttagtttcactagagcaattgagagttagttgcattagcaagagcaaactaagagggaacaaatagtttaattatggctcctagctgtgatagccagcaaagagtacaacattgcagcctagatttctgtatcttactcatttgcccttgatcaatttgtttaactcagtgccccatttacccaacagtaaattgcagatgctaaatgactcattactttggcagagtcactggttctgtaattaattatggagcactttaagattgatgaatgcaaggagctgtgcacacacgacctgtacgagcagttgtataaacatcgggattgttgttgtttctaaggcttgcttcctgttctgagcccagtgtgcactttaccacaaaggacagcaaaagctttattagtagcaattaagaaatgtgccatctctgcttttactggtttatgatgggctctttttctattctcaaaaaaaaagtttgtaagtagattcagttacaactttgatcaggctttaaaaaatatttgagaagtgttttttaaccttttatcatagaatatttacaacttactgaacagtagacagaatagtacagtgaaccccgtgtacccattacccaaccaagtaaccctagtcacacttcctcccacctcattatctataacaaatcccttctactcccattgtcttgcagaaaccacatcatttcttctacagatggttcagtattcatctgcagaagtcagggagcccccagcttaagcagaatcttagtgccatcaccacactcttaaatatcaacagaacttccttaatatcatcaagcactcagtcagtggaagaaattgttttaaaaataattttatctacagaatgttcacagttgatgggttgtattacaaaagtttgctgtaagttggttatttgcaacaccagttgaatgaatattcctgtagaaactgtagtaaaagcagtgattggcccgcattaaacccacaaaaacccatggaatacataatgaagcaattctgtgtatttctctttgagtattttactgaggggagagttgatgggcaattcaccgtctgctactagagacctggctccaaaatacattttctctttcttgtgggtgttattatggtgattccttctccctgtgcccacttcctcactccccccaactctcatcatctactcatcaaacttcccattagagaagcgagaggaagaaactttacctggtatggctgactgtattcattgaaaacaaggagggaatgtttctcttttagggggtagcaaagggtataggaaagctgccattatatgcagtttagtattttaaagacgtctagaaaacaaactgcaatgtgatctctttaacattgaagagaactagagagatatatagggctaagtagcagctgatttaaagaccaggttaatgttctgctttcgcagttccctagcaaagctcagttcagttttaagtaatttatatttccagtccataattgtgtgcatgcctctgtgccctccactaacatcagataagcagggagtggggctcttctttgtagaagaactggctagatataggcagggtagaggcaaagtttccaagaggctgtgagcctttcgatgcacctttccagaaatccagctccaggggaaggctttaggagaattgccacagggtttcccaccctcagggctgtcattgctctgggttatcacttcatcaatccattggtcatggttgggataccaggaggtggggtgggaatggtgttcccccttgggctgcagtggtaggttttgttccacagatttggccattgcgtatttggattacttgctgcccctgccacccaccatctatcccagaaattgcattttctgtcttgccctatttgccatctgtaactctcacccaccagaaacttacaaagcttatctctcccaagttcctcttgataagaaatcatgtttatgtgattctagttatttccactttcataaagatataaagtatcattaaaaaaaaaaccctaacacatgaagtgcttactggacagcctcagaacacacacgcagtcctactagagaaacaaagtgctactagtcagtattaaccatagaaacctaagaactgaaacctaggctaaagggccttccttcttttttgttgctaagaaaaataaaacaaaacaaaaacaaacaaaaaaacaggccaaaagatgctcactaacatatccaatgataaccatctctcccttgacagtagttacgtttatctctgaagattgtaatgggacagttactctgtcacttgggtattactatgtgcagcagtacactttgatggaatagagaggagaggaagcagagtctgggattatttccaggaagcaggtcctggagattcctggcttgcctgtgcccacctggtgtggtataggtctgagagaactgcagcagaagaaagaaaaaagatagaagataaaaaatatgagcaaaaactcttctcgaaaacggcgtagttaagaaaaagtggtggtgctggttatgctcttcaggaggctgaggtgggaggatcgcttgatcccaggagttcagtctgggcaatgtagcaagaaccctatctcttaaaaaaaaaaaaaatcagaaaaaaaggaaaagaaaaagtggtggctacaactggatattgtgaaattagacctgagaaaagtctaactgctcagcaattccacttagttgagtcctctcctatttatttattcattcattcattgacttattcaacaaagttattgggcacctgctaggtgccaggttgccaggtgccaggctctgctgcaggtgctggagagggagtagctgtgcctttgctgagcttccagttggtgacctttattagacctgccttgaagaaggggtgataaagagaaggctaggaccaagcagcagccttggtaggaggtgttgaatttattttatttattactcattttcatttaagactgagtgaatcaaatggatgggtgagttctttctaagttggaataaatactagggcagagccttcatttaaatgagagctgatcaattacctacttctggcccattataaaccagagttattttgcttaatctttctactcatttttttttcttttaccattgttgttattgcagttttaagcttatgatttagaacattaaattattaccaaagaattttatagtttccaagtatccccagacttcagggtttccgagagcaggggccatatttttttcagcattatacaggtatgctccaatgactgcacgtatttaaattgcattatttgatgagttttcacattaggtatacatccatgaaaccgtcactacaacaactgaaacactgagtatgcccataacccctaaaagttttctcatgccactttatcttcatacctccctcttcatgcccaccatccctaggtaatcgctgatctaatttttgacatgatagattagtttgcatgttctagaattctagaataaacaaacttatatagcaggtactcttttttagactagcttctatcacccagcatattattttgacatatattaatttggttataacaatattgcatttctattactgtgaagtactccattgtatggctataccacaatttgtttcccctgttgatggatgtttgggttgtttccagttttgggctattataaataaagccactatgaaagtttttgtgttagtctttgtgtggacatatgcttccatgccttttgtgcttagtgcattatctagcatgtagtatatactgagcaaatattgtcctgagtggttgttagacttcacctgcatatcttttatggtcttagtctgtcacccaggctggagtgcagtagtgccatcatagctcactgcagccttgaactgagttcaagcaatcctcctgcctcaacctcccgagtagctgggactgcaggtgcacaccagccacacctggggtaatttttaaattttttttgtagaaacagagtcttgctatgttgcccaaggtggtcaacatagcaagtgttatgttgctgggattacaggcatgagccactgtgccctgcattgcctacatttccatggtaattgataaataagaccaaattacttttaaaaatagttatttaaaatattattctgttttaagagaaagaatggttctgctattatcctatttccctagtttgttctgtgatattttatgcattatagtcaaacttaactgtctactcctatatttattgagttcctggaatatttactgaattcatccttaaggagaaagtgaaaaactattggtatgttacctaatgaaacaatgtaaatgccagtgaaatatttaaaagatctgtattaaatatttttttattgaactgtataagaaaattagagagtatataatattaaaagttaaggctgtttatatgggaaaaaagtttaaaggctgaaaaattgtataaatcttatatttaaaggcaaaaacaaaccaaataactgacagtaagtgattgtgagggtccagataaattatgctatgtgcctgtgagcatctcacaattaatcctgaaaataatctaggagataggttatgttaatctaataattttaagatccccatttacagataaggaaatagagactagaagaggttatttaatttgcatggggccacagagctggcatttaagcacagcttgctggtcactgaagcctgggtgctcaatcattatgtcatattgactctgctgtgttaaaacattgagacaatactgaaaatattgtggcatgttcaataaattttttaaaaagtcccctagcagcatagtcaattgctgtgtatattattcacatacatgtctctgaaagtcagtcaactttacaagttcttcatcagttttaaactttcctaataacttctgattttatatttagggtaacatttttgtagttttcccatcatttacatttgccagcctgtttctagtcacttcttattagtctcaggagacagcaatatccagtcttttttcctttaacaatcaaatcaccattgtctcttgcacttgaggctctttggcactctggatccagttgtgatccacagataatgctctatgattatctttctatttcttgcctcaaattttaaataactttgggaactttgattcgtcttgctagggcgtcaaaatgctgtccatgacttatttcctacctcgattataaatgctttgtaggtaggaaatctatcccatatttctttggttcttgctaaagaggtttctgacatcacattggtctgaaatcctggagtcagagaaatttgcctctcagtaaaattccaagtgaacctgggaagatcattttagcagacacatggagagtaagagggttttgctaatgtgtaatgataaattgaaatttgttgtagagagtgcctctgtgggcttctgtttctttagaaattggctccatgaaggcttaaactttaggtgtggcagttagtagagttaatttaggtttttaaatgggaaaattcatagttataatctgataaatactcacctggcatttcagacagtattgaacaagtctccagtcagcatacatactcactagaattgcaggaaaagtacttaagacaaatgaagtatttacatgttattgctttcaaatctaaatattaatgtttgtggtggtagttagcaccctacttcccatgatgcttagctccgagtgctaaacagatggtagatatttcatatactagatatggccagggactgttgtccctcacagatctgcaaagtgggagtcctttctgttgctgtcacctagtgtcagtttcccacaggtgtttttgctcttgctatttttggagaggtaacatggtatagtggtcattggaaggcttaaacaagttgatatgcgtaaaccataggacagcaccaggcacacagtgctattataaatcttacctattattctttattatttgaatatgggttaaatcagatactatgatttagtatatttccattcaccacatggaatctgatcattttgcatctttgctgccagattcagatcccaaatgccaacactgagtttcacgtaaattcttatttcctagtgagacatttccccatgcaccattctaggctgaaaatgtgtccaggtgggagatctatctccagaagccaaatgttgccataaaaatccattgtctatttctgcattttctgtatcttttcagtaaaatgtattgaaacctcgggggtgggaataagtaggcattttggatttgtctggaaatgcttacgtctcaggagaggtggctgagagttagtgtgtgtaacctttatggggttttacctgaacatatccctgtagattgaatcttgttatgtgtaagtcagtgttctcagggtgctcttcacacatgtgttgggagcgtgttaggcaggcctggtggtcaaggaatacaggtacaaaataacaaatgtcaaggaatgttagaattcaaaataaagagataatttcagccagtgttgcccaaacttcagccgttacatatactacttagatgaatttgccatatatgtgccatctgtaaagcactatttatctaatgttttcctttaaataatttaatgtttttttccttagacacaattatttgaaaaggaaactgtatcagtcagtaaatgaaaaaccatgaataaaaggtaatcataaaactatatacagtaattacaaatgtttatccaagttccacctaaaaccacctcagcttgagatatttaactgatctttttcctggcaattcatgcgtgtgtgcgcgcatatgcatgggcgcgcacacacacacacacatgcacacacacaccttgttatattgctgtgtactttccatcaagcatcatcataagaaaacattttctttaaagttttagtactattaaaaagaattccttttagtcctgcatgtattgacctgagatgtctatggtatataaaagtgaaaaaaatgcaacacactcccaaatataaatgaaagtacttgtataagtatgtgaatgcacacatacgcgtgcatgtttatgtctgtgtatatgtatgtatagcatacatacatacatatgcttgtatgagtattctaaatactcatacagtgtagagagaacacttgaattgttaaattacttttgagaggtattggaatgactgggaagaaggtttgcttcttcttgttggcagtgagcatggaaaaaattaaataatgaagattataaaggaaaaaaccctcagaaaccaccagagcactctttgggaaacactgatttagttcagcatgtctctttatcaataaaaaatctgaggcattgagtagctgaggtgtggagtactcttaatctagaatatattctttaagatagctaactgctatagcttacaataccctgaaactcctgccttaccacaatagaaagtttctttcttccttacattatatataactgccttctacatggtgtttcagggacccagacctcttccatttaatggcttcattgtttttcagtccccacaatctttcagtggatcttttgagtccagtagggcgacaaggaaggggatggaacaggaaggatagtgtgaaaggttttagaggatgggaagtaatgttatgtcacttctttccatgccccccttggctagaactcagtcttatggcctcacttaagtgcatggcagataaggaagtgcaatctagctgagccaactccccagaaaggggaggaaaaatgtggcaatcagagatcgctagcatagtccttgctccaagggaatttgtaatctttggattgaatttattaattttggcattccttgaattcagaagtctattacatgaaacttaggcagtaagagatctgtatacatttatttttacacaatgtattgtaattcctactaatgttaagaattaaaccatttaaatcacttttagacttaattcaaaacacataggttagtaagttttgctttcaaccgtaataaaacacatctggtgataggttttagctctggggccacaaaggagagttgtgaagagggttgccaggaggtatggaaaagtcttaagtggtcataagatcacttagggggagaaaacaacacttgaattttaaatacagtgaaaatatgtcttcagaaactataattgcctacatcaacacgatcttatatgaagattctgtgattttggaaatgaaatttttgccttcatatttctttttttttttttttttagtatttattgatcattcttgggtgtttctcagagagggggatttggcagggtaataggacaatagtggagggaaggtcagcagataaacatgtgaacaagggtctctggttttcctagacagaggaccctgcggccttccgcaatgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcaccgggttgggggtaaggttatagattaacagcatcccaaggcagaagaatttttcttagtacagaacaaaatggagtctcccaggtctacttctttctacacagacacagtaacaatctgatctctctttcttttccccacatttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttccctcttagtttgctcttgctaatgcaactaactctcaattgctctagtgaaactaactctcattcatccctgttgcagaatatctggccattctgagagatgcccccacagtgcaaaatacagaatccccactgtccaatagccacgccactcactgagtgcccaccagcacctgcaacagaagctttatctgtctgcttttctcttccttacccccgcctcacctcccttctggtggtacagagataccacattatagcacctatgcagcaaccagtcttggagggggagggagagggagagccttcatatttcttatagagattttcctcttcctgtttatattctggatattactttaaaaactataatctttaaaattatgccatgcttatgtatatattatgccatgcttatatatatattactggtttcttaatatgtttctttttctccttagtgtaaaaacactttataaaatataaatcacccatataagttactattataagctagtttaaagggaggaaaaaataatgagataccaagtaatggaatgccaagtttttgttagaattttgtccttggtaaagaggcagcagtttctcatagaatcatcaaattggaagtgcctctaaattctattcatttgacttctcttagaaagctctatgtaaaaaattattcccagtattcacaagaaaaatgtcaaatccatcctttttttcgtttctcttaattaatgtgttctgctgtacttaagacccattcttctaaatctgttctgagtggaaagggaaaagactacatgtatgaatagaataggccttttagggtcatttggtgtttttagtagaatatgtcattcattttcttttctgttaaacagttgactggaactctttagtctttcactattgactcacccgaactttcattgtaaatatgatcatttgtctctgtaaccctagaagatgttgggtttttgtacattccataagggcaacggattgtgtgtgtgtgtgttttcaagtctctattatggtactttgatatctgtgctttgcagatggtaaaaggacacagcagtcaatatttaatgaacatggctgaaggactaaaccaagttcacaaactaaatacaaattgtcgtgagggaatgcaatgaatgttagccacaggtttagtgctatgcatgtgttgaagaccgcaagttctaaattttgtcttcttaatttgatgaaatattttatccctcaataatatttaatgtgtgtgtgtgtgtgtgtgtgtgtgtgtgtgtgtgtattttttttgtctgcctggtcctttgttgctaaacatgccatttcagcagtctgctttgggtttgtgtttgagatctgttttaattgttgtggcctgttgagaaagaacacagacagactgaacacaaaacaattcagtggtgcaaaatgaggcctaatgataggatagcaatatatgtacaaacagaggttctttataattgaattgagaaaagaggtgggagagggtgtcatgtggcacacagtaatataagcatgtggatggcaagagaactacttacggagagattcaattccagccaacaccccatctgtcacatccaagtaatgttaatttcactttatttgctgtatagttttgtttgtatttaatttgtgaactttctttgattttatagttgtatacaagctataagtttaagaaatttctactgaatttatgtttgcacatagttaaatgataccaagttacttaggtataggtggcacttacaaattcaggattggaattaaagttcaaatcctggattattgtgtgactttgggcaagttaattatactctctatgtattgatttctccatctgcaaaatgggggtgacagtaattctcatgttataatgctgtgaggattcactgagattatccacattaagaggctaatgtattgctggtttatagtaagtgttctataattgttagctatggacatgataatattcttttttttaataataaaagtccataactattcaagctttacagacctggagtcaggtaaaagcattactgtttttgagggattttagttcaattctggctcagcctctacaatccttagccagtctcatagcctctcagtgctcagtttcctgcaacttcctagggttactgtgaaaactgacagtatatgctactatttggggagtgagtttgtattaatcagggttctctagagaaacagaaccaataggatacatatagatgtatatgaggagatttattatggaaatgggctcacgcaatagattatggaggctgagaagtcccacaatctgccatctgcaatgtggagacacagaaaagctaattgtgtaattcagaccaagtccaaaggcctgagaaccaggagtaggggaggaggctgctggtggaagccttggagtctggagagccaggagcaccaaagtctgagagcaggagaagatggacatcccagctttaagaaaagagttcgctttccctttgcctttgtttgttctatttgccccctcatcggattggatgatgcccatctgcgatggcagaggtggatcttctttactcactcagctgattgaaatgctaatctcttccaggaacaccttcacagacacctggaaataacgttttaccagccgtctgagtatcccttagcctactcaagttgacacatgaaattaaccatcacagagttccatgtgtcagacactgttaagcacctatgaacattatctttaatcctgctgatagcttggcaaagagagcagcattgtcctatttctacggagaaaggaactgaagcacagagagaaaactgggattgccctaggtcgtatggcttataagtggcaaagcagaggctagaagtcaggatctgcttgtctccaaagctcatgctccttctctgaggtcctcttgcaatgcagacatgattcacccaggagatttcctctgccacaagaccctgggaacagccacatcaggaataaaatttgtgatgtgggaaagggacgaatcatttggaatattggagggacaccctggcaagcctttccctgtgtgtggtggggactctggatgccttgggaaaaggacaagagggtgtcctgagataaatgacttctcagatcacctgagaccagcctggttatttgtatacatttttttctcacttaatttctttagattaggatggatatttgtattattaaaatacagagtattctggaaattaaaggaaaacagtgtaccttgtaagtcttgctgggggacagaatctcatccatctaactccgagttctgccattcagttgatgtgtagtttaaagcaagttatatttcatcttaatgcctcattttcccatatacgctggtttacaatatataaaatggtcattgcttacttccattttcaagctttgcaaagtgtgcaagagaggacacacacacacacacacacacacacacacagagtattgcccatggtcctttgcatactgggtcagcacactgttgaattagtatccactaagtgtcaggtggtcttcttagctcggcagattcatagaggattcaaaggtgagtcagggaaagtctcagctttatcatgattttcagtctagtaagcagggcaaaggctatagaatagaaaggaaatataacacaaaaaaaagtaatgaccttggatatttccccttgggccacaatttttttttttttttgagatggagtctcgctctgtcacctaggctggagggcagtggtgcgatcttggctcactgcaacctccacctcctgagttcaagagattctcatgcctcagcctccagagtagctgggattacaggtatttgccaccaagcctgggtaatttttttgtatctttagtagagatggggttttcccatgttgggcaggctggtctcaaacttctgacctcaagtgatctgcctgccttggcctcctaaagtgctgggattacaggcatgagcaactccacccagatgggccacaatattaacaatagcatatagcatatgccatgaatcatgaagtattttcttactgaagaaattctaaagaatagtctaaatggaggagaaactgtgagttccttctacggtaactgctcagaaatcatttcctaaagcttttattcctaaagggccccactgtggaaaagctttaaaaagctggcatgtcaggagttaaagtgggctcggggagaaagtgcatgggatagcatgcctcactcagtaactctctgttccctatggtgaatcctttatcccttccaattcttttctttttcttttttctttttttttttttttgagacagagtctcactctgttgcccaggctggaatgcagtggcactatctcggctcactgcaacctctgcctcccaggttcaagctattctcctgcctcagcctcccaggtagctgggactacaggtgcgcaccaccatgtctggctaatttttgtatttttagtagagatggggtttcaccatgttggccaggctggtcttgaactcctgacctcatgatacaccctccttggcctctcaaagtgctgggattacaggagtgaaccacggtgcccagcccttccaatcctttttttccgcagccctgcctaacctcccagggttaccttcagatgtggctagaataagctgccactatatatactgtatatgtgttgtgaaaagcagaattgtctttataaagatggcgctaagcatttctgcagcagaattgtctttatctataaagacagtgctaagcatttctgagttctggacccatattttaactttcacctggttgttcaattgtcactcaaacatttcccagccctgcctcctcgcacctgattgtccttctgtgttccttctcatgattcatggtgtccgtgtttcctggtcactcaaactcaaaatccgttagcccccctcagtccttctctactcttaatccccatatctaagtggtcacaaagttttgtgaactctgccttctaaattatctggtgtctttgcttttcttactttactgccactgacttggttcagaacttcatctctcacctgaactattacggcagttgcccagccagcctccctgtcaacactcactcttcacctgccgttaatcattatatttttaaaaacacaccgcagtactgcactcctgattctccatgtaaaactgctcagaataaatccaaacttgtaaggctggtgcagaagcatcttcctaatgtggcctcagacagcctctttggtgtcattccctacaagcctcctaaagcaccctgagcttcaaccacagtgaatttctttctgttccctaaatactcagcactttgttgttttgcagcctgaaactctctccattatctctgtaggaaaactcatacttatcctttaaaaataaaatcaaaatatcacttccttcctgaatcttccccatcttcttgtggccccatcactgccccactctgtaggataccacaagagaacattgcttgatcattactagactgtgaatcatccctcttccccttccacccatcatattgtgaaatcctcttgaagagaccctcaaccctcctttcataactttgaaactccagcactcagcatggtgcttgttgcccagttgggttggtgtcccatagtatttgctggcagaataaataaaagaatgagtgatcaacttacatgtgaacctgtatctgctagtttcataacaagatatttggagaaagtcagtccaaatattgttaggttggtgcaacaagtggggatcctggtagagtcagacctggcacgcgatggcaaagcttggcgactgggctcgatctcagtatagaacannnnnnnnnnnnnnnnnnnncaccagcctaaccgtacaggatattaggagattatatatcacagagtatgaatttaggggacataagtaaaatcaagtcatcccaaattttcttatatctatttatccacatctgacagctgcttttagaagccaggccaggtggtacatggagatatgggtgttttgaaagcagaccatggcctgctgctcctagagctagacagttatttactaaatacatgcagatgggccagacattcttctaagcactttgcaaatattaactcatttaattctcataacaaacctaggaaatagatactattattattcccattttacagatgaggaaactgaggtcaggtggaatgtgttttttctttgcatctactgttcatttcactgagatttctcttcctgccattcctcttctgaaatgtaagccattgttctctgtgctctcttagcatcttttttatacgtagtgctcacgcctgtaatcccagcactttgggaggccgaggtgggtggattacctgaggtcaggagtttgagaccagcccggccaacatgatgaaaccctgtctctactaaaaatacaaaatttagctgagcgtggtggcacacgcctggaatcccagctacttggggggctaaggcaggataattgcttgaaaccaggaggcagaggttgcagtgagccatgattgcaccactgcactccactccagcctgggtgacacagcaagactctgtcttgaaaaaaaaaaaaaaaaaaaaaaaaaaaaaaatatatatatatatatactacccacgtcattacatgatagttgctatgtcagtctgttccacaagtaaacttgggcacattacttaattttagtttctttgtcagtaaaatgggtgtagtaatccttaccttgcagagcagctgtgaggattaaaagcacctggcccaattctgcggctacaagctcaggaaatgagcttgtcctattgtctttttgtcattcttcacacagttgttgacacatgacaggtgttgtcctgtgagaaactgaagggaagggagaaaaggaaaaccaggacaacccaaagtcagggccactaagggcgcagaagagtgtcagcacttgcaaatctcagaaggtggcttacaattcagagaagaccgtttggtttgatcatcagtaatgttttcgataacagccttagcaggctatgaggtgggaggcagatgcaagtggttaaggagggagtgggtggtaaagaaatgaaaactgagggtgcactgtcttctcttttaggaacagaggagaagggttagagtagcagcaggtgaaaagcatgcttcccggtttggataggagagccctgaatgcgtctgtaggcagggtgggagaagcccttagcagagaatgaccagagaggatgtccttccttctccctgctctggtggaaaggctgcttagaaccccttttgtccatggtgggacttggctccatgagtcctcttactgctttgcatctcgggcatctctcacagtctagctggctttgggtaatgtacccaaaatgtaccctttcagctcagggcctgggtaatgtacataacttgtctcagctgcagtttcctcatctgtaaaatgaggagaataatgtgtacctcacagggatattgtgagcacagaatgagataacatgtgttcagtgccaacgatagtgtctcaaccattgtgtctttttaacttttctcttagagacagggtaaaagaaaagcaaaaagggtaaaatcttagcattttcttgaactgcagaaggaagaatttggggatgtgcccctggataactgctgtctcctctgtaaagcagagagggagtgagtccaccgaggcaaagggaatgggaagtttgtagttttgagggcactggtagtttgaggccgctgggttctcttcactacacaagggctgatgagcagcagcgaaagcctggctgggcatagagatggcagttaggattgtgtgtgtgaccttccatagccaggcatgaagggaatagggaaaggtgtggacggaactggggactgacaaaactgttgtattagtccattctcacactgctataaagacataccaaagactgggcaatttataaagaaaagaggtttaattgactcagttctgaatgactggggaggcctcaggaaacttacaatcatggcaaaaaggaaagaggcacatcttacatggcgtcaggcaagagagagagagcgagcagaaatgagtaaaagggaaagagccccttataaaaccatcagatctcctgagaactcactcactgtcacaagaacagcatgtgggaaactgcggccatgatccaatcacctcccactaggtcctgccctcaacacatggggattgtagggattacaatgctgagatgagatttgggtggggacacagagccggaccatatcaagtgtcaagggggtgtggggttctagtgtgtgcatatgttgggggatataaatatgcactggggagatgacagccagtcctttagtcagatgggaggtgctgatggcccaggtgaatgaggcaggtgtggaagtcctgtggtgacaatgaggatgcagagcaggttcctgggagtggggtggggaccccaaagcttgtggctagagctggggtttcagaacattagataaaagaattttcagagactaaggccaagggatggctggcatctcaaatacgatgttcttaatttctctactttttcttctattctttgtcatatgaatacctaccaatgaagaaaaagtaaccttagtctttatgcaacttttgtgtggaattcatctgttaatattattcagcaaatattttttatttctacattgtgtttgtaataatttttagtggctgcattatattatctttgcacatactgctttgtcttcttttagatttttccctaggataaattcccaagtgtgggataactatgcttaaaggtgtggatgattttggagcagggagtcttgatgggctgttagttaattgctgcaggcagatctacagcaggcagggagggcaggcaaatggggaagaaaattagaatatttaataatagactctgaatggaagctttctgtgaatattttaagtccacctcacataactctcaattctgtgtgctgcctctactggaggcatttaccccagtgaaggggaaaacagagctggctggaagttgcatgtgtgattgagtaaatggaattttgcttggcttggtctttgacgctttctttttggggactatcatcaagaacatgaagaagttgaacaaattgtgtatctggcaggggcaggtagcaatgaaagggagtttttctgttctggagttatgtatttttttgaaatagagtcttactgtgtcacccaggcctgaggtacagtggcccagtctcagctcactacaacctctgcctcctgtgttcaagtgattctcatgcctcagcctcctgagtagctgggattacaggcgcacagcaccacacctggctaatttttgtatttttaatagagatgggggttttgccatgttggccaggctggtctcgaactgctggcctcaagtaatccacccgccttggcctctcaaagtgctgggattacaggtatgagccacggcacctgacccattctggagtttttttgggggggcaggacagaacagtttcatcttgataaattaaaggatttaataattttgattacaataatcacagtgttagtattttgaataattttagcagttagtgggaaacatgatttagataattttaaagaaattgcaatattttgaatcagagcaaaatttccttaacaatattactgttaatttttttatgtcttatgattctaatgtttctcctttttttcttttaacagaagaaatacagaaaggggtttattgatgtttcaaaaatcaagtgtgtggaaatagtgaagaatgatgatggtgtcattccctgtcaaaataagtatccatttcaggtgagctggtgtatttttgtggcagtgcagtgctgggcttagtcatgtttgctctttgacattacagtttcctgtccttgctttgctggctgatttgtaggttcatttgccactttaatagttgtgacttttcttcatgaactgtttaagtctttgtggaaacattttctgattcttaaggagttggggctaagactgaaaagtgaggttgaagtgttccctatgaatctgagaaactgagaagtgaaaggctcaagtggaaatgagattaaaaggctgcttgtgatgaaaaaaataatattagacatatattaattaaactatgcttcttcggggtaatcatgttattttttttcccgacaatggttctgttgcataagggaggtaaatatctcattattctcatttatgtctgaggaaatcagtgctcacctgttaaatagcttctccaaggtcaccttgtaaatgaaaagtctgccaagcacacacacgcgcatctcctctccagaagaggagggtccggcgtcctgagctactccgcattcctgccagtatcttggttcccacctgccttgagaactcaggaatgtggagttggatcctgataatctggagctctcagcccctccccagcacctcaccacttccttccctgctcaaggatgtttttatgctctccttgagcagtgaatgtccctagtgaaagtcgccttttacccatggctgtggtctcaccatgtcctgaaaggaaagttgcaaaagtctttttcaatgtggtggaatttttgcttgtttttaattgctcttatgaagttatcaattacgttggaattatacatttaccagttttgggggatgaagatgtttgggaagcagtgagccaaaatatccaagctcctggcttattctccgctagagtggcaacatcacaaatggaggaagggctacatttaattttccttttccctgttccttattttatagctaccatttctctgagtgaaggacagggacagtaagtgcttagagaggtgactctgaggccaaactgcctgatttgcttactggctatgtgagcttgtgtaagtcacttaacctctctgtgcctgtttcctctcttaaaaaatgggaataataacaataatagtactcatttcatggggttgttgtgaggattaactgatgtgatatataaatagctttgacatataatcagagcaaggtaagtggtagttgctattattactattgctattctcttactactgctgctgctattaatattacacctaatattacacctaccacctggatctagaagtaagataaatttaaaccttcttcttaagtatgtttaatgcatatataatggaaatttagcagagaaccattcctaccacacttctttttttttttttcctttgagatggagtcttcctttgtcacccaggctggagtgcagtggtatgatctcagctcactgagacctccacttcccaggttcaagcgattctcatgcctcagccacccaagtagctgggattataggcatataccaccatgcctggctaatttttgtatttttagtagagacagggtttcaccatgttggccaggctggtctcgaactcctggcctcaagtgatctgcctgcctcagcctcccaaagtactgagattacagtcgtgagccactgcaccgggcctcctaccacagctttgatggctattagacatgctagggattgacagcattggggagctgtggctgtcatgattctggacccagcattaggatttttgctgtccaagaaagagagattcactctgcaagttttgggttgcttttaagaatgataatacaagtagaacagaacgcattccatccctgaactactaaaattgttgagatgaataaatatgagaaaagtttgaaaacaatctgaaaaattaatcaagaagggataagcttgagctttatacaatttaaagcagcatgatttaaaaggtgaaaaataccctctcttattataacttaagtataactaagaaagtatagatcctagtttcacattttcatagtgaaattttacattaggttcagatgcaaagtgaaaacaataaaagtagaagtagacattttcaaaagacactgggagaagaaagtaggacggatggagagaatggtggggaatccacaccagctgcctagatgggatggttgctccttcatgcttttctagatgagtcattctgatggcagctgggagatccccaggagctggcatgtcttccctgggcttcaaacccagatctgtctaccttttgtctgtgctgtttctcctacaccacactattaagtctatggaataaatgaatgagtggatggaagatataaataggagggtgggtaactaccagtgggtagtgttactgagggagagtattccctccttgtttaaatggtttctgcacttgaagtttgcaaagctcttccctcccaacagcctctgctgtggtaggatgactcagcacaagaattaaggcagagagaaacacagctccctggatccttctccccaagaggccaacattgtgtgatctgaggtttgctcagggagatactggcccacaaatacctcttcagcctgagatgccaaaacagggtgctattcctagaaacttctcgtagaaatacaaatgccccaagttagctaggtaatatatcaagctagttttagttatcgaaactctgaatttggattaggttttttttggtggggggaggcggttagctagtctaacaaactttaaggaagtttcacaggctcacggtactgacacgagatgagttttgtggggaagttagactgcttggagtctggaaaggcagattccaggaggggaatagtcaagggatatttgggggttaaatatcctactcatatgacttaacctcagccactttggttttgtcatttgaaaaaagaggattctaacactaagaaagaactggattgctgtatggatgatatgaggcagtgcatataaagtgcttagcccaattgtggggactcagtaaattattataataaattaaattgttattacaatacaccacaggtttctggaaggtccaaggccctagcagtcttttccagacatctcaatgtcaattcagaatgactagttcacggtgcatagttccttctgtacagagttggttgtgtgggcaagcctgcataaatgtgaaaatcatggagcaaatgaggaaacacatctcttcacatctcctttagcactttatcgctctgatatcatggctcactttctgtcttgtaataaggtatttctatatttgtcttagaaacaggcttcatgtccgattcatttttgtgtcttatgcagttccagcaaggtgcgaatggtatatagcatcatttgttctatggtgttcacattactattacagtgcatttctggctggttaccgtggctctcacacctgtaatcctagcactttggaggctcaggtgggaagatcacttgagccgagggggttccaggttgtagtgagctgtaattccacccctgccatccagcatgggcaacagagcaagaccccatctctaagaaaaaaaaaaaaagtacattcctttgatttaaatgaataagaaggaattctctattgaatatggtcagtgataaccatttatcaatgaaagagctatttggttttcaatccagtgggtgtggacgtgacaaagggaggtttctagccatgtattaactttttagccagtctaaacagatttctgccttgtgactgaccatgaagaataaaatgaaaaaatttctggcttagtttcccagggttatcttattaataatattagaaatgttaaaaataagactgtctaattgcccaccaaggactacctctaagtgaggcactgtgattaagaggctgggctctggagtctgaattctggctttctggattaccagccaaatggcaatgggcaggttaggcagtgcaacatcaggggacagcatctgcagtgcatggtgcatgagtggtatctgctgaagttacacaggagtgggggcctgggtaggcctttattttctcatttataaaatagaaaaactcgtaccttgatggcaggattaattgagttaaggtctgtaaagcacacagcacagtgctggcgtagtcggtgcttaatccagttagctactgcaattattgatagtggcaaaaggaaactataagagtgatgctgaaggagtagtccattcatctaaaatattatttagagaaatactgaatctctgttacagtttagttaattggattgaaagaaatactgagattaatgaagtatcctggcctttatatttttttctataaaacatggtcttttgcaaaacgtgtattctacttaatgtagaaatgaagaagtacttgtgcttttgtaagaaagtaacctgggttttctggatatgaagttattgactttcagttatttgagaatcatttattggtgtctgtagtaccaagggttctgtgctagacagaagtgctgtgtctaagtcctcttcaccaattccatcttttgttttattttaggttgttcatgatgctaacacactttacatttttgcacctagtccacaaagcagggacctgtgggtgaagaagttaaaagaaggtaaaactcaatgaaatattactctgtatataattttaggagatgtaatattgttatcattaagacagaaatacagctaatgtatctattgcatttgtaatctcttaatctacagtaagtgtttctccaaggatatgctgttgttgtaagttataccagcatattgaagataactttcctttttaaaatctgatttttttctagtagcatatagtttctaagaaaagcacgctctcatttaatgtgtaatatatctgaaggtgataaagcgcaagcttttatgataacagaatttggtgttttcttgttttttttttgagacagagtttcactctgtcacccaggctggagtgcagtggtgtgatctcggctcactgcaatctccgcctcctgggttcaagcgattctcctgcctcagcctcctaagtagctaggattacaggcacccaccaccatgcccggctaatttttgtatttttagtagggacagggtttcaccatgttggccaggctggccttgaactcccgacctcaggtgatctgcccacctcggcctcccaaagtgttgggattatagacatgagccgctgcacccggcccaggatttggtattttctaacaaagtgcccatgtagtcaatatttggtgtggatggaatgacatattcatgaagggtttaaatggatgatttgtcctgcatagtcctcattgcttctcctgaagaacaaaatggtggcaggttgacttttgcatttatccatcattggtgtagcagcagtcatttctgctaacaagggtgcttcacacacaaaaaaagaagaggtcaaagagaactatagagcttttctgaatgctgagtcctgtgatctaagggtgttcttatagtaaacatagtgtccaagaaataagtaatgatcgacactgttatttatgaaacattctgtagttgcttttgtatttcactattaattactatatctgtgaattacagaaataaagaacaacaataatattatgattaaatatcatcctaaattctggacagatggaagttatcagtgttgtagacaaactgaaaaattagcacccggatgtgaaaaatacaatctttttgagagtagtaagtattcattttattccataattatattgtgcttagaatgaacatattattggtatggtaagaaagtgacatggttttgattaagtacagcacactttctagtacagtgaaaatgtagggtaggtgtgttttgtaagaaaaattatatttagttacagtgagaccttctcgtggaatcagaaggtctattttgggaagcttttatcacaatattgaatcttgttcaaaatgaatccattgaaagtgtgagcctaatgtggcactgtcagcagctttgaaaagcattaatgttcttcaacaaataaaccaagatgtggagctagaaacctcgtgtagcagtgcatccacagtctgattagggctgttctcattttgatggggtatagcagtatggatttcagtagtggcttcagtctgttagaacagtaacatgtcataatgatactcacatgtaaatgttgagatgaacaatgtctaaggttaattttgacacctaaaacctttataaatcctgggaatgagagacccttagtcataagctaaaaatacgtggagattgttaagttactagtgctgtagtaggacacccatagtaatgattggatataccgtttcctgctggtgccatgcagaatgctcactgggtccatcagaactgacagagcttctggatatgagcagaactactacttggcagggatgctgtattatgaacgaggccagatcagatgaccttctcagtccatctagccctcagttctatgagtcctggcaccctgattctcttgggatatcctcacattaacttagcacattaaagaggaagcccaagtttctaaggctgttattgttccttattttttttttaatgtcttaaggtttggtattagtgaatgcacagtctgacctgctgtaaaaagggacccaaaagttacagtgacttaaactagagagaaatttatttcagtctcatgtaataacccagaggtgaaaggtgggtgacccggggctgggggtattcctgcagtggttcctctggttgctccagctctagcagtctctctcttcctggaagcagaaagaagggggtcaaggatgcccatggggaatccttttagggatgagatctaaaaatggcacaccccatttgtacacagaatcctttgattagaatttggtcccattgccacacctagctgggaaacattctttatcttgggtagccatgtgtcagccaaaactctaggactgtggactgtagaggaatggacagccaaagctgattaatttctcagtgttgtcatgatttcaatgtttgattccatgagcattattgagtgcccagtttatgcagtggtaggaatacaaagaactggcctggcttcaatccctgtggcatttattgtgcgttcagaaaggcagaaatacaaaccagctataatagcagtttttaattctgttctagaatagagatacaagcagcatacaccagagttggtcagagtgtgctgcttgtctatgtgttaacttccacttttccttaaaactacccatatcttatttttatcaattattggtagatagcattttaacctgtttttgttgttggcattttcaggtataagaaaagcactacctccagcaccagaaacaaagaaggtaggtggtctttagcttttgatagttaatctttacattttaagcctttaagtcttaagttttggtagtgtttgtgacttactgagtatgcggtttattcattgatgtgacacaatttttccctaggatcgtctcagaagcagatgtgctgtagcttatttcaattttttgtggtgtcaaataataccaatttaattgtatgagattttatcattggagatcctgttatcatctggcattttgcctctattttcacttaaagagttgtattaagaggagtgggatttagataaatatttcagtcttaagaccacagtgtgacaaagaagtgacttcactgatataatgatatgcctttcaggagtggggtatagtggaggaaacatgcactttggactcattcaagacttgatctgatatgagtgactttgagtgggttaattaaatcattgttaccttagttatgaaacaggaattataatactcttcttcatgagagtttgttggattatagtaagtagacttgaagtttctagtttattctgtggtgatgtatgactcatttagtgttttgattcatgatcagtttcatatagaagactaaactttcaaatgttatcttccttgtctagcgaaggcctcccccaccaattccactagaagaagaagataatagtgaagaaatcgttgtagccatgtatgatttccaagcagcagaaggacatgatctcagattagagagaggccaagagtatctcattttagaaaagaatgatgttcattggtggagagcaagagataaatatgggtaagtattccctctatgtgtgtgacatgcagtgggtaggtgggagtcaagtgttgagtgagaagtagataagtcgtaactatcgtgtaatgagactaatttcaccagccataaatggaagcacaccttattacttggtagtaacacagtcctttcttagtggtcactcagtaaatgcgaattgatcaatcacttcttttcaaaagttagaatacattggtctctttctcatctgatacatgtttaatgtgattattttgaccttgagggaaattaaattttatattttgtccccacctgccataagtaagtaatcttagatttttctaagagtttattgtaatttttttcttagactctctctctctatatatacgtatgtgtatgtgcgtgtgtgtatgcatacacatacacagtataatgaagcctcttctcacttctttctctctctccatgaatatatggaggaataagagaatatatatatatgtatatgtgtgtgtctatatgtgtgtatatgtgtttgtgtatgtatatataaaatatatatatgtacatgcaggaaattaaacagcaagcttttttttgtacaagttaatttaggatttaaagaaaacagtcctttcaaccctatcattgataaatatatgggcagataggggtaactgtaggggatgagtatcttgcaggcttcataagcaaactctgtatcctgtgtttacctctgcagtgcaatcccacttatactctgagttccagtggatgagaagaggagaactttttgtcctgccagagcacactcttcttccacctgccctctcacctcccagccccagccccaatttcaagtcactgttcctcagttcacttctggagaagcagtggaaacctctagtttaggcggggtccttttcttctgcttgattcctaggcatggtgcatatatgagtgctgttttgctgtgcattattaacttatttgcaactcttaaccttttattccatgtttacaggaaggttgtcactgcttctctttatcggatgctgtataagattgatttctatttttaatttttttttgttgtagaaattttcaagcatccaaaaagtatataatagtataatagaatctctttttgcttgacttcaaaaattaccaacattttgccagtctaatccttccatttttttctagaatatttaaaagtaaattcaagtcatcatgttatttcactcctaaatctaaattctaaagacttaaaaaaaacaccaccatgtcattatcattcttaataacagtattttaaataagatcgtctgtagactttcccttaatatttttgtacctggaggaagagtacaaatgagaatccacataacatatatctaagtatttaggagttataaatcaagctagcaaactttatcctccaacttgacaaataccctttcatagtgacaagaaaggcacggtttggatttagagctctgtgccagaatgttgcagtgcatggaaagctggctctgggggggctacctctcttctttcttccctcctgccctggctctatctctcatgtaccatatggatcttccaacctgtacacccacactcttactgcgtggcttgcaaaagctaccccgcatcatggccacaccttcagcctcagtgaaagggaatgcacatggccagccagcacaatttgttttttagaagatggacccagtagaaggcccatgtagaccttggaaatgagcagggagttctggggtcctagttacccagaaaggagcatgggaacacaggtcagagggaacacgcacttttgcagagctctcaaaagtgtggggttagagcaagagcttctctggcccaggtctaaggatggaaccaattatgtaattccagtttccccgattagctctaatacttatttttactgttggtttattcaaatcaggacccacacactgcattttggttaatatatctcttatgtttctcttattctacatttttgatttattgatgaaagcaggtcatttaacactaaaatgagccataatctagatgaaacagattgttttcttgtggtgtcacttaatatgcctgtgtttcttgtatttcttgtgaactggcgagtagagctagaggcttgatcacattagaaggtgatctctggatgtcctacttttagtaatgctaagattgcttagtggttcaggtgtcagacttgttcctctgtcataaagttcttcattggtatttaccctgatgatttgggggttcattaatgattctttcttagagtcattatttcattaggggttacaaaatggtgatttcctaattttgtcattccatctgcatttagtagttctctaaagaagaactgcctcatataccagttcatttagttcatgaaggaaaggaaagatgaaatttggattcttaaacttttactagttttcagaataatgagttgatgactgagctttctctagtgataacaatggtaaccaacagtttatttttagtgttattatggatacttatatatttggttccaatccattgccaccattattctctttgcttgaattggccaaattaggtcgatggtggctgtttttggtagaggatcctgttagtttttctttcctactttctggctcagtgaaatggctcaagttatcttgtatttatttttctggccaaacttacaatttgacatttttcttttcttttctttttctttcttttttttgagatggagtctcgttctgtctcgcaggctggagtgctggagtgcagtggcgtgatctcggctcatttcaacctccgcctcctaggttcaagtgattcttgtgcctcggcctcccaagtagctggaattataggcatgttccaccacgcccagctaatttttgtattttttagtagagatagggtttcgccatgttggccaggcgggtcttgaattcctggcctcaagtgatctgcttgccttggcctcctaaagtgctgggattacaggcgtgagccactgcacctggacacaatttgacatttttctaagggggactggctccttttagtcacaaatggtatttagagacagtggcaatgctaagatcttaactgctgctggattgccgttccttctgggcctttctcagtgcaacagagctacctgtatgcacacatttgtgtgtgtgtgtgtgtattatgagttcttactaatactttaaattcaaatttaagattataaggtttctactcaatttttaaattttatatgtatatctgttttcttatgctgaaaaccttagctcctacttacataagagtgcatcttaaattgtgatgtgtgtgaaagtcatttggggtaaaatcggacattttttgacctcacataggtcttctcagttcacatttattgggttatgacccaagaatttgctgttttaacaggtgccccaaatgatactgaccgaaaggccaggaattatcctttgtgaaactattctataagaactattgaggtattagagtggtgggtatttttaatccaacactttgacttttctcaagtaatggtttctttaacacatatcagcaaaactgtgaattctggagaagtattgtggaatgttggaggagcacaggagctagtcacaagtccagagtttgagttctggccctgttgctggctaactttaggacctttgggaaaaaaaatcctataacctttctaagctttagtttccccaccagaaaataggtacaataatgcctgcctaccgcagaatttttatggagaccaaaagtgaaagtactttgtaaaatgtcaagtgaattacagatactgcattttggggggtcagctagtctttcttataagctttaagcaatgtcatgctttatttcaaaaggcaataatctttctttctttcaataacctcccagtaaagtaagtttacctaaagtatttttcttatttctaggaatgaaggatatatcccaagtaattacgtaacgggaaagaaatcaaacaacttagatcaatatgagtaagtaaatgtttattttgtgaatgtggaaaatcagaaacttttcattttcctaattatgtaaggcattttgaagattaatggatatctttcatgattctttgaagggggtgctaaaatatccttaactcaattgcctgatgtggtaaaagactgagaattaatctctataatatatttttcctgaaggtactgtgtgaatggagttacataggcttatgtacataaattacataagcataattgaattgatttgaaataaatcacagattagctgactttgaaatacagatcatgtccattcattcaggacataagcagaacagtttccagagtggaaatgttaataagaaaaaattactgaaattaattagagttgacctttgtcagcattagtatatttcctttcaatctttttactatttttgaaaagatagaatcatgcttatttcctcatacactttaatattctttgaaaacattttcctagctacattttatttcatttgatcataaatttattaaatatttactgagatcttagcatgtatcaagcattatgtatggccttagagacataaccaggcagatggcacgtggatgtccaataatttatgtaatcatttccttatttgtgtggtttaggttgttttaggtacctttgctatattaaaaaaaaaatgggataacgtcttgtttcttatcttaaactggatctctaaaatctatgtgctgggctacaggctgtacgtgaacattgttagggttcccaacgcatgctgtcaaattgctttccagataacttgtattatttatatacccactagcagtgtgtggccaagttgtaacgtgaggctcatatacattgaacgctcttttatggtcattctgaggtggtgtattgatgcttcattcacttccttgaaaacaatagcaacaacaagctgttcctctcttcatgtcacttgctataccataagtgtaccttaacatctaggaaagggttaacaagttcaaaaagccacagcgctcagtggatgtgatctctcaaagtaattttagaagtagaagagagtataaacaatgtataaataaagtagcatttctgcccttaagtcaaatagatttttggaaaaattataaaatccttagaattagggaaggtgctaaaaggtgaaaacctgggcctggttttaaagcgatagcgtggagaactgattgaatttggggaaagaggatgcttggaagccagataatccttatctaaatatgagaactccttttatgactcatgtgatttcagttgaggtttttcaatattgaagtttatgattcatggcctcgagtgtttcaaatgtaccttaatttggaaattttctctcttccaagaaattttcttcctctgcataactctgtacttcagcctccagcgtgggagtgccactgcattctgttcagaggccagggaatccacatggcctttgtaccatgcccagtagatgaccaaggggaaacctgttcccatgtgggcaggcagagaccctattctgtcttcctactccatgttctgttttgttttgttttggccaaagcccaccctgtaacacaattgtattagtcagggttctctagagggacagaactaataggatagatgtatatataaaagggagtttattaaggagtactgactcacgatcacaagctgaggtcccataataggccgtctgcaagctgaggggaaaggaaggcagtctgagtcccaaagctgaagaacttggagtccaatgttcgagggcaggaagcatccagtacgggagaaggatgtaggccagaagactaaaccagtctagtctttccaagttcttctgcctgcttttattctggttgtgctggcagctgattagattgtgcccatccagattgagggtgggtctgcctttcccagtccactgacccaaatgttaatctcctttggcaacaccgtcatggacacacccaggagcgatactttgcatctttcaatccaatcaagttgacactcaatattaaccatcacaacaacttaaatgttctcaagtattaaaaaaaaaaaaaaaaaaagcctctggcagctgtggagtgaatagttctctttgcttgggcccaggaggaatcccaggccacagactgtcactgggctgaactcaggatttccaggcccgcagctcctagtgttatcagtaacctagttctaacttccatacccagtcaacagtgtagggaggagaagatcggagagatcagtgctggaaaagaaagcagattcgttgtgatggttaataacaggatgttcttggtggaaagatggtaaagggagaaggtgacagaaatgaaagcgcccttaggactggaaaaagcttaggataaaggctttgagtgggtggcatagttagaagggcagaattagagaacaagctaagatgtataactggttggttttatgtttttcctttgttctacctcttgtcttcttttcatgatttattctcacccattctcaccaagaagcttggcaagggtctgacctttccgggttaaaagatgaaatgccctcaaacctcttctttccttattgacactgctattttggggtaactagctaatctgaaaaactaattcacattagggatttaatatctaagaagaatctgacaaatgacctacaaattcagggcctaatttctagatgtatagttccttcatcaaaaggtattagcctctaataaagcttttctgtggcatgctttttttttttaaatccctacttttcaacccgctgcttttgaattaattccttcctcccttcctccctccctctctccctccctccctctgtctctctctctttctctttctctttctttcttcttttcttttctttctttctttttttcttttctttctttctttctttctttctttttttttttctggagacagagtcttactctgtcacccaggctggagtgcagtggtgcaatctcagctcactgcaacctctgcctcccaggttcaagcgattctcctgcctcaacctcctgggtagctgggattacaggtgcccactaccacacccagctcatttttgtatttttagtagagacagggtttcaatatgttggccaggctggtctcaaactcttgacctgaagtgatccactggccttggcctcccaaagtgctggcattacagacgtgagccacctcccctggccaaaggtttttctttcaattgttgggccctctttctcctgtctctggactgctgcgctggcaacatggttgttcccagcattggaattaggcttgggtgtgtgttctacttcaggaccccattgattagcataacagtaggcaaattttaacctcttagaatcagttttctcatctttaaaaggtcaataggaaccattttagcactgcacaggctttgagaccagacctttggttcagtttttggctttgctgtttcccagctgtatgcccttgagatatattttgcttctctgtttctcagttttttcatttgcaaaacagtggtgataatactacttaacctcctaagagttgtgaggatgaaatgaggtaataaatgtaacgtgcttagagcagcacctgactgctgtggcttggatctggagaccttgccaagtctcatgttgaaatttgatccccaattttggagcaggggcctgggggaagatgtttggattatggaggtagagatctccctcatgatgaatggcttggtaccattctcaaggaagtgagttctcacgcttagttcccacaagaactggttgttgaaaagagcctgggcttggcacagtggctcacacctgtaatcccaatactttgggtgctgaggtgggcagattgcttgaggtcagtagaccagcctggccaacatggtgaaaccccatttctactaaaaatacaaaaagttagctgggcgtggtggcgggtgcctgtaatcccagctacttgggaggctgaggcaggagaatcgcttgaacccaggaggggcaggttgccaagattgcgccattacactccagcctggacaacaagtgtgaaaccccatctcaaaaaaaaaaaaaaaaaattagcgtggtggcatgtagttgtagtcccagctacttgggaggctgaggcaggagaaccacttaaacccaggaggtggaggttgcagtgagccgagatcgtgccactgcactccagcctgggcgaaagagcaagactctgtcccaaaaaaataaaaaagaaaagagccaggtgcctctctcttctcttgctttctctgtcttgccatgtaatgtctgcacgccagctcccttcatcttcggacgtgagtggaagcagcctgaggccttttttcagatgctggtgctggcaccatgcttcttgtacagcctgcaggaccatgagccaaatatacctcttctctttataaattagccagcctcaggtattcctttatagaggtgtgtggtatctgtgtcacattttacctgtgtgtatagttattcctgacaggagaattcaggggagcctttgttgtcttttttttttttttcttgcctggagatagataatcacaggagaggagaaagaagccaccaagaactgaactgttagaaaatcccgaccatgagttaattcatttatttatttgtgtatgactccttcctcctttctgtctttcaacagacacttaaaggtctgaattgatatcccaaagaagggaacatcctttccagggaacatcctttccagggaacttgccaacaccataaaaatgatccctcagaacaggattttcaagagccttccttttgtgcagtggattccttctttcctcctccttctgaggagctggaaacagtagatgaggaagggacctccttctttttctgagtatcttatgtttggtttcctcttgagagctacaatttagcttcactgatttcttgtatctgaacccaagatgaaaccacctttgcttactcttattgtgaagatggactggatcttctgtttttaataactttttttcagtctctcaaatcctgctactttataattcataattaaagctccaggtgtgtttccttagttaatttttgtgaatgtttttggcacttgacaaatgtttcttatatcagtggaaaagcgttagggtcagaattctgttctcctaatttactatatttcttaattgcattcagaaatgtattgatcacaactgcaattttgttgaacttggtctcattttataaagcgggatccatgtaatgagatgtttgcaattctgaggcctggttcaacacctccgattccaaataaaatatctaacagtctttagcttggattgaggctgtaatttgcatttggctactatataaaagaatctggacagaaaaagatcttgtattgtcttttttgttctttgtgtttttcccttctttagtcagggaaggcctgtgtttccctgttttagggtttttgctgggccaaaagcaggtgctggttctcttatggaaggctgaagcagtactgggaaatttaaatgtccagaggagctgagctgattttataacatttgaattctcagggtatatgactgtggtggagaattctttgccaacaagtaaggatctaacaaaataagtttaaaaccaaagaccgaagaaaattgtctatgttcttatagcctatttgcttaaatcacatggagggattgattatgctggggaaagtagagagaggcaagtatctctgaggatgaggtggttaatgacagtatcaagaaaagggctttccaaaggataagaagaggtacagggccaggcatggtggctcatgcctgtaatcccaggattttggaaagccaaggtgggcagatcctttgaggccaggagttcgagaccagcctggccaacacagtgaaaccctgtctctactaaaaatacaaaaattagctgggtgtggtggcgcatgcctataattccaactactcaggaggctgaggcaggaaaattgcttgaacctgggaggtggagtttgcagtgagttgagatttcactactgcactttagtctgggtaatggagcaagactctgtctcaaaaaaagaagaagcggtgcagattggcagggccttgggatgtggcacagggtggtggaaagatctggtgggagggaagaccagctgcttggtcatggtagacatttctacaatagagtcttgggcaaccacagggcttggggttctgctggaaaccagtaagtctgaagacccaggaggcctgtgcttatgttttgccgtttcttttgtcacctgggacctttgtgaaattcattgagggagcctccattatgacttgagatgaaatctgctgccatattgataggaggagggcttggaataagatttagtttgaattacagacaataatacaaagggacacttcctgcatgttttagtcagtggagtaaaattcattcttgccatgattctagtagtgaaaaattaaaaatgatttttatgttgaacagtgaagaagagcttaaataaattatgacacatgcatactatcatatgtagacctatattgatttgcaaaaatatcctataatgttatatgaaaaattcaggttatcgtatagcctatgtagtttgatctcactttaatgaaacataagaatatgggcatacatacatgttttcatagaaatatgggtagaaaaagtctggaagtatatacatcaaaattattagttgtctattattgaaattatgagtgatatcttgttcttatttgttatatttattattgatgagcagaattactttattaattctgaaaagaataaaatatatcctaaaaacctgaggcctgaaatgtattgttttttctgttcagatggtattgcagaaatatgaatagaagcaaggcagagcaactcctccgcagtgaagtaagtgtttgtacttgtgggtttggcttaagggcaaattaattttaatgagtccataataagtagttccacatatctctctttctaaatgtgttcagcagtgagcaagtctatgcaaaactattcccagaggctgagggagctgagaggctgaagaaagaggctgacaaatccagtttctagaaataaatatttaatagggacttacaaacagaagtaatcatgggtggcctcaggacagttatccccacacctgccctctggacattattctttatatagcaaacttttagggtgaaacatgtgcagctggacatgtcttcagcctttcttaccaacacacatgaccactggtgaggttagataaacatctttatgaaagcattgtttaaacaccttgctgcagaacaccttgataagtggggatcgagcactggtcatcattgcggtttcacttcaaggttacatcactcttgccatgtaacaggctgttttcctacacgctacaccttgaaactggcccttacaatttcatatacccaaagccttggtaaaataaccagtgtggttattgtagcagtggtgtccccagtatgtcctgttacaaaagaaaacatattcttattgaacttatgcaagtaactgtattgccacaaaataagaatactcacaaatagcttctaaattttgaagaaatcaggtagagagaatagttagtgcttcagtttggctctcaaaagtatactttactcaattgctgtaagttttaaatagttcaaaacacacaaaaacacattttcttgactcttcttcagagtagcagtcttctgcacaggatgttgtccattcaccttggaactgccatccacaaacctagcaactcttggtaggtcagttgagagctgtttattgggcactgtagaatccagcagctactcacacagttccagagtcagtctttgggttagagaagccccctgctcatgagtgtctcctccttgcacccaccagatagtgtgatcctgtatcaactatttccattttatgatggaactcttttagatactgctgtctctattagagtgttcctctgacatcacctgaaacagcatggacatttcaggtgtcaagatcattttatattcttcagtcatagatgtagctatagttagcatccatagcaaggcagtaaatgcccgtctagtagaagttctgtagtccagagtcccagtagttgtcactgggaggtgctaactggcttttgccataagacctactaaacactcaacaaaagactatcaagtagaaaatttgtccctaccagcattccaacttcctctacgctatgagcttgggcagttatactggctcccatttatcatgtccaattaatattgcttgaaaggcagatttacatgccctctgttttacaatagaagaaacattccctagtcagatacaatgttcattcccataaaacatatagataaaggagacacagctactttacataaagcctgttcaaacattccaactttcatagtcttataaacctttatgattttatgttttagtcctaggaacttcttttctctacctccagaacattttaccctctgttgtgcaaaaggctttaggttcccagtagggggttgagccaagggaccctggcccttttgtcagtctttatcttgattaacctgcttcagttttgccctgaaacaattgttggtcagccttatcattataatccctgtcttttagctttttaagtttctgcagactggggatatagcaaactaattttgggctctttaatgttggggactcagcaggggcttcttttagtccacacaaccttcaatagtgttgtattaagacccttgttttaaccccataaatttccattttattcatttgatttttttaataaccatccaaagatttcctccctgctgggacaagttccatgactctttcctttctttttcttcattctctttctacccatttagttttatctatatcattttttcccttcattttgaaacaacctttaaataacctctaaactagaaaaaattactttttcttaagcaaaaaccatatcctatcttttatgtagccttcttcaccaaaaactcatcttcctttctttatacactgtgtatatagaattgtttctcttacatgtggtagttttaattacatacactaactactattgtaattcttagtagtactaatttccagtaaaaaatctaggaagtgattaattttaattaagctcacatgcaagtcaagcaagtgtcaagaaggtcacagaagcagcagttttatgaccttaatcagagacaacctaaacctgtctgaccagtaggtctaggcaaaatgtctgaattaaattctgaagatgtttctattttattttaccaacaatttaaaaactagtttcatttaccaaaagttttcttagatcacatagaaatgtcacacacacataacacatatagacatataggcatacaggcacacaggagcaaaccttacagctttcataaggagttgtcactgccagctttcagatagttttcattttcccttttgttagcacagcataccctgtagcaatttatttttcatcctgaaagtaaaagttgctttatcaagtcccatgaaaacctgagcatagatggtttacctcattcttaattcttagagaagcccctggggctttccactgaccaccacaaggttgtccctcctggtaaatttccttcattaggccaaacctctgtcacagccagaatgatccaggccataaggctacaattcccttgtgtatgccttgcattatgaaggcgttgctgcagggctgggtgggtagtaatgtcactcatttttttctgcttcattcctggctagggaaataccatcacccactgtgtcccgcagttagaccatccaagcagccaggggttccctaggtagttgttgttgttgttgtttttaactcatttgtgctggaggttgcaaattttttgtgtgtgaaaaatcagaccttggtgatgactttgagcagtagaatataaataactcccacagcttagtgttccaataatggaacactaggcataaatgggttaaaggctaatcaagtgacgcagtgggagtagagaaggaaaaaagaaatctgtaactggttgtcatcaattagtagtaaacactactgtgctaggaccacccagtagttggttaaaggtctttgcaatctctgagttctgcagcagtgtattccctggccgggagagtctcctgtagtggctcatcctcattttcctgcaattgttgcactttcactttccttagcatgaggggcaagcttactctaatgctttcttcctgattgatcatttgctcccttgacttttagtacttaagtatttcttttttttttttggcttgaagttagttattttaaaataatttacattgatattacataatgtcttttataaataaagcgttaatagatgtttaattccatttagaaataaatgtgctgaaattgctatacctttaaaaagaaataaaatgaaagggtaaaatgtatagagggaactactctgtgctgagtaaggggacctgggtctacctgtgacttttctagtctactttttgcatctgtaagaaaaggagttagactagaagatgatctctacaattctctgcatttctgatttagtattctatttagttattgtttccagccttttaaactcatgctttctcattttacctcctgcttattatcatgctcaagattttgttgagtgcttgtttttgtagttgatgttaaaaaaacaatagtaggtgactttgcttgacaactacacataaccatgcccacaggattcttccatgactctctggagaccctacagtgagaggcagatgtaggggagtgagtagctaaatggcagcctggggaccaaatcctggctctgctacttactagctgcatgacctggtgcaaattacccagccagtctttctgttctcatttccttacctgtgaaataatgtgggaataacaatagtacctatgtaataggactgtttcgatgattaaataaattaatatgctagaacattagaacagaataaattttcgataaataagtgggttgctgttagactgtatttatttatttatttatttatttatttatttatttatttatgatagtatctctctctgtctcccaggctggagtgcagtggtatgatctcagcttactgcaacctccacctccaggattcaagtgattctcttgcctcagcctcctgagtagctgagattacaggcgcgcaccaccacgcctggctaatttttagtaaagatggggtatttttagtagaggtggggttctgccatgttggccaggctagtcttaaactcacgacctcaactgatctgcctgcctcggcctcccaaggtgctgggattacaggtatgagccgctgtgtccggcctctgttatactttttactgaccagttacaattattatccctaattgttaccagatatttttgtggagccttatttatttaattccattgtttttcctatcaagaagagtacaatttattttatttttcaactaataaaggacacacttttcattttaaagcaatttaaatactagagattgatggtagtgttactggacagagaggtatttgaggttcgtagggtctatttcttgcttttcagtttggaagctgagaaagatttgacctttagtgctttagcattgtttccaactattgattttctctgtttaagttacttgtgcctccatctctccttttgtaaaggctgatatttggctgggtgtgttggctcacgcctgtaatcccagcactttgggagatcaaggcgggtggatcactggaggtcagaagttcgaaaccaagctggccaatgtagtgaaaccccggctctactgaaaatacaaatattagctggacatggtgttgcacacctgtaattccagctactcgggaggctgaggcaggagaactgcttgaacccaggaagtggagattgcagtgagctgagatcgcaccactgcactccagcctgtgcaataatgtgagactctgtctcagaaaaaaaagaccgatatgactgatatttaacttcaacttctagagaattaagaatttttaaattcattcttataaaaagcactgagacatttttaggaaaattcagcatggattgaaaatcatactgagtcaggaatcaaagcttataacaaatacaaaaaatgtatgaaatgaaacccaatcattaagaaatacattttttcatgacagttttcctacatgtccaggccttacaggaattgcaaaatcttgtctctcagttctggaagggcactgagagattatctgattgaaatgtctcaccattcatgaggatttgtgattgtggggaattgagtgtgatttccttaactactctcctagcgcagtaatttgaagtacaaagtcatgtgggtgggagaaaccaaggggccctactggtaagttgtgcttcttcaaagcatttttttctgggaaagaataataatcataaaattataatattaggttctttagtcttctccatggcaatgctattagtaattagagtaaaaaaaattttttctgaacttggattttaggataaagaaggtggttttatggtaagggattccagtcaaccaggcttgtacacagtctccctttataccaagtttggagggtgagtaatcctgccatttttttttataatttagagtttttgtatgaacttcctatgtagtttatatggattcctaattttcataaaaatatgcagcatttcaccattaaaaagaaaacctgaacttgatttctaaagtgtatatactgttttttgtatttatattttcagtaattttccttatagtttttcatatatatttgttgagtatggctataataactttagtaacattcaacaaacatttatagtgaactgtgctggtcactaaggataaaaatatgagcaaaggaggcagagaccctgcccaccagtaggttagtagatgctgcagcccagtaacagagagtgatggtagtaagtgccatgtgggagggtaatgtgtgtgtgtggcgggtttggggatgggggatggtacatacacagcccaggcacatcttgagttagtcatgaacgctctcccaagtgatatccaggctgagacctgataggcgagcaggaaaaacttggagggaggagacggagtgtttctgacccaggaaattgcctggacctagacgggagagagtatatggtgagttcaaggcactgaaaagtatgttgtagctgcaggtagaatgggagcacagagtgaagggaggagagagaagcctcagagttgaagcagaggcaagttcatgtcaatgtcagtgactctgagctttaccctaagagcaacaggagtcatcttgaaagtatttttagcaagagaggactagagaagatctgtgctctagaaaggtccctcaagttgaatatttaaaagtctaatttattcactattggtgatttaagtgttctagacatttgtaagtttatgcaacagcaggaacaaaaagcagtagctgctaatagctattttaagacttccaactgttgttaaatggaattcataaatgttctctttcaaaatctcatgcaaagggccaagtatgttttcagtgagtaatttaaaaactttgacatgctaatatgaaagacaaagctaagaagaacaaggggaaagtaaaatttgtgccaggaatagatgggatcatatggagagacactgtggttgcccttgtagaaaacatcttaagaatgaagttctattatttcaacttggttctgacacattttgatttttgttctagagaaggttcatcgggttttaggcattatcatataaaggaaacaacaacatctccaaagaagtattacctagctgaaaaacatgcttttggctccattcctgagattattgaatatcataagcacaatgcagcaggtaagtgagctgtgaaaacctacttcaaatataaggtagtgattaaaatgatcagatactgtgattaattccttgagcagttttattttatagttagttcattgtagaatgtggttgatttaaaattactgcatattaaaggaatgatatatacaaagaaaatttagaaataatatcaagttttataaaaagctctgtcttgaccttaggacatgagttattccagtggtatatagtaaatgttcacattacatttatacactgttggtggcagtgtaaattagttccgccattgtggaagacagtgtgatgattcctcaaagacctaaagacagaaacaccattcaagccagcaatcccattacttgggtatatacccaaaggaatataaatcattctattataaagacacgtgcatgtgggtgttcattgcagcactattcataatagcaaagacatggaattaacctaaatgtccatcagtgatagacaggataaagaaaatctggtacagatacaccatggaatctatgaagccgtaaaagaagaatgagatcatgtcctttgcagggacatggatggagctggaggccattatccttagctaactaacacaggaacagaaaaccaaatactacatggtctctcttataagtggaagctaaataataggaatacatggacacatagaggggaacaacacacactggcatcttttggagggtagaggttgggaggacagagaggatcaggaaaaacaactaatgggtactaggcttaatacctgggtgatgaaataatctgtacaacagacccccatgacacaagtttacccatataacaatttgcacttgtaaccctgaacttaaaagtttaaaaagttcacatttatgtggtatatatgtccttgacactaaagtccaagatatgtctatttcagaatagtcacagaagatgccagataagccaggattcagtcctatgctataggtttccagagactagagtaatcatgtcccacaagttaaccgtcttgaatctctggtacacttaccaccagagtgggaacaaactgaataccaaaaaataacagaaaccacattcatgaaaattagagttccacaggattatatagaaagatttccagcctttgactttaaaaatgtaactgggcagggatagcccagtgcttcacacaacttatgaaaaattttgaaattttattgaaggcaccctttgcaaagcctattattttgtgactgttcacttttttttcagataataataatggttatttagataaaatttacatactataaagctcacccatttaaagtatacaattcagtggtttttagtatatttacagagttgtgccaactatcagcataatctaatttttttaaagaacattgtcatcatcccaagaagaaatcttgtgtcaaataattgtcatcccatcccccttcaccagcccagccccaggcaactattaacctactttctgtctctcttatagatttgcctattctggacatttcatataaatggaattatacaatatgtggtcttccgtgactaagcttctctgacttaactgtttttgacattgtcatgttgtagtatgtagatgtattccattcccttttttaaaaacatacatcacaagtttattgaaataatcagataatataaacaaaatgaacagggcttgacacatagtaattgcacaataacttctacctattattgagttacaacccagagcctaacacaatatttgtggaatgcttaggttctcaggccagcatacaagtctacatttaactcttaaataaaataacagtttcaaattgagtataataatgctaaatggtgagacaggatcaacccctctatctccaaatatagggggattatcttaccatccacctgttgtattagaaagtcatgcttcatctacttatggaagccaagacatagcctagatatgtacaaactatagatataacgatgttaaggaaaaaaattgctgacaatatcactagggattctagacaatgtaaattgccattaatgtttattgctgtgatggacttcctgaacacattgttagaaattggtttgtggccaggtatacaaataattcattgtatggattttattattcatcagttgatggacatttgggttgtttccacatttgttctcttatgaataatgcttctgtaaacagttgtgtactagtttttgcatggaaatatgttttcatttcttttgggtatttacctagttatgggtatgctgcgtcatatggtaactctgtgtttaacatttcaggaactgatttcatatcaatttatatctcattctgttgttttcttttttggtgtttttgctccctaattttttcttccgtgttcctgtataagttttatttttcaccgtcatctcaattcattcaacaaacatatatcaagtgcctactgcatgccagaaacagagccaggctttggggagacttcaatatttcagtggtggactaggtgtagtcactgatcctgattttcccagaccctaccacttgtggggagacagagaagtacataacgattttaaattgctttgagatatcttgtagtagaggaaatacagagtgctatgggtgtttatggaagagacatctcctgtttcttatttagtgctgtatgcgacttgggttaaaagatccacactgatttccagtagttggtattcccagttgttgctatcctagagcccgatttgtatgctaagattgctaatactgagtcatgtcaggtgaataacttccatttttagcagactaatctaattccctttcatagttcagctctcatattggaaaagaacacgaaataactgttagaaaccttttaacatcctttaaaatatttgaaaaaagagaaagctggcatggtgcctgttaaacactgtagtatttaaaagaaaatgtttgttgaatgaataaaagcatatagcagagtgctgtatgtacacacagaggatgagcagtaaatgaataaatgatgaattttctaagtgagtttcctgtagcatgtgaccaagcagaatgattatgaatgagtttgactgcaacgctttctttgattattaggacttgtcaccaggcttcggtacccagttagtgtgaaagggaagaatgcacccaccactgcaggattcagctatggtaactcttattttgtggttgcatgagctaattttccttgaaaagaatccattgtcataagataaatttggatgtgtactatttcacatactggaactgttttttataagtttatagtataggtttttagataattatacttaagaccatagcagcctaggtattcaattttcatcattattcataattccatagaaaactttctgtcagtgaaaaataagcattatcatgttaacatctaaaataaatcaaagcccttcctggttctcactagctttattggctacaagaacgtgagtaaggatggaggtaagaaagcaagcttccaacttaattgtctttgttgcttctggcaaaagcctttaaaacagcaaattagattatttccaacttgatggaattgaaaaagaacaacaacaaaaaaaaaacctgagaaggaagagtggtaaagaaggaagtatttgtttgacaaaagtacctttaactttcaggctatattattattagcttgttatgcagaattgtcttgccttcttcatttcacgttggttagaagggattcatcctccccacctttggcagttcagatgcaggtttcaagtctgttctgtgttttaccaggaattattacagtgttatcctgtaattttgaggttgatcttggttgtaggttctttttccccctctctgattcatgctacattttcctttttaaatatgaacactttccctttctgtcctgcagagaaatgggagattaacccttcagaactgacctttatgagggaattgggaagtggactgtttggagtggtgaggcttggcaaatggcgagcccagtacaaagtcgcaatcaaagctattcgggaaggtgcaatgtgcgaggaggactttatagaagaagctaaagtgatgatgtaagttgctatcatctttctggctcatctttttgtattaagaagtggccccttaccaaaaacttggtagtttcttttcctatagtaactatatatatgtcttccttcccaggaaactgacacacccgaagttagtgcagctttatggtgtgtgcacccagcagaaaccaatatacattgttactgagttcatggaaaggggctgccttctgaatttcctccgacagagacaaggtcatttcagtagagacgtactgctgagcatgtgtcaggatgtgtgtgaagggatggagtatctggagagaaacagcttcatccacagagatctggtaaccctagccacccatattcccactcattggctgaattcctttgtaacactggctcagcaaatgtgcaatgatgtattaatagccaatttttgttcttaacaatctttcaccattatttttaaagttggtaaatttaacttgccctgtaattttaaacgaaagatctttattcaatctaatgatttacttagttaatatctccaagcaagtttccatgttttaatttttcgatctccataagaatcccatgagatagctactcacagtggattctcttaccatcattcttgtacagatgagaaaattagcttcagggaagtcaaaaggctcgcctactgtgataaatagggaaattggggttggccttgactttctaactagagcccaagttcttttccacctcacacactataaaaagaaactataagagaaatcctttggatttttaaaaaatctctcaaatcactgggaaaacatggaggttcatgttaacttctcaaaatgctagaaaaagaaatccgttaccagttctaaattatgatggagacaatttttcccttctcacctgttctcactctctcctccattcttcttttccttctgtttttcttctctacctgttctttacagatgctttcagctatcagtagcactctgtcccctgaaaataatcagctgaaaatgtctgttttcagcatatcggtagcactgtctgtcccctgaaaataattcttttaccaagaagagtgtaattttcatttgggactttctcccatattttagttttagctttctagtgataaagcatggacacatttcttttagaaagcagaaaaactttaaaaaaatttttttttcctttgagacaggtctcactttgtcttccaggctggagtgcagtggcgcaatcttggctcactgcagcctcaacctcccgggttcaagcgatcctcctgcctcagcccccaagtagctgagactataggcacgtgccaccatgcctggctaatttttgtagagatggggtttcaccgtgttgctcagactggtctcgaactcttgagcttaagcaatctgcctgcctcagcctcccaagtgctaggattacaggtgtgagccactgcacctggccttagcaaaacattttttaaagttaacagtcaccttagacagacattgttctgataagtattttacaaataaacttgtttaatcataattctgggaagtagattttcttattattccctttttacagatgaggaaactgaggtgcaaataggataaaataacttccaatgggcaagtaaattgtagagccaggatttgaacccaggaagtttggctctaaagtccctacttaactactatgctatgctctctagaattaaaacatattagagaattgaagatttggagatggaacactttatttcctaggtgtgttttgggatacttaccttatcttatattcagtttctgtgtctgtaaattgtgggttataatgttgtttggcttccaggactgttttaaaggtcacattatttgactggggcaatgggctttgtaaaatagacatgctgtagataacatcagttattgttatcattgtgtcagggatgatgaagaacatctcgtcagttaaaacttgtgaactaagaactaagaacaaaatagatgtccttataaaactgataaaaactgagtatctacgtgggtgtggcagattacacctgtccacacagatgatgttttggcaaaaacgattcttacatttctgtgcctgtgatattggtattactatggtaggtttgtgtcaccccttatgggaaactttggatgctcttgtctccttggtaaagaatcctgttgaccatccagtgcaggcattgtggagttgtgaagtgttttcataggaagatgcaggcagtccagggaatggatattaactctcactttataagactcttaaaatgcactcagcaagaaggaacctcatatgagtggaattgccacatagagaaaatagaattatgaacagtcaggaagaaaaacatatcttggtctatgggttatggtattaaaaatattatcggccaggtgtggtggctcacgcctgtaatgccagcacttttggaggccgaggcgggcggatcacgaagtcaagagatcgagaccatcctggcaaacatggtgaaaccctgtctctactaaaaatacaaaaaaaattagccaggcgtggtggcagacgcctgtagtcccagctactcgggaggctgaggcagaagaatcacttgaacccaggaggtggaggttgcagtgagccaaggtcgcaccactggactccagcctggtgacagagcgagactcagtttcaaaaataaaaaattaaaaaattaaaaaaaaattcttgtcttccttttgagaaataccacgtctttctatcaaactattttcttaaaccttgtaaccttgaagaacatgcaagaaaatataaattaaataatccacaattgtatttgaccaattttgtacatcatgttataatatactgggaacataaatgaaaaagcaaactgtatttacacatagctgttctttttgagacggagtcttgctctgtcacccaggctggagtgcagtggcgcgatctctgctcactgcaacctccacctcatgggttcaagcaattctcctgcctccagtcctaggtagctggtactacagttgtgtgccaccacacttggctaattttttttgtatttttagtagagaaggggttttgtcatgttggccaggctggtcccgaactcctgacctcaagttatccacccgccttagcctcccaaaatgttgggattgcaggcgtgagccactgcacccagcctgttctttgactgggatgagatgaccaatcactgagcagaaatattggataagagattggtcgcccatcattttgatggttgtgtgttattaagctcacctagtgagaaccggattaaggacttcaagagatgttctcattgtcagtaagaaaattggatagtttaataagaacaggtctgggaaggagaaaagtgagttgacccttctattagcccttgtttaagaatgacagttggccggtgaggttgctcgtgactataatcctaacaatgggggaggccgaggcagatggatgaggtcaggagttcaagaccagcctggccaacaaatacaataattagctggctgtggtggtgggtgcctgtaatcccagctactctggaggctggggcagaagaatcacttgaaactggaaggtggaggttgcagtgagccaagattgtgccactgcacttccagcctgggcgacagaggcagactctgtctcaaaaaaaaaaaaaagaaagaaaagaaaaaaaaaagacaattggtaaagattatgtaataatgccttattgcaaatacaactttctgacctgcctattcatttttttcaaatacacaatggaaatacttccataggggtaaaaacaacttattaaagggtgtttccactctctgcaaatgttgactaggttacactaaatttaatataaatagaacttacattttcctacttaaatgatagaatttttaaactaatataccatcataatgttgttttccaggctgccagaaattgtctagtaagtgaggcgggagttgtaaaagtatctgattttggaatggccaggtatgtccaagtatacgtggttttaggtgatgtttgcatttttttggtggaattaataagtgtgggaataatttgcactgatgaagcagaaaggaaatcttgttaactggttctcagattaaattaagtatatattgtgatggtagtaattctctccactaggtggtagtatagcctgttaaatacactgtatttcctggtgtggattagatttctagaatcttttgttttcacaaaaacatatttggtggtgaggttcttagtatgtccatgtctgcagtgtttttcttctcttaatttttataatttaatagtattataaaataccttttaaaggtatttagtttattttttctctcttctccctccgtctatccattcattcatccatacatccacccataaaaaatcaggtgcctgctctgtgccaggcataatgataagctgaaccatatagagaataagacctacaagtccttgcccgcatgcagcttacattgaggaagagggtgaatcagaagacctgataaagttacatgatcgagcatggtcgatactggtaaactgtggctgtcagtctgacccaaacctcatttgggtttcacatttttaaatggatgaaaaaaatgaaaagaatattatgacatgtaaaaaaaaatctgaaattccaatgttgctgtccataaaaatagcgtgattgagacacagcctcgctcattcatttaggtgttacctgtgactgctttcctgctacagatgcagagtcaagtagttgtcacggggactgtatggcctgccagatctgaaatatgtgttatctggccctttacataaaagttgactgatccctgtaatagagataatttggggtggtgctgaatgatgatgcagggcaagagtgagggtggctacttgatctgatgttcaggatgacctctttgtgataggcagatttgactggagacgaaaaggtaggaagtagccagtgtaggtgaaaataaaaggataaactatttcaggtaggaagaaaaagtgaaaaagcttgaagtctgggacacgtctggcctgctcaaggaacggaaaaagcgccagggtagctggccaacgggcagcgccaggaatgctcataaatgcaggcaaagaccaggccatgtagggccaagtttaactcctaaggaaactcaggcccagggagattagaaaactgttactgtcagaaatgggaccagaacttccaactcttaggatattaattacccaatgctctttatttgcttttatatacagatactatatatttgacaggctgtctgccgctttcatctgttcaatcttcatatgttaggctttcagaaaatctgcacttttgtatcaaccactcaaaaacctctttataccctaaattcagactccactggctgacagtttgatccagcccacagtggcattgtctgccagccagcagctggctttgtgccgagtcaccatctttgtctacatagcaaaggatgtttgtgcaattcttcgaaaattttctcatggaaccttttagaaattaatggtatattcacacacaatacagagatacattccttttgtaaatatgtgctgcccaccttacagaaagggctgaagtcttttcatctaccaaccctaatcaaggattctcccctaaagttagctactgttaccagtttttgtatgttcttccagaaggacattgtatgttcacatagaaaaattatatagtattgttttgagtgtatgtatgtatgtggggatgttatgtataaatacatactccaccatttacatgtggcattttgtgttgtgtttttgtttttgtttttttgcatttgctattttcatatgctgtagttttaaattgtgctctgtggaattggaggcctgaaagcctgtgtgtttctagatgctttataccacttcctctggagcagctctgctttagattttttacatatggggcctttgggtaaaattttatttaaagaacaaaattgcttacaaagaaaagcttgcaaactattttatgataccttgtctctactgccttataaaaagaaagaaaaacagaaaaatgaaagtgcagatggtaacgtggtgatggatccatctcatgcacttaaattaagctgagaggaagttggaaatcaccaggtgtggccactgaggtgaacatttagcttcaaccggatgcttgttggacttcagtcaactgtgtttttgattgcaaggggaaaaaaatgaaagagcaagtagaaaaaacagattgttcttcagaggtgtaaacccatggtgtgtcttactctaggtatgttctggatgatcagtacacaagttcttctggtgctaagtttcctgtgaagtggtgtccacctgaagtgtttaattacagccgcttcagcagcaaatcagatgtctggtcatttggtaagatccatgtttcctcatgtccgtccgccctgaggagaaagtggatacatccatttggtaatccttatccttttccaggtgttttaatgtgggaagtattcacggaaggcagaatgccttttgaaaaatacaccaattatgaagtggtaaccatggttactcgaggccaccgactctaccagccgaagttggcgtccaactatgtgtatgaggtgatgctgagatgttggcaggaggtatagattttttgtgtgctttctttttgaatctcttagggattgggcttggtagatggataacatgcagtctttatagcctagtgaggtggtgcatctttatagtgatttcaagctctaggtaggaagccaaccctctcaactcaagttctgaataacgggaagaagaatgtaaagatgtggaaaatgctaataactacctcgatacattcaggctgcttcctcacttccaagtgggactccttccatggttgcctgagatagggacttggggaataagcctggataagtagctcttttttcattggttcacttgtagagttgaagtattatttttttaccagagttggtttctttctctaaacctcaactttccgaggtctttgaaagtattgaaatgttacctcctaaaagagattagataccaaatgacttctgaaagacagtaacattagctcacatgtattatgtaccaggcactatacttagtgttttggatttagttctcaaaacaacactttgaggtggagatactttgactgtagccactctgtagatgagaagattaagggtcatgaggttgctgcttgcctggggtcacttagctacagaacagtataggcctgtctgattccaaagcccagagtctcaaccacttgctgtactgcctcccaagagcattgattgggatgggcagagacattctgggcaggaagtggtgctaaagggagagagaacagcttgagcaaaggtaaggaggtggttataaacacagtgtgcacaacagtggagacagtggccctatttaacagacagcccatgtgagggattttgtggggaacaagattgggtaacaagagggtcgggaagtggcagattatagaggctcctacaaatttgcaggacttgatttcacaggcagtaaaaagatctatcagggtcttgaagagagacatgaaagcagtgtcttagaaacgttagcctagcagcagtacatgcagggtaaattagggtagagacaagacccctttggagatgcctgtatgtcctagtcccaaagcagtgaagtctctctgtaatatgctgtgtttaggagttggagcagtgagaggttttttggaatggattctggaacccacagcttctctttgacttttaattgtagaaaccagagggaaggccttctttcgaagatctgctgcgcacaatagatgaactagttgaatgtgaagaaacttttggaagataagtgatgtgtgaccagtggctcccagattcccaagcacaaggaaggatgggcattttgtggcttttaatttattgagcacttggacatgtagatcattttacttatacagtggaaacacataatttgcttctagaccagcctctgtctagacttgcttctagacagaatctcccagagtgtggaaatgttgccttagaaatggtgattaaaatcactcatttctattcattcctcaggcacttgagtgacagttgtttaccaggcactgtgtgtagccccagggtttggccattcaggggtgcacacatgggaccatgttagctgatgccagttgaaggccagggtatttgggaaggggaagggtattagagtcatgaccaagcaacccttctttttccctttgacttctacagaaatctgggcctgagacattgtctacaattgggttctagatacatcaggaacccatcttggataaataaatacctatcttttgttttgaaaacatctcagttttcaagactgctcttagtattacatgaacaatatttgtatgctgtatatattgtaaatatatataatatataaagttatatatttatgagaaacacgaattgtcttttaattgaaacttttaatcctgtagtataggagttcaccttcttaggactagagactgtgccttatagctgttaattcatttccccctgaacatcaaatatgcctgaagagaagaaagtctagattcttctatgagtaacgccccctcctcactcaggtaaatgtgtctggggatgcctgtccagcttaaccacgtgcatttggcctatgtaatcctgcccatggtggccgcagctaatcagaatcagatggaaaattaaaccgggtaatctgcttctaagccttaagaatattccctgggacacagacactataattggaagtgctgagctctggggcagaaggatcaggtgaccttcgcaacaaagtttgcccccacctcacataggacccggaagcagcctgagctgtggcggaggatccaggaagctacggagagaagcagccagcatggtgttccgtgcctcccggacgtttttcaggaggcctggttggacttgggttcctggatggtgggattgttgtacagcctctcaggagaccctgctgtcaagactgtgtgtgtggatttcccacccttagaagctctactaagacatcaacggaattagggccttcctttttgccttgtgagcgccaaggaaaagaaactatctcggtcacgtgagcgccagcgaaaagaaactgtatcagtcatccagagaccgtttattgcccaacacgttattcttgctgttggtggggtaactagccgaggaagacacagcgccttcccttcaggagttgcgtctcctctgcaggccacgatggtctgctctggagcattgggtgaacacacaggctggctgctctgggcagcgccttcactctgaccctggagaaccatttcatttcatcctggtcagtctagagtctgtgcaccaggcagtccatccactgaaggctgtgtttattcttttcctgtgcccctcataatggaagaaagtaaactgcttatcccgagccttatcacaatctgccacattccttcttgtctacctgtttaactgtacccccatcacaaaaacaggcacaactttttttttacattccagggtacatgtgcaggatgtgcagttttgttacataggtgaacgtgtgccatggtggtttgctgcacctatcaaaaactcatcacctaggtatgcattagctatttttcctgatattagcctgatatatatatttcctgatattagcctggcatgcattagctatttttcctgatgctctcccctcatctgccctccccaacaggccccagtatgtgttgttcccctccctgtgtccatgtgtttcatggttcagttcccacttataagtgagaacatgtggtgtttggttttctgttcctgcattactttgctaaggataacggcttccagttccatccatgtccctgcaaaggacatgatttcattctgtatagctgcataatattccacggtgtatatgtaccacattttctttatccagcctatcattgatgggcattttggttgctaaccatgcacaacttttaactgacttgtagctcattgaaggagtcggtcctggcacactctaccttactatcactgtcagccttttctccttccttcctgaccttccctcctcccatcccatacttcccttttcaccttgaggagctacgggaagtactaggtggtatgaaagagagtgaggagaagatagagtccctgtcctaatggtcagtgtatgctttttatgggaaaacaagatagatagcacctggcaacatttgtcaacatttccttcaaaaatctttaaatatttttcactaagacttagaaaaaaagttttatacgaaagcataacaaaggcaaaaggtgaagtaaaaataacagtcatcacccagaatgctaaggagaccttaatctaaaccaggaaattggaagggcgattagaatatgctgtgtcttcattaaagttgctctgttaattagttgacacatggttatgctttccagtgggatgaagtgaaactcccaagtgtgttttgtattgttggtgtttttatatttctcagccatcccccaatcacattttagggttattactagattgacttcccccaaataaagtgtctgctgagtgggaggatggaacattctaaactcaatattccagagcctagaatctaattgtttctgccactcacggtgtggccttgggcaagtcccttattctgtctgtgccttcatttccttcccagtccagagagggcagtttgatttgataattttaaaggtgccttttaccaaaattttgtgatttcttgaaaatgatgtttgcgagtcacccacacctttggggatgagagactaatagcagataccctcagagattgggatggagattactgagctttcttatatatgccattggttgtcatttatactcttctgaggttttcagaacaggaaaataggtggggttaactctgcccgtgagaaacatcttgagcgaactatgatttcagttgaaagatgtgtttttgtgagtagagcaccgcagaagaactgaagactgttgtgtgctccccgcagaaggggctaccatgatcctttcctcctgtgagtaagatgggctttgtcatttatttttggggcttgttctggggcctgttattcttgaacagcagaggaagttttttttttccaaggcatagagcttggggacattaaaagataatttcctcagatgttgtgacagagttttgtttcttatttaaagaaccacagtgatgatgtaattctaataaaggttcagcattgagaacataaatgaaagaaaaacagaaagagtgtccagaaatctgcatatgtgtgtgtagaaatgcaatcagtatgaagtacttgtttttagaatgagactgtaatgagctctgggctgaaggccaggagaccaagttctagttctggatttgctccagcagtggtggatcacagtgg

SEQ ID NO: 17261 - DNA, 51975 bp, Human
caggttcttgtgtcatttctatcattgtttatgcttccgcaaagcataaagcatgacctttgtagaaaagtctgaaagtctaaataagtaaaataggaattgagagcacacacaccctctcctaaaacacagatggccagacaggactgagcacgctgtgtgggtcaggcctcagccatgcaccggtcacctctgaggggtttttatgttttttgttttaattagtttttttttttttttttttttttgagatggagtctcgctctgtcgcccaggctggagtgcagtggtgcgatctcggctcacactgtaagctccgcctcccgggttcacgccattctcctgcctcagcctcccgagtagctgggactagggcgtccgccacaatgcacggctaatttttttgtatttttagtagagacggggtttcaccgtgttagccaggatggtctcgatctcctgacatcgtgatcggcccacctcggcctcccaaagtgctgggattacaggcttgagccaccgcgcccggccttttttttgtctttttgagacaatgtccccctctggttacccaggctggagtgcagtggcccaatctctgctcactgcagccttgacctcacgggctcaggtaattctcccacctcagcctcccaagtagctggtattacgggcctgagccaccacgcctgggtaattttttgttgttgttgtttttggagcaggggaagggtgctctatgttgcccaggctggacttgttgcctctgcctcccagagtgctgggtttacaggcctgagccacggcgctccgcattaatttctttttagagatgaggtttcactatgttgcccaggctggacttgaatttctgggctcaaggaatcctcctgcctcagcctcccagcttgtttataaccgacgctatgttcttaatccctcaaccaggagcctttaaatggtttcaaattttccccattacaggaataacttgctaataataataataattagcaattgtttcaaaagtaacgtcatcccaaaagagaacgtttctgaaaaaaatgcacattagacttgaagacccccaatggcacggttgaacatggaaatgaaccagcctcaaaagtcccagcgtaggggttattttccaatcaaattggatgcctttctacaaaatgtgatgtgcacaggctggggctggtaccttcaccccagcccagagggcaccatgagagggagaacagggcgggcgaaacaggccagctcctccccagccctctgccctgctctgcttcagggggctgatctgagggcccagtgcgcactgcttttcctccttgtccgacagggtctcccgcaggccagaactaggctgctgggacactgcggggctcagggcgtgggggaagagatgcaggcagtggctagtcccgtcctgtccgcggaggtgacccagccccgacctcttcgcagaggaagtgttctccaacctgggacctgggggatgagcgggggttaggcttacgtcccaaccactaacggggctggttgaaaacggctcccaggcggaggggccctccgcgatgttctcaaggagtagcgcgaggggacgacataggaggtggggttctcacatcagcgggcgcacggagtgctggaggcaccgacccgccgcggacgggattgaactagggaactgggagggcgcaggagataaagacggctggggccggggcccacggagaggggtggtgcccagtgtcccgcgagggatgtggtgccacccggggaaggtcccgggagcggggacccgggaccccccggaaccacacacgcggtctccaccttgccccgccccatttaaagaggcggaggaacgcagggcgcgcgccgcgcggaggaatatttgcatatggcgcggcgtttcttcggaggcttgtgattggttgctgactgcggcgcgaagcgcagttgacttgcgccgcgctcggcgaatcgcagcctgtcttgctcgcggagagaggagctaggagcctcggccaatgggagccggcgttgttggaggccacggcggcgcagccccaaagcgagcgaagctagggtcgccgccactgccgcaggaggcgtgaggtgcggagacacgggtgctgggccggtaacggcgcgctggggagggcggccgggcccggacgggcgggtggggccgcgggtccggcgcgggcgcggcggcggccatctctggaagcctcggggcggtggggcaggggcggggccgcgttctggtcggggcaggcagcggcggccgcggcggggcctggggcttgggccctggagcccgggcctggggcgctggcgggaggcccctcccaactcccggcgcgcctcgcccggctgcccgcctcactgaaggtcaaggcgctttgttctgcgccgcgggcggcctcctgggcggcggccccttggaggaggcgaagacggcgagaggcggcggccgctcaaatctcccgctagcccagcccgccccgcgtgcgggggctgtggcggttacacggccgggcgcgccggagcgttcaggcttcccgtttttaaggtggagacgtccaggacttctttattagatgtttaggaatttgagtttttccgtagggcggttgtcatcgtgagcctctgtggggtcaggctgggctaactggggttttgatgtcagtttggtgtggccgagggcatgtctgacggggaagaaagtccttggcgttgcttcttagctgttgggagctgtgcggtgggagcgagctgggcggcgtgcgctccccgaggactggcctgagtggccttagactagttactcacgggacttggtttcccagccaaggtgggcagcaagtctgtttactatttaaaaccgtctttcacaagggaaaagcaaaatctccaaaaaaaaaaattgtacatgttatggatgggaaagtgccatgcttttctttcagttcagagatggtggaagaggtcacatttgtattttttgacctgaccagagtctttgttgttttcaattttccccttctgaatgctttccgttcaccccagcgaaggatggcctggtcatgataagactttccaccgtccacagttctctaagtctgattgcggggcaggaggcagacatgtttagggtccagtaaaggggactccagccttgggacctttagaccctaacgtgtgtgtcacatcacctgcctgggtgactgtgcgctcctctggcaggaaggtccgccatttcattatgttctcggaggaatcgtcggggcacattcgtctgtgctttggttcgcatcccccagtctgcattactttttcctgtagtaacccgtgccttatcctcctgcattaggtttacggggtgaaaatagacttttaaaaattctcttaccttagaaatatacaaatatgtagattaggttgttggaccttaaaggtaagtctttctaagttactaccttcctgtaatagtaactatacctctaaatgactaatacctgcactgcgcaccagggactctttcagcctgtttgcgtgtgttaactcatttcataatctaataacctgagatagatgctattgtttttccatttaactactctggaagctgaggccctgggaggttaggtataatgacttgtccgaggtgacaaagcttaaagacccaggcagttttaactgtacccagggttactgcttctgtagagggaatgaaagaagttttaatgagaaattgttttcatcattgtgctaagcttaactgaactctagcttacgaggttttgagctggttgatcatttccatctcaaaattctcttattccacagaatgccaaatgcctcctatagtagaattttgagattcagactgggatgagcaattgctaatggaataaataatatgcaaatgtaaaatgaagttcagagaaagcaacgtggtgatagaatgggaaagtaatccaaagataaaatgagtgactacagagagagagaaaattagttatttagtagtagttcacaagtttacttagagatatttttactagaatttcagggccttatgatgtgatttttatgaaccattttaacacgttactgccgtcttaaatagctgttattacatatccaattgcagtcttttttttttcctggttgagcagtgttagcttcagaatgtctgcagttatttgtgcctatatgtcatataggcacatataacacttttgtgaattttgttgtgtaagctttaaatccggtactgtttttcaaaatgaatatggagtagtcattggagaaattggttgaattctttgcagtagcaaataaattttaatcatttttaagtttgataactttggtaaactgaattctgaaaagtttacacatgttttaggatgtcctcaaaatgtacagggcattgtgttttgcaaattagccatttagccatcagattcttctgtagaattttgatctttttgcccatatgagaggtagttcttatttgtatggaggttaagtacctgcggatgggatgtgttcatcaccactttacagtatgaatttgaatttgaaactgaaatgaaaacttcctaacctgtcagagtttttagtagcctcttgttattgaccgcatgttaattccctttgttagctattcgcagctaagtgtggggactgaaatctttattttgttttccttcttttgagcagttgatagtctctagcatcaggaggaggtgacctcaaatatgtatgtatatatagtagtgcttttcttccttccctttagttgtctgcagtttaaaaattattgtgataagtttatgttgtacttccaaaaatgttgccaaagagcctatatttttcagtttgttttggaagaaaaatactttgtgggcaagaaggtgatttaaattcctgacggcctaagaggcgtcagctgtgtgaaataggcgagtgctgttactgcttgaaaccatgatggtttatatttgaataagacagcagagatgagcttgttgggagtttggcctgagattgctagctaaggaatgcttgcttttttgcttaaagggaaaagtgttttaggcttccagagtagaaatctgatattacttcgtttgattcttcgaccactatggtgataggaagtagctgatctctgcaggaaactgctgttacctgacctcagctgaatttttgtgggacctcctgaggtaagcaaatttatgcctcccgaaactatagttgtaaggtttgtctttgagcatatagtaatggaaaacccttatcagtaggtagatagtaaataattttgtatttggctgctaatgaaatttttaagaaatagtttgtggtgatataaattagttttcatctggcagtcattggttttccaccctgccctcttaagagagaacagggttgctttactttgtttgccagagctttacattttgcatttagtaacagaggcattgtgtttttatagtatgaaaacaacgaaagatcactttgtgatctttactttttgattttgaccacttcctgtgtaaccttaagtttcttacaagtatcccctgttaactgttaaaaacgaaatgtatgttcatttcatgtccttgggacttttaaaaatgcgctgtgcattatccggaaaagcctgttcaaaaacaagatgagataatttctgtttaatttgtggtagaaagaatgactgtgcacttttatgtgcaaaggttttaagtataataattaaaatagtacttgtttactcagttaccgaaaagtagctttcagtgatttgcatctgtttacttattcatgagcatcttctatgtactgggcacagttctaggtactggggcctcccgcagaataaaacagaagtctttgtccttgtttctgctatgggagacagacgaacaagttcaacggtggcaggtgcttttgaaaaacagtgcagaggagtagggactttggtggttgcaatatgaaataggtagagagggaagtgccttattgacaagatgacaagatcttttaatatgtactggattaagaagttagcctcattgagtcgtatgctaatgaactgcccagaaaagaagggtggaggagatgggagtgcagcagtaaagactgctgcgccccaagtaaaatgtagtgttttggttaaggaaaggaaatcattttttgctttcttcttgaaaccccagggcttggcaccgcagaagtctctgaagagacagtctgctgctgtttggaggcaggtatttcagtagatcttgtaaccaaacatgaatgactaaggcagtgtttctcctctgtgtcttcagaaactgcttgagatgtgtgcatgcagtcccgggcaccatgcgtgctgggtactggtaacacagagacaagttgtcatttggtagcagtgagttaagcaaagatttcttggcaaccagtctcatcccgagtctgttgctgggccttgggacttctgtattgagcaagtagacagggtccctgccctcgtggaacttgttctttagtgggcaaacatgtattattcattgcttttttttttttttttttttgaggtggagtctcgctctgatgcccaggctggagtgcagtggcgcgatctcggctcactgcagcctctgcctcccaggttcaagcaattctcctgtctcagcctcccaagtagctgggattacaggtgctcaccaccacgcctgggtaatttttgtatctttttagtagagacgggtttcaccatattggtcaggctggtctcgaactcctgacctcaggtggtctgcccacctgggcctctcaaagtgctgggattacaggcgtgagccaccgtgcccagcctattcattgcttttaaacattatcatgggcctggcatggtggctcacgcctgtaatcacagcactttgggggaagctgaggtgggcagatcacctgagggtcaggagtttgagaccctctcccgccttgggtgacagagcgagactccacctcaaaaaacaacaacaacaacaaaaaacccagaacattatcatggaaagtttaacaacatgattaacttctgatcctggagagtggtaatgatagactggatcaggagtctactggcctgggcaatagaaatgaaatctggactgtcttagggcttcgtataatcaccagcttttgtgggtggggatgttggggtgtcctacaggggtatcttgattccttctgagaacagatcatttctttgtcctttctgatgtcctaatctaaaacatccagtactcctggaggatttgaacttgtgcccaatggctggtcagactctcttggattgagaatgttggattgccattcctcagactgaatgtgggccaagcaattgtgctttagaaatttatcttagagtctgggtgcggtggctcatacctgtaatcccagcactttgggaggttgaggcaggtggatcacctgaggttgggagttcgagaccaagtctggccaacatggtgaaaccctgtctctactaaaaatacaaaaaaaaaaaaaattagctgggcatggtggtgggcacctgtaactccagctacttgggaggctgaggcaggagaaactgggaggtggaggttgcagtgagccgagatcgcgccactgcacgccagcctgggcaacaagtgcgaaactctatctcaaaaaaaaaaaaaaaaaatttactaccatccctaattttgtaggatatataggatttgtaaggaaattataaggagtcttgtgaaaacattaattacatttgaattaattttaatccttcagttatctcccataaagacattgaggacctttgagtttattaagacagagtaaatatataaaagttttggggagtacgactacactctctagctttgtctctcaaacatggcccaatttttttttcctttcttttttttttttttgagacagggtctggctctgtcgcccagactggagtctagtggggcaatcttggctcactacaacctccgccccccaggttcaagcagttctcctgcctcagcctcctgagtagctgggaccccaggcgtgtgccaccatgcccagctgatttttgtatttttaatggagatggaatttcaccacgttggccaggctgacctcgaactcccgacctcatgtgatccgcccgccttggtctcccaaagtgctgggattacaggcgtgagccaccgtgcctggccatggcccaattttatagttactctagctatggagtagatgttttcagttcaaaattaggaatttaaggttatattttgttacaaaaatctttaaaaatttcataagaaaacagttgtttggggtacaaagaaattaatccataaataggattgttacagtgactaatataaataaaagaacatttgtgtaatcatgggaattattttattttatttttcctcgacccaattaactgggtgaaaatttgcttgccagttcagatttagaattgtagacacagttaaagtttttgaccttgggagggaacctgaactttagaaaacttacaacattcttttgcctggtatccctttcataatttaacttgattgtcttttatttatttttagttattatttattaacacaaaattatatttatgatgtataatgcgatgttttgaagtactatacattgtggaatggctaagtcaagttaattcacattaggtggtatactgattctgacaagaacacttaacatctactctcagcaatttttcaattatgtgatacattgttgttaactatagtcaccaggttgtatagatcccttgattgccttttaaaagtgagagaaccttctggatgagtcttcgggctgtggttttataagactagtattaaactgaacataacatttaaaacaaacagatatttattttcctcaaacctgtatatttgatagttccttataactttctgttttaagggtgatagggattgataaacaaaaataatttgtggtgctgaaacttgactgaactctagcttgtttataataccacctctctacattgtctttccttattcaggttgagcactcctgatcccaaaatcaaaaatccaaatgctccaaattctgaaactccgttagtgttgacattaatgttacaagtggaaaatttcacacctgacttcacgtgatggatcacagttaaaactttgtttcatgcacaaaattatttaaaatattgtataaaattaccttcagtctatgtgaataagatgtgtgggaaacgtgaatgaatttcatgtttagatttgggtcccatccccaagatacctgatcatgtttatacaaatattctaaaatctgaaacacttctggtcccaagcatttcagataagagatactcaacctgtataaagggtgcagtgtttaaagtaacttgatttgttggtttcatatcaaggaatagatgtagtctatatgcatggcagttacaaaagtgaaaagagacctggcctgttatgtactaggaaatttgtctccattaacagtttctcaggtagccactgtcttctagtttgtggatgatgaaactgaggtccagaggaaggttatgcagaagagcatgagtgggaatgagtatggggaagtagacagggcctgaattggtaggaatgtgtattctgcagaaggtgacgggggaccattgaagtgtgtttgttagttttttgtttgtttgttttttgagacagagtttcgctcttgttgcccaggctggagtgcaatggcgagatctcggctcactgcaacttccgcctcctgggttcaagagattctcctgcctcagcctcctgagtagctgagattacaggcatgtgccaccatgcccggctaattttgtattcttagtagagacgggtttctccgtgttggtcaggctggtctcgaactcctgacctcagatgatccgctcgcctcggcctcccaaagtactgggattacaggtgggagccaccacacctggcctttgttaaagggtttttaaatcttcactgactagggctgggtttgggttgctgctgtggtcgtggtggtgagcatagccagccattgtagggtttgttgccttttttttttttttttttttgaggcagggtcttgctctgttgtccaggctggagttcagtggcgcagtgatagctcactgcagccgccaggcctccaactcctgggcttgagtgttgcttctgtctcagccactcaagtagctgggaccagaggcatcaaccactgtgtccagcctcatttttttttttttctttttgttttgagacagtctcactctgtctcccaggcgggagtgcagtggtgttatttcagcttactgcaacctctgcctcctgtgctcaagcgattctcctcctgcctcagcctcctgaattgggactacaggttcacaccaccatgcctggctaattttgttttttttgttgtttttgtagagacgaggtttccccatgttgcccaggctggtctgaaactcctgagcttcaggtgatctgtgataggggtaggatttgaaaccaggctgttcagtgtgtgtctgtcttgttctaggcattgagttctgggttggttggttctttagtcaaaattattttcttttttattgtgtaaattcattattttttttctatccttgatttagcacttttttttttttccagaataccgtgttgggtttaacttaactgccttgtcatcttgttaacaaaaattgtattaaacagcacatgccgggctgggcatggtgcctctgtcctataatcccagcactttgagaggctaaggtgggaggatcacttgaggctaggagtttgagactgcagtgagctatgatcctgccactgcactctagcctgggtaacagagtgagactgtgtgtctctttaaaaaagcacagccttcacttaaatgaaaattgagtgaatcattttatcaatggactctgttaagttgcaacaggtaccattccatgggaaggtgaacctctttggctcatgtcctaacacaggtggtttatgctttcaacagatatttattatgccaggaactgttaggggctctggggctgcatagtgaacagcatcaaaagggagtattgtcacactccatttgtagacaaaatggatttcttggagatgctgctgaacagtaggatttcaaccctgactaagctgttgcttgtcacttgttccaatagcagcaacaggttttttgttttttgtttttttttgagatggagtcttgctgtgttgcccaggctggagtgcagtggtgcaatctttgctcactgcaaactccgcctcctgggttcaagcagttctcctgcttcagcctcccagttgctgggattacaggcgagtgccaccatgcccagctaatttttgtatttttagtagagacggggttttaccatgttggccaggctggtcttgaactcctcacgtcgtgatctgcccgccttggcctcccaaagtgctgggattacaggtgttagcccccaggcccagcctagcagcaacagaatctttaatgagcaagtagaaacagccagaagtgaagtggtgttggtactagggaaaggttagaaggagtcagatttgaaacacgaatgcatgttttactagccgtgtgactttcaatttggcacctcacctttccaagcctcagcttcttttcgtgtaaactgaggatagtccctccctagtggagtttctcttggtattaaatgtatgaagtgcctgacatgtaggtcccttgctagtataggaggtgctggaaatgaagtatgtgtctttacgaggtgttactgatagggtgatgacaacaagaatctgtccattaaactgacagtgttagatgtttccaggttagtaggcttctttcagcaattagtgtgtatgtgtggggtaaggaaggtgctatgagatacatttcttaggcaatagagagcttcaattaagtagccaaattacagttgatgttattgtgtaactattttggcagtatgtatcagaatccattcatgctctttgacccagaaatgctactgtagcggtcctgctattgccatatcaattaaggataactgggagtgggaagccatataagccaagatgttcatagagacattatcaaaggtatataacagaaaaaaacacctcattctttaacagctggtaagtggtgttttagctcttagaatgttgtccttaaacaattgttatgaagtctgactgtctcacaccttgcatttagaatatgtgagaagggaactaacctcaggaatactgtgattgcagcaaacatggtggaggagcgtgagtgggaatgagtgtggggaggtagacagggcctgaatcagtaggaatgtgtattctgcagaaggtgacgggggaccattgaagggtgttttgtttgtttttgagacggagttttgctcttgttgcccaggctggagtgcagtggcttgatcttggctcacggcaacctctgcctcctgtattcaagcgattctcctgcctcagcctcccgagtagctgggattacaggcatgtgccaccacgcccggctaattttgtatttttagtagagacgggtttctccatgttggtcaggctggtctcgaactccccacttcaggtgatccgcccacctcagcctccgaaagtgctgggattacaggtgtgagctaccacacctggcctccgttaaagggtttttaaatcttcactgactagggctgggtttgggttgctgctgtggtcatggtggtgagcatagccagccattgtagggtttattgcctttttttttttttttttttttttttttttttttttgagacagggtacttgctctgttgtccaggctggagttcagtggcgcagtcataggtcactgcagccgccaggcctccaactcctgggctcgagtgttgcttctgtctcagcctctcaagtagctgcgaccagaggtatcaaccgctgtgtccagcctcatttttttttttttctttttgttttgagacagtctgactgtgtcttccaggcgggagtgcagtggtgttatttcagcttactgcaacctctgcctcctgtgctcgagcgattctcctgcctcagcctcctgagtagctgggactacaggttcacaccaccacgcctggctaattttgtttgtttgtttgtttttgtagagacgaggtttccccatgttgcccaggctggtctgaaactcctgagcttcaactaatctgcccactttggcctcccaaagtgctgggattataggcatgaaccactgtgcctgctgcattttttttttctttttggttttcatcttcttcattaaaacataatttattttttttgaaaaagacaatgtgtaatatttgttgtattttgaatcttaaaaatagcacgttttatttctaaacaataaaaattttaaaaaagtagttgagttaaatacaggacagtcatagatcataattagaactgtttttgttaaatatagaggggtttttttgttgttggttttaccctaaagctatgtgattcagtggtttgggctttgctcaggtactgaagaatgaacattggccagttttcagctggaacaaccgtttagcgaggccctcaggtgtatttcccacatctgagtttaaggaacttcgtaaccacacctgtattattttacatttaaggacctttttaagctgtgcatttagctgttactttaaatgcatttagattagattttgaaattgtataggccaggcgtgttgactcacacctgtaatcccaacactttggtaggctgaggtgggaggatctcttgaggccaggagtttgggactcagcctgggcaacttagccagaccctatctctacaaaaaataaaattagctgggcatggtggcctgcgcctgttgtcccagctactcaggaggctgagatgggaggattgcttgagcccagtaagttgaggctgcagtgagccaggattgcatcactacactgcagccttggtgactgagatcctgtctcaaaaaaaatgataacttttttttagttttattaatatcaagttcttctatttaagaagtaaatgccctagaacacacccttaatattcagttacaatgtcatctaattctaccaatatagaaataatcatctttaaaagtggaataatactgagtatattacacaaggtttttacacaagcaatacatcctcagtgtagaagtaatggaagatacggaataaacaaatgcaattagaaaataatcccataagttaatttgaaagtgtaaacaccagtaaatgctttgacttactctaaaatggttgggctatcattaatgtatgtttgtgttgccgaatgtattataaaaaataaggcaaattagaattaatgttattctgaagtctggttattttagtgccaataagataattttattttattttatttttttttttagatggagtttcactcttgttgcccaggctggagtgcagtggcatgatctccgctcgctgcaacctccgcctcctgggttcaagtgattcttctgcctcagcctcctgagtagcggggattacaggcgtgcaccaccacgctcagctaattttgtatttttagtagagatggggtttcaccatgttggtcaggccggtctcgaactcctgagctcaagtgacccacccacctcggcctcccaaagtgcttggattacaggcgtgaaccaccgcgccaggccgagaaatttttttatgagtaaagtttgtgtgtgatgaaatgcacagatctgaagtgtatagtttaataagctttaacaagtgtatatactcaggtaacctcagtcaagatctagaacattttcatcactctagaaagttccctcctgtcccttctagtggactccatcccacagataaccgttgtttaaaaagtatattgaacaaacatttttgcttatgaatataattattacaactctttttaatttataggggataaaaacattcagatggcagatcacaggtaagccaaagtggactttgtttattggagtttaaaattcagttggtgagcaacagccaagccatttttcaataaataattagaatcaaagttaaatgcatttcagcgtctagctgatggctcatttcttgtgtatgtatttgagcacgtaaagaaattacttccgacatgaacagtgcctcagacattgacactacagatcttttatggaaagcaatcgttttgctctccatgctttaacacccctggggtgaagtcaggtaattttgacactctcctaacagtctgtagttgtcagtgatcaagtggaagattttgttttgtggattgagggttacttttagttgtgtatattatttgatgtttattttttgtgagggaggtgtgtccaggcatctttaaaaactgtttcatggctcattttacacttgttgtggctaattttacaaagccactttgggcactgtcttaacttggtaagactgccttgctctgatcacatgagcagctgaccaaacagtaacatgttcgttggttgatgggtttggtttgagggctgggagcagattttttgaggaaagaagctgtagaaatgagagctaagaagctttggctaaggttggaaataagaactttgtagggctttatgtttgggagaggagaggggatgttacgtagtagaatatttttatagcagagaggacagcctctgagataacatgcacattggtagttttcttctgcccaaatctgacgtcactgtacagatacctcttaatatattgaataagaaacatgtccatttgtgctatgtctttggaactttctttacagtaatactttttaaacatactgttgttttagtttttcagatggggttccttcagattccgtggaagctgctaaaaatgcaagtaacacaggtcagtacactgcacatggagagtttgcatccagtatggggaacgttcctctctctggaaacatttattaatgcaagtaaaggattcctgtactgcagtggttttaggaaagctagagtaattaaaatgaaaaatcagtatctcattaacaaaagatgtatttattataggaattcagactctacagtagtaaagagagtaatagtacagtctaccttcttgtagctaccatcagtgagctttagtattgattaacaaatgaccagtcttttttcttatttttgagatggagccttgctgtgttacccaggctggtcttggactcctgggctcaagcagtttcctgccgcagcctcccaggtagttggggctacaggcacagaccactgctcctggccatttttttttttttttttttaagtctataccctttactttccttcctttggaaagcaaatcctaagaatgtcattttgttcataaattcacagatgtgatatttttccaccattaaaaaaaactatatctgtactccccactccctccaaactgtttgaaagcaagtggtggatatctattttcctaaaacaattctacaatgtcattaccaagaaacttaacactggagcaataccattctctaatagacagtcatgctcctgtttccctggttttctcagcaatttttaccccacgcccgaatctagcacctattcaaggatcatgcgttttgttttgttctagagtcatctccctaccttttgcatcttttattaatacatcaacatatcagcgctctgggccactgttgtcttatagaatgctcacagtctggatttgcccagtcgtttcttcctgatgagattcagggtaaacattttggcaagaagggcacacaggtaacatgatgcagtggtcgttggttccggaggcacagggtgttggctcggcacctgcccaaggacactgagattgatgattaagacagtgcctgccagacttctctgttaccaaggtcctttcaccttggaagcaatctgtcaggcacgtgtaaatatcctcttcctcttcagcaaactttcacacggaggttttagcacccattcatatgtgtttgtatatgcatgtagtatttatatactacacatgtgtacacagttttatatatacaaattacgtaccttaaatacacttcatgtgcttcatgttagtggttgtgtttgcagttctattatgaatgtttaaaattgagtgcctgcttggtgtgtttgacttacccacatcatgggagaatactcgggatgggagaatactcgggatgggagaatactcgggtatgtactggctctaagcaagggaagggcgctgggtttggatttctgtattgtgtcattaagagggagattgttaagagtctgtgtcatgagccagatgtctgccacttcatagtcacaactgggtaaaaggacagtcactaccttgtcaggatctcattcattggtttattgggaaatgggcttataaatacaaacagcttggtattgtgagctcactacacatgtaggttagccctaagtggggtggaatggtcagaagtgcttcctggagggaggtgggtttgggcagaaggacattcaaggcagaggcgagtagcacatgcaaagaaaacttagggaacagtgctggcagagagctagtgagccttgggctctcctggactgtgaagtctatggcaccacagtgagcaagggagctagtggatgctcttttactttgaggaactgatctcatctctgttcgtggcttctggacaccaccatgggacttgggggtagaccatgtgaacttacattaatgatgtcctcagttgtttaagtctggtgcttaaacagccacagtcctggtgagagccaggactctctaggtgtttattcagtaaatttgtaactacccatcaggtgattaacccagagtgttaaatgctcttaaaataaattttaattattttcaaaacatgtttaagaagtcactggtgtatgtatttagaaattagtagatgtaaatctaggcaaagctaagtagatatgttactaatttttgactcttggctattgtgtgtggtgggcatattttaaatatgtttggtcttaactcttcatagaaaagctcacagatcaggtgatgcagaatcctcgagttctggcagctttacaggagcgacttgacaatgtccctcacaccccttccagctacatcgaaacgtaagtgtgctgtgaatagggtctcatgcaatttggagaaacaaaaggaaaataaaggaaaaaccacttttcagttccccagaacaggattaaatgtttttttcgttccaagacattgtctatgagagacaggcactgggatatgagaggagtgaccctacccggtgcctaggctgagagtttgcctggtggatggagtagcgtgacctgtcagttctgataggaagtgcacagtgccatcctgtggagggctagaggacttcacagatcatctgagttggagaggacagctggtggctcctaagttaaactaagagaaccactccttcctgacttacccacatgagcctgtgacaccaacaccttaaaaaaaaaaaactgggcatagtgccgcatgcctatgagttttcactaccctccagcctgggtgacagtgagactgtctttaagaaaaaaaaaaagatggggtctcactgtatttcctaggctggttttgaactcatggcctcaattggttctcccgcctcagcctctcaaaatgctgggataacgggtgagctaccgcgcctggctgacacctttgctttcttaagagaggcctatgtgctagatgtattgcactatgaaaatgataagggtggtgatcctagaatcctaggatggctcttgtcaggacctctcttacttctggaaggaatttttggtttttgagttggagtctcactgttgttcaggctggagtgcagtggcatgtaatagttcattgtaaccttgaactcctgagctcaagtaatccttctacctcagcctccagagtagttggaactataggcatgcaccaccatgcatggcaatttttttttttttttttttaaagggatgagctgttactgggcttccatctataattgggtcagggcttggtctcccaggaggccccaccttccagctggtttccccagtcaggactgccagggctattacgacaagaaggggacatttattttttatttttattttttgagacagactcttgctctgtcatccaggctggagtgcaacttccgcctcccgggttcaagtgattctcctgcctcagcctcctgagtagctggaattgcaggtgcacgccaccactcccggctagttttttgtagttttatttatttcactgtacgttctggagtagatgtgctgagtgttcaggtttgttacataggtatacatgtgccatggtgatttgctgcacgtgtttttttgtttgttttgttttgttttgtttttgtatttttagtagagacagggatttgccatgttggccaggctgatctccagctcctgacctcaggtgatctgcccaccttggcctcccaaagtgctgggattataggcatgagccactgcgcctggcctagaaggtgacattcagagtttgctttgcccatttagaagcttctcagagattacttagtgggcaaggtgttttgatgttattttttttgcagactagattgatgggatggggtgatactgagtgggagtggcaagaatgagaatgagtaatggtttctagttttctcgctttagaaactgggttggtggggtggcattctgtgagaggaactgcttgagtgggatcaggtttatgtgggactagaagtggttccatattagccatattgcaggaaaagtgccggcagagggctgggtgtagttggtgtgaatgattgaaggactgttgggggcacactagggtccagtttgtttaacatcctttgtctaaatgacgagttaatgggtgcagcacaccaacatggcacatgcatacgtatgtaacaaacctgcacgttgtgcatttgtaccctaaaacttaaagtataattaaaaaaaaaaatcctttgtcattttacttcagttggaaagcttcaaaaattaaactaatttaaaattgtataattagccaggcatggtagctcacacctgtaatcctagcactttgggaggccgaggcaggcagattgcttgagctcaggagttcgagaccagcctgggcaacatggtcaaacccctactctacaggatgcaaaaaaattagctgggcatggtgatgtgcccctgtagtccaactattcaggatgctgaggtgggagtatcatttgagcccagaaagttgaggctacagtgagccgagatcgcaccagtgcactgcagcctgggcaacagagtgagatcctgtcacaataaatgaatgaatgaatgaccagtgcagaaaaggggtaaaaatggcagtgggagtctaccattttgttaaattctttctgcttttccctttttttcatctactactagcagtagttctagaatgttaagcattatttgagagtctttgcttaaactaaggacctttagcttgaggtagctgtggttgtatttcacccaggagagtggtcctttgggatgcaaggcagttgttctaatacctcccagaccagtgatatgtgtgtgtgacttgcctactgctctgtgctgtctgttgttggagggtaagtcaagtgcttagacttgaagactctgattgtgtgaatgagtattcaagatgcaggacccagggccctgccccaggtagattatttgggtctatgatgaggccaggaatctgctgttcagtccacatgattgtgaccaggggcttcgttttgaacaaatagttttgatgggttaaacaaggatttttcttctgatttataaaagttatacataacaactattttttaaaacatagaacagaattgaaaggcaaactcatagttgacctgactctccaggacaaagttgtgttgcctgtggtctgtgtttctcagattttttcctccagtgtgttaacaagtgtggattcccacgtggcactaaatattcctggacagtgtgattatgaataggccatatttgaatgctgttgcacttgcattgtccagtttttcacttgtacagatctatcgacggacactccagcataaatacttgattaggataaatttttttttttccttttggtaagatagggtcttgctctgtttcccaggctggagtgcagtagcgcaatcatagctccctgctgccttgacctcacagactcaagtgatcctcccacctcagcctcctgagtagctgggactacaggcgcacaccatcatgcctggctaattttttaaaatttttttgtagagagaggtcttgctgtattgctcaggctggtcttggagtcctgccctcaagcaatcctaccttggcctcccagagtggtgggattacaggcataagccactgcgcccagccttaaggataaattcttagaaatagaattactgggtccaaagaacattttcaatatttctgcccttcagaaagatgagtcagttagagggcttcttggcccttagcctcgtaaaacctgggtgttttgttttggtttttaattgccaatttggtaaggaaaagctgagtgttcttaaatgtttgcattcttttggatattttatgaaattgaatctttcttcatgtttgacaatttgtgttttttcttttgtgaattattttttctgcttcctcctgtatcctttttttcctgttggggtattgtccttttcttaatttttaagaggtcttgttcatagtaaggatgttgattccatgttaacctaaatttattttaataaaattgaaaagcatgctgctttattttgcaggcatgaggatgttgtatttcttactcccttttttagtttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaaggtagggagctctgttaatttaatatacagatagttttcagcttacgaaggtgttaggttccgataaacccattataagttgacaacatctagggtaagaacgcatctaacctgccaaacatagcttagtctagactaccttaaacaagctcagaacgctaacattagcctgcagtcaggcaaaatcatcttccacaaagcctattttataataaagtgctgagtatctcgcgtaatgtattgaaccctacacagagagaggaacacagtgtggctgtattggtgcccaaagtgtgatggcttctgcaccatcaggaagttgaaaatctttagctgaaccattggaaatcggggactgtctttattttacatctttaggtgaaacatccaggtttacccagggaatcatttaatatttttctttgaaccctaaaatttagaatcttaaaataagttataaaaatatccagttttcaaagtcttttagtagacattatttataaatttaactcttgagttcctaagtaagctaataacataattctaataaggtctcatttttatgtagagaagagaatttatcaccggcgatgttgaaccaacagatgcggaatcggaatggcacagtgaaaatgaagaggaagagaaattggctgtaagtctttagaaacatgtgactcatgttctgttttaatactgttaaaaataagcattttttaatgatttttaatgactagtaaacttatgtgcttctaacagtaggtgctgctgcatcattaggttgggtttagattcctttctgatatggatctagcatctgacacagtactgtcagttaataggagtaagatgtagtgccacctcagttatctgtggacaggagcatattgaaataagggatcagaccaacaaagattaaaacatcagagaaagcaaagatgaagaagagatgcccctgtgttctcagtcactggaagattgggggagttgtgaggggagtgccttcctgctcagtggcatggactagcttgccccctgagaggtgctccgccagtggattggttgcagatggtggttgtggtgtggccatcagtcacctgctcacagcctttttctagtgactggtcccattccagtgctgtgaaaactcccagtgtaccatggattaactttgtcagcctgattttatgtttgggagacaagtaacttttatcctataactaactttttgcagttttttttttttgggggggggtggtatatgatgattttggtagccatatgtgtttttgatgctttaaaaatatatagaacctggcctaattgaagccatggctgtggattaatacagttgtgaatcagtttctaacagctcaagggaaatctgcctttgctgatttaaaaggcctttcatttcaagatcatttcatcataacaatcccgtttggcaaggcattcagaatttcccatagttgcatctggtgttgcgtttcacctcccttggtctaccttttccctggggcctgactccccttccttttgccatgtggcctttctggtcactttctgatgcttgcgtggtgtctgagctggcatttatagccacttccttacaagctggataagttgctgagcactttcttgctgcagatactgctgcggcaaatttttttttttttatttcaacttagcaccccacaaattttaacaagaggtcagattattagtccaagtgaacttctttatccttgcactggactttttttgcccagtgctagatgttctgcatatttgcattgcatctccttaaggttgatgtacagtctttgcatctgcatttgtgatgatgattgtctcaggatggcacctcacagagctagcactggatggcctttcccagcgtcggtggcactttgtcatctctttagtttcttcgcctttgatgtgaaatggtacggaattccgtgtggatgtaatgacttgaatgctttttcctcagaagcatctgaaaagtgtcgcgtggcccagtgagtggtttggaggtgcagacttagaaagcaaggtgtttgatgggagatagtagaggattcggcaacgatattctacgtgaagcccctgcattgtttgtaaacttttattttcgttacctatgttgcatcttttttttagggagacatgaaaagtaaagtagtcgtcacagaaaaagcagcggcaacggctgaagagccagatcccaaaggaattccagagttctggtttaccatcttcagaaatgtggacatgctgagtgaattagtccaggtaagcacacttctgtcttgtagagagattatgtgctagtcttctaacattacttatctatggcattttttaagcactacactgggcattgaaagattgttcatagtgggcggaagggcactttctctgaccaggacctcagatgagcagtcctgatctcacagtgaatggtttattcacagtggggcttccatgctgtcttttgcagttcttggtggaaagctgggcgcttcagcctgatccaaaactttcaaatcagttccttttacctcttgtaaagctctgttgtcttgcctgtgggaaagcctatgaatagattccagagcccatctctgtcttactgtggtgtgagtgtgcaggaaagggtgagggcaggagaccagagcagaatgaattttgaagggatgagctgtgtgtttgtttgtgtgtgtgtgtgtacacacacatctcagtgaatttttgaacaagttgctaatattttctgatcatttctcttgaaaaagtgtttattttttttaaaaaaagaggccaggcatggtggctcatgtctgtagtcccagcactttgggaggtcaaggtaggcagatcgtttgagaccagcctgggcagcatcgcgaaatcccatctctacaaaaaatagaaaagttagctgggcgttgtggtgtgcgcctgtggtcccaggtacttgggaggctgaggcaggaggatcacctgagccgaggaggttgaggctgtggtgagctgtgatcacggtgctgcactccatcctggtgggtgacagagaccctgtctccaaaaaaaaaaaaaaacaaaaaacaacacaacaacaaaacccaaccaccatttctgattttgtcttgccttgacatttcactttctgtagtgaaatggtgaacaaattaaaaggtaacaaatttggttttccctgaaatgagttataatagaagtttctagaacagagaaacaaatcttgccttaagtctcactgactgacttgctgtcagtttttattgctccagcgtccccagaaacagcacgtctgcattcagacttgctcaggacagctgcaggctctgcttgtgtgggcagagtgcttctcccatcacagagcataggcactgtgcgttgcaaactgctacattgtaatttgcacaggattttacagctacggtttttaatggttttcacaaatgtatcacattgctgcctctgctacctcccttgtttaatgcttgtcctgtgtcctaagccaaaacttgagaaaagatggaaagaatgatgtatttcttattctccttccagaccagaaagcatctaaaatagaacagccttggtttttcctgatctgagcttccttttcatatgaaaaggtggaatttaagaagactagaccatacttttaaaagaatgccatgcaccagaatttcattggaaaaattaagtaatgtctaccagagccgtagtctcaccctgtgtattacaatcacctgagcagctttgaaaactaaatagcaaaaactaaatgcctcatctgtcaccatggcactgagagttttgagttggttttaggaactctaatgtgcaccctgagagttgaaaatctccatggcagggagcaggtggaaagactagctcttagttcgttcttctcagacttcggggggcatggggagtggccatggcagtgcggattctggttctgtggggctgtctggctcatgggccctggggtgattcttgcactgcagggttggagcatcttcacgtgggattgggggtgcagtgataacagggtttgggagctagagttaggtgacttgagtgagttttggtgtccccttctgtgcgtgtggccacctggttatggcattggggtcactggccatggatagtgctgccttgggttttgagagcacagtgaggcatttggccacattttaaatggggtgtcccttctcattctcccagcacctctgtagtagtgtcagtgcttcagcatttcagccatgaagtgtcttttgttgctttttgttttaacagctttaaaaagatatgcaggggttgatagagtactcatttaatatgcagagaatgaggaaatgttatttgtactgtttgtaacctcatagcaggtaatggtagcatattctattttgatttttttttttaacaatattttcttttttttttttttttaacggagtctcgctctgtcgcccaggctggagtgcagtggcgtgatcttggctcactgtaagctccacctcctgggttcacgccattctcctgcctcagcctcccgagtagctgggactacaggcatccgccaccacgcctggctaatttttttatttttagtagagacggggtttcactgtgttagccaggatggtctcgatctgctgacctcatcatccgcctgccttggcctcccaaagtgctgggattacaggcgtgagccaccgtgcccggccaacagttgttttttaatgtctggttttgaagtctgccatttctgagagaagccctttcatttttaagggacatggtcttgctatgatgcccagcctagaggtcagtggcttttcataggcacagtcaggacactgctgtctcagtctcctggcctcaaggggtcctctcgagtagctgggactgtagatatgcgccactatgcccagctcattttggtcaaatattaaattccaaaggcggattaactctgagtccctttgttctaaatttggggatagttgaaatatatttctgcaaggagagtggaaaatttgagatggcggctttacgatctgagtgcgatgcctccagtgttgtgcctttgcttcctgagtctgagcgtctgccagtgtggggcattaccttaatatttgccctggacatttaaagttttgacccacagggtacatggctgcttgaggaaattagaacataatggttattttatgaagtttgggaaaacatgagtgggcactgcgtctttgagtgggatgagtttgaagtcccagtgccatctctggaaagcatgctggtggaagtgctcatcttggtgatctagagccagcgcatgcttctgtgggtggcacgcgcagcattggagactgaacatcgcatgcaggtgtggcccatttcacaactgcctttgggttactttttgtctagatacttgcaggtatctttttgttgctgtttttgttttgttttatgtcagaagagttgaaaattaggactcaacggaaaatcaggcacagaaaggggggaaatacctcacgttcacactcatgtgggagctacaaaaacagctcaccgaagcagagaattgttgataaaggctaagagggagagagaggggaggataaatagggagaggtctgttgagaggtctgttatcagatacagagtgactgctagattggaggagtaagttctggtgtgttgtagcactgtagggtgaatgtggctaacgataatttagtgcgtgttttcagaaagctagaggacgggttttgaatgttcaaaaataaatgtttgaggtgatggtcctgatttattacacattgtgtacgtgcatcaaaatgtcactgtgtcccataaatagtacaattattacatacaactaaaaaagagaaaaaatgatttaagaaaaacttaatgcaacttcaagacattttgagattcagtgcccagactttgggggtaaagaagtgactgccatgttacaaatgaagcgcctgctgccagtgcgtgtttctgaggattcaggtcttcccactcctcttctgactttcctcactgggactttctaagctgacaggtattggcaaaatgagtttaaagaaatatcacttgtaaaatgatacagacacagataagaattgtacgctcttccatgatgcccactcttccatggtgcccgcaagttggatctcagacacgctctgtgtaagtgttcttaaagaagtaaccgtgtgtggccgggcgcggtggctcacgcctgtaatcccagcactttgggaggccgaggtgggtggatcacaaggtcaggagatcgagaccatcctggctaacacggtgaaaccccgtctctactaaaaatacaaaaaattagccgggcatggttggcgggtgcctgtagtcccagctgctcgggaggctgaatccgggaggcggagcttgcagtgaccaagatcacaccattgcactccagtctgggcaacagagccagactccgtctcaaaaaaaataaagaagtgactgtgtgtattgtgagttttggatacagtcatgagccacataacacattttggtcacaacagactgcatataggatggcggtcctgtaagattatgataccatattcttactgtaccttctctgtgtttagatacacaaataagtaccatcaccagctgcttccagtattcagtacagtcccatgctgttcaggtttgcagcgtaggagcaatagtggatagtaggctgcactatcgaggtttgtgtaaatatgctctgatgaacacacgccgaattgcctaacaatgtgtttctcaggaggtgcccccattgttaagccatgcacaactttattgccacaggtggggaagctggctgccaaggccgtagccgatctagccttctcttctgacttccaggcttctgctctttctcctcagagaggctgaggaccaacagtcttggttggtagcatttctgatctctgtgtgcagtggcagctggtggcaggaaagcagtgaaggcccttgccccagtattgcaggcaggcgggtgtcagtggcactgccctttgctggcagtggcagccaccgttgctccacactagggaaaggggacaccttggtgctgcttctctatgacagggagttggtgaataagtctgggtttcttcctggtagttattactttgacaaggacagaattccaatagggctagttatgcaacatctgggagcctctgcaaccatgactcttcgggagagatgtgttgtttttttaaaagcctgttggaattttttttctctttttgattaggaatatgatgaaccaatcttgaaacacctgcaggatattaaagtgaaattttctgaccctggacagcctatggtgagtactgacttgaccttctggttggcatcagacagggtcagtccacaaagatggaagaacttggagccaggggcaagaaacccacaaaacccacacccagccactcatctgctgggcagccctgggcgagactgctctccaagagttagactgagtaccgcattgtgtgtttgctccctgagttcgatggggatcccattgcctttctgtgtcatgcttggcactgtagtcgtgagtctgtgctggatgatttgacagtgatgcagaccatgtgatgccccagaccctgcagccaggtgggcaccaatgcaggagtcaggctgcaactcctgggctgtagtggtgctgtccactgtgccaggcctcggtcttgtagtttgtttgtttactctgttgggtggagatgataccattcttttcccaagtgtctctgaagtttgcatgcatctaatgtatatgtttaacgtttaaaaagatgggagctatgtacacataatgatcagcacttattcagaaatctgaacctactaggttttaccctaaaaaaaaaagcgcaaataagactgaaaaatgttttcctgctctttgatttgtcctgaaacacgtctttacaatatgcttgccatggcatatcattgcattagtaatgttagtggcatggatcagcctaccagttggtaagataagcttgactaggtcagcccttacttttatctgaggaaccatatgctcatcttcaaatggccttgccagactgtctcatcccagcctggttctcccagggagcactgttcgtaacccgttagcctggctgtagctaatgggttccattccggtgcaatagcatttccagcgacacatgactgactgactggtggctttcagtttcaggtcttggagacaaatgctgcatgacgggctgtgggttagggatcttgggtgtgggtgatggtggtaggggcctggggccagtcaccagtatcttccttcctccccatctcagcactggggcctgggctaatggatgagggccactaggagtgggatttcttcactgcaagtgctgcaagtaatgcctggggcagcagcaggggtgggcagtggatgtacctgtatctgtctcttctactttttcctgtctgttttccactatggaaggtgacattcaggtgtccctctctaggtggggccctgggagctgggagtgatgcctgctcaccagctgggggctgccctccagaggggataccccatcttccttcccccatgtgggttatagcaggtccttcttcctgggcttgcatcacttctgtttagactttatcacagggcccccaggagccgcctgggcacgtctgcctagtttgccctcgttggtgtgcattctcttccccatggtgtgagcgtgcggtgctttaagtttctgtgcgttttttctttgtacttctttcttacctgtgattcatccagacgcaattaactttttttcccttttgggtcagttccttttttttttcctttcttttttctccttttcttttcttccttttttttcttttttcttttttttttttttttgagaccgagtctcactgtgtcaccaggctggagtgcagtgatatgatctcggctcactgcaacctctgcctcctggattcaagcgattctcctgcctcagcctcccgagtagctgggactacaggcacgcaccaccacgcccagctaatttttgtatttttagtagagacgtggtttcaccatgttggccaggatggtctcaatctcttgacctcgtgatccacccgcctcagccttccaaagtgctgggattacaggcatgagccaccacacccggcctctttttttcttattggacacctgtttgatgatttcctaggtcaattttctttctttcttagcctgtcatcttatttttctccatctcattgtgactcatagactagagctctggttatggtagactgtggaccagtaatttttttttttctttttacttccctattataaaagtcatatgtagaaaatacaggcaagtgtaaagaacactatacaaatctgtcttctaaaagtaaatctcagcagcttagtgaatttccccatactctttttcctttgtaaaattattatgaagcgtctaatgcattttaagttataaagataaatgaaacttcaaaatgagtcttgactggtgtttttgcagcatgcctcattcccttcccttgagcgcttgcctacctggatacacagtgcacacgtgtgccacacggctcctgccacaccacatggtgtgtgcacagtgtcaccctgctgccacatcacacaggcttggctgggggaatagttgttactgcagccattggctataaaacagtttaacattcccctacatgcaccacctcccccattgtaaattgttgcattatgatcagcatacttgaacccaaatttgtgttaaattaaatgtttgatggtttccttagtttagattcctttcagtgtacttaccagtcaaagaagatgaagctttagaaggcccaaaggtcgttcagttgggattacagacatgagccactcaggccctgcctaattttgcatttctttagttgcttgtaagattgagcatggttagcatatttatggcttacctggctgtagtgcgtgtgtgaatgaagcagtcttattttcaagccacttttcatttgggcagctaaacagtttcttgaatcatcttcagttgtctttgggttactcttgactgaacaaaggcagaggggagagaaaaaaggaaaataggaagaaacatgaatctatctatagaaaagtaggctgggtgtggtagctcatgcctgtaatcccagcactttaggaggccaaggtgggaggattgcttgaccccaggagttcaagaccagcctgggcaacatagggagaactggtctttaaaagagaaagtaaaaaggaggggaaaaaatgagtaggacatggtgaaggaccacaagtctaatagtactatttgttttattggggccaccccatgccctgggttggttgtccacactgtggtcacagccttaaacagttctggaatcatagcagtctctccattggttggctacttgtcttccctctttatgttggtttttttttttttttttaagccgtggagggttgggagagaaataggcattttatttgatgctgattccctgtagctgcctcttcctttccttgtgatttttgccaggcaggtgactggcctttcgtttgtgtggttcatctgcagtgccctacccgcttcctttgctcttgccaaggccagtggagagctcctagccagatcctgctgtcatcccttctagaaaccgactagactgtctccctgatcctgacttcctaagccctcatgccccgcctcctcctccacctttctttgaaagttgttttttcacttctcctttgtgcaagtggtttgtttgaatgtataaactttttttgctgtatattttttttagtcctcttaatttccccccccgttgatggttttaccattacaatgaaaatggaaacagctgacatttagccagccttgcctataaacgcggctctaagtgatacagattaaccaccaaggcagctcctagagagggagagagttatttccagtgtagagatgaggaaactaaagcacggagacattgagtagcttccgcgagttgcctagcagtgtaggcagagatgggatttgaatccaggctgtctgagcgtagaactggtcttgtaaactgtctataaattgctcaaccaagcgcatcttccatgtttttcttctataaatagggatgaggtcaatgtctttgcacatatcgatgcatccatccaggtatttttctcaaatagaacaaattcctcaaaatagaattactgagtcagggaatatgccttttaatttaattttttttgatattgccaaattgtccttcataaaatctgttgacagtacatgagtgtgctcagtaccccaaaatcctggccgggtctacatatttttgtacattttgccccaaagaaaggcatctcattttggtgttcatgtgttttgttactcgtgagcatgaatgccttgttgctgctgttggttgttctatgcctgcgttcatgtttgcatcctttttcccggtgtgctcacgtctcttccaggtctgtagcgtgctttgtaagtgagggatgagctttctgtccttgtagagatttgtccttttctcccacccacctcccgggagaaaagctgtgggtcactgctttcactgcacagcacagagtagagaccctggcttcccccagcagggtgggggctggggcttaggctgagcggaaaaggacaggaggaggatggactgctggtccccttactttcccctagtcaccttccctccttccaggaagcaagggctgggagcagctaagagaagctaggatttcttaggagagcttgacgcctattggtgaggaggcattggagggggaacatgccccttactcatgaactgaacagatatttcccgccagtccatcgttggtttttttaacctcacgctagtcttttttgcggtggagaagtttttcttgttcatggccctatctgttgagctttcccaaaatagcttctagtaagtgttgtgtactccaagcaatctgtcctcgttatttttctattttaactggtgcttactctgaatttctacttttagtcttttgtgttagagttccactttgaacccaacgactactttaccaactcagtcctgacaaaaacctacaagatgaaatcagaaccagataaggctgatcccttttcctttgaaggtcctgagattgtggactgtgacgggtaagaaaatgtcattctaccttgtttttctgaaacaaaatcaaaagataattttgtaacttgatgggtaagatagaagtaaggaataaagtacagtcttgagtctgcttaaaagcctaaaagcctggtagatgtatatttcaatagtctttcagtttgggaatgctcatagtgcagaacttggagatggcggctgaacctgggaaatgagtcacgtggttgcacatgcaagcctttgggatagtgccctgtttcttcattttaatgaaagtagtggattctctagacatcgtgaattgaagttcttaaaattgaatccatggattaccctcagcaaataaatacttattgaatgaatgagtctgagtccagggctatattgatcagctgattgctttggaaataggtgggggcagcatagctgttgtttgactcactgatttcagtctttataaatcactaaagagagaatttggtttagaattaatttctccaggttgggttgactgagaaatggttttagtcttgacttgaaacaattacgtttatttaccagaagtaaatagtaattgttaattcaggactttattaaaatcctgctagagtaatttagaaagatgattttccagggccaggacatcatgtgagaaaaaggcctggccttaccaagcatgttcttaagcgggcagtattgagatctgccaggtgttgcctgggtctgtggtgattgtgtgttagagagagcgtgctgtgctcagccctcgccagcatccctggggctggagtggtctgcactggccatcagtattcccggtggccacctctttccttttttcagcttgtcgtgctcagttggctgctttgaacagcagcaactcctccttccttgggaaaccgcggacaagttcttgtgcatcatgcagacttgacggggctttgccacagaatatacatttcagagtcctgatgaaatgtcttgggaaaataataccattgttccagaagtctgaagttccagtggtcacacccaagttgaaagaggaccaggctgtttctctttttgccaacctccagatgaacttcatgggccattgtatttggtttgcagattggttttatttcgttttccaggtttggcatagagctgtggtttgcttcctgcatgcatttgtaatggatttttctcatggattgtgtgttcatgacagctgtcttgtcctggtaggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaaggcaagtctgttggttgttaatattcattatgttcttatataaaataattttggtcacctgatagattcctaacacccagagactttagtcctcttttttcaggcaagtgtggtcagtaggggcacattgctgtgtcccaggctgttctgttggtgcgctggcaagtttatcgcggggggcagaggtagctaggacagtaagagtaggattgtcatcttctgcaggaaagggaagagctttactctgcttggctgtagcccaggcaaaaacttgcagttctgttttaagaaaactgaatcgagtatttgcacctgggctgcttcctcacttggacacctggagcacccttctccaccagctggcatttctgccccgctgttgtgtctggttcgcaccccccggggaccactcccagcctcggagagctgctgggtttgctctgcaggtacccgttactgctgtacgctggttctagttgtgctgcttttggatcatctgcttagtcccccttttcttgtaattttttatgcataatttgatagaattttttggaatttatatattgtaagaaacacaagtagttgggactttcatttttgaaaaacatcggcagaatcacagcttggaagctgcttctttttgtttatttatttattttttaaattttcctaagtggtaaaataaagatgagacctttgagctagtaaaggttgaccaattgattttaagagtaaatttcttgggatttttcatataatttcctaatcgtgagaaaatgtgaaggtcaagcaacttgtcagtgttaaaatatccatattctctttagtttccatgaactaaaacataatttgaagtgaagagatgccagcccctgctgcagataatcagtgagtgtttgtttgtatgtggggccacagggcggatctcttctccagtctgagtgattgattttttgattttgtctctgagcttagcacccttatttatcaagctgcccttcagagttcagtccattattttaattgtggtgcctattttctgcaattagactttgaacctagaagatgcaaatacatacggtttggggaatgagagcagtcataaatttagatattacatttcctttttttggaagattccttttagacacttgggttgggcatactggagattgtctgtgaattcagcgtgaagaagggaggctttaatttctggaatcactttgtgtaggaagttctcttaaaactgatttaaaaataatttttaggataaaaatggagttgataatggactcaagggaatttttaagtgtttttttttttagattctaaaacttttagggtatgatggttgcacaactctaaaattaacgtactgaaagtcataaagttgtacatttagagtgtatgccttttaatggtatgtaaatcccatcagtaaagccacttttaaagtaatcaaacacataataccaaatggtaagtgctttgaaaaaaattgaggatggctgcggaataggtaatggggtagtgaaggaacagacaaaatggactcctgtggtgtgaagtgaaggaggcattagctagtgagtccagctcctttgtccttaaaactgcaaagccagtccagaagtatgagtgttcagagtccttgtactattcatgacttgggccagagtgccctggggagcatgctgctccagcatttagacacccagccatgctcctaacccatgtctaaaacccctgggtgatgctggcacaccgaggcttgggaactctgcctcactcatgggtggtgtttacgcacccaacattcatgtctcagcagcaaacagcaagtgctgccagggttgtggtcgcttaatgggaagggagactcagagaggagagcccagtgaagattgaaaaggcaggtatgagactaagcagagtaaacattcaactcctgatgaagctcagggtcttgtagtaaatgtttctaaaatcagggggttggatcttctaccagttgaacgttgcacagcttcattgagtgtggttagaagtccctatctgtcttggtgggcttagctcgtctgagcatcagctttcgctgaggaattgcgccactctacaggggcccctggtgggcattccagcactctccaaacaaacagaaatgcagtttctgtctcgctgatttgcagtgccttagtaacactcacagcttataaggcttaaggactttctctttcctgcaccatcatgtatagttctgcgggacatgagttaagtttccccataaagcacaaatgcactgaatggccacagcctgggggctgtttgccattcctcctgttaatatattaactctctcaaaatgatcttctcaagcttgagtgccagcccatggcacatgatggaggaggagaagggaggggggcatagaggcactcaggccagcttcagaagtggtggatggagcttgcaaagatgtctgtgaggagatgcaaggctttggggatttctgttaaacctcgaggtgagaaatgttacattttatctaccagcacagcttcctcctgtgtgggctttaaaattctgggagttgtcactgtaatttaaatatgttttgtcttttctttttctagcatccggggatggagaatcactggtaagatttgttgttaatagtcttattttcctgttgaagtctctcctgagtgaatgtctacttgtctacttgttaaaaaaagtccagtcctggctgtgtgtggactgggtatgccagtgatcttaatgctttgggaggctgaggtgggaggactgcacgagtccaggagtttgagaccagcctgggcaacatagcacaaccccatctccacaaaaaattaaaaccaaataaattagccagccgaacatggtggttcacgcccgtaataccagcactgtgggaggccaaggtgggtggatcaccagaggtcaggagttcaagaccagtctggtcaacatggtgaaaccccgtttctgcttaaaataccaaaaaaaaaaaaaattagttgggcacggtggcagcgcctgtaatctcagctactcaggaggctcaagcaggagaatcacttgaacccgagaggaggaggttgcagtgagctgagattgcaccaccgtattccattgggcgacagagcaagactccgtctcaaaagataaaataataaattagctggacatggtggtgcactgtgtagttccagggtcgctggggcccaggagcttgaggctggagtgagctgtgattgcaccactgccctccaacctgggtgatagaataagaccctgtctcttaaaaaaaaaaaatccatttctgtttcctaaaactctgggattaatttgaaatcattacacatctaagtaaaagtatgtgtttcatatgttgatttcagtagcaaatgtgcagtgctttaatactgcctgtttcccatatgtgagactgataccgcctactctgggtgagacctttggacaagttgtggagctgtagggccctcacttcccactttctctgccattttgcttcagtagctctttaaagctacttaaagttgttttaaaggggctttgagtgtctagtggctgtcccccagcagtgcaggagtttggtgttttaagttaagtaaatcaaaagtgaggggctgaggtttggctgagggtggtgaagtgaatgtttttatcccattaaaatgagttaacacgtaggtttttcctcctcaggatgaagattctgaattcacattagcctctgattttgaaattggacactttttccgtgagcggatagtcccgcgggctgtgctgtacttcactggggaggccatagaagatgatgacaatgtatgaggctcggggaaggggggcttccacctgggtgcttatctctgttggtgcagagtggccctgaattgtggcttaggaaacccccatgcctaatctttttattacatcatcagccagatatgtagtccaagctgctgtccttgttgtggggggaatacgcttgaagaggagaagtctgaggaacagagcaggaaaagcaggtgtctgtgaagcagtttcagaggtgattgccagtttcctatgtgagccctgcctagtgactcaacaatattctctcaaaacctaagcttcagggaacttgtgaacacagggaatatctcttttatggaggtctggccacaacaaacatttattgacagtggacttatgctagcctgtggttcatcaacccaaaagaaatagaaattcctgaacttctatctaattaggtaaaaaggaaaaaaaagaaacccgtgctcccgaagaaaacaacaagattgcatgtcactttcctttctgggcttgagggaagccagctcttccacagtcagaacttgcgggtgcacagcccaagtaccgcttagaaactcccatcctcaccaaggctcaagcagcttcaagtcttcttgatctgtggaaaataaagttttgttttatagactgttactggaagtatgttctagatgatactctctttcttgtggagctcttaggtttcttttcttagaaggtctggtctgttggggcttcagacagggcggcaagagcttaggtgggttcaagggccttagccccctgtggcagtaaaggccaacatctcctcacacctctcccattgtactgagttccaccagtggggagagtaggccagcgtgctctttatcagctgttaggtcttagactgttcatttaacttctaaaactcaacttgctggctcatccctaggttgggaggtgattgcaggtcagggaacatggacagtcaggtagctgccaagacatagttttacaaattctagaccagcactttccagtagaactttctctgttgatggaactgtcctctgcctgcttggtccagtgcagtaggactgaccacttgaggacttgaaatatggctgctgagactgaagaactgaacatttcatttaccttagtttaaatttaaatagtgagctaagggctagtggctacacattggaaagcttatctgaaactgttttgatcatacacccgtcagtttaaaggacttgaatatgcatgtgtgctatttgcttacttatatgcggtatctgtactgctggtgagcactgtgccacatttgcttatagtacatgtgcgtttcattcacaatacgttcagcacaggtactactgatgagcagtgtcagttagaggctagaagtgccagctcagattagactgctcagactcgcatccccattctccctttagtagctccaccacctccttgagcttcagtttcctcagctgtaagtagagctcatggtaaagactctggttacttgttaagcccttaacatagcacctggcacagagcaatgactcagtaagtgttggcataaaaagtgttttactaatgttactttctagaccgtaccccaacactagaaagttgttggaggaggaggtgaatgtgggaaccctggtcttgtcttctctgcacgtggcagctcctgctctgcccaggtgggtgatgcatctggagcagcccctgtgcacagccccttaagggcaaaatgctgtccttagagccttggaataggccctggagcctgctggaggctcgttggatctgacgtgaaatggaagaatattgagaagcctttccctgcctgatgccagttagggtccttagagcggaagggcgctgcactgtggccacatctcatcctggctgctgcgtggcgccaggaggctgtgcacactgtgtgaactccacaccagcacagtagggcccttctaagttccaccgaagttggctctaagcaatacatggtgtgagctcaacaaaacgggaaatgttgataaatgaagctgcattttcatgcactacccttgttatgcaaccagtagtgataaggtggttttgcttttggtgtaagtctcatgtttgaaacttgatttttagtctgaccaatgatgtatttggatgtaggagaaactgattcaagacaattgactaatggtggaggttcacctttgagcaccttattgatcactttaaagattaaacaccaaagttttaatatatttctactaaggtttcttttccctttgtatgagatgtaaaatgatacccagattcctgtatccaataacattatgctgctggttcgatcagccttgtagaaaatttaaggaaaacaaattcatcggtttacaaaaatcttttcctgtgtgcctgctcctcggtgtgagaacagccagggcagagctgtggtgccaggttcccagctgtgtccagggtacaccctggctgaccagcttcctatcctattccttgttttgtgtgactttcaatttcctggcatgcttttaaaatgcgctgcacacaagcaaatggctcctcaggcaagcgaggcccagcaggcagcgtggctggactttctgctcctcttaggcttggtcagtgagtcacttgatgggactggtgtcttgggcaggctgctgtcatgttttgtaaacctaaaaatgtttttctgtgtttctccagtttgaagaaggtgaagaaggagaagaggaggtaagagacaggtttatgcagtgccacttacctccctgaagttgtttctttggctttctctgcttgaaggttatggactcacagggctgtgttaaacccattttttgtgacgctgtctttgattctaagaatgttcttaaaacactaagcagaaatgcatagcaaatgctgtgacagtttccatcgtttttgaccctgcagttggttcatgaaaatgtatcttagaaaataatcatttaacaaaatctactttttcagaattttgtttctttcagggctctctgtgagaacaaaaagatacctagaaataattctaagtgtccaaaggaagtgatgagtcacttgtgggtagcagtaattgatttccatctaaggcagtgttttgctccttgtgtttgtggattgtgaatgccacaagagtttaaatcttgtcattccagctaattctcactttttaaatacaggaattagaaggtgacgaggagggagaagacgaggatgatgcggaaattaaccccaaggttggtaactttggggccacccagacctacttattatgctgcactcttagacttttaaaaatgttccccactttgaggcagtagtgttaacaatattcattattccctaattagaaagtttaaaatgtgtcagaaaaatagtggaatgattattcagacactgtgtctataatttgagtgttgagtgtacatactcagtagaagcttttccagctgtctcaagctgtgtcttatttacatagactcctcagtagagcaacttgactttccaagtgtttcattcttttaaggtaaggtaatgatttaactgacaacataaataaacttttctttgtgcgtgtttggaaaaggtgcaaagaagggactttggggctctttttgttaaggaacagaataatgggattgtgggcatcatttgacccagttgcacttgagctgagcatgcccagatgatgtgtctagatatctcatatgtctcagataatttaaaataaattggaaaggtttactaaagaaaactgagttgaaaatgagtgggcaaccccattaattttacctgcaaatttagatttttatttgtggtctcagagtaacttaaatcaaggtactttgaccatttggcacattttaaaatcagaagtgcttaaatgtcatcctacagcatcataagagtttcttcttgtaaaacatgaaatgtgtagttcacttgcctcttaaaattaagtatattatgggctgtcagaatactaacgttacctggtgtttttgtaatgtgtctctgtccgactagacgttttttgcttgtttttacccttgttttttggagtgtgcactaaaagctgtcagtgtgatattctggctctgtcatcagttggtttaaactggctgtttccatgaatgcatgttcacagttgtggttccttcaaggaagggatgggagaagagcttttaaaacttttttgagaatgtgtcttataaagactactctgggaataatctgctcatggaaatgttcatcttctaaagtttggcctgttgatgtgggaggactctgctgaaagcgtacctgtgcgcagcaccgtggtggtgggcggtgagggctgtaggagaccaaggcctgggtctgccttgcgtgcatcacagtgtgcggacagggaaggtgagggctgtcagtcagccagtgaacaacgttgggtgaataaatgctgcccatcactgctgtgcggggtgtctgatggacccaagggccacgtgtgtttattgggctgtgtttccgccttgtgggcgctgaatggacacttttaaggttgcagttgtaaagcaaggactggggtcaattggcagggccacctcctcagactccgcgcacagctgcctctgtccttgttgcacttgtatctccccctccctgtattctgtgcctcagcttctcttttcctcccctctgttgtttgttctgctttctctgtcaccttggagaaccttgagtctcctttcacgtcccaggtttctaaaagagcattctcaccagccattacagagaacatgatgtggtggattacacatgctaacaccccatgaaacctttgataaacggttatgttggttgggggagaagggactaaaaacatgttccggctaatggtgtgaatgaagttcagagacggcccggcatgtgtggccaggataaggccaagcctgctgtccctgtcacatgcaccttccagagagatgggcagtgttagagtctgtgcaagcaaaagaaaacaaggaaggaagggaggttttagtattgggagcagtctgatagaagtgaaaatcatgcttctgcccattttgaaagtatgatctagtgttgaagttgttcaccccgagttcagtatcttgcagcccttttgtatcatgagaaattgtggccgtttcctcctgtataattttgtgcatttcattttctttcatgctgacagttcctttcaatttttttccccatttaggtgtaatttttgtctgttaatcattcatacgtttctaggtaaggtggaattccattcatacctaacttccaaacttctgatctatactttatacaatgcattgttttgactttgaataaagagggagttgctgtccaggtacactcactgtgtcacaggtttgacataggtgtctgttacatgtacttttaaaatcaacgaaccaaacctagatttggtccctgctttctgagcccagtgtttcttgctaaccaagtagcaaagatgtaacttgggtgtaattttcattgctgatggtactgctttccagtaagagggccctggatggtcagcagtctgcacggtggcacacacgggccaccataagcaagcagtccttgcagagagcataacacactgggctgtcccagctgtgctcagaacacacactggcagttgaaattggcccactgtcattaccaacacgtgtctgttgaatatctatactttttgaattcatgttttgtgcagaccaataggtacacagaggggtaacagcttttactgtgccagcattttttatctgaaacatgaactggcatctgttttggtgtcagcagtaaaaagtactgttgtgaggttggtgctagttgaatgaagcaagaaccagttgtagatgaaagtgagtgtcagtaagcctggaagctgtttcccactccactttcttcagtccctgtagctctgtcctgtcctggaatgctgacaggaggccgtaagtagacagaggctcttgcccgtgacgagacctgttcactcgtggcactcgggatgtagtgggagaaagcagagaggtggggacaagaggtgccatgaggaaccccacaaccatagcagggcctctgcatgccaggataagtaggcactccgtttttaagggtctcgtcacagaacatcagcatgatcctggcagcccatagaccagacgtccttgaggtcttagcgccaccgcctccctgtcttcctcatgtaggctgctttcatgggaaactgatggtacatagggcggatgcagctcttggaacgattttgttttccagggccaggtttcagaatatggctgtatgtttaaaattatgtctagctgccattaattcctgttgtccccgcatgtctgaagaacttagccactcttattccacctgtaccctcacccactcctcccacgccacccctcccatgccaccagctcttttgaagagaatcctcgatgcgtgccacctatccgtatttcagtatgcctccctggaagagaagggcagggtgcaacagcagcaacccccgaggagtgtcccactgaggctgctgcctcttcagccatagggctctgggcacttggggcttcttcgccagcgcagctatggtcgagtgtgtttcagcggcatgtctttgttgcctttctcaggtcgagtgttatctgttcaaaccccaccttttaaatggtcccatgagagatgagatttttttcctattagttggtaccttttaaaatgccaactcctcctcccttgataatcttagcattgattaatgactcaaccatcattaaaatttgtgacatgagataaaggacgcttcagtttgggagtttaggtgtagttttttttttttcggcatgtgtcacaagctaaaaacaattggtgtctctcacatgtaaaattcacttctaaaactcctgtcagtcacttgcagaagctccagtgtgctgtgtgagcaccaaagcctggcaggggtgggccacatgctgccttccttcccagagggggctgtgccctcaaggcacgggggaggcagctcttcccagagtcaggtgcatggcctactcccctccagcaaggcactgggtcatgacaccggtcttgagagagtgttctatgcggactctattccctctagcagtcttcacccaggatattggttttatttaggacagatgaatactacattctcgtggttgaaaatacctattacatcatttctgcaacttaggataatttagatttatttctggttgagcattccaaatctggaatcctcccgtgagcattttctttgtcttgggttccagattttggagtatctcagatttgggatttgggatgctcaatctgtggtaggataaattataaagtcctgtgtatgacatgacatagtatttgcgtaatttaaatgtacataaagatggagtctgtcaccttgtcaccagccccagtcttccccgtccctgcacagctcctttactgacatcccattttctaggcgagtcccttggtggaggcacactgcttgtcccactcctcccctcactgctcctgctcggggcgccctgcatcccccacactcctaaggccagtggctcagtgttcttggccactacactgggccaccttcagtctacccttgaatgtcagattgacatggcgagggtttttggtcagcctcgttttgtcttggccaggctctttgggcagcctctggggtggctgagattgggagcttagacaccagggttcaaggttattgattttgttttttgcatattttacacatattttttcggccatcccttaaatgtgatttccaaaagaatgaactgtagcctcagcttatactgtggaagatatcatttatggtaacccagggatctttttgccccatacagtacaagttcttaggttccataggcacgctggattaagggcaatttgtaatcttagccagaaatcataggttacaggttcgtaaagttactagcgcagaagcattagcaagatcgtgatgtatttcttaggctattgttggcctccacacaaattcatggagttgctggatgtggtttaaagggtacaagatctctgtgttagataatattggagttaatccattcctctgggaggggaattttgtgtcccggatgccgttactggaaggatagcattgccccttggtgagactgttaggagagtgaaggagagtgagtgacagatggagctcttgggagtggcagctcatcatttgttggtgcagtacaggccaccagaagaggatggatctgccggggcgctccctggtagtacaaagagcaggaacccgctagaggagagatgtgctttccatgagcgccaagggcccagcctacccccagacagatgtgcccttgagaagtggggactgttggcaccaagaggggttgcctccgcggtggccttcctggatggagctgcccgtgttgagcgcactgtgctctgtgtgggcaggggttccagctgcttcccagccctttcatgggcagccccctggagctccaccaccccaaggagccccaaaaccctcctgctgaacatgccatgaatttgaatgcttgaaggcatagctttaaaaacaaaaaaaaaccctgctttgactgcagggtggtagggggagttagctttgtttttgtcactatttttaaaagtatatttgcagtaaccatttttttcaatgagaatgaactcattcagtcttggctttcattgttgattggagctaattggtgaatggagctggctttgctctctacaagccttgtctttttcattgacagaaggaacccagccagccggcggaatgcaagcagcagtaggaagcggaggcgggtgcctggcagaccggctgtcgggactccaggcctgtgggcggggcctcggtccttgccgcagcacaatcccgtggacagagcttactccatctaactcgttttcaagtgcatgattttcactttcacttttcctttttccttattattttgcttaacttgtacagtggcaactgaaatgcatttcagaaataggaggtttcgtccagcaccctctgcagccttggtgcctgtagctctggacttccctgggcctttccctgtgggagggccctgtagaccacatcagggtggggtgggggtcacttggcaaaaagggccgaggtctggtgatgtggttcccaggatctggaacctctcccacccctcctgcagttggactgaattcttccctttcatccgaagaaacccacttgctgtttccagccgctgaatctgctgagtgtgcagcctgcatcacctgctgtatgccgatcatctcagaaagggctgtgtagagtagggccctgttctccttaggatgttgcttcttcatttttttttttttttaggggtgggtcagggttgtgacacaccagcccaggtgagagctgctgcgggtcacctcatatttatttatcccttcttgcctgtgaggactgcggcttttcgctgtggctcgtccttaacgtttctgaaccaccttggtgccctgagcaggaagatgtgccacttcctagcaggcgcaaggcctgtgcggaagaaacgccgctccctgccaccagggctgaagatgcgagcccgtcctcatgacgcaggcgccaccctgctgccggagccgggcttcggcagtcttctccactgagggactgggctgggaagtcctgcgtttcagtggagcgtatgagcgtcaagtcctgctttctcagtagccccattgcggggccccaccattcatcctgtctgaaggtcctgggtttggtgtgaccgcttggcggctggtgggtggggttttcaagtgggtgacggcgctctccggcagccggggatggccgtgtccgcactgaccaggcctgtggagagtgctcggcctaaccttagaacacatttgtaactgaatacagtgttttcaatttgtacagaatagttagaatattctattaaagtggtgaaacattgagtcagcactgtgccatgtgggtctttgcaggggaatgtggtggggaaggctcagatgtgctgcacacctgttgggctctgttgagccctgggtattggtggctccaagaccggttgtacagtttacttctgaggccttgaaagctcagtttgaggcagaggctgctgtagcccccccactacacctaagttgctgctgtatgcaggcagcttcactgcgggcccaggggaagactgttcctgcccccaggaggggatcatttctcagagttagtgggactgtgctttgtagatccagaaggctccaagaggagaacttcctgataaagcccatgttaggtgtgtttgctctctgaagcttttccccgtgtctcttccatccacaatgagaggaggcactcaacacctgctgcaccggcacttcctgacctgaccgtgggaatcccagccttggcagcgccgcctggtgaatgaaacgctgtcatgagaaggcagccgtggagctggctcattgctccccacgtggctggccccgccctgctgcctccagctcacccgtgggctgccttctctctgggagcagcaggaagggcaggtgcaggctgggaagtgaatgcttgcagcatacccccaagggccggggagcctgatgtctgtgcttcctgcacccgttcctccgtccccatcctgtgaagtacctgggggagcttggtctcaggctccccagcctcagggtggccccatgggtgagcagcaccctggccttacttggtctgcccagggtcagaccccataatccaaggggcatatgctgttttgcagtgacccgcccttcagctgcggagacagccctgcacactgccctgtccactgggtgcccagagtgcctttttaggaagggctccacaggcttggggagtgcccctcactacctagctgggtggttttagatcagatttgcacttttcgatcagatttgcacaagcaggggaaagggcttaacattgtggcttctgggggtgggggtatctggattttcccttttgagtaagaagtgtgtgagaaccctgcacccacctgcgtgcatccttcactgagctgggttcctgtgtcccccagtgagtctgaccttgggagtgcatggttcgtggatgctgcccagttccaaggacatctgggtgcaggacctcaacgtgaagcctggggagctgtggaggcccgagggtgcaggcaacctggtctcccccaggacctcagcacctccggcctctgtcacccctgcatggccgccgtgtcctgcctgcaccccagggtctcagaaaagggaaggtcattctccagtggccaaggagcccaggaaccatcccaggcccaggccattgtcagctcaggaacctcagccatcagtggtcaccgaaagtcgctgagtggttgagaggtttgcccagagccaccatctggaaggcagctgggaagtgggggcttgtggcggccgcccagcctggcctgggtgaagggtggctgcttcccttctggtcctggaggccagggggtctgccacagaacctcagctctgctagcccaggccctcctttttcccgactcagcccctggctggggaggcagacattcaccgtccagccccgccccacccaccccaccccgcttggggctcccccagcccctgcccttcctgtgactgttcaccctgtgcgggaactgagactcaaaaccagtggcgctggggtcagggcaggagtttggggagcagcccgggagatgggaggtggggcctggggcacccccaccccctgcacaggtggctcagacgcttctgtcagctgccatcacacgggtgctcctgggcaaggagggaaagaacccgcacggcaagcagccaggcacagaagacctggagggccctgtttctgtccggttctagagcctgcaaagctatagtgccggtgactgcctgggagggatctggggtggggggattga

SEQ ID NO: 17262 - DNA, 24428 bp, Human
tcctgaacatgcgaacaaaaagaggtttaattggacttacagttccacatggctggggaggcctcagaatcatgacgggaggcaaaaggcacttctttcgtggtggcggcaagagaaaaatgaggaggaagcaaaagtggaaacccctgataaacccatcagatctcgtgagacttattcactaacatgagaatagcatgagaaagacccgcccacatgattcaattacccccttcccccggtccctcccacaacacacgggaattctgggagatacaattcaagttgagatttggctggggacacagccagaccgtatcaactgcgaatatgacagcttttgtgctagttttgggcctaggctcaaaaggtcttaaatgcttctgtgtttcccagaaccttgctatctttatgagatcaagctatcagaaccttgctatctttatgagattagccagctggaggatgacataccatggtggggagaaggaaggtgccactgttgatagccatctcatccccagaagcagagccacctagtcaaccagcagctggccatacatacatgaagcagtccagttgtgacaagaatagctcagttgagttcagcgtgaatggctgatgaactcaatcatgagctattaagttttcagtgatttgttatgcaatagctaactaatacatgcacccagggcagatagggtgccaggattcaatgaaaggttgattcctagttacctgcaagaagaaagcactttacaggtactaattctccccccttatttaaagttggatcttttgtaagataatgttccgtcatacagaaatgcatgtacacatgtatatatgtgattggtgcttttactcacacagccccccaaccacgggaagaaacagacaatcacagcttgatcattagggctaaggccaaatagcaagatgagtctgcctctagtctatttcctccatatctaaatgttggaggtcaaggctgtggacagatctgaagatgtgttctctcctcttagggccccattattgatgggcagcagtcctctacccgtggatattttcttttgctttcccctatgctctctaggatcaccatctcgtccacccttcgaccggaggagagatgtttgtagcaagaggctgttccctcacctctggctgaagagggacattcagaccctccacttcctgacataagggaggttagacctcagagctgcactttagtgtggcagctattgatcatgtgtggctattgaataacaggaatacagctggtctgaactgaaatgtgctgaaaaggtaaaatacagagtgagcttcaaagatttagtaccccaaaatatatacttccttaccaattgtatattgaccatagaggaaaatggttacatactgggttaaattattacaatcaacttcacctgtttcttagtacattttaaaacgtggctactagaaaatttaagattcacacatggctcacattttaattcttagaggcttgaatcctttttgaaatttcaggctgtctgttcaaaggaccaaaagccaggaaggccataaaatataaaaattcaaaatgattgtctttattttcttctttccattagtgaataacatatatttattatttataaatgaacataaccgcagtcacaagatgaaatgtaaatatcctctaggtggggccggacagcgcaggcaggaagccccgctccaaaagatcgcggccagcacctgtccttgctgtctcattcggcccattgtctgattacagctcctgtcactcagggcctgagggggcggggcgtgaggccctatccaatcagaggagtaggggcggggactgtccaatcaggcacatgtctggagaggagaagacggcttccgggatctagcggggcctttgtcccgacagagctccacttcctgtccccgcggctctgtgtcccctgctagccgtaggccgtgtgacccgcaggcaccgggagatccagaagtgaaacgccaggctctctggaggccaggagatggtgagtgtaggggccaggcctcctgagagacagggaggggcggactggaacccgcggtaccggctcgggaggaaccgggctgcccgggtgggttccgggctccgcggacccgaggcccctccagctgcaccatggcggccgggccccgcgcgccccggcgcatccctgcagagcggctttggcccaagcccagagccatgtccccccggcagctcttcgcccgcagaccctcgtctccccgagtcaggaagggagaatcccgactccgtgggtggtttgtgcataagaggatgatctgtagcccgtgggggccccagtccctcctttctctcgagggagtccttgcaaaaatgtgaaagagttttatttgagcaaagagcgattcatgaatggcagaggacccaaccatgttttttgggtttggaggtcccaccagccggccttgaaggaaaggcttttatcaggtgcatgaggaagcaaaccacattcattcattagttcggtacagttacgtcatctcctgatttcagctatctaggctgaaattttctggtcctgtaatcagaagttaattagaggtttgtggttgacgaagcctgaattttgtttctgcaagatagtcatttgcaagaaacgcatctgagttagatttttttttttaacctaagaacccagggcactagagccacctcagtcggattgcctgctatttaattattattatttttgagatggagtctcgctctgtcccccaggctggagtgcagtggcgcgatctcggctcactgcaacctctgcctcccgggttcaagcaattctcctgcctcagcctcccgagtagctgagattacagtcctgcaccaccacgcccggctaatttttgtatttttagtagagacggggtttcaccatgttggccaggctggtcttgaactcctgacctcatgtgatccgcctgccttggcctcccaaagtgctgggattacagtcgtgagccactgcgcccagcctggacggcactttttaagagatttgttttctgtttgtaatcattccacgtgacaggaaagcagagaatcatcccctgacgctattgtaaaaagtctttgtgcctctcctcctttttattttccctaggcacagacaccttaccagaatgtctttggtttgaggttccactttggaaacttgacagggtgatttgctctcagccaccctctggactttttcctcagtttcagtattgtccagggataacacaggatgcccaccatggccatgtctgctggagcatctagtgaatttcaggccctgggttatttctcagaggacagcctgaggtatgaagtgtggcctctccagggagcagctggatgccctgggctgagagaaatctcctggtctactcttcctctaaagaggtaaccacttaggacattaagattgtcttcacccaacccaactttcaatccttggagacacatggctgatcagccaatcacatgccactgtcagagggaaaagaccgaaatcatttctgccctttggactctcagatttgtgaagggagacagaatgtttcaaagagcaagaaaaactccaccccgtgagatggtgcaaaacctgtaaagcaaaattcacctgggacactcagcggggcacagtgcagtgtatcatcgggggtggccggtgagcacttcggtgaacaggatggaggtgggagaatctcccaaggaatagaatagcctgacttgacacaagtcattagctgtgtctgtgttccagtcggcactgccactctctgtgtctccttgaaataatttattcacttactgcaacgttggatttttaattgtaaatttacattttatcagtagagcttgaaaggtaagaaaatacttacaaaggacatgaaataggtcaatttcaggaaaaaagttaaatatctagtcatacatacctttttcttctccagagtgattaagggtagaaagttacttaggtctgttcttttgtggaagatgatttccaacagaatcccagggcttagctttgggaatgctaccagggaacataaaatgcttcttggatggctgtggagaatgtttacattttctacaaaaaaattatggtagattacttggtaaattacatagattcatcagaacatgagctctttttgcaggatgaatttgttgtcgtgagtatctctgttttatatcctgttctctagatgtctgagcttaatgctaagttgtaggagatggaacttagcacttctaaaagtgttcacatgtgattgtttactatatgatttgttatggaaatagttaaatgacaagttcattgtctgaaagcaataaataattttgctttttctgtggaggtgaaagtgtaagtgcttacagtttccttttcttctgtaaactgtttgagtgattttgttggatgtttccaacactgggtattttcttatttaaacctaagtggataaccctgattgggaagttgaagcccaagaacagtcattccaagctaaggctaatactgagtctgcaaaagaaagcaatcgaaggcctggctcaagcttgtccaacccacaggcctgggccacatgctggcctgggctttgaatgtggtccaacacaaattcgtaaactttattaaaacattatgagacttttttgtgattttttttttttttcagttatcagctatcgttagtgttagtgtattttatgtgtggcccagggaagccaagatcggacacccctggcctagctagtgcttcctgaggagcctcccctgcgggtgccccagactgctcacagcaaccatggaaggagcctttctacagagagaagctgcagagcccgggagcactggggacccacaggcagatgcagttagagttgggatggaaggaagctggggaggacttgctgggtatggaatcgttattatcctggggctgtttctagacttcgtcaaataaaataaatttagctttagataggaagttattgaactctaaagaaggattgcaacagggagaaggtagcaactatcatggatctcatggccatagagggcatctgtgcagggtcaccaggaactctctcaccagcacctggagtcttttggacattcaggagtgcactgtgcagacggggctcaggctgacaaaacggtccatctgtgcttctgttgtagaataagagaaatgagtcacccagggtttgttcctcccctcagagaagaaacctcattggtatccacatgggaattactccagtttttctggtacttcagtaaaaaacaaaaatgagatctggagattcaaactgataaactaattgattccatcctgtgtagccattaggaaaacagagaaggcagccatggtccccgcaagccagaaacttttccatttccagtaactggataaatcattgaattcagcgtcttggggtcagcatgaagaagggagtggtcaaagggacttcggcttcatttgggccattttcctgatgtggttgttgtgagttctgatgtcatattgaagggatattcagacagacaaggtggtggtggtattatttctgttgcttttgcccggctaaaaataaatatttagcttctaccatatctgtcctagaaaatcctaaaggttttggttaaattgcttgttattttatgttataaaatagacaaggaagtggccaaaatagattaaaattatacaaaccctgggatttaaattttggggtggggggcagttttaggaaaaacagaattgtaaatactctagtagcatagagagcagaatcctgcgtagggccctctccctgcccagacatgcccagactctccttctctgagtctcatccaggtctggcttcaccctggactctcctccgacagagttaactacagaattaaatcagagttttgggtttagctacagagttaaatcagtttggagtttaactacagagttaaatcagagtttgactcctgctgcctctccggaactgatacacagaattttcggaaaccccaaagcagataaatgggatcaaaggactctctattttggagccttaatttttcttttttactaacaccagcgctgttagagacatcgtatccagcaagctctttctcagtcctgtgggtctaatagttgcttcacaagccacaagaaagtgaagataaacacaacaatggaaagtgcctttgcactacacttcatcccctctgtatcccttccattggtctatctggagcttttatcactacacttttaaaaagttaatgataggaaaatagaagaggaaccacaaagcctggtcccttcatctatatcttgagagttgcaggacacttggttccatcacccagggtgtggtgaggattaactcacatgacgtgaggtgcccagcacagtgctgtcacatacatccgagcaccccgtgcctgcttaataaacactgcattcatacgtgtgtacacattgttttccaaatgcagacagactcagacattgcttccttctccagccctggaaaactttaaagagccaggaaataatgtaatctttcagaatagagattggctgtctccatttgcaccagaagaacttatgttgtggtcagagggttgggtgtaagggactgtgctggggctgctttctttagctgagtgttaatgatcacaagtcttggggtagcagcatcaccattaatggcagaactgttaaaaaatccaacccatgaacccctttgaaatcttcagaatcacatgacttagagtggggccaaaattaccaaaagattcatatgcacattgaagcttgagaagcaaggcttagctaaatggttctcagcctggcttctaattaaatcacatggacaactcaaaaaaaggccctcacctttgccctcacagattctgcctattggtttgggtggaagcaccagtgctgtttaagtcacatgcatcatgggattctaaggtgtggccagaatcagtgatggggggtttcagatgcatttgtacgagttgagctcagccttggttccaaagggaggtcacagggccttctttgcctaggtttcagaggccagctcagtgcagcttatactccaattgctgaagcagaattgctgttgtttagcaggagagggaacctgagagcaggaagagagaaagtcacattttgatctccatgtagaagtttactgttcctgaatctcttttataaagaacagaaaagcgtggactttttctgtatttcttggtctttctgttgatggttgtggtggtagcaggtgaaggggttgtgctaacacctttaaaggcatattctcacgatgcaggtgtgatttgtccagagaatctttcctaagaggaaatcccagagaagcaggagaaagagaaagaaatggctggtgctcaggtaaatgcatctcaggtcaggggttgtgtccacttttgctcctgaaatgtcatgtgtttagaatttggaaacctttacttctctacttgtggtgtttctccatagtaagtttgtttcaactacttttttttcttataataatgaagggtctctgaaaatatttgttttctatataccaaagccgtctctctgttatcttcaccttgacttcttatatgccatgaagaattcttaccatgactttatgacctgcagtattaaaaagttcacttcgtggcactgaacttgtggatacccaggattcctcttgaggatggggtgggtttttggatatcagcaaagaagggaaatgtgcactctttaggtttcatctggatgctccataagctgcatgcagaacaggactaagaaaataaacatttaaaccagatgacatttatcgctcagaataactcaaagcattctggaaaagagaaaaatgaaaagacacttgctttttagaatgctaaagaaagactcttttaatacactattagagattactgctgggcatggtggctcacgcctataatcccaacactttgggaggcctaggtgggcagatcgcttggggccaggagttcgagaccagcctgaccaacatggtgaaaccccatctctactaaaaaaatacaaaaattatccaagcgtggtggcacatgtgggtagttccatctactccggaggctgagggacgagaattgcctgaaccagggaggcagaggtagcagtgagccgagatcgcgccactgcactccagcctgggctacagagtgagactcagtctcaagacaaaagaaaacagattacagaacctgggagatatttgtcagaacctgggagatatttgtcagaacataggagatatttatttgtcagaacctgggagatatttatttgtcagaacctgggagatatttgtcaggacctgggaaatatttgtcagaacctgggagatatttgtcagaacctgggagatatttatttgtctcttgaactttgcataacactaaggtttcggtatgatttgattcagattataattgaccttttggccaatatcacaccagtaatatgtccttctctgtgcattggcacgtgataaaaatctgtcctattacagttgatattagttttattcagttgtttaaagagctccctgacagattttccattgtggagtttatttttttctcttttaagtaccttgaggagatttactaattaatgtgcataaataatcacatttaatctgaaaggttttgcttcttagattctttttgcatatgccttgctttagaagatgaagaatctcatctctctttatggtttagaaaaactgggataaacccaagcttgccacttacaggatttttgacaaaatattgtccttgggcccaaaggactggcatcactggtgagcgcgttagaaattcggaaactcagccttgacctccgatttcctgaagcaaaatctgcacactagtttattggacacatgaaaattggagaggcagcttctaactcaccatgacttttctgcctgcgaaatatacacagcttattcatgtgacgtaaatgtagcactcaaaaatggacatgcctttgttgatgcccttaatgttatacttgttatcaaccagaaaagtattgtatatacactgcttatgtggctctcaggcaattctctttcctcagagttagagagtattcttctgctaagaattaccttattgtataatttcagtcacttgtgtaagtcagaaccagttctcttcactcgctcatttcaccttgaatcaagtatttgttattgttgttgtttcttcttcagactctgttgacgttcagggatgtggccatagaattctccctggaggagtggaaatgcctggacctcgctcagcagaatttgtacagggatgtgatgttggagaactacagaaacttgttctccgttggtgaggataacttcaatacgtagttcctcctatgccctaaagagttcctttcgttcctctgcggaatgttttttgggagtttctgcgttgcatgaatgagtttcagatccctgcttttaagaaaaacatggggaatagttgatgtaaaaaaaaaaaaatcttcaaaatgtggttcatcttgacataaaccttccttttttttcagctgatctgtatctttcactctagtgacaattccagaaattcagtggcatgaaatattgttgcccacaacttaaagtcaaatttccaccaccaattttttatgtcagcagtactgagtggtgaaactaagaacccacagatttaaaatacttactgaatattctaaaggtgatgtcaggaagcataattttgggattaattttctagaatcttatataatgttcactctactaagcacagtacaaggttgataattggagaatttcagcaagagtaatgtcacttttttctaataaaacaggtctcactgtctgtaagccaggcctgatcacctgcctggagcaacgaaaagagccctggaatgtgaagagacaggaggcagcagacggacatccaggtgggtgggaatgaacgaagcaggtaacccaggtgagaggtccagaggtcgaggaggaagccagaccttaaaatgtggtttgagaagctctgccctagtggagatggtttctgagagcctgggtgtctttctcttgctgtaccctaggagcgtcttctgtctcattctctcaaattttgtatagactctgcttcctgtttagtgatcttcctttataaaggttacagtaaaaatcagagtcctcctcctgacgagtaagggcctgtgtggtctcatggcgtgctccgccactgcttttgggaacatgcctgtacctgcctgtttttgaggaactctgttaaatgttttttgatttcctttgcatcatgtctgaagtgtgcgagaggcgtggtgatggtgattggttcagaaatcccagaagtcccgtaaacagatgttgtatgctttctgctttatgatttcgtatcctacagaggtttcaaatgggagtctacagaaatgtatactcagcagttttctccgaacactaggcatctgcccaaatatgagataatctaatgttattttacttcaacattttattttattttttttagtatgagctgaggttggtcatttaaactttatattccctaactcccaactgtaatagttataatattatcattttataatttcttcttttttagtatgaggcttatcaggactctgtcattcatatgtatgtatgtgtgcatatgtatatatgtgtgtatatatgtgtgtatatatgtgtgtgtatatatcatatatgtgtgtatatatcatatatcaacatatccttttgaaatgataggatttcattcttttttatgctggagtaatattctgttgtctatttaaatcatattttctttatccattcatgtatatatacacacacatatatacagtgtgtctatgtgggcatatgtgtaacagattattttagaaataaaaattgtgtatatattgtgtacaatgtaataatttgatatgtgtatacgttgtgaaataattagtgcaatcacttcaaggaacaaatctatcacttcacgtaattaccttttcttgtagtgagaacagttaatgtctaccgttggcaaactttaagcatacaaaagattattaatagtattcgtgaagctactcattagattccccaaacttactcatcttacaactgaaagtttgtaccttttgaacaacagctcattttccccaactccaggccctggcaactgccattgtcctctgctcctgtgagttcagccacgacagattccacgtctgagggggaacgtgcagtctctgtctttggggcctggctgagtttatttagcaggatgtccttcagggtcatccacgtggttgaatgacaggatttcattccttttttatggctgagtaatattctattgtctatttatatcacattttctttatccattcagcatccgcaaacgtttagcttgtctttatatcttgacaattgtgaataatgctgcagtgaacatgagggagcagataattcttcaagatgctgcttttattcccttcagttattatatacacagaagtgtgattgctgcgttgcagggtaggtttatctttttctaacttttaaataacgccccccgaccctggttttcataatgactctaccagttgagaactctgagcgttcagaattgttttttctttacatccttatcaacattgttagtagattggcgcaaaagtaagagtatttcttactatttagaaggcaaaaaccacaattacttttgcacagccctaatatgttacttatttttgatattagccatcctagtatccaaaagtttgattgtaaattgtctttggtgtcacaagctttttagcttaatgtactccattttgtttatatttacttttgttgctgtacttttggtgtcgtgtctaaaaaatgattgccaagaccaatatcagaggttttctctcagagtttttaaggatacatgttttacatttaaggcttgatttcaagttaatttttgagtatggtgtaagaaaaatgggctatttcattattttgattgcgggtattctgtttctccaggaccaagtgttgaagagactatactgtctgtattgtatcttcttcgtgaacttgtgaaagattagttaagtggatatgcgtgagtttaattctgggctctctgttctgtcccattggtctctgcggcagttttcctctctgttcgcataccatcctgttcttactactgtagtcctaaaatgtcacttgaaaacagaaaatattatgcctcttgccttgttctttttcctatagattgctttggctatgccaagtctattgtaattccatataaattttagaattctattttcattactgtgaaaaaggccactggaatttgataagaagtttattgaatctatagtcttggtctttagcagaattttacaaccccctccctggattactaagctctattaaaggcatttttgtgagatgagatctctctgtgtcacccaggctggttctgaacttctggcctgaagtgagcctctcaccccgaggtcctgaatagttgggattataggcatgagccgtggtgcctgattctcttggaaaggcatttctgtacaagaagactgacacatttttgttgctgtcggggaatatataacccagggtccacctatgtcaccatttttctatgtcactgtcctgtacattttcactttctcttttgttccatttcaaatttatctctaatttcaaattctaatatgcagaacaatatgctagaattaatgtgttatgtctgaattatttagtaagcactatttgtttgtttgtttgtttgttttgagatagagttttgctcttgttacccaggctggagtgcaatggcgcgatctcggcactgcaacctccacctcccaggttcaagcaattcttctgcctcagcctcctgagtagctgggatttacacacaggcatgcaccaccacgcctggctaattttttgtatttttagtagagatggggtttgtccatgttggtcaggctggcctcgaactcccgacctcaggtgatctgcctgccttggcctcccaaagtgtcaggattacaggcgtgaaccactgcacccggcaagcactccacattgattaaattatcctatttcttcaacctgtatataaataataatatgatttattcccagatgtttattttatatatcagtgactctcaccatattttacataatttatatttttctctttatttagaaatataaggctattccttgcttctaaaagttggatggcagcattttaaatttgcataagaatagcatcggtatagtaaacatataataaaaattacctttagtatctcttagtcattaaaatgttctcagtagagtcttttcataatgattgtagtgcattttctgtgaaatgttactgctgtccactgcatgccagtgactcaaaatacctagttttcatgactacacagtcacagttgaatactgtagttatctaggcaaattcttttttaatggtacatcaatgtttcatagcagattttatgactaacatctcttagtgttttgtaattccatattactgtttttatggttgaataatattccttgtatgtatataccacattttttctgtgtgttcatcacttgaggcttcccccatttgacttttctgaatagtggtacagtaaacatgggtgtgcaaatatctcttctaagtcctgagttgctttgtatacttttgatatagatctagaaatgggattgctggatcatataattccatttttaatttttttaagaaaatttatgcttttttttttttttttacacagagtttcactctatcacccaggctgtagtgcagtggtgccatctcagctcactgcaacctctgcttcctgggctcgagccttcttcccacttcagcctcctgaggacctggaactacaggggcacaccgccacacccagctaacttttgtgtttttaatagagacagggtcttgccatgttgcccaggctggtctcggactcctgggctcaagtgatccacccgcctcggtctcccgaagtgctggggttccaggtgtgagctggtgtgaaccagtgtgcccggcctatgctatctttcatcgtggctgcatcctttctttcctaccagcaggttacgtggttttcaatgtcttcacatccttgacaggtctggattttttttttttactgtggccattctaataggtgtgaggaaatatcttaattgtgattttgttttgcatttctctatagataagtaatttgagcattcattcaaggcttgttgggcgtttccatatcttttttggagagatttcagttagtccttcatctatttttaaatcaaattatttaatttttgttgtttagttgtaaaagttccttatatactctgaatataaggatacactcctatcaaatgtgtgatttttacccatttcttaggtggtattttcacttcactcattgttttctttgatttgcagaaagtttgaagtttgatgtagttcagtttttctgttcttttgttgcttatgcatttgctgtcctatattttcttctaagagttttattcttttttttttttttttttttgagatggagtcttgctctgtcgcccaggctggagtgcagtggtgcgatctctgctcactgcaagctctgcctcctgggttcacgccattctcctgcctcagcctcctgagtagctgggactacaggcgcccgccaccacgcccggctcattttttgtattttttttttttagtagagatggggtttcaccgtgttggccaggatggtctcgatctcctgacctcgtgatccacccgcctcggcctcccaaagtgctgggattataggcgtgagccaccacacccagcctattctatttttatgtttttcatttaaaatatttttgtatatggtgcaaggaaaagataccacttcatttttccatgtagatatctggtttttaacatttgttgaaaggattcttttctccattgtgtggtcatggataccttgtggaaaattacttgattttatccacaagggtttatttctgggctctctgctttgtttcatcatttagttatctgtctttgtgtcagtaccacattgtttttattttcgtagctctttatatgttttaaaatcagaaagtgtaatgcctctttgttctttttaaagaattttgactagttattgttcttaaactaattttaggattaaaaaatcaaaaagtagctttgggaatttgatagagattacattgaatgtgtacattagtgtgggcagtattgacatctttaaaaaactaaattatctgaccattgagcaagaatgtgtatgttcaagggttttaatttccatacatttttggcattgccagttttacttttgcttttgatttctagttttattacattttggttagaaaacatgtcatgagactttcatctttaagagttgttatttgttgtaacacaatgcactatgtgtatttgagaatattgtatattctgcttctttggactggagagttctatgcatgtctgttaaattgatttggtctgtaatgttgcccaagctttcttattgatcttctgtgtaattttctattctgtattgcaaatggggtcttagagttgataattattgtattgctgtgtacatcttgcttcacttctctccatatttgctttatatatctgggagccctgatgttagatataaatatagacagataaacagttacaggttcctggttaatgtacgcattttgccattacatgctattaatctttatctcctgtgacagttctgacttacagtatattgtgtctaatataaggataaccaccccacctgattgtggttactaattgcatggaatttttttttattttcactttcagcctattttactatttaaggctagagtcttttgtagctagcatattgttcttaatccattcagctattttatttctgttcaataagtaggttaatttatatttaaaataatttctgaaggaaatgaagttactatcaccatcttgattgttactgttttctgtgtttcttgtagatatgttatccctcatttcctctttgactgtcttcatcgtttgttttgttgattttgtgtggacaagctttcattcttttctcattgtgttttgcagaccttgtataggtattttcttttggatcaccttgaaaaatggagagtacataaaacaccttaaaattataaatacagattttaatctcacaacttcattgaatacaaaaactgtaacaccctccagtgtgctgttaatgtaacaaattattatatattttgtgtctggtagcaaagatttatgcagatattttttcagatattatagcagaattttgaattttttacaccatcattatgatagtaaagtattatatatctgcttatatacctttaacagagttttatattttcatatggttttataatgctgtctagcatcattgtcttttttaatacgatgaagtcttttgagtattttttctgtattttgtagagattgggtcttgctctgttgaccatgctaattcctaactcctgacctcaagcaatcctcctgccttggcccacccaaagctggcattatgggcatcagccaccatgcctacccaacctttagcatttcttgtagaactgtactagtggtggtgaacaccctcatctttttatttattttggaaagtctttattttccccctgttcttttgaagtgaaattattctagatcaagtgttcttggttagtaacatttttatcatactgaaatttggaaagttaacaacctttttttcttcaaataatacctctactgcttttctgctatgtattttttgtaagacttctttcatgaatatgttagtttagatcatagtgttcaataaatcccatactttagctattatatttgttttacagttttttctgtgttttatttttaaatctgtgctacattctgttttattggtctatttgtctgcctttataccagtaccaaactgttttaattacggtcgccttgtaatgtgttttgaaatcagacagtgtgatacctccaacattgttcctctgtttgaaaattgttgggtgctttacagccccttgagatgtcttaggatttttaggttgttgcttttatttctgcaaaaagaggattcaaaatctgaaagagattgcctggagtttgtagattgcattggacagcgtgaacatctttgcaatattaagtatttcaacctttgaacaagagcatgctcaaatgtgttgtttaatttccatatatttgtgattttttttgtttttctttgttatttccaggttcatttcattttggtcatatatagtaatgcagaagacttcaattttttgaaatttgttaagacttatttatttgtttaacaggtggcctatcctagagaatgttttctgagctcttgggaagagtgtgtctcctgctgtgttgtgtggagtgttctctctatatctgtgaggtggaattgttttgtagtgctttcaagtcctctctacaattattaagtcttgctttatcatttattactgaaagtgggttgtagaagtatgccaatattatattgctgtctgtttcttgctttgatgctgtaattgtttataaagaacttgcaaaattgaagcaaaaaatagcagtataataggaagttacttcaatacctaaatatatatacgaatatgcacccacgcttgtcataggttcccagttcattctcccttctgttactgttttatgttcttgttttttgtgagctctgacttaaagtatgttttaggaagtatgacattttttgacttaagatgtattttgcataatacaattgtaacctcttctgctctcatttcattaacatttgcatgaaatgtctatttccatcttgccactttcagtctctttttgtcattagatctcaagtgaatctcttgtaggtcagctgtagtttgatcttagtttggttttaaattatttagcatatgccttttgattgagtagtttagttcctaaataagcaatttactgaaatgaaaaggtgtactttagccattgtattttttttacttgattcttgtagctttttctttctctctttcctttttgtgtcttgtactttgtataataagctttgactctttttaaattttcttttgtgtgtcttataggtattttctttgtggttaccatggaaattatataaaacatcttaaagttacaacaaggtattttacactggtaaatacttaactttagttgtatacaaaaattctttcttattaaatctgccctcaactttgttactgatatccctaaatcatttaatgttgtatatccattaacagttatttatgattatttttctactttcatctttcaaattttagataataattaaaagtgatttctgcaccatcattatagtaccacagaattttatttttctgtatatgcgtatcttttccatatatttattttgatatgattatatattattttatagcatcgcattattttcagtggaaaggactccttttaccatttcttgtttgacatgtgtagtggtaatgtagcccttggttatgttagaaagcctttattttttatgattttgtaggacactggttatattattcttgcttggaagttttgtgttcagcaattagactatctcatccaattcccttcttgcttcaggttgtactttttttgagacagggatttattctgtcactcaggctggaagtgcagtggtgtgatcgtggctcactgcggcctccacttcccaggttcaggtgattctcccactccagccttctgagtagttgggactacaagtgtgcaacagcatacacagctaatttttttgtattttctgtagagatgggatttcaccatgctactcaggcttgtcttgaactcctgggctcaagcgatctgcctgcctcagcctcccaaagtgctgggattacaggtgtgaaccaccgtgcccagccaggcctcaatgtttctgtggacaaattcactggtaatctcctaagagcatgtaccttgcttttcacttgctgctttcaggattcttttctcctttgactttggaaactgtggttataatgtgtcttatgtccctttttgtttatactagttgatgtgttgagcttcttgatttttttgtatttttttcttacttttgagaatttctcagtaattatttcctttcatacctcagtttctcagtctgtttttcatacttcatgtctttttattggtatccttattttcctaattttacttagtttgctgttttgccatttttactcattgagcattattcaaatggtaattttattttcttcagttaatttatgcatctccatcattttagggttgatttctgaactttttttatttctttgattatgccatgtgaccctaatactttgtacatgtcatctttgactgagattcaggcattaacaacaagcctcctgccacaacctttataatgtgcctttctcctggggtcatctaaaacaaataggcccagattctagaggcctcttaagcctgttctgggatgtgtcttgtgtggaattgtgtgtgtatttttcatttaaagagggtttctcagctttctttgtagtgccctggaatcacacaatacacttgtcgcctggtgctgctgctgcagccttcctaccgctgtcatgggtatttcctttcggtctcagcagacccagcctgtcactcagagtaccaccatttctctcagcactccgtgtcacggggggcagaaaccaatctttgccaaagcttcaaaaggccaaaagtaaaaacacttgtgccagtatttgctttctcttttgaaggagaagccaagagctgagggtgtactcttaaaggcatgatgctatactgcggaggagcggggcctgcagtgggtaaacgtaacagactgtttttcttcttatctggctcctagcactgtgctcacctggggtgctgcaaactgtgaaatggtttttagagttcagatgcatcttctcactaggtattgttacatttatatgtttatacagaaattagggcctgtggtattttttatgccattttgctaatgtacccagtattattttatagattagattcataaagtgtattcatctgtgtctagtaagtcggataactttttttttttttttcagctatgtcttctcattttacccaagaccttctgccagagcagggcatacaagatgcattcccaaaaagaatactgagaggatatggaaattgtggccttgataatttatatttaaggaaagactgggaaagtttagatgagtgtaagttgcaaaaagattataatggacttaaccaatgttcatcaactacccatagcaaaatctttcaatataataaatatgttaaaatctttgataacttttcaaatttacatagacgtaatataagtaatactggagagaaacctttcaaatgtcaagaatgtggcaaatcctttcaaatgctctcattcctaactgaacatcagaaaattcacactggaaaaaaattccaaaaatgtggagaatgtggcaaaacctttatccagtgctcacactttactgaacctgagaacattgacactggagagaaaccttacaagtgtcaagaatgtaacaacgtcattaaaacttgctcagtccttactaaaaatagaatttatgccggaggggaacattacagatgtgaagaatttggcaaagtatttaaccagtgctcccaccttactgaacatgagcatggtactgaggaaaaaccctgcaaatatgaagagtgcagcagtgtctttatctcttgctcaagcctttctaatcaacagatgattcttgctggagagaagctctccaaatgtgaaacatggtacaaaggttttaaccacagcccaaatccttccaaacaccagagaaatgagattggagggaaacctttcaaatgtgaggaatgtgacagcatcttcaagtggttctcagaccttactaaacataagagaattcacactggtgagaaaccatacaaatgtgacgaatgtgggaaagcctatacacagtcctcacacctcagtgaacacaggaggattcacaccggagagaaaccctaccaatgtgaagaatgtgggaaggtcttcagaacttgctcaagcctttctaaccataagagaactcattctgaagaaaaaccctacacgtgtgaagaatgtggcaacatctttaagcagttatcagacctcactaagcataagaaaacccatactggagagaagccctacaaatgtgacgaatgtggaaaaaactttacccagtcctccaaccttattgtacataagagaattcatactggagagaaaccctacaagtgtgaagaatgtggcagagtcttcatgtggttctcagacattaccaaacataagaaaacccatactggagagaaaccctacaaatgtgacgaatgtggaaaaaactttacccagtcctcaaaccttattgtacataagagaattcatactggagagaaaccctacaagtgtgaaaagtgtggcaaagccttcacccagttctcacacctgactgtacatgaaagcattcatacttgagaaaaaaataaacaaatataaaaataggcaaagccgttagtatctgctcgcatcccactttacatcagagttcagacttaataaagttatcataaatgtaattactattgaaagacctttcatgaaatataagtctccagagcacacaagagtatttcttctgaaaaaaatgttacaattatactagatggaagacttgcatcagttgcttaaactttcagaaaatttgtagagaaacccaacaaatctcataaatgtggaataacatttgttcaaaaatgatagcttagaaaacactagagttcatactaaaagatattttgcaaatacactaaatggaaaaataagcaaaatccaatttaagtaaacaatggaggatttgaaggagaaaggaatagagcacggacacgttcagaaatgacactgaatccctgtgttgagtctacagagacatctagacttaaaatagatcatttatatttaagtttaaaaggaggatgagactgagtttttgtagagttataattacattcaaaatatacttttttgcattgaaaaaatgttaaatttttgaaaagcgaatattgatgtcattctattctcaaatcagtagatgctgtgtcttcatttctagtgctgatgtgaaaacacatggtcagttgttgctgcgtcagagatatgagaaattcttttctcttaggtgtgcatcactgatatacttgtccgtgaaaggtgaaagacactgaaatgtaagatgcgtgagtaaaatcttggtagagaggctctttgtggttgttttatatacttgtaagtgatttatgagataggtgtttagaataatactcttctgttagggtcaccctgatcagaccgttcccttcccctcccacaggacttacaatacggtcccttgtgctctctgcacagctaccccagggcaaaaaacaaaccccccttcactgatccctccagtaactgtgcagacagttacaggatgcggttaacatgtctgttcacctcgcataacaaagctggcaaaaaacatctccaggatgcagacaagacacctgcaccctcgactaagctcccccaccccaacccagttctcctgcacccccaactcagctcccgcaccccgacctagttctggccctataaaaacctgctatagtctgtaagcagggctgcctcctctaactgtggtggagcagccaagcagctcaataaagcttgcttgcctgactttgggtctcttcatcctttctcttggctgaccttacatttctggtgccgaaacccggaaaggtgatagagttcggcctccctttctccctttctctttctctccctccttcccctggctgaactcccccttccagaacctgctagagacccaaggatctcatacatactttccattgctggcgaacacatccaacaccagggcctcctcagggttgagtaaaggagactttcgccttgtgtctggaacccttgtctgctctttccttcctaaaagacccagcactgggccaagggtttcctcctcctggcctccaggaggccctcgatatctcctatcaaggatgcctgaaccggggattatcgcacttctccgacttgaactgtgggacaagggacgcgttctcccaccattctagtctccggccaagtctcccatctctacccctccctttctcattccactatgggagccttccaatcccctccctcaaagacatccccgcttcgggtgtctcctccatcataaccttaatgcccttagcctccattccgaaattcagccaaaaaaaaacctcatcttttattgtaacaccgcctggccacaatataaactaaacaatggctcccaatggcctgaaaacggcactttaaatttcaacattctcaggtacctagacaacttctgccatcgcaatggaaagtggtcagagattccttatgttcaggctttcgtttgccctccatagccatccctccctctgtcagtcctgctctactttccaaatcctcgcctgctccaaacctgacccatcctcagacccccacccccgtcaccgctcctcccaatgattcttccttctttgatcctgccaacttttccccaacagcaccgtaatcctcccccaaatcatcacaatcctccaccatacaatcccgctcctgccttcgttctcttcctctctccaaccacccagcttctgattctgattcctccccatctccacctcatacccgctctcagactcagcatgcccaacactcggcccccttacttcccctctgagaggtggctggggctaaaggagtcgttcgcgtccacattcccttctccctctcttaacctttcgcaaattaagaaacatctcaggtccttttcctccaatcctgacacttatatcaaaaagctcaaatacctcacccaatcttacaaactc

SEQ ID NO: 17263 - DNA, 22104 bp, Human; identical to SEQ ID NO: 12745

SEQ ID NO: 17264 - DNA, 60304 bp, Human; identical to SEQ ID NO: 11995

SEQ ID NO: 17265 - DNA, 25049 bp, Human
agagaacaatgttcgggattgaacctgttttgcctttttaatcggaacacaaaagggatacctttttctttctccaagtttttgaaattttggtctccctcctacattcactccttgttgaaagtaatggaaaggcaattaggtctgtgtcccaaatgaaagcccacagtcaggaggggattctcattgaggtgactgtcctgttaagacctgctcctgtgaacccccaagcacagggcagagcaggacatgaactaagagccaggctttgccgaatccgggtcgagttcaccgacagcagtgtgtgcagcacgcttcctcctctgcaccctggcagtagagcccttcctcattgtaaagccaagtggtgtctgcagtccgccttgcccagggctggaggcagagctgagcttggtgaacaggtgccaggggattcctgtcatcagtggactatgctttagaagctgcttgttgcaaaggtactggttgatcattgtctgagagttggatctgaaggccaacacccactagcaaaaccatcatccctgtaataacagcaacccaagcagatttgatttctccagtgaaggttctagatgagtctaatcaaggcttcccacccatcttctcccaacaccagagtttccctgtgaaaacgatcatggttaactcgcactgaatactatttatgtgccaagtaccattccacattctttacatattttagctcactttactccaacggggaccattattcccagtttgcacataagcaaatggagccagggaaagcaaggggcagaacagggaactgatttcccggagtttcggcccagagtcagtgtgcttagccaccgccaacaccagccccagagctctaggctcctggaagtcgtgctcccgagtccttccccttgcacagtggagagaactcgatgttggaatgaaaccagctaattccagtagggtgcttccgctgttgtgaggagctgggcaactagtaagctcactgagcctcactgtgctccactataaaaccaggagagtgcgcagcagaggagagggtctgggtttcagaataagaagcaggttttcttcctgctcagcaaatcctgggtaattgtatcatatcccctaaccccttaaacctcagctagagagggcgccagtcttagccccagggaaggctttcgtgtgcacattggagacaaagcctgcccagcagtgcccggcacagaactggggagctgttgggataagcatgggggtggactctccctgggacagatcctatctcacagcagtttggagaactgttgtatacacacgcaggtgacacgaggcagagcaggatgtgaaacgagcgcagtggtttgccaaacccgcagcaggcttaggacggagtggtgagaacagcccccttccttttcctcagcttgacggtcccagcctttcccattgcggacctagagcccagactcccagggcagaaagcgccccacagactgataaaggtgaacaatccaggctttgtttccaagggctttatccctgactttccaactggcttttatctgtgtcttcacgtctctgacctcttgagcctcacaggagctagactagaaggttcaagttcttgaggagaaggcaggggcgggagagccccacttgcgggaatctcgtgcggaccgagtcggggcgggagagggcgcgcaccagccaggctagggcgcgcggggcgccgaggggcgcggggccgtttggggccgttcgggccagttcgcgcggcggggcccgtcggagcttttctctcggcagcctggctggccgcgcgtcttctccgcgcagcgggcgaagtcgcgatgggttcattaaggcggcaggtaggcagtgccccggcggcggctgcggcaggcggtcctggaatgtgcgaggggcgtgatgacagcggccagcctctttgcgcaacaccttcgccatatatacccggggcgctgcgctccacctggccgccgcctccagcccagcacctgcggagggagcgctggtgagtaccgccgccggggcaggggcgcttcctcgctctttcaaggactttgattcacttaattcttgcaaatacctctcggtgctgacttcaaggaacttggctggctttgggccgcagaagtgaaaaacacaaagctctccacaatgttcaagttgttttcttcttaatgttacggttattgcttttattacagcttttgctgctacactcttacgatcgacagtgttattaatcagccacacttgtggattctaaaatgatcactgttttgagagtcgtggtttggaagaggaaaggcccaggggatagaaatctccacctaggaatcaggatagctaggctctttgtggctgggtcaccaactagccatgtgacaacgctagtccctgtgagcccctgggctgccgtcttccattctttataagaaggggaatgcgacatctcaggaccatgaaaattctaggtttgtggtggctgcctggtgatgtgacactgccccccacccaagtgtgacttccacgtggtacagtgcttgtttgcagttatttaaggtgcctaggagacagtcttagtttgtttctattagggcccgtggccatcagcgaagggtccgtccttcagccgtcttggggagcaaagcccgcaatttatgttttccaagccacaaatgggtgagcaggctggggagataacttacaaggagatgtgcacaggagtggttgggttcggggactgcgcatcctcaggccagaaagttgggggctgcatggcatggagttagttcaggttccctgcaacggtgcctgccaccggtggctcgcactgcgctgaagagagttggaatctcgttttctttgaggaggtccctttttcaaacatgttgatttcatggaagcagcttgtggatttcatcactcgagtcccctcttcctgtttgggtgccccagggggtttctgtgttagccctgatcgctctgggccttgtcgttctttcctttttccttcttcccttgtgtgctggcagttctttaacttgtcctgggttgggtattcttggaaaactgtgcttgtaggagtggccgttgtttcagattgttaaagaaaaacaaaaataaaaaagattgcctcttttgtcccatgcccgctgatcatgatcttctctgcttttgtaatttggggaatgggtgataagaaaggcgtgctttgtaaaaggtttggatgctaaacaaattgccccatccaaaactccccaaattgctcaactgtctcaatgaagcaagtcccctgtggtatgaggatgggcttctgattgttgctgttagacacaaaggggacaaaaaaatagcccgaattcaatgcaatgaggaaaacagcctcacagaatcagagtgctttggaataaactgggctttagtaaccagtttcaggcatcttccactcctccatcctcacccacacccccacttccattctggggaccgcagggagcaatcaggacatcccagggaatttattcatctcagtgaatttttaaaatgcaaaggtacaaaaagagggctataaaaagattgcggtatttttaagatgtttatatttacaaatttaactgctttaacctccccccccaatacaatgcagcacaactgatatagttacaagttatttacaggatttattttaagatatcataaatacaaattgatagtgcatggtgagggtgtggtttggtgatatggcccaagtttaaagtttattagtgtgccacatcaaaaatgtaaactcaagttatctatcaatgtgaggcccaggccaattgcttccttgactcctctcatcactaccaccattgtgtccttgaagagattattattagcagtaatgtagggacagggtctcactatgttgtctaagctggtctcaaactcacaggttcaagggactctcccactttggcctcccaaagtgctgggattataggtgtgagccaccacccttagcctataggggtgattatttttccttgtgatggctgtaagggaagcagaggaaaaggagacgtcaccctcttgggaatttttgaagcacagagtcattctttcaaagtacaagaaagttttcctgggcatcccgagaacactggcctgcatgaggttgaaattatctctgcagtgttgtggtgcctatgtgatttgaagccattaacctctctgtggctcagtttttccctctatagaatgaggatactgttcattttaaaggagactctaagtttacatagatacatgaaatgctgtgagtaaatttgtgcaccaatttgcaagtgccaggcacaaagtctttaataaacactacttggctaccatgtgcccagcactgtcctatgtgctggggatacaatggccatactctagtccctgtgcttgtgaaggctgccattctgatgggagactgtgtgtccatgttctggttcctcacaggaccactgccctgggcttcctcctctccccatttcttcagatggccttgactgctgctctgggcacaaggggcccaggaacaggtcttggttggagaagcccaaacaatgcgaatgtaggggttgggtgactgccaggtaccctacattcccctgcttcccaagtctgagccaagtcaagaaagttcctctcctgggtcttcaagaaagaataagagctctttctggcagtgggtgcccatgtggtgcaggaagtggagccaagagggtgaggcacacaggcaactcggttatagaggccagtgtggcagcgggggagcccctccctgggctttagtaaaaagcttccaaatgatgacttctcccttcctctgctgcttctggcaggtggcaagaatgtgctggagtgaggccttgggaaggctgggagagaacaaggcagtggttgcgccagggctatgggggtaggagaaaggcttagaggggctcagagctccagggtacattctctgcctgcaccatttaataacccaccccccacccacccaccccacccccaccaccctcccctcctgctcatccattgcaacattcttgggcgggcatttccagcatctgaatgatcatgtgggagtgacctgcagacatgccaatctagccagctatccgaaaacactcagagccctcaatgtgcctagacctaaggcccctgggtgccctggtgctttgagggctggagaatttctcctccctttgcccctggctgtgagatctgtggaaaagcttctggctttggagccagcagtcttgggttcatatcctgacaccagctccaggtagttggaggcaagcttctttgtttctctgtgcctcagtttctttgtctgtacactgagaagaaaaactccttccttggtagatttaatgaggtcacaaactgtataggacactcctctgccacaaaacaaacattagcatctttctctcacaggctttggattcatttattcaaatattaactgagatccactaccatgctgagcattggagatgaagagcttatagtctagggtacacacagtggaaatgaggccatttactgttcatgacacagtgcatttccacgtaataaacactcttgtttattgttcatgacacagtgcatttccacattgtgtcatgaacaataaacaagagttccgagtgtttactctgccaggcaccatgctctagcctcacctacacttattaaccaattagtcctcataacagctcagtaagcaagatggtattgtccccatttttacaatgatgaagctgaagctcagagtggctcagggttgcatatagtgaggggcaggcctctgcagagccagccctccctcactgtgattcgcctctctccaggtatcactgagccatcttacctttgtgagcttagaggttgagttgcatcttttaaaataattttcttctaaaatttaaaaaatcacccacagtctcaccactcccttttacctccagagaacatttctggatcttgtctgccttgttgagatgatgctgtgaatgggaaaaagaagtgctttagatgtgaagtttatctaaagcatttccctatggttttactgattcagtataacctctttaatggcatgctcttacaatgcatggacataccatagttagaaggagtaatttctcttttttcattttttcacactgtaaatgatagagcagcaaatatctttttggtctacatcacattcattctatcataaatatgcccggcagggctcaagaccttaaagatgaagtgatggacaagacaaagtccactttttggtagggtttgcagtctggtaagcaggaaataggttgacgaagaaaggagtcaggtggactcaggctctaagaagccctcttggaagaggtgatcagagtaagttaggtatttctgaatttctgagaggaaatattcctagcttcctgattcctagaagtgaaatgactgggtcacagacgtgtgatgaacataaggcactttggacagtttgctaacttttccagagcttctagcagtgttcaactcataacatcttctccagcatagcataatgaacttaaattctttttgctactttgatagttgtcactgttttagtttgaatatatgggattgcttctgtttttttgagacggagtttcactctttttgcccaggctggggtgcaatgatgtgatctcagctcactgcaacctccacctcccagattcaagtgattctcctgcctcagcctcccgagtagctggaattacaggtgcatgccaccacgcctggctaattttgtatttttagtagagacggggtttcaccatgttgtccaggctggtctctaactcctgacctcagatgatccacctgcctcggcttcccaaagtgttgggtttacaggcatgagccactgtgcccggcctggattgcttcttttttaataggcattttagccatttgttccttttctgtgaattgcctttctccaatcttttggactgctttgtctaatggacaaggactaattgtctaatgtcaaagaacaaggactgcaaggactggaatgtgaggtgtgtcaagtaccatgtaactgagaaaggccttgtgaagaaaatagattgtaagaaggtcttttctgaaggctgaaaagaatgtggttctaacaaaggatgattaatccagacagcatgacatagtaataattgctgctatttattggatgcctcctcaatgccagtcactttctagacttttaatttcactattagtctcataaccctgcaagaactgttccattttatagatggagaaactgacactttatgctcagaggcataaagggacttgcctaaatacacactcattaataggtggcactgctggattttaaaaccaggtccatcactcttttcacagaaggcctgggtggtaggtaaaacacgcagaaggtatatgaacacctgcatatacttatatattttgagacagagttttgctctgtatcccccaggctggaatacagtggcatgatctcagttcactacaacctccgcctcccaggttcaagcaattctcatgcctcagcctcctaagtagctgggattacaggcacccaccaccatcccctgctaatttttgtatttttagtagagacagggttttgacacgttgcccaggctggtctcgaacttctgacctcaggtgacccacccaccttggcctcctaaggtgttggagttacaggcctgagccacctcgcctggcccctgcatatatattcacatacacactaagttgtataaatctgttaaattccactggataaggttttgcatagatttgcagtgcacttgtcttgatataagaagtagatggggttccattgaagggttgtgaggatttggcatgctatgagacaacaaagatgaatgggcttgcaccctgcctttttctttttttttttttttgagaaggagtttcacttttgtcacccaggctggagtgcaatggcacaatctcagctcactgcaacctctgcctcccaggttcaagcgattctcctgtctcagcctcccgagtagctgggactataggcgtgtgccaccacgccggctaatttttatatttttagtagagatggggtttcaccatgttgtcaaggctggtctcaaactcctgacctcaggtgatccacctgtcttggcctcccaaagtgctgggattacaggcgtgagccacggtgcccgttgcaccctgcttttgactgaaggagagagtcaagacaaaaacaagtttacgagattaaaggtggtacatgcagctaactcaacactgtacgaggtagtttgctttagcgactgggtgagtgtttgaaggggaaccacagaggaaatatggtgcttaatatgccacacttagggggcataagtgtgaaatctttcccttccttttactgccgcctccggccgaaacccccacccagttgatgctttgcaaccaatggttcttcctcttatagcatctcggtgtgcctcctttccatgactgctgctttaagctgttttctcatccacagaccatggctccctggcctgaattgggagatgcccagcccaaccccgataagtacctcgaaggggccgcaggtcagcagcccactgcccctgataaaagcaaagagaccaacaaaagtaagtgtcgctcgtttgtctgcagatcggcctttgtgaggaccccaggagactcaggtctgattcctcattaccccttttgcttgtttcagcagataacactgaggcacctgtaaccaagattgaacttctgccgtcctactccacggctacactgatagatgagcccactgaggtggatgacccctggaacctacccactcttcaggactcggggatcaagtggtcaggtaaaagtgaggccagctgagacattcaggagggaaacttcctgtggttcacggtgtcatcatcctcctgtccctcccccttttcattgttctgattcccttgaagcaagggtcctggctagggatgtcaccctctcatctttttttttttagacggagtcttgctctgtcacccaggctggagtgcagtggtgcgatattggctcactgcaagctctgccccgtgggttcaagcagttatcctgcctcagcctcctgagtagctgggattacaggctaatttttgtatttttaatagagatggggtttcaccatgttggccaggctggtctcgaactcctgacctcgtgatccaccctcctcgaccttccaaagtgctgagattacaggcatgagccacagcacccggccaccctcccatctttgaggtagagtcaaagcatgttggagtaattgggggtcattcattcaacaaatgtgccaggcactgtggttatagcaaagatggacattgtctggctccttataattcgctgtgggtgatgaggttccaggtactgctttggagatgctgtggatacagtgatgaacagaaaaggcccctcttctcagagagctttcagaggggtcccctcaccaaaatgtgggcatatttctagtaaaagaaaatatgcagccagacagctggatgcaagcaatcactgtttcatttccaaatgtatgtagggcagaaggtctgtctgtgaactagacagcaaggaggaaaaaggagattggggtgtggggtggggaggagaggtaggaaggaaagagctgggagggggaagatgagaaccattttaaaagccagtggagtaaacagcacttaaggatgtagcatcccaggatgtatgatgccccaagccctccataaattgaggctgattgctgctgtgcagctgcattctagaaaatactctgtgctgtttggaacgtgacagccattatctccgaccctgcacttagcaggtggctagtgctgtcaactgcctcactcagtgacactgtggctcagctgagcatggagcctggtttttctgtcgcagaccacattgaacccctcctcccaaacgcaaatcctttagaggcactttaccaggggtttcagctaaatggaccacagcggtaactgctttgaaagctgcagcgatggctgcttcccatctgtaaggctggctagacataagaacttaacggctgccaggctgggaagggaggggaggtcgggggagctctgagctcattgccaaacttctcagggtttccaacactaaaagtttcatgcctttctctctctccccccatcccacccccctgcagagagagacaccaaagggaagattctctgtttcttccaagggattgggagattgattttacttctcggatttctctactttttcgtgtgctccctggatattcttagtagcgccttccagctggttggaggtaagaatgaaagggtgagaggtctgcgggtgaggggcattatcttgaaatgtggttccgagagtaaaactcagcaagccctctccagctgcagcctcctggagtgttttaggactggaaccgacctcagatcatttatgaagtctatgctttccgttatagaagagaaaactgaggcctatacaaagggctatgacttggcccaggtggcttaggccaggagctggggctagactattccaagctatccgccagttgagtttgtccacaaaccccaggcaggaagttgtctgacatacagacttagctgaggaattcctatatcctccacaccagagagaattctggaatgagaaagagtgccctttcaaatatgggcccttgctgggggaaggacagggccccttctctgggctggaggaatctgcatccattgtacttaccttcacagcccttagggctgcgtgtgcccatgcagtgtgagaacccaggagtgaagtcaccatgtgcttggttccctttgtacctcaatggtgatgtcagaaacaaacaagcagcactccgtctactgggtgcaggcattttcgggggccctctatcaaacattctttcccagagccctcccatttacggagagatcatgaaccagccctgagactcacagcctgtgattagcagagtaagattcagtctcagatctgggtgacacaaaggaccatggatttctgcaacccttggtgcctttcttgggaacccatctgtgtgacttgggagagttggggaggtgggcattcatgggagagcatgaggggcaaacacttcctggacattgcttttttttttttttttttttgagacagagtttcactcttgttgcccgggctggagtgcattggcgtgatctcagctcaccgcgacctccacctcccggcttcaagcgattcttctgcctcagcctcctgagtagctgggattacaggcatgcaccaccatgcctggctaatttttgtatttttagtagagacggggtttctccgtgttggtcaggctggtctgcaactactgacctcagttgttccgcccgtcctccgcctcccgaagtgctgggattacaggtgtgagccaccgtgcctggcctcctgaacattgcttctgggctccctggtccatgggagcatcagctaggggctttgctgtctggttatctcagacaaatcacctgcatcctctgggcttccaccttctttatacaatggacttgggaatgcattgatggtctcaggtacactcttgagaataactctcccagcattcaattacaggctggtgctagggctaagggtggatagagagatctactcttggaggataaatctgaattgggtatacaccccagagacatccaggaggctcattggaacccactggtcccagtatggagttgaggctgggttcctgagcacagaagggcttgctgactgaggagtgtttgaagagtgggaggatgcagggtgaaggaacaaaagtaaccaggggctcacagtgggtcgggaaccagggcagagagacagagacaggaggcacgtgtgggcagctagtagatttcctgccttatcggggcagcactgggaagaggcatggggaagcaagattccttgggtgcctgcagcgatggaggctggactctgcaacccacagccagctggccttggatggagacttctgtttactcagtgcccacctaatccccctcgatcacgttgtgattgtttttgtttgtttgtttgtttttcccaggaaaaatggcaggacagttcttcagcaacagctctattatgtccaaccctttgttggggctggtgatcggggtgctggtgaccgtcttggtgcagagctccagcacctcaacgtccatcgttgtcagcatggtgtcctcttcatgtgagtcggggcacccatgagcccacctgcattccagacactctcctgtctatctgagggtgggaaggacgggggaggaattcactctgaatatgtccaggccttgccaccattgtcttggtatcttgccccagctacaatgtgtttccctcttgatccaaggcaacttcctgtttccatttcgatggcaggatctggaaatagaccctgctgctggagttctcagctctgaattctctagtactgtactttccagacctgtagccactagccacatgtggcagtttaattttgttgaaccttaattgatttaaaattaaaatataacattcagttcctcagttgtactagttacatttcaagtgttaaagagccacatgtggctggctggcagctaccctattgagaagtagagacatagaacatttccttcactgcagaaagttagttctctgggacagggccactctcagtgctaagaagaaagacaacttaatcacatcacaaattgctctgggacaaccgagcttgggagatggcacactaaacttgtacctgtctgataattgctgcagctacgttggacagaccctctgagggggaccagtttgaactgattattattattattttttctattttctttttaaatagagacttgggtctcactgtgttgcccaggctggtctcaaacttctgggctcaagtgatcctcccaaaatgctgggattacaggcctgagccacagcccctgaccagaactatttttcttcccaagctagcatcttagccaaaattaactagaatgtttctcgtccagttagaaaaaggtattacactttcaaaatattttacttgtttatatcaaaaaaggtgcagcaatatgctgattttgttggaaaaagttacactgcctagaattaaatgtctgatatccagcacagaaatgatgcttcctggctgggcctagtggctcacgcctataatcccagcactctgggaggctgaggtgggaggctcacctgaggttgggaatctgagaccagcctgaccaacacggtgaaaccccgtctctactaaaaatacaaaaattagctggatgtggtggtgcatgcctccagtctcagctactcaggaggctgaggcaagagaatcactttaacctgggaggtagaggttgcagtgagctgagatcgagccactgctctccagcctgggagacagagcgagatccatctcaaaaaataaaaataaaaaagaaaagaaaaaaaactgatgcttccttaaaggcgagcctgtgtgccatgcacaactgactcaactgtacatgcaagccctgcactcatccacctaagtccttaatcagtgggtgcctcctggtctccttcaggctagccttggatctgcaatagggaggaaggaggaagctagaaaggcactttcttcagattcatagtgaggtgcagagtgaggtgcaaaaaaaaagtttaagaattcacttgcatagaggataaaaactacttctttagaggataccagcataggtaactttagcctgcctccaggctgcctttctaagcttgctaatggtacttttccatcctctagtgctcactgttcgggctgccatccccattatcatgggggccaacattggaacgtcaatcaccaacactattgttgcgctcatgcaggtgggagatcggagtgagttcagaaggtaagaggctcaaaaccagcctttgcgacatcagctctattgttcttggccacgctgttgtaactgcttttaaccagccaaagatgacatgcttatcaggttcattcctggagttcctagaagtaaccacagggaggtatggctagggttggatcacatactcaccagctgattagactcagctccctgatcggcagagcagggataatactatctatcactactgagttgttgtaggattaaatatacaacccagcaggtgagtgttcagagcacccagcacattgagttcactaaataaatgcaaactctagctagaaacttagccgctgggtggcggaattgaagcaaggccagttagaagagtaggatttattgggactgggcgtggtggctcatgcctgtaatcccagcactctgggaggcccaggcgggtggatcgcctgaggtcaggagcctggccaacatggtgaaaccccatctcttctaaaaatacaaaaattagccggccgtggttgccagcgtctgtaatcccagctactctggaggctgaggcaggagaatcgcttgaacccgggaggcggaggttgcagtgagtcgagatcgtgccactgcactccagcctgggtgacagagtgagactccatctaaaaaaaaaaaaaaaaataaataaatactgttttgtttggtcataattataacttatttaaacttccactttcggtcagctcaacccatgccaccttttctttgttcttcacttacaagttaataaaaaacaaaacctagtttctgcgtatgcagaaactctgaaactagagcaggtagaatgctggaaactcttttctttcaaaaaggttaatgtgaaaattaagtgtttcttagcctcttctagctagttttttttttttttcagtttttttttaaaaggtaagctgtttcattgaagacataaaaatccagaacagagttttttaaatctggagataagatggaatcgaggaggaatctttgaacctcctcagatggatgcaaaatgttttagccttgtttcccatggaaactattcatgtttcatcactttcaagaacttaaaaaaagtttaagaattcacttgcatagaggtctttttaagttaaatttttttattgatacaaaatatttttacacctttctgggaaacatgtgatattttgttacattcatagaatgtgtagtgatcaaatcagggtatttgaggtgcccaccgctttggggatttatgatttctatgtgtttggaacaattgaaaactccagcatagagggctttggttgccttcatactggtccccacctttccaaaagaaggtagccttcaatatacatgatacaaaagtgcccttgatgcaattcttcgaaacagtgattgctgagctaattattccagccgtaacatgcttgctggcccgcagcttcttcatctggccaatgggaatatagataccagccactttggggatcgatatgagagaacaaaaatgagattgtgtacatgtgcacacttccataggtgacacctagcagagggtggcagatgatacaggtaatgacccacctcacatggtgcccacttgcttagtgactaatctggctgtcggggtttccctcccatagagcttttgcaggagccactgtccatgacttcttcaactggctgtccgtgttggtgctcttgcccgtggaggtggccacccattacctcgagatcataacccagcttatagtggagagcttccacttcaagaatggagaagatgccccagatcttctgaaagtcatcactaagcccttcacaaagctcattgtccaggtaacttagctccttcagagagagaaggagactaacttcctacccacaacatcccctacctgagctgacagatatagagtgtctacaacactattctgggcctggcatggtggctcacccttgttttcccagcactttgggaggccgaggcaggtggattgcttgaggtcaggaatctgagaccagcctggccaacatggcataaccctgtctatactaaaatgcaaaacattagctgggcatggtggcgtgcacctgtagtcccagctatgtgggggctgagaaaggaggatcgcttgaaccccgggaggtcaaggctgcagtgagctgagaattgtgccattgcactccagcctgggtgacaaagtgagactgtttttaaaaaataaatagatgaataaacactactctgtagctgcctctggaaaaggccaagggaggcagaacttttgggccacctgatagagtgactgaccttgatggttactttgacttccataacatgccacctttattggggtggaggtgcttcttaagactggacacttgagaccactttgttcccactgctgtcctcaacaccagtggacttgataaagtatgatctaccctttcctgcctagagtcatctcagccccttctccctgggtccttgctaggaccttgtgttttcactcttactggttttcttggccattcagtcatccagaaaatatctactgtctgctccctagatatcagtgcctctgcagatagagtgagtcccactttgcctctctgggggctcacagtcacatttatctccttagagcccctctcacttcaaccccctgggtttgtgtcctaaatcggttctgaggatatgctgatggtttcctgtctactgtttccacagctggataaaaaagttatcagccaaattgcaatgaacgatgaaaaagcgaaaaacaagagtcttgtcaagatttggtgcaaaacttttaccaacaaggtacgtttccaagaatattcccggggcggggagtgaacctttgcatctgaacatgaaactaaatcttgccttcaaggaaggtaaatagaaagtcaggggaaagaaatattgggagtccctgaaaaatcaaaagtgaccagtgaatgcctttagaaaacaagtccttgaatgaatgccaaatgcaggtaaacagtaggacagacagactcccttttgccccatcccagggatacattatttctggtttgttatttccatgcctcttggagaaggcttagctctgcctgccgctctgttctcatttttggagagacttgtggaagtagtccagcacgccctacgggtgttggcagcaagtgtcctctctcttactttccagacttttccagagtattccccctgctcgggcccagagcattcatgccctctgtcaggaacctacccaggctgctttgcacctgggttgtggcttgcccttgcttctggggtgtacatgtattttttttgtggggtgctaaagactggagactagaataaacaaagtagatgtttttaaatgatgaaggctgatttcagttgtcctcagttattctaagatttctaataaaggtgagaaataagtcttcaagagaaaagaactgttctgttggggccatactgcatgcaccatgggtggtgtctgcgcctgttcattcccacccccgccattgcctcccattccccactaaaagccagtgttgtgggcatttgtcatgtttgtcatccagacccagattaacgtcactgttccctcgactgctaactgcacctccccttccctctgttggacggatggcatccaaaactggaccatgaagaatgtgacctacaaggagaacatcgccaaatgtgagtggagctcagtggattggccactatgacaggtgttgtctgggggtgacctatttatccgtgtgaagtcccagtaagtgaaggaaaggacagtaggagtcaccaagcacctgccctacatcaagcagtgagcaacatgctttcacagcagaggaaactatggcttaggaactgaggtgacaggcctgaggtcccacagcaagggcagaactggaacttgaagtccatttcctttgccagctccacaccacctcagaaaagctcaacagattctagaggattccctctacatgctttgttcagattcctttagtcaataactctaggggccaggcatggtgtctcaaggctataatcccagcactttggggaggccgagatgggctggtcacttgaagccaggagtttgagaccagcctggccaacatggtgaaaccctgtttctactaaaaataatacaaaaaaagtaggcatggtggctcaagcctataattccagccaagattgcaccactacactccagcctgggcaacagggagatagtctgtctcaaaataaaataactttagggagacgacaacccgatttgaaggaagatgtgggacccacatagaacagatgtattcactcaattagtccctactgtacagcaggccccatttcagggcactggggctgtagctcttgaacgggcagtgagcttgcatgatgctctgattattaagaagctgtaatgttttttccaacccagccatccttcgttattctaattactccttacatatacttttgtatatctctgcttctctcttctcaccctcccaccacattaattctgagcactatatcttaatactctaggtatgattaccccaaagaatcaagttaacttaccacctcccacattctaggcactatacattcattcatataaccatgttttgctgggattatctgggggatgcagaaggggctttataattagcaatgccccttactttgacttgcccatcgaatccctcaaagcatacttatcattagtaaaaaaaaaaaattagaccatcgacagcatggtctttagagacagaactgggctgagtctacccctgaacagttgtgtgatttttaaagccatcacttcatcttccagcctcatgcgatcccactgattatgacatagtttcagtggtgccccttgctgcgaaggaggctgagaagggctgtcttgatttggggctgccatctgttaaactaacaaccaggaatctgtttgtaggaaagacaggatctgggggaataaataacaatctgtagccgtggtggctccatgccctcctgacaagattctttgtggtctttcaggccagcatatctttgtgaatttccacctcccggatcttgctgtgggcaccatcttgctcatactctccctgctggtcctctgtggttgcctgatcatgattgtcaagatcctgggctctgtgctcaaggggcaggtcgccactgtcatcaagaagaccatcaacactggtaggtacactgccctcacttgtaggccttgagggatggtcactgcatggggtgtgggggtcctttagattcccatctagcaatggcctctgcatggagtttctctctcagattggatcagcaccagaagtgaggatgtcattcacctggaaatgttcttggcatcctgggtggggtctagggagcaggcccaagtttccattgcatcttggcaaggtcctgagcaggagttcatatctagagagctgtgagtcaggccttccttcttagcgggtttcctgtatgctcagagctttactggctctgtcaagaccccttagaaaaaggaccccaggtgtctgccctcgcccccacctcccttcactcttgtaaaggaaatgtgatgcataaatacatcagcatctagaggtggccaatgagactgctggctaagaggatttcctgccaagtagggtgtcctggccaatgagagctcgctaagccaatgacatcatcacttcatgaaagctcagtgaaatatagccaagaaaattcgccccccaccccagattgtcttggggaacagagcaactctgggtgcttctgggaaatgcagggcctgatccggtgctagttgggtggaggactcagttggcaggcatgttccaagctgctacagtttcttgatgctctttaaggcagaaatgaaggttgaaggtcaaatgtgggtgctgacaggagaccagggcaggcgaggaagcatgctctcagcactttctggaaggagagtggttacttgggtgggttcactctttctaacctgacctccagggaatctgtgtttttgttttcataacacttacctgtatccttggtttttccatctgaatatgcggagcaaaagacaatggggaatgaaactggattctaaaactctactctgtaatctgagaccatatatgggatgatgtacaacctcacccctaagcccagcccctaccccaggccaccaggccataccttccccggagaggccatgacatctcttccttctgtcttccagatttcccctttccctttgcatggttgactggctacctggccatcctcgtcggggcaggcatgaccttcatcgtacagagcagctctgtgttcacgtcggccttgacccccctgattggtgagttacaccctggcttctccctctggccaccactgccatttcctgtcatcccatggggctgatatgtttgtgttttgtgtttcccccaggaatcggcgtgataaccattgagagggcttatccactcacgctgggctccaacatcggcaccaccaccaccgccatcctggccgccttagccagccctggcaatgcattgaggagttcactccaggtcaggacttggggcacggggacaggggccctgggagtgggaccacccatggtcttgcaaactggtctctaacaagagccaggcttttctctgtactatccaaaatatggaactaatatgtggaggggaagccacgggtaaagttttcaggaccttgatatgagaacaatcaaaactatcagttctgagagaagcagtaagaccctcataactggtggttgtttcagcaaaagtggggtggccccttgatatagatgtggaaaaggtacttaggaagcacagacaccacctcccatctcctcactgcctcctatggggaactttacaattaggagaactccttggcatggaccatctatgttactttgtgcaagacctttgggatttgaatttatttatttatttttattttatttttttgagacagagtctcgcactgtagcccaggctggagtgcagtgatacaatctccactcactgcaacctccacctcccaggttcaagtgattttcctgcctcagcctcccgagcagctgggattacaggcacctgccaccacacctggctgattttttgtatttttagtagagacggggtttccctatgttggccaggctggtcttgaactctggacctcatgatgtgcttgccttggcctcccaaagtgctgggattacaggcgtgagccactgcacccagccggggatttgaattcttatctcaccatttacatactaagtgacctttggcaagtgatctaacctgagcgtcaattccctcatctgaaagatggaggacataacccctatctcattaggattattataaagatctgatgaggcaaagccatctgtgcaacagaaatagaaattcaggcatctaatataaattaaccgcatatgtcatcctaaaattttttagtagatacatttttaaaagtagaaacaggctgattcattcttcaataatgtatttgatctaaaccattatcactttaatatgtcatctgtcaaaaattgagagtctttgaaatctggtgtgtatttcatacttaaagcacatctcagtgtggacatgcggctagtgtattggacagtgctggtccacagcctgggcatggaaattggcaccttgggaaagtgaccaagcgcctggcctctggagccaggctcccaggatgtgaatttccacctcttccatctcccacctgtgggacttgaggagcctccattttctcatgtcaagaaataatggttgccactctgtagagtgttttttgagaattgagataatgcacagttgagtgctcctggccctcccagacacatagtaggtcctcatggaatccaggtaccctctgggctgagccataaggacaaagaaggcctggaaggcccgagactgtgctgcctgtgatgcctgctagcttacctccccctcctcctccctactgccacccgcattgggcaacaggcccctcacctgtccaacctcttgtgttgcagatcgccctgtgccactttttcttcaacatctccggcatcttgctgtggtacccgatcccgttcactcgcctgcccatccgcatggccaaggggctgggcaacatctctgccaagtatcgctggttcgccgtcttctacctgatcatcttcttcttcctgatcccgctgacggtgtttggcctctcgctggccggctggcgggtgctggttggtgtcggggttcccgtcgtcttcatcatcatcctggtactgtgcctccgactcctgcagtctcgctgcccacgcgtcctgccgaagaaactccagaactggaacttcctgccgctgtggatgcgctcgctgaagccctgggatgccgtcgtctccaagttcaccggctgcttccagatgcgctgctgctgctgctgccgcgtgtgctgccgcgcgtgctgcttgctgtgtgactgccccaagtgctgccgctgcagcaagtgctgcgaggacttggaggaggcgcaggaggggcaggatgtccctgtcaaggctcctgagacctttgataacataaccattagcagagaggctcagggtgaggtccctgcctcggactcaaagaccgaatgcacggccttgtaggggacgccccagattgtcagggatggggggatggtccttgagttttgcatgctctcctccctcccacttctgcaccctttcaccacctcgaggagatttgctccccattagcgaatgaaattgatgcagtcctacctaactcgattccctttggcttggtgggtaggcctgcagggcacttttattccaacccctggtcactcagtaatcttttactccaggaaggcacaggatggtacctaaagagaattagagaatgaacctggcgggacggatgtctaatcctgcacctagctgggttggtcagtagaacctattttcagactcaaaaaccatcttcagaaagaaaaggcccagggaaggaatgtatgagaggctctcccagatgaggaagtgtactctctatgactatcaagctcaggcctctccctttttttaaaccaaagtctggcaaccaagagcagcagctccatggcctccttgccccagatcagcctgggtcaggggacatagtgtcattgtttggaaactgcagaccacaaggtgtgggtctatcccacttcctagtgctccccacattccccatcagggcttcctcacgtggacaggtgtgctagtccaggcagttcacttgcagtttccttgtcctcatgcttcggggatgggagccacgcctgaactagagttcaggctggatacatgtgctcacctgctgctcttgtcttcctaagagacagagagtggggcagatggaggagaagaaagtgaggaatgagtagcatagcattctgccaaaagggccccagattcttaatttagcaaactaagaagcccaattcaaaagcattgtggctaaagtctaacgctcctctcttggtcagataacaaaagccctccctgttggatcttttgaaataaaacgtgcaagttatccaggctcgtagcctgcatgctgccaccttgaatcccagggagtatctgcacctggaatagctctccacccctctctgcctccttactttctgtgcaagatgacttcctgggttaacttccttctttccatccacccacccactggaatctctttccaaacatttttccattttcccacagatgggctttgattagctgtcctctctccatgcctgcaaagctccagatttttggggaaagctgtacccaactggactgcccagtgaactgggatcattgagtacagtcgagcacacgtgtgtgcatgggtcaaaggggtgtgttccttctcatcctagatgccttctctgtgccttccacagcctcctgcctgattacaccactgcccccgccccaccctcagccatcccaattcttcctggccagtgcgctccagccttatctaggaaaggaggagtgggtgtagccgtgcagcaagattggggcctcccccatcccagcttctccaccatcccagcaagtcaggatatcagacaatcctcccctgaccctcccccttgtagatatcaattcccaaacagagccaaatactctatatctatagtcacagccctgtacagcatttttcataagttatatagtaaatggtctgcatgatttgtgcttctagtgctctcatttggaaatgaggcaggcttcttctatgaaatgtaaagaaagaaaccactttgtatattttgtaataccacctctgtggccatgcctgccccgcccactctgtatatatgtaagttaaacccgggcaggggctgtggccgtctttgtactctggtgatttttaaaaattgaatctttgtacttgcattgattgtataataattttgagaccaggtctcgctgtgttgctcaggctggtctcaaactcctgagatcaagcaatccgcccacctcagcctcccaaagtgctgagatcacaggcgtgagccaccaccaggcctgattgtaatttttttttttttttttttactggttatgggaagggagaaataaaatcatcaaacccaaaaggagtgtgttgtttttaattacagggaaatagggacctccttggatctattttataaaaatgtgaggtctccttttacctcgttgcactgctaggagcaagatgggtcaccagcagctgtactggagccacccaaaaaaa

SEQ ID NO: 17266 - DNA, 31035 bp, Human; identical to SEQ ID NO: 12272

SEQ ID NO: 17267 - DNA, 49559 bp, Human; identical to SEQ ID NO: 12892

SEQ ID NO: 17268 - DNA, 119032 bp, Human; identical to SEQ ID NO: 12160
  misc_feature (1)...(119032): n = A,T,C or G

SEQ ID NO: 17269 - DNA, 41199 bp, Human
  misc_feature (1)...(41199): n = A,T,C or G
ctactccttaaccccaagcctctttatgacatccatccaggaccagctctgctttcctgttgaaggtctcaagagacttgccttcctcctctcggtagctgccagtactcttaccatttcatgagttttcccccaagcttggctgtgaaatgtgatacctattagcttccgcagcacctttctcccaacttccttgctatacctgatgacaactcttcaggcctcttatattcctaggatcttgctattaatcactatagggataagtaaaagtaatatatacaaaataattgcataacagaataatatagggcagttacatagaatgattcttgctgtttaatcctggaaaatgtgatccccgaggattcacattttaatttctgctctttatttctgaggatggagtcaccgttttccccttctggctacacatttagatgcatttcaggtctgatgatagttgcaatgtaaaaaagaatagcaaggcctttggtttctgtagacaatttggaccagataacttccagactgggtaatatccggtttattagtgttactggatgggaagtcttgactgagttgtctgggtttttggcgtgttgaacaaagaattgaacaaaacgtagaaacaaagcaacaaaagaagcaacgaaagacaaaacaacaaaagaacgaagtaacaaaagcacaaatttattgaagcgaaccaagtgcttcaagagtcccaattgcagtgttcttaagggttactaggctaaaagaatttggtaaatccctaggtgccctttacagtcgtccaattggttgcaccctatgaaggattggcctgcgaccaatcagaggctgaaatggagatggccgaggacaatcagaggcgatgtggaaacttctgtcttgtaatcacaggagtgaaggtgtggcctgtatgctgcctagtcttgcctagaaattgctgcacctgctgttcttttgcttatgccttaacccttggttaccctaattccctattctcttgcctcattaggtctttaccctgactaaaaatgcactcatctagctgggacaaatcctacactgcatttgtcccatctagatgagtattctagcagagtacatggcacatgagtaggcattcaaaaattcaacatacagtacattttgttacctatgtgccaggtgtcgggcaggctgagttaacagctgaacagaaacctacctacccaacgtgctaacttctatacagcatggtcgtgcatccaaatcaaatggaaagcggtatgggagatctggaaaggcctcctgtgggtggcatctgactacctaaattcccatcccagtttcacttactgactttgacacttggaacaagcagcctctcagtgcctgttttcccactggcaggtaaatgggctaatgacggtatttctggcactagacttcgttaattaatgaaaagcacatagaagaaaacagcctggctctctaagtgggcagtgcgattcccaaggacggcacttcgcctgatagtcttcctctaggctgagaagccagagtaaatccatttgattttcctaccacacagtgccttctccccagatgagttcaaagctttaagtctatccagttctgtccagacgcgtctgttcatctccaacaggcccactagagaggcgggttttccaaagcctggcacggcccactgcaggtgacgccctctgccctccagcgccctcaggcctctggggtccacccttcctccccacccgactccggaacctcttcccgcgccctgcccgggcgcctggctgcttggggtagaggccttccgccacacgcgcggccccgccccggccttcacgtgacctggcgtgcggagcgcgcacgcgggaacccgcgctggaggcgggcgagggccgaggggcagctagggagcgcggcttgaggagggcggggccgccccgcaggcccgccagtgtcctcagctgcctccgcgcgccaaagtcaaaccccgacacccgccggcgggccggtgagctcactagctgacccggcaggtcaggatctggcttagcggcgccgcgagctccagtgcgcgcacccgtggccgcctcccagccctctttgccggacgagctctgggccgccacaagactaaggaatggccaccccgcccaagagaagctgcccgtctttctcagccagctctgaggggacccgcatcaagaaaatctccatcgaagggaacatcggtaaggagcctccggaaatgtgggacgcaaggctggggtgtcgcggcagtggctgaagcttcccttcgccgcatctctctgcagcaactcggtgagggctttccctccagcctggcggtgtggacgcggcctcggcttcctttcccacccagagcatccttcccttacctcccgctccacggggtgactgcggtccccggggtcagactgggcgccaggcctgcggtctctgtgaggcgcgctttgaacctctgctccctctttgttgggaactcgcaaagggaagcgggggaagggtattagatttcttgaggtgtaacttacattaaattcaccctttttaggtgtactcttctatgaggtttgacaaacattatgccttttgctatcaccatgatcgagatacagaacattttcatcaccttagaaagttcctacctgctcctttgtattcagccccctccacccttcctattccctggcacccactgatttgatttctatccctgcaagtgttgccttttccagaatgccatataaatggaatcataggctatatcgccttttgtgtctggcgtctttcatttagcataatgcttttgaaattcattcatgttacttgtgtctgtagtttgtttctttttattgctgagtagtattccattgcatggatgtaccatcgtttatccattttctagttgtggacctcagggttgtttacagttttttagctatattattagcgaagcattgttttagctatattattaacgaaactcgaaacattcgagtacaagcaaagaggtctttaatgatcttaatagcatggagttcctcaccccttactccacatccaagtaaacattggattatgattcaaagaccactaacgtttctgttaactcagatggggggcagactaggccatgcctgtcactttgcaagatacacaccaacgtccgattcttctgtatctccaaccacaggaaacctacccctgaaacttcctgttttgatagatttaaaaaaaaatttttttagctccaggttgggtgctggtcattcatgcatacagcaaattttttaaaattcttaccacattcaaagcactgtaccttcttgaaaaaggccaggcaagcagatgctttaagcattcaaatgaatagaaaaactgcattctcaaagaggacttcttatttcattgctccagaattaaagcaccagtagaaagaccatatgatataattagcaatgtaagttatttgagggtgcatgtttactagtatggaatctctgacagctgcttactgaataaagaagaccatatataaagacaggagaaagtggctgaacaaagccatctgaaaagtaaatttgaggcagggcatggaggctcatacttgtaatcccaggatttggggaggcttaggcaagaggatcacttgagtccaggagttccagatcagcctgggcaacatagtgagaactcatctccacaaaaaaattaaaaaattagttgcatgtgttggtgtgcctccagctactcaggaggctgaggcaggaggattgcttgagcccaaagatcaaggccacagtgagccatgatcacactactgcactctagcctgggtgacagagcaagactctgttaaaaacacagaaacaaaacagtaaagttgaatgaataacccctcggatcaataccacaatacattcatcccctttccctctctccaatccagttaggtagcatcatatttagaaatatttcctcaaagcatctttaatcttttcagcagctgaaataatttcctaatatatcatcccatctccagtttctcttaactacttctgcaacggtctttttgtatgcaaatgtcatgtgttatcccctgcttaaaattcttcactgattttgcctttacctacactgaaagtagttgtgaactgatagcctgcaattgcacaatattggcctgcacaggttgaaaaaaaattttactggccagtggctcaagcttgtaatcccagtgctttgggaggctgaggcaggaggattgcttgaggccaggagtttgagactagcatggcaacatagtgagaactagtctctaagaaaaataaaaataaaattaggccaggcacagtggatcacgcctgtagctccaactactcaggcggctgatgctgatgtgggaggatcacttgaatgtgggaggcagaagttgcagtgagctgagatggcaccactgcaccccagcctgggtgacagagtctcaaaaaaaaaaaaaagccagttgtgttagcatgcacgtttagtcctagctactcaggaggctgaggtggagatctttgagacctatagtttgaggctgccgtgagctgtggttgtgccactgccctacagcctgggctacagagtgagaccctgtgtctaaagaaaaaaaaattaaatttgttgctaactcgaaaacgttttgagatttcccataaacaattagattcttggcttcttttgaaaaatctgaagatctgttaacaccgggcctgcatttctgtatgacaacaattggtgtttagatggagcatgttccttgccatttttcgtctccctgacactgagactttgttagttactgttcattattggtcttgcacttttgttcatgtctccttcaccttatttgccagatccaaataagctgtaaatgcacaaattgttaagctgtgcgtaaactattttgcaattcctctatttttcctagaatttgaactttacttggtcgttttagttttatatttatataacccatcttcttatgttctgtgttactcaaatgttcccttatgttagattgatggaggacttacctgcttctcatcttaatagtctgttcagaatgactttcagcattataatgcctgcttggcattaggaattctgttagtttccatgactttttaaagtattaacatcagtgtctttggttcttgttctcctttgccttcatagaaaattaatttattaactagcttattttctagctcccactttgccccaataagttaaggaactagatgtgttagtgtgattgggaactctagctgttattactctgcttgaactaaatgtaactgttattactcttagactttttaagtatgaccatatgaatttttctgcttgtaagcagtgtcagaagaaagttgaatgctgtagccttaagtgctttcagactctggtggatgcctaatttttttatttgttccttgggtgctatttctgaacatcatgttctcctttccctcttccatctagctcagtgaatgtggggtgttctttctatatgctttcacttccacttaacattcttctaaatgctgtacagtccctaagcttacactctccatactaaattttggtggccagtgtttttaccatgattaaatctcactgttatccagtttatcgttaaaagtttttctcctctcctctggatacagtttactttgtgtttttcttctaaactgtctacctgtgtcaccttctttactgcctcgctcctgttttttctctgtgtgtaattctttaaagttcttccaggtttttcttcttttctattgccctgtctaatgtcctagatttaaatatagttctgcaagtcaaaggtaagttctttctactccccatggatctaatttataaggaagaggaagctttgcttgtaagtatattgaagttatttatatgttcatctgtgtgtgtgtgcacgcacacacagggaaagagagagaacattatgctaaccagagatgtctaatacaaccacatttggtgacttcagatataaagggtgtggtggccattaggagtattacttctaggtcaagactgtccctactattaaatataatatattgttaaactaaacgtaataaaaaacaaatgtgcttaatgaaattgggcagggagccttttcattttcttctaaagaaatatgaagagaaagtttagaaagttgaatgttttgggctttttatgttgcttgctattgtaaatcttgcaaaagctaatgactacttgacatctttttttcctgacaacttttcttcctcaattttatctttcctcacaacagctgcagggaagtcaacatttgtgaatatccttaaacaattgtgtgaagattgggaagtggttcctgaacctgttgccagatggtgcaatgttcaaagtactcaagatgaatttgaggtatgaaaataaaatttaagtagataaaagcctcttggtttagaggagcagtagtacttaatctctttttctttttctttttcaataaaactttcaaatctcgctttaggtatgtatcttcatctaggtggtggttacatggatatatatacagttggctctccatatcaatgggtttcggattgatatggattcaaccaatcatgaatagaaaatattcagaaagaaataatacaaaaaaatacaaataataaaggattactgttcatatagcatttacattgtattaagtattataagtaatctagagatgatttatactatttgggaggatatatgcagatactacaccattttacataaaggacttgagtatatgtggatgttggtatctgtgtggaacctggaatcaattcttgaggttactgaggggtgactatatgtttaaacatgcattgaggccggggttggtggctcacgcttgtaatcccagcactttgggaggctgaggcgggcggatcacttgaggtgaggagttcaagaccagcctcgttaacatggtgaaatgccgtctctactaaaaatacaaaacttagctgaacgtggtggtgggcacctgaattccacctacttgtaaagccgaggtaggagaatttcttgaacccaggcagcggaggttgcagtgagctgagatggcgccactgtgctccagcctgggtgacagaatgagacactgtctcaacaaaaaaaaaaaaaggaaagtaaaatttatcaaactatgcattcaagatttatgcactttaagtaaagtataaaagttttctttttcataaaaatttctttttttgttgttatcctttaagttctgggatacatgtgcagaacgtgcaggtttgttatgtagatatacacatgccatggtggtttgctgcacccgtcaacccgtcatctacattaggtatttctcctaatgctaacccttcccttgcctcctaccccaccgacaggccctggtgtgtgatgttcccctccctgtgcccatgtgttctcattgttcaactcccacttacaagttagaacatgcggtgtttggtttcctgttcctgtgttagcttgctgagattgatggtttccagcttcatccatgtccctgcaaaggttatgaactcattcttttattatggctgcatagtattctttggtgtatatgtgccacattttgtttatccagtctatcattgatgggcatttgggttggttccaagtctttgctattgtgaatagcgctggagtaaacatacatatgcatgtgtctttatggtagaataatttataatcctttgggtatatacccagtaatgggatggctgggtcaaatggtatttctggttctagatccttgaggaatcgccacactatcttccacagtggttgaactaatttacactcccactaacagtgtaaaagcattcctatttctccacatcctctccagcatctgttgtttcctgactttttaatgatcaccattctaactggtgtgagatggtatctcattgtgggtttggtttgcatttctctaatgactggtgatgatgagctttttttcatgtttgttggctgcataaatgtcttcttttgaaaagtgtctgttcatatcatttgcccactttctgattgggttgtttgtttttttttcttgtaaatttgtttaagttccttgtagattttggatattagccctttgtctgatgggtagattgcaaaaattttctcccattttgtaggttgcctgtttacttggatgatagtttcttttactgtgcagaagctccttagtttaattagatcccatttgtcagttttggcttttgttaacactgcttttggtgttttagtcatgaagtctttgctcatgcctatgtcctgaatggtattgcctatgttttcttcagagtttttatgattttaggtcttatgtttaaatctttaatccatcttgaattaatttttgtataaggtgtaaggaaggggtccagtttccgttttctgcatatggctagccagttttcccagcaccatttattaaatagggaatcctttccccattgcttgtttttgtcaggtttgtcaaagatcagatggttgtagacgtgtggtattatttctgagggctctgttctgttccattggtctatagctctgttttggtacaataccatgccgttttggttactgtagccttgtagtatagtttgaagtcaggtagcgtgaggcctcaagccttgttctttttgcttaggattgtcttggctatacgggctcttttttggttccatatgaaatttaaggtagttttttctaattctgtgaagaaagtcaatggtagcttgatgggaatagcattgaatctgtaaattactttgggcagtatggccattttcacaatattgatttttcctatctatgagcatggaatgttttaccatttgtttgtgtcctctcttctttccttgagcagtggtttgtagttctccttgaagaggtccttcacatccgttgtaagttgtattcctaggtattttattctctttgtagcaattgtgaatgggaattcactcatgatttggttctctgtctgttagtggtgtataggaatgcttgtgatttttgcccattgattttgtatcctgagactttactgaagttgcttgtcaccataagggattatgggctgagatgatggggttttctaaatatacagtcatcatctgcaaacagagataatttgacttcccctcttcctatctgaatcccctttatttctttctcttgcctgattgccctggccagaccttccaatactatgttgaataggagaggtgagagagggcatccttatcctgtgccgatttttgaagggaatggtatcggctgtgggtttgtcataaatagctcttattttgagatacatttcatcaatacctagtttattgagagtttttagcatgaagggatgttgaattttattgaaggccttttttgcatctattgagataatcatgcggtttttgtcattggttctgtttatgtgatagattatgttttattgatttgagtatgttgaaccagccctgcatcccagggatgaagccgacttgatcgtggtagatgagctttttaatgtgctactggattcggtttgccagtattttattgaggattttcgcatcgatgttcatcagggatattggcctgacattttcttttttttgttgtgtctctgccaggtttttgtattagggtgatgctggcctcaaaaaatgagttagggaggagtccctctttttctattgtttggaagtttcagaaggaatagtaccagttcctctttctacctgtggtagaattcagctgtgaatccatctggtcctgggcttttttttggttggtaggatattattgcctcaatttcagaactttttattggtctgttcattaaaccagagttcttcctggtttaatcttgggagggcgtatgtgtccaggagtttatccatttcttccagattttctagtttatttgcgtggaggtgtttatagtgttctctgatggtagtttgtatttctgtgggatcagtggtgatcctttattgtgtctatttgattcttcccgcttttcttctttattattctggctagtggtctatctattttgttaatcttttcgaagaaccagcttctggattcattgattttttgaagagtttttcgtgtctctatctccttcagttctgctctgatcttagttatttcttgtgttctgctagcttttgaatttgtttgctcttgcttctctagttcttttaattgtgatgttagggtgtcgattttagatctttcctgctttctcatgtgggcacttagtgctataaatttccctctaaacactactttagctgtgtcccagagattgtggtacgttatgtctttgttctcattggttgcaaagaacttatttatttctgccctaatttcgttatttacccggtagtcattcaggagttgttcagtttccatgtagttgtgcagttttgagtgagtttcttaatcctgagttctaatttgattgcactgtggtctgacagactgttatgatttccattcttttgcatttgctgaggaatgttttacttccaattatgtggtcaattttagagtaagtgcactgtggtactgagaataatgtatattctgttgatttggggtggagagttctgtagatgtctttcaggtctgcttggtccagagctgagttcaagtcctgaatatccttgttaattttctgtcttgttgatctaatattgacagtggggtgttaaagtctcccactgttattatgtgggagtctaggtctctttgtgggtttctaagaacttgcattttgaatctgggtgctcctgtattgggtgcatatctatttaggatagttagctcttgttgttgcattgaaccctttaccattatgtaatgccctttgtctttttttcatgcttattgatttaaagtctgttttatctgagactaggattgcaacccctgccttttttttgctttccatttgcttggtaaatcttcctccatccctttattttgagcctttgtgtgtctttgcatgtgagatgcgactcctgaataccgcacactgatgggtcttaactctgtctaatttgccactctgtgtctttcaactggggcatttagcccatttacatttaaggttaatattgttatgtgtgaatttgatcctgttattatgatgctagctggttattttgcctgttagttgatgcagtttcttcatagtgtcgatggtctttacattttggtatgtttttgcagtggctggtaccggtttttcctttccatatttaatgcttccttcaggagctcttgtaaggcaggccttgtggtgataaaatccctctacatttgcctgtctgtaaaggattttatttctccttcacttatgaagcttagtttgactggttatgaaattctgggttgaaaattcttttctttaagaatgttgaatgttagtccccactctcttctggcttgtagggtttctgccgagagatctgctgttagtctgatgggcttccctttgtgggtaacccgacctttctctctggctgcgcttaacattttttccctcattttaaccttggtgaatctgacgattatgtgtcttggcgttgctcttctcaagggcatctttgtgatgttttctgtatttcctggatttgaatgttggcctgtcttgctaggttggggaagttctcctggataataatcctgaaatgtgttttccaacttggttccattcgtcagtttcaggtataccagtcaaacgtaggtttggtcttttcacatagtcccatatttcttgggaggctttgtttgttccttttcattctgttttctctaatcttatcttcacgctttatttttattaagtttttcttcaatctctgatatcctttcttccacttaatcgattcggctattgatacttgtgtatgcttcaccaagttctcatgctgtgtttttcagctccatcaggtcatttatgttcttctgtaaactggttattctagttagcagttcctgtaaccgtttatcaaggttcttagttccttgcattgggttagaacgtgctgctttagctcagtggagtttgttattaacccaccttctgaggcctacttctgtcaattcgtcacacttattctccatccagctttgttctcttgctggcgaggagttgtggtcctttggaggagaaaagacattctggtttttggaatttttagcttttttgcactggcttttcttcatctttgtggatttatctacctttggtctttgatgttggtgaacttcagatggggtttttgcgtggttgtcctttttgttgatgttgatgctattgctttttgtttgttagtttccttctaacagtcaggcccctctgctgcaagtctgctggagtttgctggaggtccactccagatcctgtttgcctgggtatcaccagcggaggctgcagaacagcaaagattgctgcctgctccttcctcaggaagctttgtcccagaggggcacctgccagaggctagccagagctctcttatatgaggtgtctgccgacccctgctgggagctgtgtcctagtcaggaggcatgggggtcatggacccacttgaggatgctgcctgtcctttagcagagcttgagcgctgcgctgggagttccactgctctcttcagagccagcaggcaggattgtttaagtctgctgaggctgcactcacagccacgccttcccccagatgctctgtcccagggagatgggagtttgatctgtaagtccctgacgggggctgctgcctttctttcagagatgccctgcccagagaggaggaatctagagaggcagtctagcttcaggggtttgccaagctgtggtgggctctgcccagcttgaacttccaggtggttttgtttacactgtgaggggaaaaccacctactgaagtctcagtaatggcgggcacccctccccccaccaagcttcagtgtctcaggttgacttcagactgctgtgctggcagtgagaatttcaagccagtggatcttagcttgctgggctccgtgggggtgggatctgctgagcaagaccacttggctccctggcttcagcccccttggctccctggcttcagccccctttctaggggagtgaacggttctgtctcgctggcattccaggcaccactggggtatgaaaaaaaactcctgcagctaactccgtgtctgcccaaatggctgtccagttttgtgcttgaaacccagggcccttgtgtaggcacccgagggaatctcctggtctgcgggttgtgaagactgtgggaaaaagcctagtatgtgggctggatagcaccatccctcaaggcttcccttggctaggggagggagttcccccacccctttcaccttccaggtgaggcgatgccccaccctgcttctgcttggcctctgtgggctgcacccactgtataaccagtcccaatgagatgaattgggtacttcagtcggaaatgcagaaatcacccgtcttctgcattggtctcactgggagctgcagaccagagctgttcctatttggccatcttgcctgggaatctaaaagtttttaaaaagttaaataataaaagttttaaaaaatctaacagcaaattaaattccttcattgtcttttctaatttttttttttttttgagatggagtttcgcttttgttgcccaggctggagtgcaatggctcgatcttggctcaccacaacctccgcctcccgggttcaagcgattctcctgcctcagcctcccaagtagctgggattacaagcatgggccaccatgcctggctaattttttttactagagatggggtttctccatgttggtcaggctgggcccaaactcctgacctcaggtgatccgcctgcctcagcctcccaaaatgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatggaaaaaaccctgtctccactaaacatacaaaaattagctgggcgtggtggtgggcgcctgtaatcccagctactcaggaggctgaggcgggagaattgcttgaacccgggaggtggaggttgcagtgagccgagatcgcgccattgcactccatctcaaaaaaaaaaaaaacagaaaaaacaaaaacaccaaaaaaaaaaaaaaaaagcaaataagaaaaagaaaaactactattcagtaactgaattttacctttcaagccttttgtcatttactctcatttctttttactttcattcttgccagactttcactctgggcagaagttgtaattttgcagcattttaccgttctgcactgcaaatgaggaagaaagagaatgacagagttcagtgtcatttttttaaataccaaaatgtatggttgtatgtgtgagagagacgttgctaagattttcgtttctggagaaatgagaattgaaattgaaagcaaggccaggtgtggtggtttatgcatgtaatcctggaatttttttttttttaagtgacagcaagtttattaggaaagtaaagcaataaagaatggctactccataggcagagcagccaatcccagcacttcgggaggctgaggccagaggatcgcttgagcccaggagttcaagaccagcctgggcaacatagggtgaccccgtctctacaaaaaatttaaaaattagctaggtgtggtagcctgcacttggggttacagctacttggaaggctgaggttggaggactgcttgagcccaagaaattgagactgtagtgagccatgctcatgccactgtactctagcctgagtgacagcaagaccctgtctaaaagaaaaaaagaaattgaaagcagtaaggcagaaaccttaaaaatggaaatgtatgctagcaacttactttgatctgaggagtacagaaaattgaaaaaaaagtatctaaaaaaatttagctgttggtataaggaattctgggaataataattgaatatttaaaatgtaaatcacatatgcaaagaggaatcactagcaagatattccatggactttgagaatatatggttttgaataaccaaaaatactttttcatacaccttctatttgccaggcatagctaactttagacctagggcctaattcagtacaccccaatccttaggatatccaggactaaatcttaaaggggctttcttcccatatagacctcattatcttaagaaattgatgttttatatctgatttttggggaaaggcaaggttagtctacagtagaattttaaagtgggtaaatttgtttatttgattctttttaaaaacatttttgacatgatatatctgtagaaaagtaggtaaaagctaatgtacagtttgaagaacagttttaaagttgacatctttataaccattatccaggtcaagaaatacgacatcatcattccagaaatccctgttcgccttctccaatcactatatcttctttcctacgttactactccgctaggggtaattactcccattcttttgtgataataattttcctgcttcctaaaaattgtttgagcatacatgaacatacctctaagtataatttagttttgtctatttttgaatgttatataagtggaattacattgtttgccttttttcctctcgcttcttttacttaatacatttatgaaatttgtccatattatatgcagctgtagcttattttcagctatatagtattgaattttgttttttaaaaatattcttttttttgagacaggatttcactctgttgcccaggtaaagtgcagtggcgcagccatggttcactgcagcctcaacctcccttggctcaggtgatcctctctcctcagcctcctgagtatctaggaccataggccaccacgcctgtgtgccaccaggcttggctaatttttgtattttttatagagacggggttttgccatgttacccaggctggtttcaaactcctgggctcaagcgatctgcccatctcagcctcccagagtgttgggattacaggcttgagccactatgtggggcctatagtatttaattttattcgtctatcactgtttgtccattttatacctttaattgatttttgagtgatttccaatttagttgcttatgtaaacagcattgctgtgaacataaattcacccgcatacatgcaaaagtttctgtaggaataagaagtaaaattactgggaatgcttatgatgcctgttttccaaactggctttccaattttctctccccccagtgtaatcaagctctcattaatctatgtctttgccagcatttagtagtgtctggctttctcatttttgtcattctgctgagtgtttactatttttttgtttaatttgtatttccccgctggctaatgaggctgtgttccttttcatatgtttattagtcattttgatttttgcaaagtgcccacttgggtccttttgcccattttcctctgagccatctgtcttctctcactgcatttttaatgtagcttttcgctgaagtacctactcaagtttgcttagcttttgaaggagagactggagttctaaaagcaactctttttccttttatttctggggtcagctgtcagtgcagttatcctcaggtggtagacagaaactaaccagattaaaccaatgttggaaaatagagggtattcttaaacagggtattggactaggtgacctccatttaaggtccgttgacatatttgtcatttgactctcagcatgcctcacattaaccaagggcacagaaactgacatataaaaccaaaatgccaaaaattttaatttgcagaaagaaatgtaatcattaaggtaattgaatttagatcagtttattctttatttggttcgtaattctcaaccagtggaaggaagtcataagaatgtctgagagctaaacagtttgaacacatggagatagagtgtggaaaaatagataacaataactgggaagggtaagaggaggggaagatgaagaggagtgagttaaagtgtacagatatacaggaagcttgaagaaataattcagtgttttatagcaaggtagaatggaaaaatacattgtactcaggtgatggacaccctgaatgattcgattactgcatattatatacatgtacaaaatttctcatgtattccataatttgtacacacaagaaagaatctcaaggattcgggtgctttttaaaataacaatcccttggaggttcaaatatgtgggatgcctcatagttaaaagtcatcaccctagtgaatcactgttaactgttgggagtatactgaactctttagttaggttgcagagaagttgaaaaacattgctttcgtatataagacaagacaatttataataaggttgtctgttgagcttggaatcagagcccagagggattagttaaatcatgttaatcagactgtgtcatcagactgtgatgcattaatacatttgtcttcattttaagacttaatggctttctgaatctgatatccatgtttatgggatggggcattttctttccatatacttgattcagaatgccaaactggccattctttataactagcatgcaggtgatcctattattattaacatattcttttatcaggccgtttattgtaatctggtcatgtcttcatgatgttacaatttgattacctttgttagagtttggtgcacattcttggaaggtagcttcagcttttttgtgtgtattggggactgctccgttgttaattctctgtacttctgtacagagggggtagtatttttgagatatagttgtggaatatgaggatggttgggtgggtggcttccctgtatctttggatattttcttccactaaactcaagaagtgagattttatttcttcatccagtagtccttcttccccagactcatccttgatctattccttgaggttatagtatgaatcacccactattcaaatgtcaatttttcttagaatgctgttagtgatgagaagtgactgttttcagacctaaccttggcaaggtcagtcctactttgatgttcttgtttcatcacacttcttggcatttgtagatttggaagaattgggcctttggtacctctgatctcttcgtttagcaacttactgtgcacccatatgcttagcttttgctgttttagctttttttttttttttttaacctgccacctagtggccgaaatgttgctatactattgataaggtactcctaattttggcaaaatagtaagaggcaaagcaccaaagattatgttctctcccttctccaaatctctcttggtgagaatgatctttaaaacataccactcagattattagcaatcttggtatggaacgtttttaaaaataataataatgtactttatgtggtgatttatgttattatttaggcccaaagttttgatttaattgtttccttttagcttatttttgagatatgcagtctgttaggaagctgtctctgtcttgttttttcattgagctgaattcttttggaggatcactattattgtgaagtactattttacttttaattaaaaaaattaagatatttttatttttaatttacagataaaaattatatttaattttatattatatttatatataaatcatatgtaatataaattatatacataagttatatataatataaaaattatatacataatataaattatatataatataaaaattatatttatggtatgcaacatgatgttttaaaatatgtctacattgtggaatggttaaaccaagctaattaacatacgcattacccgtactattttacttttatccaatacttcttaccactaataagccactgaaaaactagtaattgtgataaagaaggtgtaaaccatacttatttatgacagaacagcatattttttacttttaataagtcattctttttttttttttttgagacggagtctcgttctgtcgctcaggctgaagtgcagtggtgtgatgttggctcactgcaacctctgcctcccaggttcaagcgattttcctgccttagccttccaagtagctggagctgggattacaggcatgtgccaccacgcctggctaatttttgtaattttagtagagatggggtttcaccatgttggccaggctggtcttgaactcctgacctcaagtgatccacccatctcagcctcccaaagggctgggattacaggtgtgaggtctcttttttttttttttttttttttttaagacggagtcttgctctgtcccttagtaagtcattcttgaaaattagttaagaatgcttgataaagcacttccacttgtaccttttgaatagatgtgataacttttgttggcttgtatttttttgagtcttgctttattgcccaggctggagtgcaatggtgaacctcagcccactgcagcctccgcctcctgggctcaagtgatcctcccacctcagcctcctcagtagctgggactacaggcccacgccaacatgcccggctaatttttgtattttttatagcgataggattttgccaatgttgtctggttttgtctcaaactcctgggatcaagcaatccgcctgcctcggcctcccaaagtgctagaattaggcatatgagtcaccatgcctggcctgttggctattttataattatcttgtttggtagactctgatcttttacagttgaacttaattcaactcttttgcaatgtttacaaagattagacctagaattaaaagataaatgattttatagctgaccttgatatttctatttttcacttaccttgacaataatctgtacttcctataacaatgaagtattctttcataaagtgaaaatggacatatattatagagaacagaataaatgttattcataatcctaccactctgtatgtatcttttacatagttgaattaataatgtaatatattaaattttggtggaggtgatatgtaatttaaaaaatattataaagtaatacctgtttactgtttgaagttaaggaaatattagaaattatcaaaagaggggactaaaacttacctataaccttattatccagagataaccatagatcttacttgaaagaacagtatacagttttgtattttgtttcttccccaccccccacaatatttatatgtcaagagtctgagatccaactgcaaggcggcagtgaggctgggggaggggcgcccaccattgctgaggcttgggtaggtaaacaaagtgggctggaagctggaactgggtggagcccaccgctgctcaaggaggcctgcctgcctctgtagactccacctctgggggcagggcatagctgaacaaaaggcagtagaaacctctgcggacttaaatgtccctgtctgacagctttgaagagagtagtggttctctcagcacggagtttgagatctgagaacggacagactgcctctgcaagtgggtccctgacccccgaatagcctaactgagaggcaccccccagtagggggagactgacacctcatacggctgggtacccctctgagacgaagcttccagaggaacgatcaggcagcaacaattgctgttcagcagtattcgctgttctgcagcctccgctgctgatacccaggcaaacagggtctggagtggacctccagcaaactccaacagaccagcagctgagggtcctggctgttagaaggaaaactaacaaacagaaaggacatccacaccaaaaccccatctgtacgtcaccatcatcaaagaccaaaggtagataaaaccacaaagatagggaaaaacagagcagaaaagctgaaaattctaaaaatcagagcgcctctcacctccaaaggaacacagctcctcgccagcaacggaacaaagctggacggagaatgactttgacgaattgagagaagaaggcttcagataatcaaacttctccgagctaaaggaggaagttcgaacccattgcaaagaagctaaaaaccttgaaaaaagacgaatggctaactagaataaccagtgtagagaagtccttaagtgacctgatggagctgaaaaccatggcacgagaactacatgacgaatgcacaagcttcagtagccgattcaatcaactggaagaaagggtatcagtgattgaagatcaaatgaatgaaatgaagtgagaagagaagtttagagaaaaaagagtaaaaagaaatgaacaaaacctccaagaaatatgggactatgtgaaaagaccaaatctgcgtctgattggtgtacctgaaagtgatggggagaatggaaccaagttggaaaacacacttcaggatattatccaggagaacttccccaatctagcaaggcaggccaacattcaaattcaggaaatacagagaacaccacaaagatactcctcgagaagagcaactccaagacacataattgtcagattcaccaaagttgaaatgaagggaaaaatgttaatggcagccagagagaaaggtcgggttacccacaaagggaagcccatcagactaacagtggatctcgcggcagaaacgctacaagccaggagagagtgggggccaatattcaacattcttaaagaaacgaattttcaacccagaatatcatatccagccaaactaagcttcataagtgaaggagaaataaaatcctttacagacaagcaaatgctgagagattttatcaccaccaggcctgccctacaagagctccggaaggaagcactaaacatagaaaggaacaagcggtaccagccactgcaaaaacatgccaaattgtaaagaccatcaaggctaggaggaaactgcatcaactaatgagcaaaataaccagctaacatcataatgacaggatcaaattcacacataacaatattaaccttaaatgtaaatgggctaaatactccaattgaaagacacagactggaaaattggataattggataaagactcaagacccatcagtgtgctgtattcaggagacccatctcatgtgcagagacatacataggctcaaaataaagggatgtatgaagatctaccaagcaaatggaaaacaaaaaaaaggcaggtgttgtaatcctagtctctgataaaacagtctttaaaccaacaaagatcaaaagagacaaagaaggccattacataatggtaaagggatcaatacaacaacaagagctaactatcctaaatatatatgcacccaatacaggagcacccagattcataaagcaagtccttagagacctacaaagagacttagactcccacacaataataatgggagactttaacaccccactgtcgacattagacagatgaacgagacagaaagttaacaaggatatccaggaattgagctcagctctgtaccaagcggacctaaaagacatctacagaactctccaccccaaatcaacagaatatacattcttctcagcaccacatcgcacttattccaaaattgaccacatagttggaagtaaagcactcttcagaaaatgtaaaagaacagaaattataaaaaactgtctctcagaccacagtgcaatcgaactagaactcaggattaagaaacttactcaaaaccgctcaactacatggaagctgaataacctgctcctgaatgactactgggtacataacgaaatgaaggcagaaataaagatgttctttgaaaccaatgagaacaaagacacaacataccagaatctctgggacacatttaaagcagtgtgtagagggaaatttatagcactaaatgcccacaagataaagcaggagagatctaaaattgacaccctaacatcacaattaaaagaactagagaagcaagagtaaacacattccaaagctagcagaaggcaagaaataactaagatcagagcagaacggaaggaaatagagacacaaaaaacccttcaaaaaatcaatgaatccaggagctggttttttgaaaagatcaacaaaattgatagaccgctagcaagactaataaagaagaaaacagagaagaatcaaatagactcaataaaaaatgacaaagggagtatcaccactgatcccacagaaatacaaactaccatcacagaatactataaacacctctacaaacacctctacgcaaataaactagaaaatctagaagaaatggataaattcctggacacatacactgtcacaagactaaaccaggaagaagttgaatccctgattaaacccataacaagctctggaattgaggcaatagttaagagcctgccatccaaaaaaagtccaggaccagatggattcacagccgaattctaccagcagtacaaggaggagctggtaccattccttctgaaactattccaatcaatagaaaaagagggaatcctccctaactcattttatgaggccagtatcattctgataccaaagcctggcagagacacaacaaaaaaagagaattttagaccaatatccctgatgaacatcgatgcaaaaatcctcagtagaatactggcaaactgaatccagcagcacatcaaaaagcttatccaccatgatcaattgtgcttcatccctgggatgcaaggctggttcagcatacgcaaatcaataaacataatccagcatataaacagaaccaaagacaaaaaccacatgattatctcaatagatgcagaaaaggcctttgacaaaactcaacaacccttatgctaaaaactctcaataaattaggtattggtgggatgtatctcaaaataataggagctatttatgacaaacccacagccaatatcacactgaatgggcaaaaactggaaacattccctttgaaaactggcacaagacacggatgccctctctcaccactcctattcaacatagtgttggaagttctggccagggtaatcaggtagtagaaggaaataaagggtattcaattaggaaaagaggaagtcaaattgtccctgtttgcagatgacatgattgtatatttagaaaaccccatcgtctcagcccaaaatctccttaagctgataagcaacttcagcaaagtttcaggatacaaagtcaatgtgcaaaaatcacaagcattcttatacaccaataacagacaaacagagagccaaatcatgagtgaactcccattcacagttgcttcaaagagaataaaatacctaggaatccaacttacaagggatgtgaaggacctcttcaaggagaactacaaaccactgctcaatgaaacaaaagaggacacaaacaaatggaagaacatttcatgctcgtggataggaagaatcaatatcgtgaaaatggccatactgcccaaggtaatttatagattcaatgccatccccatcaagctaccaatgactttcttcacagaattggaaaaaactactttaaagttcataaggaaccaaaaaagagcccgcattgccaggtaaatcctaagccaaaagaacaaagctggaggcatcacgctacctgacttcaaactatactacaaggctacagtaaccaaaacagcatggtactggtaccaaaacagagatatagaccaatggaacagaccagagccctcagaaataataccacacatctacaaccatctgatctttgacaaacctgagaaaaacaagaaatggggaaaggattccctatttaataaacggtgctggaaaaatggctagccatatgtagaaagctgaaactggatcccttccttacaccttatacaaaaattaattcaagatggattaaagacttaaatgttagacctaaaaccataaaaaccctagaagaaaacctaggcaatactatttgggacataggcatgggcaaggacttcatgtctaaaacaccaaaagcaatggcaacaaaagccaacattgacaaatgggatctaattaaactcaagagcttctgcacagcaaaagaaactaccatcagagtgaacaggcaacctacagaatgggagaaaatttttgcaatctactcatctgacaaagggctaatatctagaatctacaatgaactcaaacaaatttacaagaaaaaaacaaccccatcaaaaagtgggcaaaggatatgaacagacacttttcaaaagaagacatttatgcagccaacagacacatgaaaaaatgctcatcatcactggccatcagagaaatgcaaatcaaaaccacaatgagataccctctcacaccagttagaatggtgatcattaaaaagtcaggagacaacaggtgctgcagaggatgtggagaaatgggaacacttttccactgttggtgggactgtaaactagttcaaccatgtgtaagacagtgtggtgattcctcaaggatctagaactagaaataccatttgacccagccaccccattagtgggtatatacccaaaggattataaatcatgctgctatacagacacatgcacacatatgtttattgcggcactgttcacaatagcaaagacttggaaccaacccagatgtccatcagtaatagactggattaagaaaatgtggcacatatacaccatggaatactatgcagccataaaaaaggatgagttaatgtcctttgtagggacatagatgaagctggaaaccatcattctcagcaaactgtcgcagggaaaaaaaacaaaacactgcatgttctcactcataggtgggaattgaacaatgagaactcttggacacaggaatgtgaacatcacacactggggcctgttgtggggtggggggaggggggagggatagcattaggagaaatacctaatgtaaatggcgagttaatgggtgcagtacaccaacatggcacatgtatacatatgtaacaaacctgcacgttgtgcacatgtacccaagaacttaaagtataaaaaaaaaatttatatatcagggcaattaaaatcgttgttaaaaatttactgtaaatgatttttaacagcagcctaatttattgtatgcatgtactattatttacttaatataaatgcctaataatagtggaatgataacctattcgcttagccttgtgataaatacctttgtggttaaatttgtattctagattatttctttttttttttttttttttgagacggagtctcgctctgtctcccaggctggagtgcagtggcgccatctcaacttgctgcaagctccgcctcccaggttcacatcattcttgtgcctcagcctcccgagtagctgagactacaggcgcctgccaccatgccccgctattttttttggtatttttagtagagacagggtttcaccgtgttagccaggatggtctcgatctcctgaccttgtgatccacccgccttggcctcccaaagtgctaggatcacaggcgtgagccactgcgcccggcctagattatttctttaaagtaaattttcaacagtggaattaattgggccaaaaggtacaggttttttttttcccacaaatgtagctaaactgctttctatctaaccatgttctaccaatttgtatttaatgtagtttcactctgacacattcatattttttatctggatagtttgcagaggggagaacttgataaaattaacattcagtttggtaaagatgatgcacagtattttttagattttttttttttttttttttttgagacaagagtcttgctctgttacccaggctggagtgcagtggcacaatcttggctcactgcagcctccacctcccaggcataagcaattctcccacctcaacctccggagtagctgggattacaggtgcacgccaccatacctggctaatttttgtattttttgtagagacagggtttcgccatgttgcccaggctggtctggaactcctgagcttaagtgatccgcctgcctcggactcccaaagtgctgggattacaggcctgagctgcctcacctggctggataaatttttaatattcttaacatttataattgcatacaaaaaaccctagcaatttgtctcaaatttcacgcataggatcaaaagaaaatgttttatatgactcataagttatcctgaggaaccagataatgataccctggcttactgttaattttctaatttgttacactattaaactaagagacaataacatcttcatagctgaaaattctatttcagatttttgattcagtttgaatttacatatttgtatttttagaactagtttattatttttttgttaggtgatgaatcaagattggttctctaagttattttaatatagtaaactttgaaattgctttgggcaagagagattatatttattgagaaattaaaataaaaggaggtatgtggtcttttttagttaatttttttgttgtggcaaaaatataaaatttatcatctgaaccatttttaagtatacagctcagtagtattataagcatatttaggtcattatgaacagatctccagaactttagcctcctgaaaagatccagagacccctggagcttctcctactatactttgaagaacctctatcttagagaatatattacttcatctggaaaagacagactcacagagaactctagaaatatagtcttttaaaacatatcatctaaaagattaataattctttttatcatcttatccggtctgtgttcatatttccccattgtctaataatgttttcgtaattttttgaaattaggagccaaaccaggttcacacacgttacatttggtggttgatataccttttattttttttttaaatttatttttctgagatgaagtcttgctctgtcacccaggctgaagtacagtgcatgatctcagctcacggcaacttctgcctccccagttcaagtgattctcctgtctcagcctcccgagtagctaggattacaggcgcgtgccaccacgcctggctaattttttatatttttggtagagacagggtttcaccatgttggccaagctggtcttgaactcctgatctcaggtgatctgcctgcctcggcctcccaaagtgttgggattacaggcgtgaaccactgggcctgcccttgatatgccttttaaattttaatctattgattgtctctttgtttataatttatttgttgaagaaacagggtcatttgttctacataattttcctcattctggttttggctgagtgtatctctggtaaaatttaacatgtttttcagttctctgtatttccagtaaatttataggtagagacaggcttgattagatttactttcaattcttttttggcaagattcctagttggtgatgtgtatttctttacatcaagaagatgtgttttgtgatgttaaaatcaaacagattagctgttgtcagattgattcatccgttgtaaaattcccaattaacttttctctaatgatagcatctattgctaattgttgcctcattgcagtatattagtaggtgttgtaaaaggtgatattccttctccagccttctgaatttattggctgggattcttcaggaaagaagacctcttcctcatataccactttattaccctgaaagtatttatacaggaaaggccaaaataaaatgggactttttttttctttttacctacatattcccagaataattaatttgtgccttaggagcctcaaaacatgactagagttttgtttgtttgtttagaattataaactcatggatttttgcctcccattcattttcgatgttcaaattattctttctttgaccagtggcagcttatttatgttggctcctttgtccttggcacaatcccagtggtctgtagtagtttcctaaaatatacaagatgaagctcatcttgtatattttcttccccagatttagaatcagaattctaattcctttcagtgggaaatggtatttagagattataatctgggtgatatttttgtatattcctacaatgttgtcattgtttataggccttttgatggacagaactaggaaaactttatagaaagagaaaaataattcatgtgttccagatgctatttctttttttttttttttttttgagacggagtctcgctctgtcgcccaggctggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctgctatttctaactcagataaaagatgataagagtttttacttcattttaaaatttacatttgtatttttcctcaacatgtaaaatgtggttctaacaataagattattgaattgcaaaatctggggcaggaactattgtattatattagaagattggagggttacaaatacaaatgcctaaaggggccagacagccaaatgaatatatcaggcctgttatgaaaatcatccgggaatggtggggattaataagccagagagcatatatcccatctaaaggaggcatctgtgacttgattctagctgatttttgccaagagggaatatgggcatggtactgcttggttttttcatttttaaaaagaagacgtaatccctgcactttgggaggccaaggcaggcagatcatgaggtcaggagatggagaccatcctggctaacacggtgaaaccccgtctctactaaaaatgtaaaaaattagttgggcatggtggcacgcgcctgtagtcccagctacttgggaggctgaggcgggagaattgcttgaacctggtaggtggaggttgcagtgagctgagatcgtgccactgcactccagctggggcaacagagcaagactccatctcaaaaaagaaaaaaaagaagatgtaaatccaaatattttatgtgaaattatttagcttttaaatattgacaatactattgacaaactaagtcaaagttttaaaaaggacttttggaccaaacaatgatttcttccataggttattagtttgtaacctcttgtgagaaagatctaaggattttccagacctcagacaatctgaaaaatatattgggaaagagtatgagaaagggaacttaatcatcttggttttgctgatcatgattacatttatttatctgacttttattttttagccttaaaaattaaaatagccctattgaccattaattttgctttttatttctttttgcacattcaaaataggaacttacaatgtctcagaaaaatggtgggaatgttcttcagatgatgtatgagaaacctgaacgatggtcttttaccttccaaacatatgcctgtctcagtcgaataagagctcagcttgcctctctgaatggcaagctcaaagatgcagagaaacctgtattattttttgaacgatctgtgtatagtgacaggtatgtataaatggcttgtacgtggccatttgaagtttttatcttagaactggactttttttttttttttaatgtttcctgggaattagtaataatgaatggctgagctggggatttaagatggaaaatgacatttaaatccctcagcagtctggtactaatggcattagggaagttattgcatttataatcctcagcttccatagaaactgttgggaatatggtggtgcccatttcatttaaatttgcagagaagttgtttttccctctaacccttttaaaattctcatctgctctggttaaatctggatctatatcctagactcttacctggatcaagaagataaaagtctctaaggggccttagaattgccctacttatgctaggattcttttgacctccaaagttagctcagaacagaggttctcaaacatttgatctcagggcccttttcaattcttaataactatcgaggtgtccaaagagcatgtcctattgatacttaacattactagaaattaagatgcacaaaaatgatttaaaattagcaataataaattcattacatattaatataaatacatttgacaaaaagttatattttctaaaataaaaagtagctagaagaatatcattgctttacatttttgcagatatctttaatgcctcacttattaaaagacagctggatttttatttatgcttctgtatttaatctgttatggtatgtttgtttgtttgaagtatattggtatatgaagtaatctggcctctcacagaaccccttagaagatcttggggacttaatggggtcctcactccgtattttgagaaccattggccaaaaacatgatggaaagactcttgtctttttctgctttccacggcactatgtgccactggatttaggagaatgtttcatgttcctgttctcttttttatttctttgttgtttttttttgaaatgatacatgtgttgatgaagactctcttttaggtatatttttgcatctaatttgtatgaatctgaatgcatgaatgagacagagtggacaatttatcaagactggcatgactggatgaataaccaatttggccaaagccttgaattggatggaatcatttatcttcaagccactccagaggtaaaacccaataaaaatgtgtttcactgaaaatttaaagaaatatttagaactcttttcagtggtatataatgagggcaatttagtttaactccagcctcccaacctcccactccccacctctaaattagaaacttgtaactgtgtagatagaagcattcttttttctcagcaaactggaatcccagactgggcaagttgctgttttaggctctttgtgcttcctcaattcttttttattttactcattatttctttctaacatttgcagactcttctcattcatcacagttaaagtaatgaatgtggtcaagcaactcctagaatataggcttcatgaggtgggaccttgggcattttgattactattgaatttccattgcctagaacacccagtgctgggcactgttggagcatatagtaggagctcagtaaatatttactgaatgaatggcaatgttgatggaggtccatatcaagaaatattttattatggttgtttgtgccttggaatgagtggataatggcagctatcgttgggaaaagacttagaggacccttgccattttccattaagggagctcacttgaaaaggtgctttttgtgataggttgtaacatagctattctagttacatatgatgttatataatgaatacaggatgaccaaatagatgcctttcataaaactaacctaaatattaagatcttacatttaatcagaagctttctggttttggtgcgtgcatttctattgtttctgttttttaattctcattttttccttaagtcacagggtaggcactgatgaatgtaaatgttatgacttctggcctaaaattagaatactgtgttgctgtcgaagctgggttttcaaagaaattaggtttcctattccaacggatgattttgttcttcattaagtaaagattttgttcttcattaagcaaggatttagcaattttttagcaatttcaaaagtgaattttgaaattcacttttatttttgaatttttttgtttttaattacaaaaatagtaaataaaaatgtgaaaaagaacataaggaatatgaataatttcattttgcttgaaacatttatagtcactattaagctagaatttagcaaatataataattttgaaattcacttttatttttgaaaaggtttcttaaagttatgaaaatagtacaaacaccaaaaacataaataatactaataatttcattttgatactgataatttcatcagtattgtttctgatatctttggatgaaaggattgtttaattattgaaaagagaatttagagtagagtttgaaacacagtttgtatgctgccatggtcttatgcatgtcatttaggttggaggcttttatttcttggaatgcatgaagagtttctcatggtatatgagcccccacaaattatacgaaattttttatgtatgtgtgcttttgggggaccgttatctagagctgcactgtccaatgtggctatttaaatttagggttattaaaattaaataaaatttagatatttagttccttggtcaccacactagccatatttcaagtgcttaaaaaccacaggtggctggtggctaccttatttgataatgcagatataggacaggcataaaacattccaaagttgttttggttgtgctgatatagagttttcatcacattaagaaccactgtctttagtggttttatgtgaactgaacatagatattttgtaatcaaggttggttaacagcaaagtaagattatgtttatagattggcataccttttagctgttgtctctgaacattttaagtagatgtttaatttttttctcctttttatcaaacttagtatatttcatgtgtggatggataccaaaaatttataggcttatttttgaaagtactgcttggcttagagccaccaagtggctgaaaagctcatggagggaaaaatgaattatttcagcttttaagaagtaataagtagagattttggctagcgtgagtagagagacacagaaaagaaaattttgatggcagcagacaagaataattgttccctgcctttttcttccatctcttattacttgcttttagacatgcttacatagaatatatttacggggaagaaatgaagagcaaggcattcctcttgaatatttagagaagcttcattataaacatgaaagctggctcctgcataggacactgaagtaagacttatttttatttactattcattttaaatacctttgttacctttgttaaattttaatctaaaatttggaagatatgactagcaatatgtaaaatttccagtcgttttgcttattggtatcttccagaactaggtatagattttcattctcttgattgcaatgagatcctatttacttaaagtttttataactagtatcccttggtggtattgatagcgtaatatgtgaaatttcactttaagtgataaagtaggaatatatctgaacattatttaggtactctttcagaaagaattttgacttgggagattgtatagcgtggttgttgagaggatagactttgttattagtcagatcttggctcaagtccagtcttactggcgtgtgaccttggatagcctctgagcttcagaatgacaattctgagctttagttttctcatctttaaaaatgcagaaattcctactttattgactgctacttgtttttgaagagaatcatatgttacagtacccagctgtatatattttgtacctaagtttttgggctccatatggtaaatctagatgagaaagaaggggctgccagatgaagtactgcaaagtaactttagtgtaaatgattgacaacattttgattttccaaggacatacgaatgaatttttaatgtttctctcttttttttgttgaatttctgattattttattaatctctctttttaaacagaaccaacttcgattatcttcaagaggtgcctatcttaacactggatgttaatgaagactttaaagacaaatatgaaagtctggttgaaaaggtagatttagacagactacaaacaaatatttgttttttcttaaaaagtgtactgagtggtgagaaaacaattttctaacagaaaagcttccataaagttacattaagaaacagttaagagctttagaagattttggactgtttaagattccagtcctgactaaattctagctttgtggcctgagctaaaataaagatccttcggaatctcagaatctgacagatcttagaaaaaaattaaataaataaaaataaaataaggatttttttttatcctttagtgcctctatctgtaggataggtaaaattataataacaaaaattctttctcaccccctttttctctgctttgtccccatttcttcctctcttccctacaccaccaatctttagatactttaataataaactgcttgtgaaattaaatttatctttttcaactaaattcaatatggaggatatttaaagttacaggatatggatctcatctatttttatgttggccaaagtcttgagattaagggattttagttttgagtttcatttgggatcatgtcaaggattaattgacattacttaatcattgagtcattgtcttaatcacagttcatttattgcccaaatcactgggagttgactgtattctgttaagtgagtggtgcccatattgataaagggaatgggtgagaatttattgatgaatatttgagagagaatagtaagggaattggtataacaaatatccctatacccatgttgataactgagtgattaagctataaagaagaaagcacaatttggtttagttttgagaaaaatttgatttttcctttcttttgtggcataatgtctgctgtttaatagagacttgacattcataagggatatatcaaggattttgaaaatcttgacattttatgtaactactgtagcgtatacatgtagttgtttttcccatggtatgaactaaagcttatctggaaaattccaatgacctcttcatactactaatgatgttaaaaatataggataaattcacttacaatactattaaatgaaaagtcagcattaagtattaacagccaaccatcaatttaactgactttgtaaatcactttttaattttatctaacacttctttgttttgactaagaatcatttcacattattatatttacttttattaataatgctagcagttgactttcttattaaggtatttttacaaggcaataatttttgtttcttgagaattattgagtagcctagaatatgtagagaacaagcatattcttacattatggtcagtaggctaggttcattgactccttacatgattttctgcacacactgacattgcaaagtatgtgattcacatatgtgcttcagaaacatgacaaatctactacatgtttgattttcaaagttgcttgaactattgtgcttattaatgttatcagtgttaaagctgcatatgtcagtggtctatgatatttaaatgaagagattataaaattggtgttacagctattttagaactatatctatcttagattgatagatgcagtggctcacacctgtaatcccagcactttgggaggctgaggtgggaagactgcttgagcccaggagttcctgaccagcttgggcaacatagtgagacctcatctctataaaaaacaaacaaaaactagccagacatgatggtgtgcacctagccaggagttcaaggctgcagtgagctttgattgcaccactgtactcagcctgggtgacagagcaataaataactcctaaaatgaccttttaggtcattcatcttttactactgaagtatttaacaatatttcttttttttttttctcgagacagtcttgctccgtcgcccaggctggagtgcaatggcacaatcttggctcactgccatctccacctcccaggttcaaccagttctgcctcagcctcctaagtaggtgggattacaagtgcacgcctccatgcctagctaattttttttttttttttgagacggagttttgctcttgttgcccaggctggagtgcgatggcgcgatctcagctcaccacaacctctgcttcccaggtttaagcgattcttctgccttggcctccctagtagctgggattacaggcatgtgccactatgcccggctaattttgtatttttagtagagaaggggtttctccatgttggtcaggcaggtctcgaactcctgaccgcaggtgatctgcccgcctcggcctcccaaagtgctgggattataggcatgagccactgcgcctggcctatttttgtgtttttagtagagatggggggtttcaccatgttggccaggctggtctgaaactcctgaccttaagtgatccacccatctcggcctcccaaaatgctagaattacaggcatgagccgctgcgcccggccttaacaatatttctttggaaagtaaatgcaatggcattgtggtagttacttatacagctggggtcttcaactattatatacttttaaatgaagatgaatattagatacctcaaattagtcaaggaattatactgatttttttttcttcctttcctcaggtcaaagagtttttgagtactttgtgatcttgctgaagactacaggcagccaaatggttccagatacttcagctttgtgtatcttcgtaacttcatattaatataagtttctttagaaaacccaagtttttaatcgtttttgttttaaggaaaaaagatttttaaaatgaatcttatgcaaaactttttgatcagtttcttttcttttgttttttttttaaaaaagacatttaaagacaaagacattatttctcatagcaggaaatgtagaggtagatggttccagtatcagcatagtgactaaactacattataaaagatccagcttccttctgtcattcccctcttttgtcttcctcagcaggttggcttttttccctggtgcctctcacttcgttggtgaccagtttcttaaactgaaagctttaatgttacatagtaaatggtagtgtgtcctgtgtaaattagtgtacctattaaaagttgcaaagtggaattaaaggaatccctagaataaggattctgaagttttattttaaattattatcttcttaacagtttagtcccacctcttacttcctgcctcagtctgctttctctactgtctggattaattaggcagcctgctataaagttaaagtcacacatttctattttgcaaacactgtgattactctttgctttgtagtttgctttgctttgtagggttctgcttttaagtttttctctttttcagacaaattactgataaaaatgatattgctctatatgtaatatatcctgaaagcattattttttgttgaataggaaataaaattaatgaagacagaggctagaaagcatccattaattaatgagacacacttaactacttatctctaaaccatctatgtgaatatttgtaaaaataatgaatggactcatcttagttctgtatataaatatattttctttctagtttgtttagttaaggtgtgcagtgtttttcctgtgtattaaacctttccattttacgttttagaaaattttatgtattttaaaataaggggaagagtcattttcacttttaaactactatttttctttccaagtcatttttgtttttggtttcttattcaaagatgataatttagtggattaaccagtccagacgcactgatctttgcaaaggagacttaatttcaaatctgtaattaccatacataaactgtctcattatacgtatgcatttttttagtttgtttttgtttggtataaattaatttgttaattaaatatttcttaagtataaaccttatgaactacagtggagctacactcattgaaatgtaatttcagttctaaaaagatgtaataatcattttagaattaaaatttattctacttttaaataaattatgaatattaaaggtgaaaattgtataaattactttgattccattttaagtggagacatatttcagtgatttttagtaacctttaaaaatgtataatgacttttaaaatttgtagaattgaaaagacgctaataaaaatttattatttatttgtcatgactcaaaagttgtctcagtgtggtggtcataatagaattgagcctaatggtggtctggattatctcttggatctattacctatatcatgtcttccattagaatttatatattgctctttatagtttgctctcctagaaaggtaattaataatacaagacttatttttctcatccagaattttctcttctgctatgcctaaaacttgaaacttataccgagccacctagaacttaagtctgtcatatgttaaagaacagagttgtaaaatgtttctaaaatagagatatagatgttattgcctttgaaaaatgctagatacattgcaacattaagtctggtaaataatagccttcttcatttgactaacttacctcttcttttaattttttttttttttttgttttgagagagggtcttgttctgttgcctaggccggagtacagtggcgcagttatagtttactgtagtcttaaactcctgggctcaagcaatactgcctcagccacttaagtagctgggactacagggctttcaccaccatgatggctaattttttaaaattattttttgtatagatggcgtattgttgtccagtctggtctcaaactcctgggctcaagtgatcatcctgccttggcctcccaaagcgctgggattacaggcacgagccattgtgccctgcgctaaaagctttttttgaaatagctttagactcataaaagttgcaagaatattacagagttcctgtttacctgtcactcagttatttcccaatgataactttatttaacaataatattttatcaaaacaattaaatttggtgtactgctattaactaaactacagacctaatttggattttaccagttttatgtcttactttaattcataaactttaaagcatctttggctggctcttttttcggactcagcccgcctgcacccagatgaaatagccttgttgctcacacaaagcctgtttggtggtttcttcacacggacgcgagagacatttggtgccaaagacccgagtcagagggactccttcgggagaccagtcccctgttctcaccctcactctgtgaagagatgcacctaccaccttgggtcctcagaccaaccagcccaaggaacatctcaccaatttcaaatccggtaagcggtcttttcactctcttctccagcctgtctcgtcaatctccctgtccttccaattccagttctttttcctctctagtagagacaaaggagacacattttatccatggacccaaaactccggcgcctgtcatggactcaggaagacagtcttcccttggtgtttaatcactgtggggacgcctgactgattattcacccacatttcattggtgtctgatcactgcagggagcctgccttggtgattcacccacattcccttggtggcaagtcaattgcggggacgtctgctttggttgctcacccacattgcagccccgggctgctcgcccacccccttccccgtgtctctacctttctctttaaacttacctccttcactatgggcaaccttccgccctccattcccccttctcccttagcctgtgttctcaagaacttaaaacctcttcaactcacacctgacctaaaacttaaatgccttattttcttctgcagtaccacttggctccaatacaaactcaacagtagttccaggtggccggagaatggcactttcaatttgtctatcctacaagatctagataatttttgttgaaaaatgggcaaatggtctgaggtgcctgatgtctaggcattcttttacacatttgtccctccctagtctctgctcccaatgcgactcatcccaaatccttcttctttctctcctgtctgttccttcagtctccacaccaagctctgagtcctttgaatccttttctgcggactcatctgacctctccccttctacccaggctgctccttgccaggctgtgccaggtcccaat

SEQ ID NO: 17270 - DNA, 12579 bp, Human
  misc_feature (1)...(12579): n = A,T,C or G
taaattagaaaatgtggctgggtgcagtggctcacacctgtaatcctagcagtttgggaggccgaggtgggtggatcacgaggtcaggagatggagaccattctggctaacacagtgaaaccccgtctctactaaaaatacaaaaattagccgggcgtggtggtgggcgcctgtagtcccagctactcaggaggcggaggcaggagaatggcttgaacccgggagacggaggttgcagtgagccgagattgccccactgcactccagcctgggtgacagagggagactccatctcaaaaaaaaaaaaaaaaaagtacaggttcaaatttcattaaattttttttccatgccccttctctggtggtaggatgataggggatgagtaaaatatcaaagacaactaaaaattcctaaactagatcctcgggtcccaaagaagtgttaaccatggagtgccccaccttctgaggttggtgcttcctggcacaggctcttggaacattctggattgtctgacattccttttactcgctttagaacctaaagatgttgctgggggaaaagggagctagggagagggaaggggaaggatgtgggataaggcataaactatgcttgtgggaaaaaaacaaccagtaatttccttgatggggtttttgcttgactttaaaatgcagtaagcttttaggaagcttgatggagcctgtgtttctaccattagtgctgcatttgtttggcttaagatttcattaagcttcttaaaatggagatacttctggaactcaaatggctactgagcagggaatggcaaatcagtgacactgtaggaagtggagggattttggcaaactagagaacacaccttccacaggggcagccactgctctgctgggcccgctgttcatctgcagggacgtgcatcttgggattatttccaaagtcagaactcagcatttttatgagaaatgtcatgatttttaaggtcttaacaagttatcccacattaaaaaaataataataaaccaggccgggtgcagtggctcacgcctgtaatcccaacattttgggaggctgaggtgggtggatcatgaggtcaggcgttcgagaccattatggccaacatggtgaaacactgtctctacttaaaatacaaaaattagctgggcatggtggccggcgcctgtaatcccagctactagggaggctgaggcaggagaatcgcttgaacctgggaggcggaggaggttgcagtgaactgagatcgtacccagcctgggcaacagtgcgaggttccgtctcaaaaaaaaccaaaaaacacaaaaacaaaaaacgacagagaaggccaaacaaaacacatctgtgggctggatgccgccatgcccaccggtttgcgacctttgtgttggactcttctgttcaccagacaccctgccctgcgagaatgtatctcatcctttgctggagcaggtttgcaggcacagtggagagaggagagaagaaatgaagggacacttatgcagaaccatgagtggccagagaggaggagaaggagggtgagaggagcaaagaagccatgacaacttcataattctgagtggactgggcagtggccagaaattctggtggtggatatgctgcctttccaacaggtgaatatgaaagaataagtcaaaccctgttcaggacgctgttaattccaaatgtgaactttttgagtcattctttccatgtggaattcaaaggagaatgtaaacaaattttcaggagggacgtgcaatatccctgaaagataacaaagttcgtaacacttatttacatacaacattctctagttattgattaaacagatctctacagacttgcatgaggcaacatttcttaggcttgtttgctacaatatctttaaaaatacttgattacacatcactttagcttatttagatggacttttcaccaagctctgaactgggatttcattttgttgcattcatcctgctcacgagacacaggtaggcagcaaatgagattatccctccagtccccatggattggaaatgttcccccttctttatgagctcactgcagtatctccttctccctttccccaaaggacagcctttcctgcctcagggaagaagagagagacagactacagtgatggagacccactagatgtgcacaagaggctgccatccagtgctggagaggaccgagccgtgatgctggggtttgccatgatgggcttctcagtcctaatgttcttcttgctcggaacaaccattctaaagccttttatgctcaggtaagaaacagaggaaggaaatctagagtttccaattcagataagatccaggcacagcggtaaaggaggagaggctggctttggtttctcaatctgtgactctctgccatggtctagaaaaagaaaaatacaattcctcttccgctgtcagtgctgggggcagctgggtgtggaggaagaggtggcgagaaggtcaaagatatttccctgcactgcctcctcccatctcataatctatatatacctccaaacacgtaatccacaaattatagtttcttcatttaggtcataaatcctccccttaaaatgttggtattccaagagagagttaaaccttgtatgtgagcacaataaaagttttttgagtctgaattttttgagtttgacagtgtctacctggcacatagtagttgctcaatacatattagtttccttccttttaattaggttctttattcaatatatgtagtgatacagttgacctttgaacaacatgggtttgaacttcgggaatccacttataaatggattttcttctgtgcctgccacccctgagacagtaagatcaatccctcctctttctcctcctcctcagcctactcaacatgaagaggacagggagaggacctttatgatgatccacttccatttagtaaatagtaaacatgttttctcttccttatgattttttttcttcaatttttgttttaagttccggggtacatgtacagaatgtgcaggtttgttacaaaggtaaacgtgtgccatggtggtttgcagcacagatcaacccatcacctgggtattaagcccagcatgcattagctattcttcctgatgctctccctccccctactccactgagaggccccagtgtgtgttgctcccctctaggtgtccatgtgttctcatcattcagctcccacttttaagtgagaacattcagtgtttggttctctgtttctgcattagtttgctgaggataatggcttccagcttcatttcatctatgtccccgcaaatgacatgatcttgttcttccttatgattttctttccttttcttttttctgagacggagtcttgctctgtcgccaggctggagtgcagtggcacgatcttggctcactgcaacctctgcctcccgaattcaagcagttctcctgcctcagcctcctgagtagctgggattacaggcgcctgccaccatgcccactaattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcaggcgatcctcctgcctcagcctcccaagtagctgggaccacaggtgtgtgccaccatacttggctaatttttaaattgttggtagagatgggatccccctatgttgcccaggctggtcgtgaactcctaagctcaagtcatccttctaccttggtctcccaaagtgctgggattacaggcatgagccaccatgcctgaccagtagttaaatttttgaggagtcaaaagttatatgcaaattttcgactgcaggtttgggggtgtggtgttggcatccctaacccctgaattgttcaagggtcaactttagttgctacttattaagtatatgctgtatgctcaatacatactatattttatcctacttaaacctacagcagcccatgatggaagtgttattttagttttcattttataaatgagaaagctgaggctcagaaaggccaagtaacttgcccaagttcacatagccggtaaataatatgcctgtcattctgacgtaagacttgcttcttaatacctaaatgatgtttgctgaaatgaggggaatgggggttctgattagggaaggggaggggctatttaattttgtaggatggcccacacaacatgtggtactctggggccaggtcagttcagggtaaaaggaaggcaaggggtgctttttggacattgctttatttttggacagcccttttttttttggacagccaaagagcaacaggaggcccagggggagtggaagaggaaggcctaggagttcagtgagggaaaggggtcataaaaaaggaagagagtggcctacttctgttatttatgattcatctcctgccattcctaggttaccattgttaggggaaagatgtagaagtcaccatttactatagcacacagtgccactgttggaagaattccagaagaagcttctctctggtattagcaccaggagaagctgtgctgctcctgatcaaccagcttactttcatttaatggacgccaggagtcttgtatctggttgtgtttccttcattgctttggctgctaggaaacccagaggcaactttgtagctcggttctcataactacaagggatcttatggtctgcagattacatgtttgtacctcacttttttttaaacttttttttttaagaagtgggatctcactatgttgtccaggctagtctcaaactcctaggctcaagcgattctcttgtcttggctatacctcacttctgacttcattctgtctttttttcctctttttcatttactccttttcctctcatcatatatatatatatatgcattacatgtctatgtaatttgattgaatgtttgaatgtatgggaatgttgagtaaatgtccgtgtgtgtgcacaggcagatcatttttaaaaatgtgacatatttgggagatggcttgagggtaccttctgcaagctggtaccaaactgttgctcataattaagttttacttttctaagcattcctggaaattatttggttaaattaattaagtgaatgcctaagagtggtgagttctcatctctctcttgccttacatcttgtgccatctcagcgagtagttttgctccataaagggtggtagttaagaagccctgcgtagttcatacctatccccactccctcaacctctcatccctcaatcagatgatggattttgtcacagctgtagccaaatacacacccgatgctattgaaggaacatgcttattttttagccctaaatacatccctggttccacctgaaaggctctgaccggggccttgtgcatgggacagaatgtcccactctattttgaagctttctaaaatctttaaggaaaattcaaatcatactcagttcagtactcggtcaagatttagagagcttaagttctaacagataaaaaagtaactctaaattattatttcaagatgcctagttaaaataaacatataaattaatttagtgaaaaagcaggccagtgctaagtctatgaaataatcttattttccgcttttgtattttcacttgcccagtattttttctttggccatatctagtgatttttataccccagaccttgaggccatgttaaactgcacagtgtgtctcaagtttgttatattaataagggaaaatgattattttggtcaaagagattagtgagagtgcattatgaacctagctaaatattgcttttcgaacattcttacttttttttttttgggacagagtcggcctctgttgccctggctggagtgcagtggcacaatcttggctcactgcaacttctgcctcccgggtttaagcaattctcctgcctcagcctcctatatagctgggattacaggtgccggccaccatgcccagctaatttttgtattttcagtgaagacgtggtttcgccatgttggccaggctggtctcaaactcctggcctcaagtgatctgcccgcctcggcctcccaaagtgctgggattataggcatgagccactgcgcctggccctgcttttcaaacattctgactttagagcttgctaatctaacttattatgtttaaggaaccggtaagtaaacacaggagtccacctatatgtgagtgtgagggtatatgaagagctggtctcatatattcaatcaaagcgtttcctcttcccctcgtttactttgtcttggacttgttttcaaattatttcatacatatacacatgtcctttctcttcaacatcaccacaaggtcttcatggcaggaattttgtctgtcccttctgggatgttttgcatatgtattacatgtgaaaattctcaagaaattttccaagtaaaatttaattcagaccaggagccgtggctcacgcctgtaatcccagcactttgggaggccaaggtgggaggatgacgaggtcaggagttcaaggccagccaggccaatgcggtgaaaccccatctctactaaaaatacaaaaaattagctgggcgtgatggtgcgcacctgtaatcccagctactcaggaggctgaggcaggcgaatcgcttgaaaccagaaggcggaggttgcagtgagccgagattgcaccactccagcctgggcaacaagagcgaaactccatccccccccaaaaaaaattaattcagtacagcacttattaaacatctactcagtgagaagcattctgtttcatgctttgaggaacatacggatgaattggatatagctcttgacctctaggaacttaattgatagcaaaaatatggtaagtattctactgagagattccatgtatgatttgcacttgcctctttggaagtagtgggtatgtggaattgtaccttgttgccagaaattgtgtaggctatgttgaccaacggccctgtagttagactccttccaaaggcacattttcatcaggacaagccagtgcatcttgagatgatgagcatgagaggtgatgagattcctgagtgagggtgaatcttggtggttacagcattatggtaatgctaacactgtttacactgtggttctccaaatacctgcatcttaaatactattaaagattcctgggcctcaagtcagacctaccaaatcagaatttctggaatgaagccctggaatccacagtttaacaaattcttcattctaacaaactcacagatgattctgaagtttgaaaaccactggtgtagtgagaaatatgccagtagggtcatcagaagtgaggtggaacttggcactttgtggctctttaccccaactctgtgtcttccatgctccctgtttattatgtgcctgctgtaaggatcctgcaccacctcaaaatacacaaatgccttgtacacaaatgccttgggcattgtgtacataagctcataaccacaccaaaatgtagaatgaaattttctaataagtgaagaacattttttttttttcaaattgaagcattcagagagaagaatcgacctgcactgccatccacacagatatcatggacgactggctggactgtgccttcacctgtggtgtgcactgccacggtcaggggaagtacccgtgtcttcaggtgtttgtgaacctcagccatccaggtcagaaagctctcctacattataatgaagaggctgtccagataaatcccaaggtattgtaaagtttaaagagttcttatgacagcaacccttccctgccagactgtccctagcagggtacataaataacccagggctgtctttagggataaatctatttttttggagtgaacatttttatagtgatcaaatcaggataaatgaagctttcttcttggtggagaaatggggtatatagaaaggagagaaattattccaatttcacaacttggtgtctggaatttataggctgagccaatgagtagtcatttgtggggagtctttcttttggagattccactccgcgccatatgacatatgctacagtgtactcacagtctcccttgaatcaagtaatttttcttatcaaataaatgtaaagattatttttattttagtaagttacacaatgggttcatatgatttaacgaattatagaaatgatccctgaaatagtctttcatatgatttaaaatttatatttatacctaactataaaagttgagttgtgttagattagttgacatgttacattttattgtctttaagcatcaatttcaatccgatgacttttgttttctgtttgggatgcaatgatttttaagatttcaaacagtttttggcctttagcacagtacctcaagtacctaatggatatggtaataaacctcaagcttttttgaaaaaagtcaccagctgacagagctcccttctccactggttctgtctcccaggaaccaaagtccaggtggggctccctctctgtgagtctagagcaaaagcctcaacgtgcttttcttcagggtgatattttgctacaggagatcaagacagagacaacagaggcattactaagcgttgaaagctcatagtgaggcccaatacatttttgttcaatggacaaacggattcatactgtccaagagtccaagaacctgcatgtagggaggagtcatattccttatgaagttggtcactgactctcctgcaatgtcatataactaagaattctcttccacatccttgcttaatgactggaaatggccatttcactgtggccctccaatcaaccctttcccatgagctatgtaatattttaccaccttctaagattgaaactgcccactaataacttcagcctgaagctatttcataattaaaaactgttaagtatttggtattggtgacagtgcctttatctttttccctcttccatattcctagtgcttttacacacctaagtgccaccaagatagaaatgatttgctcaacagtgctctggacataaaagaattcttcgatcacaaaaatggaacccccttttcatgcttctacagtccagccagccaatctgaagatgtcattcttataaaaaagtatgaccaaatggctatcttccactgtttattttggccttcactgactctgctaggtggtgccctgattgttggcatggtgagattaacacaacacctgtccttactgtgtgaaaaatatagcactgtagtcagagatgaggtaggtggaaaagtaccttatatagaacagcatcagttcaaactgtgcattatgaggaggagcaaaggaagagcagagaaatcttaagacggtggccaaattaaagggctggccttcagatgtctgtgatttctgcaactgaggacctaattatgcctgtctgcaaactaacaatgtaaaacgtaatgattaaagtatcatattttcatgtgggaaaaaatttaaaagcctcattttgtattctatttatttctataaatacatacaaattaaccatcttttctaatctcaatctctttccaaatgagctaaggaagcacttttttcctgtatagcaaaatgagttcaagatattctttgcctaatttcagctctagctagaaccagtcaatatggaaataaacaatgagggtatctaatctactgaacactgaaccatcagcctaactctatgcaatatagtcatactaaaatatttctcataaaaaagttcttaacagtttgttcactatacaaagacaaaaatctggtagaaaacttaagaaaacatggagctaacatatttattatagtttttttttttttcctttttgagatggagttttgctcgtcgcccaggctggagcacagtggcacagtcttggctcactgtgacctctgcctcctgggttcaagcaattctcttgcttcagcttcctaagtagctgggattacaggtgtgcaccaccacgcccagctaatttttgtatttttagtgtagacagggtttcaccatgttggtcaggctggtcttgagctcctgacctcaggtgatttgcccgccttggcctcccaaagtgctgggaatacaggcatgagccactgcgcttggctttagtttgttctttaccagtctagacagcagaggaaagctgctgcctagaaaattcactaagtttagagttactagtatttagccttgtcatgtaccatgtaatttttctttcagtaacatttttctagttaattaagcttttcataagctcatttcactttgtgcactttctggtgggaaaaatgggccagaaatatgaagaagctatactggattttaacattcatctcagatgatccacatcgtattaggctggtgcaaaagtaattccagtttttgctgttaacttttaatggcgaaaaaccgcaattatttttgcatcaacctaatagaaaagaagtcccacatggatagtcaacaattgtctgtactttaattaatgaatcaaccatggttattaaatgatgtcataaggctctcaacaaatgctttccaggttgattaagccgaatctatgagtggaaaagagattttggtctgattttccaaagtgcctcaaagtatctttaaaattttattatactcaaaaatcttaaattatggacagtggaatgagacatttgaagctacttttgtatgtagatgtaatcaaacaaaaaactgattctaagtcagtttaatcccttttagcaattaatttcaagacacatattactaaattagctgaatacagcaatattgacttgatcagtaatgaataatcttggtgttttcctttctagtgtgcaatggtggaaagaacatgtgtctcagagtaggatttatttgactttgtaggccataatcacaactttgggcaaataagctaacctgtgtaaacctttcttttctcatctataaaatggggataacctgttctttcacgcagttattttatagaataagcaaagtagggcatgtgaaacactttagcttagcttctagcatccagtagcggtgctcaaaaatgttagatcatttatgtaacaatctgctaggttataacattcagtgagccttggtacttttcattgaacagctggtatagaggctagggatagggagctgcagttcattttccatgcccctacccgagttctcttggctaaatgtgatacgcatttaaggcccagaacctgctgtttaaaaggttgtggtaaactattttgtataccaaagacttctctgtaataaagtatgtaagtacacatgaacattttatatgcacgcacattttaaatcatctgcacattgagattctacacttttctcaagggcacatctctattccgtttctttgtaaatttgacttctacctaacaatatgcagttgctgggatttttttttccctaacaaattcaaaactgctaatt

SEQ ID NO: 17271 - DNA, 15945 bp, Human
  misc_feature (1)...(15945): n = A,T,C or G
tttagacagcctcgctctgtcaccctggggtacagtgatgctatcatagcttactgcagcttcaaactcctgggctcaggtgatctcccacctaaccccccggattacagctgggattataagcgtgcactggtgcactcggctgagttttgaaactttttgtagagatggggtcttgctgtgttgctcaggctggcctaggcctctcttgaaagatgagaattttggcgatgctgggtgtgcgttctcacctcctgtcgtccgaggagagtacgtggtggccgccttcttaaagggttcttgggagccaagccctgcacagcccctcacctgccttacctggctgtcccctgtaatcagtggacgttgttgcctatcatttagtaatgagaacccagctgtgtaaacctcctaaaccaccacacaggaatctggctcttagcgcacctttcccgaggtgggggttgctcaccacaggacgttctgcaagaaaagtcctaaacatgccctgacggaagctggagccaaagtctgtgtctgtgaattgtttcctgagagaggtttctgggggtgggctgatgtgagaccagggtctagggccttgggaggggatgggtggctggaggacagcgccggggaagggttgctcccctgggatctgccctcatgggactggcaccatgatggtgtcccctcttctggggtccggataagctaggtaaccgtggcttcctcatggggtgcacacccccttccccctataacagccttggctgccacagctttcctgcaaggcagattgggagcaggggtggacacaggttctgagtgtgccctgaccactggcagacccatctccacaggctgacttgccagagaccaccccaagtggaaaattctgggggctgggccagggtggatctagggctcggaggacctggagtatgtaccatctgggggcccttttaaagagagagaacataaaattacatagacacaggcaggtacaggactttgggaggggctcgtgtagtgaggggtcctgagggtgggctgccgttgggtgggcccagggggcatcggggtggccttggttgcacttgccctctgggctttcctgaagagctggggttggctctgtcctgtggagggagagggtgcgggaggctgtcagcaccagcccaggtttctctcacctgaagtcccaggtgtgatgggatgcttgaacataggggaacctaaggccacagccttagaagaagccacagccacatcagtcatccctggtgctgggcaggaggcctgggtgtaggctggagctgaggactgaggctcaccttgctcctgactctgtgcccacaggtagaacacctgaaggagaagctcattagccaggcccaggaagtgagccgactgcgatctgagctggtgaggccacaaggctgtcctggggtagcgcagggcctggcctgccttgtgcagatgggccctgccaggggcaggggtgcgaccctctctctcctgagcccgcacatcccaccctgtctcagaaacacaccgagagccttatccccacctcctagtaccctcagaggccttgtggctccagggggtgggaggttccttctctgttgctgacattaaacgggagtgtgaaccctggtataaatatgtctctccttgtgactttcacactcagaatagggtgggggcagcagggagagcaggctctgggtcaccacccttctcaactctgccctccactgtctttctcttggtttctctcttgagcttgttccctcctctcttgcccttgcctttttctttttctttttctccttccctctgcctttctccacacctctcctctcttccctgcccttgtgccatctccgcgggcctctcttctttcccccgtcatctgccctcgccacatgcgccccctcggccctggctctctgcaggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggtgagcagaatggccgtggtccccatgctggtcctggagggccaccccagctcctcacagtgagcctgtcccttgcactcatccagtgcctcccaatggctgcaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggctcagtcggcgcctgcgtgacagccacgagaccattgccagcctgcgggcccagtccccacctgtcaaggtgagccctggcccacctgatctgtgcctcagcccaaggcccctggcacctggggcagggccagcccataaggggggcttgtcctggtgaataggtaggtgtgtgtgggtggaagaatcattccagttctgtgcttggtcctgccccttccccttcctgtatccagggccaggcaccgagtaggtatccaacagctgaggtgccaggcacagatgcagcgcagcccctggattctgccctcgtctttttgcctttcttgtttgtacccaggatggggccccagccaggctcatagtagcctcttgttaagctgagaaggttccaggagacccccccagctttctggaaagccaggacctcaaggctcctctagtttttttctggtttctgagtgggatgttcccgagagttccttcccctggcctgctgcgtctcaggctcttgggtgaggtacggtgcccgctggctccacgtgccattcctccctcaccctgcagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcaggtacccaggctgtgtgggggcacatgcccagccaggaagccagaggcaggcccttgggccaatgcatcggttaaacatttgggtaccccacagacacggggtccagtccctcctctccccgatggccacgggacccagggcaagttttgtctggtttccttttcctcatctattataacacgatctggtcccagaacccacctcacagtggggactcaggaacgtcatcccaagaagctttgtgcccacggcccagcacacaggctgtgctcagtaagctctacatggcacttgtcactgtcatcacagaggccctctcctaccttcctgagggcacgtggcttgggcacctgatgtgtgctcagcactgggttggtgttggagccaatgcccagagctcacagccctgtagggggagggagacaaggccattctgcccctctgggtgtgcacatgtgtgtgtgcatgtgtgttcatgtgcatgggaggtgaccagtttctttctcggtgtggcacctgcccctctccctcccgcacctcgaggtactgagccttttcctggtctggccagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggtgagctgaccagctgggccctgtctgccccacgccgcggcccctcatcccctcccgcctcacagcccgagtgtccccataggcgtccggaccaacttgctgaccttgcagccggcactgcggaccctcaccaacgactacaatgggctcaagcggcaggtgcgcggcttcccactgctgctgcaggaggccctcaggagtgtcaaggccgaggtgagcgagggcagtgggtgggagggtccaggctaagggggtgcactgggagaggcacgacatccactcagggcgtccctccaaagctcagacaaagccgctcagacagcagcccctgccccaccccccatgacacttactgctgcccttataggccctgtttgaaactagactgctcagggcaggcattcggctatttgtcttactatgattctttaaaccaaacatgttacagataacttcatatttcaaacatgcaggccaggcgcggtggctcacacctgtaattccaacactttgggaggccgaggcaggcggatcacttgaggtcaggagtttgagaccagcctggccaacaaggcgaaacttcgtctctactaaaattacaaaaattagctgggcatgggtggcaggtgcctgttaattccagctactcgggaggctgaggcaggagaatcacttgaacccagaaggcggaggttgcggtgaaccaagatcatgccactgcacttcagcctgtgtgacagcgagactttatctcaaaaacaaacaaaaaacatgctacatacgtattttttaaaaaaattatttattagagacagggttcattatgttgccgaggctggtcttgaactcctggcttcaagcagtcctcctgccttggcctcccgcagtgctgagattattggtgtgagccaccatgactggccgatacagtcttacctctgttaggtttaacttaattctttcaagctgtacttgtacatatgagaataaccagtgcctcttaagtgcctcctacatgtcgagctgtttatagccgttagctccttgaatttgtatgatagctttgcaaagactaatatattttgggaacagaatatagttcttctcctttaaaagactatatcagtaatacatggacgtggtgaaaagtcaaactccatagcagggcatcaggtgaataggaaaggcctctctgccacccacccaactcttccaatgtggcctctcagcatttcccccgactgttctgagcatgcttaagccaattgtgcgtgtgtgtgtgtgtgtgtgtgtgtgtgtgtgtgtgtgtgtgagaatatatggtaggcccttcccccatccacaggttctgcattcccagattcaaacaaccacagatcaaaaatagttgaaaaaaattaacagtacaacaattagaaataatagaaataaaaaataacatataacaactatttacacagcatttttttgtttttgagacagtgtttcactcttgttgcccaggctggagtgcaatggcgggatctcagcttactgcaacccccacctcccgggttcaagcgaccctcctgcctcagcctcctggatagctgggattacaggcgtgtgccaccatgccgggctagttttgtttgtttgtttgtttgttttgtatttttaatagaggctgggcttcaccatgttggccaggctggttttgaactcctgacctcaggtgatccgcccacctccgcctcccaaagtgctggcattaccggcatgagccactgcacccagcccctacccagcattttcattgtattagatattataagtaacctggagatgatttaaagtacatgggaggggctgggcacagtggctcacacctgtaatcccaacactttgggaggctgaggcaggaggagcacttgagcccaggagttcaagaccagcttcggcaacatagtgggaccccatctctacaaaaaaatataaaaaaactagctgagtgtggttgcctgcacctgtagtcccagctactcgggaggctgaggtgggaggattgcttgggtctgggaggtcgaggctgcagtgagccaagataacaccactcacaatgagtttccaccacatccatggagctgtgattgcacttccagcctgggcaacagagcaagaccctgtctcaaaaaaaataaagtatatgggaggatgtgtgtaggttataggcaaacactatatcattttatatcaggggcttgagcatctgtggatttttgtatcctccacggttactaagggaagactgtatacactgtatacacttcccttctactccagaaaggggatgtgtgatttgtgtacagtgtgatactgtatgtgtgattttgcatcttttttccacctgtgaaatgtaactgggagatctttacagattcatgagttagatggtattatccctgctttccagatgagaaaattgaggcttaaagacattgagccagtggtctcaggtccccagctactcaggggcagagttggaatttgagtctggctgaatcacatagtcaagcactagtgctgtggtgtggagggctgagtcctggctctatgcttattagcagagcagcctcaagctgtcagcttagtgtctgcggctcagtttcatcatctgtaaaatggggatggtagcagtacctacccagaggggtgattgggacagtctgacatgtgacagcgtgtgtcaggtactcagccaggggcaggaggcagtgagcacccctcaggggtgggcagtcaggccggtaaggctgatggagccgtccccctgacagtggtgtgcaccccccaccagataggccaggccatcgaggaggtcaacagcaacaaccaggagctgctgcgcaagtaccgccgcgagctgcagctgcgtaagaagtgccacaatgagctcgtgcggctgaaaggtgactgcaggagggctgggggtgggcgctggcctcggggtcctcgacctggcttggcagtcatgcttggagctcaccccaccattgaggcactattctaatcctatctctgtagataaggaaacagaggcacagagaaggcagggaacttgctcaaagccacatggatattaaatggtctgccttggatttgaacttgagtctgtccagctcagaagccctggccccagtgcctgggcaggtgactccccaggccctgggtagccgaggggtgtggtgttgcagcattgggttggtggcagctggaaagccgcttattctgacctggggcctggtcaagcttgagactccaccattcactgcatggagctctagagtgcctgctctgtgccaggtgccgttccagcccgaggctatggtcgtggccccacagactgcctcccggtgcacactttagtgtgagaatcaacaatgatgattgtcagggaaccccaaccctgcccccttccagggctgagacaggctttcctgggtatgggacaggcaagtgtgttgaggggcttcccagagaaggcaaagttagagctgagacctggacagtgagctggaacggatgggtgaaaagggagggcaggtgggccatgctggcagtggggggtgtttcctcttcattccaagagcacagggatcccaacaaaggctggaagtagatggcggcatgaccagctcatgctgccagatacccctgtggctgccccactatctgggccctcagatacaccaccagccatcacctgctgcctgggcctatatgcccatctgattcctaagccctgtcctgccattcaggacaaggctctttgctcattggggcccaagcccctcattgtctgaatgaagaaactgaagtccagggagaaaaagagtgtccgttctggtgtctcaccctgacggggtgcagtgcttgagccccacaactgacctttcctccccatccccaaggcagagctccaccccagtcaactggtctgttcaagaagaaatgtactaagtgaattcatactatagtgtgaatgacggataacagctttgtgggcccccttcccctagggggctgtgcttaaaagtcaggggactcctaggtcaactagtctgcctgggacaccagtggaccagaatggagactggtcttgacatggcctggacccatttccccatccccaaccaatccagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgagtgtggccccatgcgggaaagggaaagcaagggagagagggaaagatggactcacagggagcgggggcgctgggcaggaagaagcgttaagagtggggggtgcaggaatcagaagtggggagccagggtcctgctccttcctctggaggacagaagagggtgggaagttaagactgaagcccttgaaagcctccttaggaaggagagatccagacacagcccatcccctcccatggctgtggttcctcccgtccccaaggccccttctaccgtgtggccccgcccacccttgaggcccttcccactatcgtaactcattccattctctcagctgtggctcctcccaccatgtggcccctcctatatccacagccccttccaccacatggcctcacccacagcccctcccaccaccatggctttgggtcctcccattcaggtggccccttccactgcatggccctgcccactcccaaggcccctcctaccatcacagcccatcccaccctcatgctgtggctcctcccatctgcatggccccacccaccctcaggcccctcccatcttcccaccatgtggcctcacccactttcaggcccctcccaccatcacagcccctcccacccccatggccacccacatggccccatccatcttcatgaccctgcccatcttccccatccgggaataccctcctgtatcagtcccctgggccttcctaggaatcccccaaccccctgaggctgtatgagaaccatgtgttctcagtgtccactcttcccttatctctgcccagaccaacctgccagccctgccaggcctgtgccctcctgttctcatgtctggttctatctttgcccccatcctctgatggctggcaggcaggcccaggccagagaggccccaggcatgtgctggcctccaccttccttgtgctgagcactctttgagagagagcaggaggagctgggggaagggcagcaggcactggcctgtcttccctgcagtctttgggcggcccggttgcccactactgtctaatgtatgactcatgagtcacgaatcattgtgagctgagtgactgcagtaacacgtgatgtggtgttgctgaaggacagcatggttggggaggtggctggacttgtagctggtggtcccagcggccctggaagccccccccaccagcctccctcccaccaccctcccaggtgttccaggaggtgcaggccctggtcacctcttgcattgatggcttcaatgtctgcatctttgcgtacggccagacgggcgccggcaagacgtacacgatggaggtgggtgctgcccaatggggtgggggttcacagtgaagcatgaagggaatgcgggctccctcattggtcttggggtattgtgcagtgtgtgttttgcctcatttggtcctcacaacccaggagcagaggctgtagttatctgtgttagccctgaggcaccaggccttaagagggggcccccttgcccaagggcacccacaatgggcccagcaggactgggagagaggcaaggggggactatcatcacagggatctcggcttggggacagagtctggggcaggccaccgacctctctcaggaccagggctgcatttcaccttgagtgtgcactgcacactcctgctttaccgctgccttgggccgggcctgggggatctgggatgagtggcgggtctcagtcctcaaggagatcccagggcaagactggcatatgaaggctgttgtggggagcccagctcttgccggtggtccctggggccaggccaaggcttcctctccctgctcgtcaccggcaccctcccaggtgtggtggagcaggtggcaggccagggagaggggcgttgagactaggaaggatcttgactgtgggcagagggcagtggaaagctagccctggctctgaggggtgctgtgggattgattccctaggtcaggaggaggccaggtggtgtggcgtctggacaggggaaggggctagccaggcctgctgggcggccctcttatttcccatctggactctgctgttccctcgattctgggactggtgagactagttagtgggggcaggccaggccaggcaggaggaggaaggggatgtgtgcggcatcctctgggctccccgctctgctttgggattgcttagtgttgaggtgaccaccaggaacatcagagcgttcatcctcaagtgtatctgctgatgcataaggtgtatcaggcatcgtgccaggcacagctgtgacccaaacagtccctgcccccacagagggccctccccacagggccaacctggctgtggggagacagcagggtccacacaaatcagcaagtgtcctgtcaggccagggagaaaaataaagccaggaatgcggaactgactagggggagggacagggcatttgggggtgctgggcgaaggagcagcctccctgagggggcatcttgggagcagcctccctgagggagatgacggagccggccaaggggcggtcagaggagtacccggggcagagggagctgcagggctgaggccaagaggccagagcatgccaggggcacctgaggcccagccaggaggcccctgtggccggaatagagagtgagtgagaggtgctatcagaagaggggtgagggccaggctcccagggcctcgaggtcccgggtggggactccaggtttccttctagaaaggccggcccacccgtccttccccaggacactggcccgctcctccttgtgcctcctctctaccacccacagagcccaggtctcagcctccctgagactgagcgcctttctgggcagtggtggggtcattcatttccagtgcccctcccaggtggccccacagggccaggcatgcatctggccctcagctgccctgtgtggggtctgggccaggcccctcatcccagtgctgcactataagtctcagggtagtcctggcagggcgatgccattttaatggtggggaaatagaggtgcagttgcccgcagctggtggagggcattttgggggacagtggcaggtaggtaagagctttgggcaaggaggcttgcttgtgaggggtagtcaaggggctttggggacagacaccacacgagcgtctttggggacaggcctggcttactggggcctttccttctgtccccaggggaccgctgagaacccaggtatcaaccagcgggccctgcagctgctcttctccgaggtgcaggagaaggcgtctgactgggagtacaccatcaccgtcagcgctgcggagatctacaatgaggtcctcaggtgggagccccagggtgtgcggagcaggcctcaggggcagctttggggtcctccggggtggtgctggaacgaggtcctcaggtgggacccccagtatgtggggagcaggcctcaggggcagctttgggatcctcaggggtggtgctggagcaatgggggataggaagtggggtcttcctgaagggagtgtagggaccagatgaggccgtcaaggtgaagggagtgtagggaccagatgaggccgtcaagggacctggctgcaagtcctgactcagcccagtgggttggatggttctggggggaggaggggctctctctgagacccaggcaatccttgcccctacctgtgggctacaccaggtggccatgggtgagagtgggcagctaggggccctgccaacaggggctcattgtattgtggagtgagatctccacgtcttcagctgaatgcggtggaggagctggaggaggagagatgcactcagctgatggctggagaaggcttcctgggttgggggaacattcctggctggggggctgggtgcagtgcaaacagcagctggaaatgggaggagggggtgactgtctcacctgcccctccagggacctgctagggaaagagcctcaggaaaaactggagatccggctgtgcccagacggcagtgggcagctgtatgtaccagggctgactgagttccaagtgcagagtgtggacgacatcaacaaggtgtggaggcgggagcccctgaccacagccacactgctctagaggacacaactgggtttgaatgtaggctctgctgtgtcctaagcacgcacccttgggcaagtccgcacgcctctctgagcctcagtttcctcatctaaactgcggagggtggtgccactcctcatgggtgcttggggccaggtgactctgaggaccccattctcaacgctgtgcctctgccctcctcccaatcccccaggtgtttgagtttggccacactaatcgcacgaccgagttcaccaacctgaacgagcacagctcccgctcgcacgcgctgctcatcgtgacggtgcgaggcgtggactgcagcacaggcctccgcaccacgggtgagagtggcaggcagcctggcctgaggatccccacaaccccaaggggcagggcaggcctgatcaggtgggtgccttccctgcagggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgaggaccttgggttagggcgggccagtccctagcatgtaggggctacgctagcagtgagacccagtcaccccaggctgtgcaaatggacctccccgcccctagacctggccacacacaccctgtgtaactcccagtccctcctctccacctttgaccacagcacctctgccatgttgcctgccctcccaccccatccctcaggcctctccaggaagccttctgacggccccagctgtgagctccctctcgtgaccctgttgcccctccagctggcccgggtgggcagtgagctctcgtgtcccctaggtgtcccccgtggagaagaacactagcgagacgctctattccctcaagtttgctgagagggtgcgctctgtggagctggggcctgggctacgcagggcagagcttgggtcctggtcaagccaggagcatctagaggtacggggactgtcacaggcctggctcaggtggccctgggtcagagactttgggtcatggcaggagcagggagctgggcggggacgtcctgaagcagtgggggcagggaagctgccggagttgggtggagctacggctggaacccacagccagcagcctcttcagtacaggtatttcttcttggcctcggaggttcctgtggggtgacgagctggccgtgggggtggcacatagtagatgctcagtggtaactagttgacttctttacatgaattatctcatttaattcttgccataactgaggctggggcacaaacatcatgcccattttgcagatgaggaaactgggtgttaggaggcagggcaggggagtagagagaagcacagcagggtggggagccagggcagccgtggcccccgcccatccgcccttccctgctcacagtgggagccggcttgtcagacgccacagccctcggcacgggcccactcagcccccagctctgggaccagtagccgccctggatccatccgggagggaagctgcagccctcgggtgagcctggagtggcagtgtgggtggggagtctccccagggtaatagtcaccaggctgnnnnnnnnnnnnnnnnnnnnnnnnnnnnnnnnnnnnnnnnnnnnnnnnnnnnnnnnnnnnnnnacctcccctgcccccaggcagtagtcagggcagacagtgctgtgtccgttctgcaggtgggaaatggaaggtctgtgggaagggggcagtgtaaggagaccccagcctctcagccgggggtgctgactctaccctgggaccctgctctctgagcatgggctggctgagcctgtgcagtaagccccctccagagcagcccctgcagccccctccctgtgcctcagctgccccgggggtagaaagggccgggcttgcctacctcctaggtgaggagtgagccccgccacaggaccgggacccagggctccagcccctgtttagcccagatcatgggagggcctggcccatccttgagtccaaaggggtagcagcagcagggtcttgtggggtactggcccaaggcaagcccaccagtgagacgcctgtcactttgatttcagcctgacggctggggctgcagagtctctaggtgagtgtggggcctgtggcccagggctgcccgcctgcctgcccgcagtgggttgcagggctgcgctgggacgttctgctgttcagagctgggtctagcccctgctgtcgcttgtctatgtgcttttgctgggttccctcctgctctcggtggcaactgctgtgggctgccggtgggcaagtggacaagaggctgatgatctcatgcccctgcagggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccgcccctctccttcaaggagggttcccgcagctggggggtgtgcggaggcgcatggcctcccgccacggggccgtgctgtgtttatggctggcagaggcagccagcgggtgggggattctgctgctcgctcacctgcctggctcgctggtctctcgaattttcttccctctgaaatcctatttaagaacttttggaagcttagccatttttacttattaaaataaaagaagcctttttacacaagtatggtctgaaaaagttggtctgtgagcccctcttggtctgattagggggacggggcactggcaggtcttgtggactcccccgctggctggtcaccccacagccctctgggatctgtcctctaggtcagttagggacatgcgtccttaacaaacaactggggggagcctgcgctgtcccaccctgggtcactttctctgttgtttgtggtcacagtcgcctcatgcggtacctaccatgtgcccacgataactgacctcccaacaggggcattcctccatgttactgatgggaaggaaactaaggctggagagagcttcaaaggctatcaaagccttgcccaaaccatgctgggcttccaggttactgctgggcaccacccactgcccactctttgccctggccttttccctcttcagtgaactggccagaggtccacgccaccttcctccagtgccgaggaccctgaccaccccggggcggggctgtacctggtccctgccttg

SEQ ID NO: 17272 - DNA, 234288 bp, Human
  misc_feature (1)...(234288): n = A,T,C or G
cgctgtgtaaagaaatacccaaccatagacacggcaggaaggtgcagaacatgccccttgaagtaggggcggctgctggttgggtttcactcgtgtttcgaagaggatggaagcgctgacaaccacaggaggaatgcgtcatgggttccaggacagcaactggctggacccaactctgggctgcctagctcccccagccttcacaattcaactcatgccacctcttacaggaagtcctcctggatgcccagctctggagtcatctctgtggtatactaggattccagttccaactttctctggaaccagttgggtcatcacaggtcacgagagcagatgcctacagagagtgaggagaggcgggacctgccacaaactgcaaggtaagtgcccatttaatggttgctaagcaggactgtggggctagcgtggccacatcttccaatatctcaagaaaagttaccaatctaaatttccatgtgacatctcaccatgcctgggagctggatccagcctcgggcacccttaggtgacacagaaagagtacagcttgcaggtgaagatggctgtccagctgcgatgctctcacacccaggacccacaatcgaaagaaccaaggacgtgagatcacagttagagcctgctgtgtaagtcgtgtttcccccaacgactgggacctcctggccagcagggagaggcctgagtcatctccgggtcctctgcccctggccaaagcaaagaccaaagccctggccacacagacctggggcagggcaaatgagaaaatcaaaggggtgggtgttcaccctctggggaagtgaggcagaaattgggggtcccagggcagagatgatcaacagcctgagagggggctctcaggcaggccctggagagaggccgctgagctcagacagcatgggaggatcagggccttgctggagaggagggactggggaggggttccggttggcaacgggctctaacagcaaactggccccagaatgggcccaggtgtccttggatgcttgggtggaaaaggtaggcagagcttggagaggccatttcaggttgggggccgggagtgcaatggcgggaggacagaatgcatacgtggggttgaggacagatgagggcaggagcctgactgtgctcatgggcagagagcccaggtctggcaggaagaggctgtgctgaggctgcagcggagggatgggaaggcagatgggggacaggggacagggacttcagaggaagaggaactggggactgaaggagccttgcctctctcagtaagggcaaaagttgatctttggggtcgcgccctgggtgtaccctcctaacagcatcttctggcctttgcggcctctatttgggcattcggcctggctcagaccttggacccagtagtcagtcccccctcccctttcattccctcaccctgtcctgccccagagcacagagacagggggatgcaccccttgaattccagggctgatgggtgggacccggcaccccaagggctctctaggtggggacgttcggccggcgccgctcctcggaggttgtgcccctggggtggctggcggcggggctcccccggcccggcccgcggcgcttctctgccgccgcctcggggtgtctctgcttcgctgcgagcccggcaccgcggcgacggcggcgcgaagagggaagcgggcggcggcggcggccgcgccaagatgcgccgggtcaccgcaggctgaggcgcccgccgtccccgccctccccctcgctcgcctccctccctcccgcctgcctccctcgctcgctcgctccttccctctccccgccttccctccgcgctcccccgcccgcccctccgcgcctcgcctcctccgccccgcgccctgcggtgctgcagctgcgggcggctccagctgcccccagatgtgggctgggcggctcgcggggaactttcgcgccggctgcgagtgcggggccccggctgcagtccggctgccatggatccgccggcgggagccgctcgccgcctgctctgccccgcgctgctgctgctgctgctgctgctgccgccgccgctcctgccgccgccgccgccgcccgcgaacgccaggctcgccgccgccgccgaccccccaggtaggtgcggcccggcccctactccccgggacccccgccggcctggccctgtcccgcgtgccccgccgccccctccccaggcgtcgtccagcctgacttgggcaaactccgcgcgccccgcccggggccaagttggccaacttcggggccgggttggtcgcgcagggggcgccccgcaccgcccccgagcgccttgggccgggggagcctcggagcactggcggctcctgagtcgcggagggtggggacggagggccgggaaaagccccgcggccaagagcgcagagtcagccccagcgggtccgaggggggagccagggcgaggcggcgccggggctcgcgtccggggacgctccggaggagccggctgccgagcgcgtagccttgggccctaaggattggttggggcgccccgcagggaatccccggagatcggagggaccctgttccacccctcccagtcctcgggcgctcggggagacggggccggcagcgggctgagcgggagctggacaggcaggacaggccgctcgtgctcggggaagccgagactccgccgctccggaggctggcggtgagggcactcgggcggcaggggcccgccgaggggtcgtggcacacgggtaagggggccaacccggaatggcttccgagcagctccacgtcctgccaaggacggtaggtgcaagggtcgggggactctctgacggggtcgtcccttcgggcacggggaggttcccaccgagccccaaccctgaacggggcagggggcagagctcttggcaggcaaggtctccggaggagggaacggctggggagtggcggagccccggagtggtggccctgttaacgccccttcccggttgcaggaaagccggggaggtgcaggctggcttctggggtcgcctggcggaatgccccttcccttcgcagtggggcggggtctgggggggcgtggcttgccggcgggtctctgaggcactggggctccgtggtctccgccgatctaacgccccttcccgttgcaggcgggcccctggggcacggagcggagcgcatcctggcggtgcccgtgcgcactgacgcccagggccgcttggtgtcccacgtggtgtcggcagctacgtccagagcaggggtacgagcccgcagggccgccccggtccggaccccgagcttccccggaggcaacgaggaggagcctggcagtcacctcttctacaatgtcacggtctttggccgagacctgcacctgcggctgcggcccaacgcccgcctcgtggcgcccggggccactatggagtggcagggcgagaagggcaccacccgcgtggagcccctgctcgggagctgtctctacgtcggagacgtggccggcctagccgaagcctcctctgtggcgctcagcaactgcgatgggctggtgagtacgcacttctctagctcctttctctccgctgctctcgcctgggttttggaaaagggttacctgggagtcccttgggagggcaaggcctgcgctgaggactttccgcgcccttcccgtgctttagtgagcctcgtgctccaactgaagggcttggctggaaagcaggttgttttgactggtctgagcagggggccatttatgcatggggagcgcccgggtctccaaaaggctcagcaggcaggagcgtgcgcctctctcttttgcctgcctgaacaggtctctggcttgcatccgggggtgggtccgtgtatgtgtgtgtacctttgtgagtgtgtgcacatgtgttgtggaacgttggtgtgtacctgcatctgggtgcccgtgcacctgtgtgaacatgtgcgtgtgccagtgtctcttgtgcacgtatgtgtctgggtttctgcacatcagtgtgttgagcatctgttgagtttgtgtccgtccttgtgcatactggcgtgatatgtgtgtggtggacttatgggctggcagtcagtcttcctgtttccttgcgtgcgggtaataccagcccagggagctggcagtgatgctgaaatgcccagttagccctctgccccttggctgaccgggaatcattggtttttctgctgtggtttcctgttgaactccagctggttctttgaaaagttggttttctctattttgagctgaggggtgcatttggaaatgaaggctctagtgcccatgagctgctcgatcttttgggggcagcgcctgaaggacaagagagaggctaggggatcccttttgagactgcctgcgcctctctagtcctgtgactggagctctgggaagctctgcttcctggagagggcaggagggaccgtggctcagcacaagggggcctcagaggaagcctggatcgatgctgagggaggaggctgacattggcggtgctctgtccggctgcccggggcctggcacacagcagaggccactgcagttttctattttggattgggtgtgtggtggtcaggctggctgtgctggccagacatctgaagccgcccaccatgggttccgctctaattgctactcagggaactcctgccccgagtgagtggccactctcccagcccccgtggcccctgagcacgcccgtactcgggcagctgaggctcatcctacagtctgcagagccggcaattacaccagggctctgcaaccactgtcattctttttatggagacacagaaaatatcacttgttgctttggaaaatcactgcctttggctggatttagttagaacttggccatattgcaaacaactgtaaatatccctggaggagctgggttaaaatggtgagcccttgacatcgcccactgtctctgaggacatcctgggcctcagaggtgtgtcccattttacgctggaggttaatttcctaaatgaaaggagatgtttgctgcggacttagggtgaggtaaggtggtgggagttgacatggggttgcagtctgttggtgggccaacacctgtgtactatgcattcctgatggagagcattttggggaggacttgtcactgtttcattcattcagcagttcatttggtgattcatttttcagccagcaccttctcatatgtttatcccctgtactggtcagcaatgaggcaggtctggtacccacccagggctcctgtcgtcagggtggctgacggacactctggccaggacttggagagtgtgctcctggggggctgtttgaatgggggctggaagaatgagtggccagctggaaaagacgcaggttggcaacccgggcagagggaggagcgtgtgcagaggtaccaggtgtggattggcctgggcaggacaggcctgctgaagtgtcccatgtaccagacagagctgggaagaatattggggttggaagaggagctgggacctgcctgagcggcattgaatgctgtcactgaataatggccttggacagtgggacagcaccattggttctgttttctttttttttttttttttttgagacggagtctcactctattacccaggctggagtgcagtggcgcgatctcagctcactgcaagcgctctgccttccgggttcacgccattctcctgcctcagcctcccaagtagcagggactacaggcgcccgccaccacgtgcagctaatttttttttattttttttaaaatttttagtagagacggtgtttcaccgtgttagccagggtggtctcaatctcctgaccttgtgatctgcctgcctcggcctcctaaagtgctgggattacaggcatgagccactgcgcccagcctcttttcttttcgcttgtcctctttctcttctcttctctttccttccttccttccttcctttttttctttctttctttccttttgatcaggctggtctcaaactcccgacctcaagcgatctgcccatcttggcctcctaaagtgctgggattacaggcctcagccaccgcgcccggcctcttctttccttttctgactttgttgctgcgtatgtgtctgtcctactgttaaatccccctctgctgccaccacgataggcttctttgctaaggacctgggtctttacacagggcacctcttgtcctcacagagccctggtcggggaggcatctcatccctggttacaggtggagcactcaggctctgggaggttgagtgactagacggaagttattcataataatatccacagcgaggggttattcatagtatccacagcaaaatgtccctttgcacaaggcatgagcaaaacaggctgcacagagtggtgttgtgcctcacgttgctgcggaagagttttccagtatctcctgggcagcgtggtaggcgtgctaatttcacgtggtttttacatgcccattaaaaacccagtgagaagccttttggcgtaaaaggtaatgatggtaagtgacagttgactgtgttcctattaacattgtgtgccaggctctcagctgagccccctgtgccacctcgccttgtttaatcctcacagcaccctacggaacatatcccgacatcatcccccttctacagatgaataaactgaggctccaaaagtcgagatagcttgcttcaagcttcgaagccagtatttgaacacaaatctgattccaaggccatgctcactatgttttgttgccttttcctgcatgcctacaaaaagaattttaaaaatgcatttctttacaacatttcccacctttcttatttgactcctggagacgttctcattgtgggtttgaccatcgtcagtgtgagtggagccgggagcaggcctgggagctgagtggccttgactggctcgtgacctgcgctgggctgcagctcctatgggtggcctaagtcctcactggtgggggactgcagctgggacttccgtgggatggaagcaaccctgcccgcctctgcctccccactcagggcagcacggggatcctctcctgccaggctgggcagcagtggatgaagcctccatgggctgggcggtggagatggtccgccctccaaggcctggtccaatcctggggcccaaaggaggaagtgtatgcccttccctggatgcttgatgcgaaccccacaaccctgtgagatagggctgccccactgcgtggctgaggctcagagagacccaaggttgcatggcaagaagaaatccagggctgctgcctttcaggctggggctcccctgcggggctgctgtctgggccaggcacccactctgtcttgctggacattaagagtcataaaggccacagagagaagtcagaagccggcctaagggatcgagatgagtttcatttttcccagcaaggctgctgccttcgaggccacacactgggctccagcaggctcaggtgctagagcagatcaggcaggtgtgagcgggtcctgggactgtgcagtggggtgaggggcacctgagatttgcagctgccgctggtagggtcttccttcctcccaccccaccttggcactgcctggatcgcaatgagaggttgtcaggaagactaaagaggggctgcaggaacctctgggttccctagggtgtcggggctccccaggtaggagcagaggctcctgtgggccccagctgcaagcagcctacacagctgctaaggccagtctcagcctccgccatacttgtcaccttaagacttgctcagtttaagtgacagaaacccctgctcatattggatgaaacaaacaagggacagcatggccccaattatctgggggtcctgaggagtgttggcttcaggcctggctgaatccaggggctcagagcatgctatccatttctcagccctgcctctcagtgttcatttcagaattgctctccacccctcaacccccggcccaccagcggctccaggcccaactcgttttccaaggaggcaacctttgagatggaaagccctcctctctgggtgacacctgtgagagttgggggagggattggaggcccatcttcaaacccatggctgtgatgcgggcctagcccaggtctcctgcccacctttgggactgagggggagggacagactcccaaactctggaatgaagaggggcctatcatacaagaagggaggagaattgtgcagggtggtgaacacggttgtggccacccttctcctggactccagaccccatgttgggcttagaagtcctcctgggctccaggcttgcctgctcggctgcctctggaacccccttccctggatgaccccatactcaagtcacgtggctctccccactctcctccagaccccacccttccaggatcgccctcccctagccagctccaattctagagctctctcagggcccggcttccctccacgcctggtgccaacccctgctttctgctcttgtaccccccactgccccatggtctctccccgacaacccttctccactctgcagccagagggatttttagaaaccatgcagcaactcatgtcacgccttcacttaagacctctcagtggttcttactgctcttaaaaacatccaaacccactggcctggcattcaaggcccccgtgacctggtcagggccctccagctccggcctgagtcgcctgctctgctggtctggaatgagactccgggagaaagggctgcaggaggcagaactccagcgttcccctcaggtgcccctgggagggtggggcaatgactccctcccctgctgccttacgtgagctgagggcccctacagagatgcctgagggatccagcagtgcagcgcagtccctctggaggcggcggccagcctcaggagggggtccggggagcagcatccacaccatctacctctgcctggggctttgaacccagtccctgcggttttcctgtgagccagccaccgtggccccatttcacaggtaggaaaccgaggctctaggagttacatatgcaggttctctgtgtgggctggcgtctctcctggaatcctttagggaggggcagagtggagccggctcccagcccctcatgaaggccggcatagtcagcactggtctcagccggagcccaccaaggccagctctccctgggagagctgcactccattgtgtggctgggtatgtttctggcactggtaaatgtgcgcggccatgtgctcattcaggtgtggcaggcttctcctgcccaatggctcgccgtggcttccctgtcccccatgtctccagtgcttagcgagtcatgcctgagtgaatgcaggccctcctgcagagtcagctgggaggtgaaggccaggtcctcacccaggcctgctgtgaggctcacaggggcctcacctgggtgagtgagtgaattcaggccctcgtgcagagtcagctgggaggtgaaggccaggtcctcacccaggcctgctgtgaggctcacaggggccacacctgggtgagtaagggaatcagccagggacatccgctcagcagcgaggctggctttgcctcgtggctgcctgagctatggtctgggcctgcccactgtggtatctgaagacccaaagaggcaagtgtgcatggcagccctcctgggaccctgggtctgtgctggcaggcagacatgtccttctttaccccacctgcctctctggcttgggcagccctgggggtccctgtgttgctgccggcacagcaggctggtggctgcatgtggacgtgtgcgtgtcctgggcctgtgcatggcgggagtgtgtgcatgtacgtgttgcctctgcatgtcttgcatgtaggagtacgtgcatgcagtgtgcgtgtgggggtgcatatgtttgtgcacgtctgaatgagtgtgtacacgtgtgtgcacatgagtgtgtctgcatgggagggtgtgcatttgagtgagcatgggccagcatgtgtttatgtatttctcgggaggggtttcctgcactctgtagaagaggggccttaagtggggttgaggtactcaggggagaggaggaccccagccccctcaatcttggcgccacgttagacacccccatcccctactggtggttaccccggaatgggaggatccaggtaggagctgcacactctgctgcgtatgtttcatattaaatatcagctgtccacagggtctgcggtgctgccattaatatggagaagttattaccgagcccggagctggctcctcgggcttgtccatgaatttcaattacactgcacgacgactccagggctgcagagtggggtgcacagcttccgctcagaggcacagggaaccctagtgtccaggaccaaggcctgggtgctgctgaagccaggcaggctctacgccatccccaccctgccttgtgcatttcacgggttaacccagggaaggcaggggcctattgtgggctggaggctgttgcgggtcacatggtccgctgtgctcctcgtgaccggcagggcggacaagcaccacgatcctgagaaccttagttcctccaatagcaaaagatgggttctgtccgcacgcacttcagtggcagtgaaagggtgggtgtgcagcaagcgcctaccccaggcccgggggtgagaaagcggtggccgtgtctgcatatcattagctctaaggtgccatcggttacaggacacaccattactttatacgccaccaagaaagaggagacactcccatttaaactgcaactctgtgccttgtggttccctggaggcgcgggccccactgccacagtgcttggtttctctgatgctgtctgcagcctaatgggtgggccatttctgctgcctggccgtcgcttgtcacggctcccgggaactgagttcggttggcttcgtccgcctccgggggtcttcctcttgtgaattacgaagtagcggtccttcctccagggataggtatttgcctcaccaatgcaaagctacatgcgcctttctgcgtgcaccctaactttttgacctcacagcgtgactcttcaaagacattttgagtgtccagggtgttgacagtgagggactgcgttggaagtgtcgtggcccaggaggcgggggccagggccggggcctgagacccgccgattgcatcctcagttcaggggttgggaaatggaaagatgcgtgttggagggaccagccctcaccagctctgtgcagaatgtccgggattcatctttaaacctgggtatttttcctttgaaagccctaatctgaaatttcaatgtattaaaagtatttccaagtgttaaagcctgtcatctttacacccgggtatttttcctttgaaaacccctaaacgacaaggtttggagagctttgggttggtgaacaggtgaggtgctgggagggtgagtgcccagagagggcgtggaggctctgcagcccttcccgttaccttgccctgcccatccctcccacgcggctgtttgaaagcagggattgggagcacatggaaagtagggtgtcttcacgtttcatgcaaggcttgtctaaggcttgctagtggccattctgattgggacagagcttctggacatatgatgaaaaggggcttgagagctgtgagcatattggtatgtatttacatctgtctattttatgggttatagtacaccatcgccagtcagttgcaaatgaaacctcaggttaagcagtaccgcagatacattctacttttccatctttctgttcttgtaccaatattaagctgtgtttattattagaactgtaaggctctaatagtcaaagtattaagtactttgaagctttgctgtccaatacagtagctataagccacacaaggctattgaagacttaaaatgtgtctggtctgaattgagaggtaccctgagtataaaatatacattggatttcagagacttcgtaccccccaaaaagaatgtggaatgtttaatagatcattttaaagtattgattacaggttgaaatggtaatattttgggcatactgggttaaataaaatatatttctgaaattaatttcacctgtgtcttttttttttaaaaacatggctacatataaagctcgagttctatttctgttggactgtgtggctttggaacatctggctggatacgtccccctttgctggtattctcttacaaaattttcttggctggtcacatatgtttattctttcaaatgaattttataattgttttgtcgggtagaaaaatccctcgtgaatttgattgatagtaaattaaacttagaaactaattaaaggaggaattgacataatttacagtattcatcaggaacatagtatattttttcagcttatttcattctgctttgatgttgtaccatgaagtattatatatacatatttttatacaggtcatccatttttaaaaatcaggattatttcaaggattttttttctttttgccattgctcattgaatactttccatctattggtacacaggaaggctactgatttttatagaactatcttttatcaagcagcttgattgaactcattaattctaatatatctttgtggagtcccttgggttttctaggtatacagttgcactctgtaaacactgataattttggatcctcatctccaatctgcaccgtctggaaccttcagagcgatgttaagtcacagccgtggctacacgcatcctcatctgtgcctggctttaacggcaacgcccccggtatttctctgcttaatacagcgcttgctgtggattaagatggatttcatgtgaaggcaatatcctctgaattctcgttttctaagatcccatttttatcagtaaaggagctgaaatcaagataaaatgtgtcttaactcttaacgctcccttctctcacctccaaaagccagaggtgttgcgattccggggtgtttgtgttctcagcctcggcctcagctgtccactttgctgggccaggaatgaaacccagtccccatttacgcaccatgggaagccctcgtagggaggggcagccttcctgcagaaggtgggggagccagcacctcccggccacgcgggtgacttctggaagaacaggaccctgttcttggaaagccctttgggccatgtgtgggggcatttccactttcatctgtgggttctttcttccctcccagtggcgtctccctccctctgtccagtttctctggagcaatccctccattctcctcctgtgtcttaacagcggactttgcccgctgctctgaggtggtggcactgtctgcagagtctcctgctcttccagtcccactgttatctgttatcccatgtgcttctagaaggtgtttttccaagcaaagacatttccctccttagaagaaatctgtaggcggggcacagtggctcacgcctgtgtaacttgaggaggctgaggcgggcagatcacttgaggtcaggtgtttgagaccagcctggccaatatggtgaaaccccatctccattaaaaatacaaaaattagctgggcatggtggcacacgcctgtagtcccagctacttgggaggctgaggcaggagaatctcttgaacccaggaggcggagcttgcagtgagctgaaattgcgccactgcactccagccaagcagcagagtgagactctgtctaaaaaaaaaaaaaaaaaaaaaaacagaaaaaaaccaaatctgtggcttgtcttgcagaagagcatttccattgtgtgatctctctgcctgcccactgatgggcatgggatttgaggagctttgcacagcatctgtacataggccccatcctgagagattctgctttatcagacctgcgtgagccctggggtctgtacttttcaaaagctacacaggagagtcttttgtacagcatgacgggtgctcactagcgagggctgtggggagtgggggctcacagaccagacttggggcctggctcttctcttgctggcctgtgaccctccattttcccagttaagacaccacctgcctcacaaggtgtgtgtcagtgagggagcagagggggatgaggctggctggcctcagtcaaagggaattccatggggggcttgaggtggaaggaagcgatggccagtgggcatggcccggcttgggatgcgggaagctgccacagcggtgtcggctcctggccctctgctctcgggtctctcacctggaaattcagagccccggcagaaggaaggcagccgccgtcgcatggctatccccaaggccacacagtagggaggggtcctcacaggcaagcgggcaggataagggggtgagggctcccagggcagtagctggcctttgctgcagggctgtccacacttggcggccacctggagctccatgggcgttgagcactgatcctgcagacctgatcagggcaaggtgggggcagtggtaggcatcctccttggtgctcctcagtgccctcccaggcaggtgcccaggccctgggaggctcctggtctcctctccttcccttccttcccctcccttcctctctgcactcctccctcccttcctctcccatcccctccctccctcccctctgccctcccctctctgcacgatggctggccactggccactgatcccagcacactggccctgagctgaggtctgggcttctggggcaatgcaggttgggtcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgtgctgcttgcgctctgtcctccttgcgtcttcctccttcctgcttcctcctgccctcttcctccttcccgtcctctccctcccttccccctcctctccctccagcttctcctccccttccctcctctctcttcccccttcttttctcattcctctttttcccactcccctcccttctcttctccctcatctcccctttttcccttttctctccattctccctttatgtcctctcccctccctgccccttctgtcctctccctgttcccacctttctttcccagagtctttcatcagccaggactcctggggacccttcctggctgggggcccttcgtcgtcagctgcactctgcacctgtaccttcctggtacattctgggaaccaacaacgagccatcccaatgtgctgggaggaaatcagggcacagcgatggggatgacccaccccaggtcccacagagcccagagccagctcctttcactgcagctggagcaccagatgaaatctgtacctcctcagaggtacagataactccccacctgtacaagcagggtgaattgctgaaaaggggaattcatgtctcctctccttggcctgctactgagttcttggtgcattttctagcaaacaaggtcaaggctgagtccctgccctgccagagcatcctccacctcagatagggcggcttggcctttgggctgtctttcctgttggggtgcccaggctgtcacgggctgtgtcctcactggggagggtggcccgatgagcagggctgctgggaaggttgtgcaggtggtgtgctgggcaaggtggccaatgaggccagcctttgctccgtctgggagtgaatggagtggaggttggagggtgcccagcgctgggtggagatcacgggcactgggggaggggaaatgtgtgccaggtgtctgcctccacagtcaggttgccagagttgctgcgttcttctctttgcagagcttctgcattctcgggactagggacattaaaaaccaaagccggggcagttgcagggaggctgctggacattgcaggtggccctgattggggcagtctcagctgtggtgactacgctgtggcctttggggccagggatggctggtccaggactgggcatggtatggggtgggtagatgtaggccgtctctgtcttggtgtcagcctgtcctgatagactctgggggctcagagtcctcacagccttcccccaacctgcctgcaggtgcccacctggctccccaaggcctgcaggagtccgctggggctgggctggcctgggacccttggtgggagtcaggcaatcgtgttattgttgaaacttgtttcctttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccacgcccggcctgaaacttgtttctttaatggctggtggttacggcccccaactttcctcctctgaagctgattggttctccctggggctagtcattaaccctctgctagcttgggtgggtttatatttgcagagcttccttttttattctgccgggctggtgttttgtttcttcggtcagctctgtcagcctctctagttgctttcttctggttactcagcctgtagaaaagtatcagcctttcaaagaaatactccattatatgttttgcttttttcctgacttgatttttaaatatataactcctttaattcaagtgaaatgtgtttcttatactgtataaggtgttggttttaagtgttcatttttttctaaattgccatgctgttgtctcaacaccattcgtttgctaattcactctttcttcttgactttggaatgtatattccatcatctgtgaagttcatggaggatatggggtttatttctggcctttctgggttttgttttgtttttttttttttttttgagacggagtctcactctgttgcccaggctggagcgcagtggcactatctcggctcactgcaagctctgcctcctgggttcaagcgattctcctgcttcagcctcaagagtagctgggactacaggcgcccgccaccacacccggctaattttttgtatttttagtagagacggggtttcaccgtgttagccaggatggtctccatctcctgacctcgtgatccgccctccttggcctcccaaagtgctgggattgcaggcatgagccactgtgcctggccttttctgtttttcttttgcaccagtccaggggtctttaattgctgttggttgacaatatgttctgacatctgatagggcaagtatcaccatcgtgaggttttaaaaaaatgcctaaagtagtgtcccctttgcagaaggccctcagcaaatctttgctgaacaaatgaacgacatcttcatgatgtttaattttctcacggaaataagaagattgattcagatgtttaaaaacatagcccagtaggtttattactaagagacttagaatgttattgccattgtcaatagggtcttttccattatattttacaccagattgttatctgggaacacttttaatttataatacagtaggtgattatttactcagaatacctgggacctgcttctttcagactaatgatattctcagaatttagacatctttattcccagggagaaaacagagttaaaaatgacacattagtgcaaatcatacatgcatgtgcagagctgccacgaaccacttgatacccatggttgacctggcaagcccaagccccagcattgctgtcctcaaggcgcgcccttcctggcaacagcccctgcttcagatcctttgctcccaatgacctgcatcttcccatgtcttagcaaagcagtctctctgttactagaatggcacaaatatgaaccacagataatcacaaaaagtccttctgaaataaatctcttgccgggtgcggtggctcacgcctgcaatcccagcactttgggaggccgaggcgggtggatcacgaggtcaggaaatcgagaccatcctggctaacacggtgaaaccccgtctctactaaaaatacaaaaaattagccgggcgtggtggtgcgcgcctgtagtcccagctactcgggaggctgaggcaggagaatggcgtgaacccgggaggcggagcctgcagtgagctcagatcgcttgcaccactgcactccagcctgggcgacagagcgagactctgtctcaaaaaacaaaacaaaacaaacctaaatctctcgcttggatgtttcccatgtttgcgttcccagatatatgagtttctctatttattttgcatctagactttttatgaacttccttgttattatttggttcctttttttggatgtttttgggggtgaggattctctacgtgtgcagttactttctgcagttcataatattgtctcttctttttcaacatgttttcgttttatgtctttagtaattttgtgtgggagctacaaccatgccttcagagcatctagccccgcttctaagggaattgagaaccaggtgctgcttcttctgtgaatgctggtggtggtagacccaaagtggacaaaccttggcctgaatggatctcccaggcccatttccccacggtggcacggctttcctttccctgctctcttgcatcaagtagagcttcgaacgcaggatgtgcccatgttgtggttttatggggatgagtggcggcggttgaccttccctttcagtcaaggaggctctctcagtccctcgtggtctgttaggtgtcccctgtggttggggagcagtgcaccgggcatgcacagggttgtttgcaggctggcaggaaaactgcggtctttgaaagatgccctgagtttctacgggggatgtggttcagtgagacactttcaggagaaggctggcgagtagattcggtggtacaacctggagactctatgaatgtggactgaggagccctgttttgagtccctgccttacccttcacaatgagataattttctgcacttcagggttcccattgtgcagggcggagtttgcacactggtgggccacgggccatgtccacccacagatgagttttgtttggcttttccagtgtttgaaaatttctcacaaagctcaagatttccagtttctcttgagaaccaggaaatctgccgggcctatgtgctggagggctagagctgagcaaggatggaaccctctagaagggtcccacagttccaggtgccttgggagtctctgctgctccctatcattaccctggcgggcttcacgcgcattcactccctgtgtaggcacctgagagtttctcttattttgagatgagtgctgcatgggctttggaacggtcatttcttcctcccctctctctccctctccctctccctctccttcccatgacttcagtttttggccatcagcccctgcaaggtcccgtgcgctggagtcagacgcgatctcgctccaacacgtgggcttggttttctgctccctccctccctgggcgagcgagcctcctgtttctcatctgtgaaaggtaaaagctgatgacggtaactactctggtgggttatgatgaggattaaatgaagcgagggccagcactgagcagcgaagggcctgttactacaagatcatattttcctgatggcgctgctaggagggaccacagtgtgaaagcgcttggacacacggagccaggtgcagattttgtctcttttgagagctctgtgggcggggcttgggcgggcatgggagtggggggcggggccgggggcggggcacaggccggggtaggatgctctccctgccccaggcatcaccggcctgggatgtgttgccagtggaggccgttactgttctgaaatggaattcctgggtcagaataagaacagatgtttactggaagaggccaggagccgctgacatcaccgagagcccctcaggacatggctgaggccaagggtcctctagctcttcccgccaatacagcattcctggggcagctgcccggctgggggtggacacacacacacacacacacacacacacgcacacacaaacgccatttctccaccaaatccttcccacctgaaaacaattagtcaagatgcggaaaagatttccagtctggaatgggagaagagtctcgtggcgggcaggccccaagaagggaaatggaggtcagtgtggcgaggggatgtgcaggacggagaggcagcctttgttgggggagcgctctgatcccttcctccgcacccctcagctgggaggacttggccgcctggccgttctcctttgggagtgaatccggagggtgtggcccagaggcggctggcctcgctcctgtcctcccatccacacctgtgcagctggtgcctgtgcccctgtccctcccacaggccatccccaggtccacactcctgtgactgcaagtgacagaaaaccggggcagaagcggctggggccaaagggggaatgcggggctcagggcggcagcccaggcctcccgcacggtttcagctcagccgccctccccgtgggtcctgcctgggcagtgcaccagccgcccggcagagagaggcccaggttccccgagggtttctgggagagcccagtggtgagttctcactggctcaggttgggtcacatgcttcaggcaaatcactatggccaggacagcggagcaggacttcggctggccaggcctcgtcacaggactgctgtggctccagggctggcgtctgtcctctgaccctctgggagtgggtcggggagaggatgggccccagaggaaagccaggctgatgtgtcaggaggagctatgggtccccattgccttctgtctccaggacatctgccctgtcttctccctgcccccgtttctcccactcccttccagctgcccatgataagcacgcggtctcccttccgtgccccacccgaaatgctccccatggctcctccactttgagggtaaagcacaggcccccagaaccagcattcaaggcccctcctgaccatcatcatttcctgcttgctctacccaccatgtccaccttcccgttcatcctgtgggcctgggacaggagctccgaaagatcacacacacccatcaactgtcaactctgcccacgttggaaacagtgcctgtggcaggtgcaggaggggaccatttgtcttggctgaagttgaatctgaaaatgacctaaggacttgaaggaaccagggcctagtgtgtgtcggggtgtgatcgggtggctgaagaagctgagactccttgggcctcatgggctttgcattagcagagcagacagtggggggtccctgaggacctctgggcttttgcctgaatgctgggaaccccataggcctggccaacttctcatcacccctcttccagcaaaccttcctgtcttctgtcctggtagttagcacagctgttccatgtcgtgaaccctcctgccagcctggtgaggcccatggacccctgatcaaaataatgtgtttagtgtacactacaaaatacaaaggaaataaatctgattgaaataaagctatcggccaggcatggtgcctcacgcctataatcccagcactttgggaggccaaggcaggaggatggcctgagctcaggagtttgagaccaccctgggcaacatggtgaaaccctgcctctactaaaatacaaggaactagccgggcgtggtggcgggcatctgtagttccaactattcaggaggctgaggcacgagaattgtttgaaccctggaggtggaggttgcagtgagctgagatcgcaccactgcactccagttggggctatagagtgagactctgtctcaaaaaaaaaaaaaaagagaaaaataaagctatcaacatacacatgcttttaaaatttttaatcattattataccttacacatttttgataataatgttattgagacataattcacatactatgtattttaccaacttataacgtaaaattcaatgaatggctttagtatgttcacagaatggtgcaaccatcaccacaattttagatcatgttcaagactctgaaaagaaaccccagaccctttagtaacccccaattaccccgtcctcccaggcctaggcaaccactgacctaccttctgcctgtatagatttgcctgttctgggcatttcattagtataaatgaatcacacaatatttgccctttgtgtctggcttctttcactcagcataatgttttcaaggttcatctaggttgcagcatgcatcagagcttcattactttggatggaaagatatgattccattgcatggatgtaccacagttttttaaatccactcatgggttgatggattgggttgtttccaccctttagctcttgtgaataatgctgccaggaacattcatgtaaaacttttttgtgtgcttttaattgatgcattaaataataagacctaggagtgcatcttacagcctctataatttaagttgtgctgagtgtaaacaccatttggtctggtctgcagcagcggtgctgacagttgccgaagcctgtgatttctgccctgatgggcgcaggtgctgttaagtctggggttgctgcctctctccagagttgaagggaatggcagctttcagttcccagttagtaaagatgaagttgaagtgttctcttttcccagtttatggagcccaggttaagaactctccagggagctcccacagggcagtgacaggacccaacggcccctggcaagtgctgtggcctgtggcaggaccaggtgtccagatcaagctggcggctgttctgcctgccctcagccatgctgacacctgccacgaagcctggtgtctgcttctttctcctccccgaagtattctctctgtccttagcttgggagtcctacagctggagggtggggggcccaggccctcctggactgctgcccctggggccccattgtctttccttctgccaggccatttcccttcgcagctatttagaagggaaggcagccaaaggcctgtcagaagggggaccacggatggattttccatcagatgtgcagacctgctccctgacactggctggctcggtgcctgcctctggagggcaccaggcctctgtcacttcctgtgcagcccctgccagccatgagacaggtgagggctccttggttttgtggagactgtcagtcttggctctggagtggcctcagtcctaggcagctcaagttctgcctcccgccagtcctgtctgcaggcaggatccagtcctcacgcacccatgctgggcacggccctgcttccacaccgtgctcaggaggagagcgtccactcccaggagaggccttgccaggcacctctccttagggacacctgcagttaggggtctggcgccagcttgtgtgtgagagatcaactccccctggtactgtcaggccccgagtgagggagccgcagcccagagaggcctctttctgtccagtttgcatcgccacatttgggtttctgtcccgcctggcctgggccccacctgcctgcggagctgccgaggccctcgtctagtgccctcccagaggggcctccagtcctggttcttatattacagaggcagccagaggcttccctgactctgtggctggcgcagccttgacaagtcatctggaattggctcacggcctcctcgcgtctcccggtgtctgatgtggcaatgaagctctatttcagggcctgcgggaggacccagcgtggctcagggtttgtcctcaagggagggcgtggatcagagcctgtagtgcggacctgggtgggggagggagaactggaccctgcactccctcctgtgtgaccatgggcgggttatttcacttctctgcactttcagagtctccaccttgagatggccccgtgaggactgattcaaagaaggcacgggccgtgggcgcatcctctgctcctctccccacctgcgctgggtcccatcagattttggcattcccagcaccggcagtcctggggtgactcacgatggctggcaactttttgtcctgtctttaagttaaaaactgtcgtatgtgccttcatataaaacagaatgcagaaataagccaaaaggagaaaatggaaatccctgcagtgccattagctttcaacatttttgtgtgtctcccacgtccatgcacatatgtgtaaacatacttaatgacaaaagggtcgtattgtaccttccctttgtgatctgcctctgcccatgccacacataatggaaatatttctggatcatccagtgttctgccggaacatctttcaatagaggcagcataatctactcaggaaacatggagaggccgggatctccaggcacttgggtctgtgggcctgggggctgagggagaggctgaggaaaagcactccccagcttttgacttgcacagatgggtggtagagaggaagggtagcttggagagagggtttgtcactggggctgtctcttggaaggagtctggcagctggaaatgcaggtcctaggtgcaggggcaaggtctgggtagaattcgggttgggagcgctctgtatggagggctgtggattccacatcctggggtgggtgggcgggcaccaaaggaagagggaggcagaaggggaaggaagtgctccttggccccccaccatgtgcagacaagtggaggaggcagtggggtcttaggagcggggctgcccacctgctaaaggatgagagaggttcaagaggagggggttcagggaattgggatggcagggggcatcaggcccagcagccaagagggggctttgcagggtcgctggggagttggtggaagctagactgaccaggtgaggggccagtgagaggcaagggagtggagggaagctggtgcgcatggcacacatgctgcggtggggcagacatcagctgcggagggtgtgcagtcttagatgtgagtgcagtgtttacgtgtgcgcttgtgtagatgtgtgtgtggccctgcctcgagcacagaggattttaggtggcttgagtttgctcagggaccgaggatgaggatccgggagatggagagtttgaagctatagaagagagagtgtattagtcaggtgttattcctcaagtgttggaaatccaagtaaaagtggcttcagaaaaaagaaaaaaaaacttattggttaatctgcaaaaagaaaaatatctagaactatctagcttcaggtgtggctggatccaggtgcccaaataaattttcagttgttttttttcccacatccccaacccttggctttgctctcctctatgtcgatttcactctcaggcctgctcttctctgaggcagaaaaatggatgcaggcagctgctgcattacctcctcacagggcaacaacccgggggaaacagcttttcctttccaacaattccagcaatagttcctggatttaacttcatggaataccttgtggcaagtcctcatccctgagctatgttcatgtagtcagatgacaacgtattctacctggcctaggctgggtcatgtgccctccttgcccactggtgacgcagggatgagagctggttcctgagtgacacaggggctgtgctatcagaaggagaagggtgggccaggaacagtggctcatgcctgtaatcccagcactttgggaggctgaggtggacggatcacaaggtcaggagattgagaccatcctggctaaaatggtgaaacctcgtctctactaaaaatacaaaaaaaaaaaaaaaaattagccaggcgtagtggtggacacctgtagtctcagctactcaggaggctgaggcaggaaaatggtgtgaacccaggaggtggagctcgcagtgagtcaagatcgtgccactgcactccagcctgagtgacagagcgagactccgtctcaaaaaaaacccaaaaaaatggaggagggtggactccaggcaggcttagggttcccaaggaagtggctggggccaggattgggagacctggaaggctggaggagggagctgctgcccaggagcacagcaggagagagaaggacacgaggcagacatggagcgggagggaatttcctccgtggcctcccttccctcaccaggcagggcagggacagtgaggctgctgaccagcctctacagctctcctgggagtcggctggctctgcaaggcaaacagaaggctggggaggttgactgatcaccggctgctccgggagccgtcaggctgggcagcaggagtggcctgaatgcagagaagcaagccttgagatcaggcagggcagtcttcctacattaggagtctgggaccaggcattctgtgggccaggccggagatgtggcaggctgggtgtgaacgtgctgaccagtggggacctgggtttgggtgctggggagccaggcgtaatgactgcgggggctggtgaaggctgagtccagtctgcacgcatgcttcctgtggtttctgggtgaaaagagggtcacagctttttgcctcaacagaggggagaggcttctattctactggttgagtgtggatggggagggctgggaggggtaggatgaggtggtagagacatacaataagcaaaaggccaaataaacaccttctcaggtagtggcaggaactgggaaagtaagcaagcaggcagtgaggctgggagcagcaggagggtgtgagtgagtgcatgtgtgtggctgatgtgtgagcacgtcagtgatgcatgtgtgcaaatgtgaggcatgtgtgagtgcatgagtgtcatgcatgtgtgcacatgtgcgggcgtgtgcatgtataatgcatgtgcttgatgcatgcatgtgtgcactgcatgcctgtacatatgatacctgcatatgatacacatgtatgaccgatgcacatgtgtatgtgtgggtaatgtctgccatgcacatgcatggggcatttttctggtgcatgtgtgtacttgtgtgtagtgcacatgtgtggacatgtgtatgtgatgcatgtgtcacaggagatgcacatatgagtgatgtgtgtgtgcatgcgtctgcatggtgcctgtgtgacgcctgcgtgtgagtgcacacgtggtgcatgtgatgcgtatggacatttgtatgtgggtgcatgcatgctgcatgtgggagtgcatgagtgcacatgcatgtgtgtgggggcctgtgtgttgagggaatagctgttgggaaccctcagtcataacagggctgtgtgaaatcttcagctggaggaagacaggagagaaatagcgtgcagctgtgttcctaatggcacacacgccccttgcccagagtgcatggtggaagagggctttctggcccagggaccagctctctttgtggcccaggcctgctgcttttgggctggggtctgaccttcctggaagacccttcggggccccgcctctcagaggccaggccccaacgtctcaacgctcaaacagcgacatcagtgtttcccccaggggagtcatcctggggaggctcagctccatcctgagccgagggggccttggcattgccccacctgccctggtctgagaaggagctgtcctctgcctctctgtggtctcatggggacaaatgccagccactggacagtggcccttgtcgtcttctaactgtcaagattccaaaaagacggaggcgaggggtgtgcgggagcaccctctgcgtgtgcttggcttcttccccaccagccttcttgtgagagggctagaagcagctgtcccactttgcagtgggccctgtccctcctggcagggcagctgtggccgtccctggctgtccccgccccgcccggcatctccttctctccccatcccctgtctagctggccccgcctctcctccctgtcttgctttagtctcatgcctttttaatgagggctcagcctcctgtgtgctgaggctcagcggcagcgcatttaattaatactctcgcatcgcagttcttcagagtaaatgctgccattttattcctcactaattggaaggggctagttaagctctgagataaatgaccctttctgctgggagtgtctcagctcagagtctccatgagagtggctggagccttggatgggaagggcaggagggctggcctgctgtgttcctcctggtccaaggggggcctctttgctaatggccagggtagagacgtggccagggtgaagcctgcctgacctttggggaggacgtgcaggtggaggctctgctgaccagcagggcttcagattcatcactgcccgttcctcatgtcccggctccaccccagccctggatgagccccagggaccccagggaaccttcagtctgggtttccagaacctttccctggcccagtctacacctgcctccctccctcactgtggaccagccccacctctaccctccatcctgtacgtctgctccactctccccaactggcgatgagtctggccagggagtctcagctggtgctggcacgctaacctcccctagacgcgtgctgaaatgtacacgtgtgtgtgtgggtgatgtatgcgatgcacatgtgggggcgtttgtgtggggcatgtgtccctcagcacacatatgctctgtgcccgctggccatccgggggacatagattacaccaacactgcagtgctgctggccacccatggtctgggcagcaggaagaggtgcaggagtccccacacagtgtcgctgggatggcctctgggtccgtgcttatagaagtctcatgagtgcaccctccgcccacctgctcgcatctctctccctccacgaggaactgtgctgtggcctcctgggtcttcaagctcctttcctgttgtgttggtgacaggaatcggggtcagaagggcagcgtccgagcaggcttggatgagatgtgtgatattgtgttaccatatcagcgactctgctagctgagtccatcttcagggacaaggatagctgtagccagacctacgcatggatttatgaggaactaccaagaaaccactgggaggaaagacgccaaagtgctgaggaaaaggatgctcagaggtggccctgctgccagctggcagagtgacaggagggctggaggctgtggggacccaggccacgtggggttggggctctgggctttgtccttgtgttcctgtaattgtctgttgctgagaattagctggaatttctttctttccttcttttgttctttccctatcctttccttcctttcctctcttctttccatcctttctcaccactgtgtattctttttaaaaaattaaatatatttcctttttttgagacagggtcttgctctctcccgggctagaaggcagtggtgcaatcgtagctccctgcaaccttgacctcctggttcatgggatcctcctgcctcagcctccaaagtagctgaaagtacaggtgtgcaccaccatgcctggctaattttttaaatttattttttgtagagatggggtctcactatgttgcccaggctgatcttgaacttctggacttaagcggttcttggcctcccaaagtgctggaattataggtgtacaccactgcgtcccgtccccacttcatgttcgacagcagttctccgtgcctgctctgccctgggccttgctggactggggttgaagaggcagccttctgttctcttggagctcacaggttcctggagggacacagcaggaaggtctcaaatgccatccctgggagtggggagggtgttctgtggggctggggagccctagggggcctaggcaggagcctgggatgcccacatgcaatgaccccctgagctgtggccgactccccagccctgctcctgagggccctgctgctctcagcatctcccagggtgtcacccttctgggttgctagatctctgctgctctggtgtggcctctgtccctgccgacccctctgagggacacagctgtcctctgctgcggtggctctggcctcggaatggggcagcctcttccctccaggcaagagcctttgaattctttgccagcaggacttcctgggctcttgtctcccgtctgctgcccggtgcccacgccccagtctgggacttggatgtctgcctgctgcctccctgtttacactgatctgatctgctctttccctctgggagcttttgaactttctctttgtctttgatgttcttaggtttcattatcgtgggtctagctatggagctttttcttatatatgtattgataaggcctctaggaacccatccatgctggaatctttcatgtaattttgttttttgaaatattccttctctcacctccccgactctcttctgggacttgcccacgtctcgcagcttttctccctgccctctgtctcttgctcctttcttagcacacagcgagagctctgtccagatcccccagttctgcggtggctgtggctgttcagttcctctgttctgctcttcggtgcagccaccaagccctctctccagtggcgtttgtgctcagcagctcctgggggcggccagttcctgtggccatctggggctgtgctttgtctctggaaggatcgttgtttcagttttcctctgcgtgccatgggcggtcctgggtacggcctctctagaacatagtacctgcgccactcagatcccagctcgtgtccccggaggtggagactgtggctggtggtgctaggagggctcatgccagcttctagctctggcttctcctcgtgagcgggacaagggagatgggaggaaagtccccagagatggcttccctcccacccaagctctgtttcctgacctgggatcctggctcccaatggtgggaaacaaaccccctttggggacacccccacttcactggcaggagtgcagtcagccctgggatcccgacatgaccttcccaaagcactgtggcctcagtgctttccagaagccaactgtggcctcagtgctttccagaagccaactgtggcctcagtgctttccagaagccaagggtatttaatcttgtccatggcgacgtggacgcgtgtcttgggaggagccctctggggtggggcagaggctgtgttaggtgggagggtctgaggcagggacccaggaggaacagaagagagagagtgagtgaggcctgctccatgcaggggcagggggaggaggaggccggggtggggccttggggattgtggggggggtgggtgtaggaatccagtaccacttccaggttccttccaggcttgaataactgggagaagggggcgtagctggctgtgattaggctctgggaggggagtcgcttaatgtcaggaaagagagttacttctaggtaggccctgggcttgaggctcccgggccatgctaagggacattcctatgtcccttgcagctcttggttgggcctggcacaaaaaagtgtgtgcccaagactcctgtctgtaggtggaggtctgctggagtagaggttgggggcactggcgggggacaggagccccacctgggtgcaggaaggctacaagggcttggtggaagagcgtggaagcccccagaatcaggggcttgtaattctggcccgtcaccctgtgggacaagcacatgggcctctgcatgctgtctcacctcatctgtaaaagggagacagtccagtgaggatgtgggcccgtgagagagagacacggcccggggggctgcagaggcaggagcgctgtgggtgggagggctgcttcctgggctctgagtacagcacggtgcatttactactcttgtctcaaaaagcagggaaaactgagtattccggccacgccacgccacgccacggggtggggaggagcctggccttgccgctccctgcactctcctctgcgctcacttagctcagagctggcggccgcccagctcccagtgagacgtggcagccaggaggctgaggcccagccaagccccagatggctggcgagaggtgcttcccccgagctgagcaagacaaggacagggccgacccggtgggaggggcaggatgggaccaggagcccgggaaatgccagtcctggccctggccctggccggtctgtgtgctcccaggctgcgcccaatccgaagcctccgtgtggatgcagagcctgaagctggaggtctgggcataggcaggggtgtggggtgtgtgaggaacccccccgccccaccatcaggttctgcctgggaactcctggtcctggagctgacacccctgctccggccaggccctcctctgtctcggtgtgagtgtgtgtgtgcacgagtgtgaatgcgtgtgcgtcccctctgctgacacccctgctccggccaggccctcctctgtctcggtgtgagtgtgtgtgtgcacgagtgtgaatgcgtgtgcgtcccctctgctgacacccctgctccggccaggccctcctctgtctcggtgtgagtgtgtgtgtgcatgagtgtgaatgcgtgtgcgtcccctctgctgacacccctgctctggccaggccctcctctgtctcggtgtgatgtgtgtgtgcatgagtgtgaatgcgtgtgcgtcccctctgctgacacccctgctctggccaggccctcctctgtctcggtgtgtgtgtgtgcatgagtgtgaatgcgtgtgcgtcccctcttcacaggccactcctgaggagggagccccggtaaggctttaggctgctggctggttctggggttgccatgaagtcctgaaatgctattctattgctgtttcttgatgtatcgggtttcgatgttgtccattgacttcctgccctggaagaggagggtttagctcactgacaacactgctgcccctcccagccccattcttctaccataattctctcaccacttttagtccatatcagagttccccattgtattggtttctgaggctgcctgcaaattactacaagcttgctggtttgaaacattagaattgtatcctctcacggttctggaggctgaaatcagtttcaacagggcaaaacgcaggtggcggcagggccgcgctccctccggagcctctaggggaggatgcgtcctgggctcttccaggtcctcgtggcagccagcagtgcttggcttgtggcctcttcgctctgggcttcagggccgacatcctccatctccctctgctctgcctgtacgtggccttctcctctgcctggctcatcttgctctgccttcctctgataaagagaagtgtgattgcatttagggcctgtcttagtccatgcaggctgctatagccaaataccataaacggagcggcttaaaagcatcggaagcttatttctcacggttctggaagctgtgcatatggttgtggtgagggtctgctccctggttcaagaaggcatcttgttgcatcctcacatgctgaaagggtgagggagctctctggggtccctctgatcggggcacaaatcccattcgtgtggatggaatctggtgacataatcacctcccaaaggccccacttcctaatatatcaccttgggggagtagctttcaacatcggaatttggggggaatataaacattctgtctatccctgggcccacccggaaaatccagcagtcactccatctcaggatccttggactcaccgcatctacaaagttcttttttgccatggaaggtaacatttatgggttccagggattgggacccggacgtgtcttcgggggccatttttcagctgaccactgccatggtcgtctgactgttatatttgcacctctgcagcttctaacattagcctggggcagagggtctagagtatgcccttagcggcacagggttcccatgccccttctccctcctccccactgctgtcatttctaccttcccttcagcaaggcagagtgttgttaaatgaaaaatgattcaatgatacttattaaagcgcggtaaggcggactttattcaggaccatggagatagacacaggaaccgctagagtgggctcttgcagtcggggagagagactgggctcaactccgaatacagcacgggcgagtggggggtgatagccaaggagcagggtaggggccaggggatggggaattactaagagcaacatcaggggtcggggattctagctaaactcacctaacatgattctagctgaagacaggctggggtgaccagacatcaccagaggggtgatggggaggacgagcctgaccagatatcaagggtgatcagatatggagagatggggcattcgtgacttagcagagttcttgataaactggatcttacaaggaagtgggcgaaggagaaggttcaggagctggactaaagtttggtcaagcaggagagtccctgtcagtgtccactgttcaggtcctttgttgtcattgaggctttgctggcaggtggatgtccctgtgattcttggcatgctgctcaccactgtctgaccctggcccattgctgtgcctctgagccaggcggcgcctgcccatgggctagagagagcagagtggaggggcatgaccctgcacaggacagagctggacgaggcccttccagagaagtggccagccagaggccagctccacctgggccaggagcgccaggccctgggggagagggatggggacgtggccttcctgttcagagggcgggggaggctcggcctcagagtgaacatctgctgaacatacgcatcctccccttatataatgctgtctggaaaaatggtttcctgttgttgttgagataggagtcaacgggccctgcactcggtgggttggggggtggggggctggggagtggagagggtggtctttggctccaacctggggtggaaaggggcggaggtccagaggacccagccggcaagtgggttggggcaggcaggggcaggtggggttgggcaccctgctgagctgctgtcctgggccatgcctccctgacccctgcagtttggccatggtctggggtggtggccctttcactgtccccaggaggactaaggccctgatgcctctgcgtccccagggcagggcagtagggcctctacacccacctttgagggaccctgggagggtctagagcagtgtgtcccagacttcaatgtcatcagaccacctgggaacttgccaaaatgcaggttttagttcagctggtctggatggggcctggattcagcatctctaacaagctcccgggggcccccaggctgctccaggccacattttgcatagccaggctctgcaccaccatccctcaccccagccgggattctagcaccggtgggtggcccagagacgccaatcagattcttctgtggacttgaacctctccttgttcctggaaatcctgagatatttaatgaccaggggagccctctggggctctctaggccatactgtaccctgcaaggcagcctatgggggggcttcggaaaggcttgtagatgcctcctgatcctccagcttggagctggggggctgagcccccaaagacaacaagaccagttctctgtctttcttcactgtgtttctgccttgtggtatgagcaaggcatgcctagatccctgcccgctgggagctgcagcctggtgggggaggagggccgtccacaggcccccacagcagacagcagagcatctcagcgcctgagcgctgtggggacatgggacgtgcagggagccctgggcaggcgtagtccggggtggtctctcctggagggtcctgggtgacaggaaggagcagtcaaggcatcaacctgggcagatccacaggacattcaggggcacccttgtctgtccccagggccgcaggctactcccaaggcctccctgacttgaaccccagaagccagagggcaggggtggggcagggaggacaggagggacatgcagtgggggcctgctgggtccagggtcctgccctgccctgaggcaaacccagggtgttttgccctcagagctcctcccctatgcattttaaatagaagaaactgaggcacggagaggtgacccacccggtcaagtggcagggccagagcctttttttttttttttttttttttttttggagactgagtcttgctgtgttgcccaggctggagtacaatggcatgatctcggctcactgcaactccgcctcccaggttcaagcgattctcctgccttagcctcctgagtagctggggttaccggtgcgtgccaccatgcgtggctattttttttgtatttttagtacagacagggtttcaccatgttagccacgatggtctctatttcctgacctcgtgacccgccccaccttggcctcccaaagtgctgggattacagtcagccccagctttctgcagtgtctggagggaccaggcttcaggcttgggggccgggctaggaagctgtgcacagttagagttgaaggtcaggtctgggtcactgttgccaggggagcaggtgtctgcagacatctgactgggatggctttggggggacatcctgtgacctgggtcccgaagaggtggcctttctccagctctatccaccaatggccccaggcctgtggccactgaaggcagaagcagtgggactgggtctgccccagtgggtgcctggctgaagtctccctgcacaacccttgggaggcatgctggctcctaactggcctctacccggggaacacagagttttcaactgaattggtgtttgcgcctctctgctgagctggcccatctctccatgtagcttcctgtggatggcgcagctgcagaactccagtccacagtcaggaggcacggggctgccagggcagcggaagagacccaagggcaggaacgcccgcctcagccctcttcgtatctttccctggacccagggcctcaccatggcctggcctgtcctcctagaagaatggctgaatgaatgggcagctgagggggatgctaaaggcagggaacagtaccccgagggcttcagtggctgtctggctcccagctggcctagctgcatcccagggcccctggggtgggaaggaagaggaggcagaggggccaggaacctgcaggagggtggggttccatggcagcccgcgccctgcttccactcaggacgccagccagattcatctgctgggacaccaccttaggaaggaggcacttctctgagaggccttgggaatttcccccaatccacatacacatgggcatcatgttgggagaaactgttttgcaaatacaattaaaaaggatcctcccaaagttttgcctagaaaaaaaaaatgaggctgtctattatgggggcctgcaggcatggtcatcgcattgcaggagctcctgtgggctctggtgcccctgcacccttgctcgtgaacagtggcggctgcccgttcctgtcctcagcctgcccaggggctgcgcggctccccttccagctggcgtgcgtgacctttccagctggcatttcgagtgctctctctgggcaccgctgagctccacggatccccaaggcggtcatttgtcagatggtcctggtgactcccgacatcccatcagcgtctcctgctgctaagacaattgtgtcagacaactctcagcgcctgtcttcccacctccaccgagcagcctgaatgctttactaactggggagaaatcagagcaccggatcctccacttaaacccctgttttctccttgttgtcgctccagaaggcggcaaacttggcccactctgcaccacagggaccttggcaaggaaaccttacaccatcctgaagtaggggaagggagcctcgggagggccggcgacctcccgtactcaactccatgcctgtgagatgccaggcactggtctggtgacgtggacccagcaaggacaactttgctctcgtaagatccctggtcagggggcagagagtgacccaataaagaacccacgtgtcgatgattgggaaatggtgttacaaaaaaataggacaggatggcagtgtggagtgtgatggagaagggacacccttcaccaaggtccttgtgaggaggcatcggagctaggacctggacttctggaagaaggccattccaggtggaggcagcagcaggtgcaaaggccctgaggcaggtgctgagttgaagtgtgccaaggacacagaggagatctccacggctggcacttgagtgaaggagaaatcagcggggaccggggcagtcatgtggtgggaagccgctggagggctttgggcaggcagtgacaggtctgagtcgtgtttcagagattctgtggggcagccgtgaggagcatagagaatgaggtcacaggcttgggacgcccgggctcccagcctggcatacgtgatggtgctattagtggatggtgcagcatgacccgggaagcccctgcgtggtggtgccccccggaccgggctgttgaatgctcatgggcagagctgcttctgtgtcatggagctgtcctggagtgctgagcagtggccacccagggttggccgggtgctcgagccctgagagggccggtggacctcctgtgggccccaggtcttgccgtccctgaaggctgaggcttgcagggtgcgatgctctcacagcactgctggggcagatggcggagcacagcagggcaggggcgcgtgggccggggcagctctgcagtgcgggccccctgtgtctgtctcatgctagcagggcgagggtctgggccgggcttaggctggctggccactgacttccccgagagattcttcttactcggctgcccctctactacgtgctggcctcacctccaaggactcaggcccagggttgatcctgccagggccacaacagatgtgggactggccctggtggccaattccccacccagcagaagactgccctgccctctcatccctcaggctgtgctcctgtcaggcctggtcctggaataagagccatgtcctcagagcctgtgggagcacttggtgctatgagactcgatctcatggagttgcttccttcctgggtgtcctttccctggttgagttcatctgcctggctctctgctggcaccgggcttggcactggagatcaaagcttcatgaggctggagcaggagggcccccgcttcccctaggctttaggggccagtcacccttcctggacatccaccttccccaggaacacgggttttggggaagctctctggggccctttcctgccctggcctgagggtctgtgctgggtgctgggtgtgtacagaggtgctgtctaggactcaacccaaggttgagtaggagtcgtgaaaatgctccttattttaggggaaaacagtttctcaggatgcggtattgtgttagctttagtttttttgtagatattcttaccaggttgagcacgtttctttctctgttagttgagagtttttaatttttagtcatgaatgaatcatatcatatggttttctctatcacttgatataagcatattttttttccttcttcagtctgttaatatgctgggttacactgacttttggatattgtgccagactctgcaaatccaggacaaacatgacttgtctgttgtgcactctgctgtttatacatggctggactagacttgccagtgttttgctgaggatttttgtgtctatgttcattgagggatattggtttataggttcatgagggatattggtttgtagggtttttttttttattgaactgtctttgtctggttttaatatcagggtaatgttgacctcataaaatgaatgggagaattggtgccattttttcctgagaggttagtagaattttccagtaaaaccgtctagacctggaaatttcttttttgcaggattttaaactatgaattctttttctttaatagttacagaactttttatgctatctactttgtcttgggtaagttttggtagcttatagtttttgaggaaatcatgcatttcttcaacactgatggatttatatgcatagaattgtttatactattccattatcttttttatggctgtgatgtcattagtgatatcctttttaaaaatattctgatactggtaattcatatttttttctgtttctcttcttcagtctcactagagatttatcagttgactgatctttacaaagaaccaaatttggtttcattgatcttctctattattttcatattttcagtttcattgatttttactcttatcatttcctcccttctacttgctttgggcttattttgctttttctatttgagcatgttttggtattcaattttaatttacctattgtgtttggttgtatatctttgtatagtgtttactggttgctccagggattataataaacctatgtaactcttcagagtctttttcaaatcaatattttaccacttcaagttgaatgttgagaccctgccatcatataggtccctctgtcctcccctgaatgttgttgtcttttatacacctacatacatggaaaactacatcagacagcattatcattcctctttaaaatacgcaagagcctaatctgttatattttttcaggtatttctgttgctcttcctttattcctgatgttcaaaatttctttctagcatcattttccccctgtctgaagaacttccttcagcaaccatcttagggtagatctgctggccacacattctataagttttgcttcatctgagaatgtctttatttctccttaattcttgaagtgtatttttgctggagatagaattctgggttgacagttctttttttttttttttcagcattttaacaatgttttgcacttcctttggacttcacagttttgataagaaatctgcagttatctgaaccatttttcccctataagtaatgcactgtttttctttgactgctttcaagacttttttttgtctatagttttcagagtgtgtttataacgtgtgggattgtgtttccttggatttctctcatttgaggtttgccgatctgttgaattggtaggtttatgcatttcacagaatttgagaagttttcagccattatttatccaaatatttgtttagtaatacattctttctcttctccttctgggacatgactgttagttagatctttcggtattttcccacagtctctaaggctcttggcattataaaatatttttactcgctgcagtttgaattgggtaacttctattgctctatcctcaagttcactgactcattcctctgtcatatccattctgctcttgagcctatccagtgagttcttaaagtttctgttattgtatttttcagttctaaaatttccgtttggtcctttttaaaaatatgtcttccgtttcttgctgagactatctttccattagttgccagagtttttgcccttactttatggagtatttttataatagctgctttaagatcattgtcagttaattccaacatatgtgctatctcagtcttgttatctgttggttgtatttgcctggaggagttgagattttcctggttcttggtatgccaagtaattttggactgtatcctggacactttgatattaccctatgagactttggatcttgtttaaatgctatggagaaggtcattatttttgtttgatcaggtaattaacccttgggttaattgggttccggctgcaagttccaatgtgcctgtggattgcggttcaatgtcaggtccattttcaaagcctgtgcagtcctattctgatcaatcccatgtaaacacaacccagtggcacgtctgggacctgggcattggtccacctcctaagtcagtccccagaacctatggcgtgttgtttagggtcagacccactcgtgcacggctcaagcacgagcccaggagtttctaaccaactttctgatgccagttccccaagctctgctgtctctgccatcttcctagccctgtccagtttcctgcggctccttgttaaatctctctggccagaaagctggggctttattgaccctgctgtcttgcacacttcctgcaactacactcctgggaggaccaaaagaggaaagagcaatggggtttcactccacctttctaggaccacagcacttccagctacacagccaggctcccctcttagagttttaggtgcctgtgggctgccatgagctggcgtgtgagaacacgaagaaaagaaaaaggaaataggaaagaaaaatgaggtgttggcttggctctgagcattcggaaatgctttttctatccttgagctacaacaacagggcttgtctcgagctctgtctgtctgtacccagtgcccgcttctggagtttgacctgccttgtatctaggctgaggaataccagagaatgaagagtaaactctgcgggtttgctgaacctcacattctagtcttcttccccaatctgcatgctgttatttattttgcagggtcctcagctagctgctcatgaatccagtgcatttgggtggctgcaggcagtgggggatgcaggtgaggcgtgctcacaccatcctactggaacctgaaccttctcctagggacctctctatgtgttgagcggtttataatcagggagggacttctaccagcagaaatacagccataggcagatccctgctgaacaggaatttcatagagagagggagggagatcctgcccccagcaattctcacaacatgcccagagcaactgacaggggaatcaggtctcttccaccctccaggggctgcccactgcacagaggagaaaatccaatctcctccccacagcagaggaagctctgtgcagtctgcccccgcccaccactctgacctcctgtaccccacccaggcccaccactctgccctcctgtaccccacccaggcccaccactctgccctcctgtccctcgcccccgcccaccctttgctctccacactccactcacattggccttcttccctttcctcaaacatggcaggtctgttctgacctcgggtcctctgcatgtgctgttctctgtgctggagcccacttccccagatctctccatcgctgcctctttccaatcatttaggcctcagctccagtgtcatctcttccaggaagtcccccgcccccctcaacaatactctgtgctgttgtcctcacggctgcgtcactctctgtcgacttcctctttgcttgcttactgccatttgcccccccgggagatagcacccagggtctgcattcagccacaggtcgcaaatgtgaatgcacctttgtggccacatctatcggtgctgctggcaaggtggaggttgggaagccggacccactgggccacaagtcctcagggctccttcctggtccagaggacccccaggaggaggcagctctgcctccgcagagaatcttgctgcagtttgggttgtccggggccttatcactcccccgcttttttttttttttttttttttttttttgagacggtcttgctctgtcgcccagagcagctgggactacaggcgccccccaccacgcccggctaatgttttatatttttttagtagagacggggtttcactgtgttagccaggatggtctccatctcctgacctcatgatccgcccacctcagcctcccaaaatgctgggattacaggcatgagccaccgcacccggccatcacccccgtctattttcatacatgcagtggggtgagaggcagaagtcccggcttctgctcctgtgtggcttcctactcactctacactccccttcctgacgctggccagaggctggcggaagggctgtgctgggccaggactggcttgcagttcctctgcagggagtcccggagcctggggcctgagggctgccttggaagggcacccaggggcgaggtgtgcaggctgactgttcccaagcagctgggggcctgccctcgctcctctcccgggcacagcacgctgtgagcggggcatcccgcacgccctgctgccaccggctctccggctgcactccttcttcacacactggatgagaggacactgctggggcagcagggcacatggtgcaggggtcctgccctcatttgtgtcttttcccagaggatgggttgtctccaagttctgcgtcaaaactgaagttcagcatacttaagcccagtggttcacaaaggagatgcttgaaacccacttctctcccccagttactcaggtgctgcccagtggagagagatctgtgcacacagccttgtctccctgcggcatctgggcgccacagggcagccctcaagagatgcccctgtcccagtgcggggctggggaggagcccagccctgtgcgagcagatccggatccaccactcattagctgtctaatcctgaaagagtcatgtcatctcttggagcctgtttcccaatctgtaaaatgggcataatgatactgagctcacttcctttgccttcattatcttattttcaatcccttgacaactctgtaaagtaggtaatattgtgccattttagacacggaaaagcagaggtcgaaagaggccaaatagccacaagtgacagagtggggatttaagtctaaagatctcaagtttcggctgggctcaattctttccttcagcccaggatgttcagggatgacagccaggctgggcccctgagcaatgccctctgctgtctttttttttttttttttcctgggggacaggagcgagcagagcctccagaacctttgcccagatcacagtaggcggttcttgcagctgggaccagttcctcccacttggacagagtgaggagtccaggcttcactgaggccaggagggggctggccgccggctccagactggggaagcctgtgtttggggcttgtgctcagtgtgtggggacatcctccggcctctgtcctgcgggacctctccgacttttaattggctttcttctggctccgcgtagatgaagagtttttgccagagccagagccataacggtttatctgtctgctggcttgcgtttctcagactgttactgaattaagttgtatgtatgaagactcttaaataaaataatatcatcgtgtttattcggagcttggccttaaagtgcacttttgagtgtgcacatcattcttcttaaaccagggcctcctttataaggggatttatcttcactttgagaaacgtctgctaaagcctgctgtgccaaagtcctcatgcttactgctagagccacagaagtgaaggggggtctggcttgtcctcaggcagctcaaagtcagggggacggggacaaaagaccagccaaaaagtgttgcaaagacatcaatgggtgctataagaggatgctattcttttgtttctttagttttccattgtttacaattaaacattattcacaacaactgacaaaacatgattcacaataatttacattattcacaattaaaaattacttttgaacatacaaaacatatggtcattatcattgaataatgtagaaaagtattaaggagaaagcaaaaaccatgaaatcctacccttttgagatagtctctgtgagagacagaataatccttctcccaaagttgtccatgtcccagtcccgagaacctgggaataaatcaggtgacatagcaggggcagtgaaggttacagatggaagtcaggttgctaattagttgacttttaagataaggagattatcctggatggcacagtgtaatggcaaggattcttctttttttttttttttttttttgagacggagtctcactctgtcgcccaggctggagtgcagtggcataatctcaggctcactgcaagctccacctcctgggtccaagtgattctcctgcctcagcctccagagtagctgggactacaggcgcctgccaccacgcctggctaattttttgtatttttagtagagacggggtttcactgtgttagccaggatggtctccatctcctgaccttgtgatccgcccgcctcagcctcccaaagtgctgggattacaggtgtgagctggccatgacaaggattcataaaagtagaagatggaggcagaagttcagagtcagagaggggtcagtagatgctccggtgctggctttgaagatggaggagggggccacaagccaaggaatgtgggtagcctctaaaagctggaaaaaaacaaggaaacattctccttagagcttccagaaggaatgcagccctccccacaccttgattttagcccagtgagacccattgtggacttcagatctctagaactgtcagataataaatgtgtgtgtgtgtgtgtgtgtgtgtgtgtgtgtgtgtgtgtttgagttggagtcttgatctgttgcccaggctggagtgctgtggtgtgatcttggctcactgcaagctccgcctcctgggttcacaccattctcctgcctcagcctcccaagtagctgggactacaggtgcccgccaccacgcctggctaattttttgtatttttagtagagatggggtttcaccgtgttggccaggatggtctccatctcctgacctcgtgattcacccaccttggcctcccaaagtgctgggattacaggcgtgagccaccgcgcctggacaaatttgtgtttttaagccactacatttgcagtaatttgttacagctatacaaactaaccgtttttccatcttgttacatatatgtcacactcagaagtgagatcttgtcactcatgctatttgtatcaacatctttaggtttatggttgctctctcttctgccctcttgactggagcactggcttcatttattttcactctggtctataattaagaaggttgtgaacttgcttctggtggtggctttggtctcatccacaggttctgatgtgctgaattctcactgtcatcattttaaaaagatttatgattttgattccagtaacttaagagctatttagaggaatgttgaaaaaacttccgagtggttggattttaggttattaagctttgcgttgattcctagtataatccaaatgttttcagaccttagcatctctgggtttaaattgggtcttgtcagcatttatatctgcatcttgccattccagtgacaccccacccctaaccagcgcagatctcagtttcctacaagggcttgtgaatgcctccccctcaacccctctagcatttctaggcatctcccagttccgtagagcccgtccacacccctcctgccacgtgtgtattctgagcatcccaggctctgcaggtgtccctccgttcaggctgccataacaaaatatcacagactgggtgtttagaaacaacagaaatttatttctcacagttttggagtctcacatgtgagatcggggcgccagtgggtttggtgtctggtgagggctgcttcctcgctcatagctggggccttcttgctgtgtttgcacacagtggagggtgcacaagctccctgggcctctctgataagggcactaatcccattaacggggtccccaccctcatgacctcatcaccttccaaaggcccgcttcacaccatcaccttgggacaggaagagctcatctccatggaggcttggcagggccaggcctgccacagagttaggagtgaaggggacagcctgggttccccgagcctcggggaatttctgaaattgcctctgtctcctggtgtttgctcagcttctatgaatgtcaggtgggcttctgaagggagcacggaatctgcgttgcagggtcactgtggcacgaggggaccctggcctctggtgctgtggaaaccggagcagctgggggcggccagagagaggctgagcaggagggtgtggaggtccccggggccctggggaggagggacagaggccatgggcattggtgcgtgggagggagcagcagaggccagcctgctgagaagggctgtgagggaagggaggtcctgtggctggaggggaagcagagtcttcttgttcaggattgaagagacccggttctgttgttgggctgagagaggactttagagaggaggaggccgaagacgcagcaggggaggcgagaagggacttgtggagagccctgagggagctggtggtgggcagtgggttgtctcggctcagagcaagagctctccgtcctctgggattatagtggagggcgttgggggcactctgccagtgacttcatcagtaggggtggggagttggcattatgccccatgatgcaagggcccaagtcaccctggagagggaagccggggtcttgagggagggtcctgggagacatggggcctcagcgtattggggaagggaacagtcaagagaaaggggcaggctgtggggagggccttctggctggacagtactagcagggagtggggcagaagggggtccccataccaacttcacctcttggttcttggtgccgagaagcagcaatctcaggtttctgcattgccaggcaggtggggtgggaggctacggctgacaggcttgggggattcaggccaggcaggcaggggaggccgggatcaatttttgtaaatgctcccccatgcttgtaaagaatactcatttgctttcggttgtaagtcgtcagatccatccagaaatcaatccggcccatttcccgagtcaatgagtctgtgcccctctgctgtggtctaggagacctgtcacccactgggagtggccgttcgcatttccctttgacagggctgttgagccacttgtgtttctaaccatggcagatgctgcggcccttggtttgtaaagcttggtgactgtgtgctttcaccaagccttgtcaatacaacaggagtttccagtcatttagtacttgctctgagttctattttgatgatactacagacaccctgctttctgggtttgcagttttctctgtctctcttttagcatgtttcaggcatgtgttacagacggcatgccttgtttgttccatctcagtctggttgatctctaactgcaatgttaaacccattgatggttgtgttagtgataccagtggcccgtccttttttcggcctgcacctttgcatctttatgcttgacttgtcccctgtccaccctgggagcaggcaggcagctggtcttcccaggcaccaccctcctgacccacagcacgcagcagcctctctctgcccgccgcctctccctcctgccctctgcccaggccgcccctggggaccttacccactgagcccatctccacctgccttgcggtccttccttatccgagtcggatgccactggtcctctttgctgtacttgctccctgcctgtaccactgtctcccgcctcctgctttccttgctgaattgctgggtccagccccatccctcctcccttactttcctgcctccgagcaggggccccagcctcgctgaaggatctacttcgacattcctgactgctggcctctgcaggcagcatccccccttgggaccttcccgctccctgctcacccacctccttgctcacccacctccccctcctccgagcacagacaggccccggcattgcccctgcccgtcccttgagctccggctgctcccgggtcccatcattgtcagcattctcagaagcacagcccctgccgccacctcctccatggctctctggcatcacccaaagcgtctgctgaggtcccacggaccacagaggtgtggatcctgtggtcattctcctgtccccacggctcaggcctcccccatcctcctgcttcaccatcactgcatcgtccgaggcaccgccagctcctcggtttgctcttcccctgggctctgcaccttggcacgtgctgtgtggctgagcaggaccctcagtctcctggaccacagccagaaaggcatttcctcctgcagtggggcgtcctgggttggaggagccttccctcctcatggcagcctccttccacagccccacctgtctccacgcctcccttgctcccagcacaggccccactagtggtttcagcggaatatggaagggcttttgaggacgtgtgtggaaggtggccttggtggctgctcctgaatcccttccagagcctccagctcctcccaccccgactctcacttgcgggactgccccagccgccatggacggggctcctctgccctgctcagaatgttctggaccagcctgggactttgtgtcctgagtctgtggtggttgcagggaactggctcacccgtgtgcttcagggtggaaattgggctggagtgtggaagtcccatcccaaaccctagagatgggaccagcacctggactatgagagtgagggctgcctggtcgggctacagggcatgtcggatcagtcaggggcctgggacacataagggatcaacagaaaggagttgacaaaggcacaactcacagagctgcgggcaggacgagggagcttgcagggcggggaggctgggggccaccacagcgggagaaataaaaccttctgtctctctccccagccctggcttcctgtcggtgccccccttcacccagggagagccaggaggagccagtccatcaggtctgcctactgggctgtaggacagggcagaaggtgaaggggtggggagcccaacagagacccgccagcccagaacatcagcctggaaggaagggacgcagggacctggttcttctctgtgtcttttcaaagccaggtttcctttctaatccagaatctatttattcagccaggcctggtgccagatgctctcaggctctgaggatgacagacaaacccagcagcctccagtagggtgctcaaggcctggttttgaagtggaaacaatgatccatgcggccagtgggaacccgccaagttccccacaggcccgttcgcctagaggcagtagttgagagcgacaggagggcctccatgccaggagtctgcacagtgactcttccttccttctttagactgcctcagaggctgtcagcatttggggtggaaaagagttgtcctgttgagtgtatacatgacctaagtctactggagactcaatgagggaattgaaggatttttcagggaaaatgttgacatttcctgctgaccctagaaagcaagcccctccgcttggccagcaggaagtttctctggcatcaggggcaggccaccttggaagctgggcacacggggcaggggccaccctgcggatgtgggtgcagccctgcggggaagctgcagtgggggcgggggcagggcttggggtggcccttccactccccaagtctgtgggtgcccaatctccagaccaccattccggacctccacaagctgcctccttgggccacgtgggtgggtcagacttgcatgggtgctcagcatccctgggtcgggttgatcctggcaccccctagggtgggtctgctgggcagccctcggagcctggacagagcttctagccatgcacccatcttccctgttcatgggattgagtcaccaaaggaagggcattcattaaaaataattggctggctggacgtgtttctgggctgtcagctctgactgtaggctgcgtgccttcatcaacatctttctcccggttcccagtcatattttttctttttgaaagtgtctttttctgttacccaggctggagtgcagtggcagcatcttagctcactgcagcttggaccttcagggtttaggtgattctcccacctcagcctcccaagtagctgggaccacaggcatgcaccaccacacccagctaatttttaaattatttgtagagatgaggcctcactatgctggtctggaactcctgggctcaagcagtcttcctgcctcggcctcccaaaagtgctgggattgcaggccccagttcccagtcattaagtggaatgtttgagatgcacaaataccttaaaacaaaaaaacaaaaaaacaaaaaaaccttggccaggtgcggtggctcacacctgtaatctcagcattttgggaagccagggcaggcggatcacagggtcaggagttcgagaccacctagccaatgtgatgaaaccccattctactaaaaaaatacaaaaaaaaaaaaaatttagctgggtgtggtggcgtgtgcctgtaatcacagctactcgggaggctgagacacgagaatcacttgaacccaggaggtggaggttgtggtgagcccagatcatgccactgcactccagcctaggcgacagagcaagattccatcttgagaaaaaaaacaaacaaacaaaaccctaccctggaatgccaactccggtgcttgtcttgggctgggatctatggggcactggcctgttctggcctagcaatgggaggctgatgtcccacgcttgtcctgggctgtggcccggaggcgttggcacactccagtccacatgggaaggccatgttccctatctgtctagctcagcgcacggctctgactcactgcagttagcagggaaaatactcttcacattgagatgtcagttttcacttcaagcctgatttctgatccataaacaaagcctgcaagaatcagaggctgctcatgtgggagtcagctaattaatctgactttcctcaaggaaggcacaggccgctgcctcttttgtgaagattagcactttttaaggacgtgtgagtctgtcaggacaaagcaacaccaataacgttccttattttcggggagcagaggaaagtggggtcagactgtcttccccgtggacaaggaggagcggcttcaggttagcacttacaccagtgctgtgagtgagaagctgtggctgtcaccaaggtgaggtcatggctgcaggaaagacgcttcccaccctctccccccaacaacagaggatgtcccaagcccaggggaccggccagcgtagctcctgacaacctctaggaaaacaggagggcttctctttggatggcaaaactgacctcaactcacttaagcagaagacaattcaaggcaggctattggggggctggggctggaggcctggaaatggggtaccttggagggccccagccaggacctcaggaagccgtctgggcagtggtctgcactccagggtggggtgggagcttggattggccctgcttacaatgggcttctctctcagatgtatcttgcaaggagagagagtcaccttgggcaagctgactcccacccacccaggccccttcctgacagtccttctaggctgttcccaaaggcatggctggctgtccctaggatacatggggccctgggcatatatttcctgcaggactcctgtctatatagacaatttgattaaaaaatttataacaagattcatgagcccacatggggaatagcaagatgtatcaaggaagatttaggggacggggaggagaagcacgaacacatttgctcactgtctgctcagtgcttgcagagaccctcgttactgctcaggctcaggagctatctcttcctgttctttatggtcgagtgtgctgtcccagctaatttcatatttatatctcccacagctggggggtaatagcaaagctgttaccgctcacaatgtgtggctctttggaacctgtttgtgtggagatgctgtatatcttcttgccccgcattccccagccccatgtatttagtgctggttgtggcatttctcctgactccgccgcttctctctgcccccgggaatgccggcttccgttgttcccttgaaggtggttaccgtgcttcattaatgatgaccaccaatgtggatcttgcccagagtgtgcaagaaaatgtgagccatacgtcctcatctggtcgtgttaaatttaatgtttgggccaggtgtggtggctcacatctgtaatcccagcattttgggagaccaaggcagtaggattacttgagcccaggagttcaacatcagccctggcaacatagcaagacctcatttctacaaatttttttttttcttttaattagctagctgttgtggcacacgtctgtggtcccagctacttgggaggctgagttgggaggatcacttgagcccagggggtccaggctgcagtgagctgtgtttgagccactgtactgcagtgggtgacacagtaagatcctgtctctaaataaataaataaataaataaatatcgtttggacctttatagcgaagggaagaaccacacatcttgcagcctcatcttccccatcagtcctgaggctgttacttctgcactcccagaattcaacctcgtttaatggtgggcacactcccgccttccacactctgccaccagcaggcagaatgacaagagaagagggatcccagttgtgacaggcattccatccctctgcagaccagcctgggaggagagcatgatgtccagcacggcttggaggcaagagaggacacgggaagggtcgtggcattgcagggcaacagcttccctctgaaagcactccaagcaggtggatgcagccagccctggaagactgcccggaaatgacacggaacctttgagggtgtgggccaccgccctgggcaccagtgacagaggcacagagtgaaggatgtctgctgccactgcccacccctgaacaccagagcccggaggtggccccacagccgatgcaggagcccacaagtgccactcaggcttgaggcttgggcagctgtatcccagagccccgcactcattctgtctgatgtgagtgggaatcctcaaaacccacgtgtcagcatcatgctggtggctcagtcccattcacacctgtgaaggaagtcccctcctggccagtgagggtggctcgctcatcaagccactcactgagacctgaagcaacctcatagtcaacagccctagagctcctggggcatccgtggccccatgcacagggcagagggttggagagtgccctgaagggaacggcagggcccacagggcggctcaggcataggccctctgcacaagagcattgctccggctacacggttctccctggtgttcctggaacacgccaggcttgcttccttctcagggcctctgtacttgctccccgatccctggaacctaccaccttctacaggacctgctccctggacactggggatgcagtgggcgcctccactccagggaaaggcagccaatgtgaagaatggaccggccagagagcactgagggaggctggggcccagttttatttttatgtgtttaaagttttaattttgaaataactttagatctatgctgtcttggaaaaattgcaagaaaagttgcaaaaatagcatagatttcctctgtgcccttcacccagcttcctccgtatgcaacgtagaacaaggactgaaaccaggaactttgtaggttgatactaagcgttggtacttagtgtcttagttttagtctattttgtgttgctataatggaatacctgagactgggtaatttataaagaaaagaagcttatttagctcatggttctgcaggctgggaagttcaagagcatggccctggcttctggtgaggcctttttgtgctgtgtcataacgtggtggagagggtcaaagggaaagcccatgtgtgcaaagaagggaaacccagggagtgtcctgcttttataacaacccaggctcgggaactaatcaagcctctccagagcaagaattcccttgctaccttgagaacagtatcaagccactcacgagggatcggcctccatgattcagatacctcaccccaggccccaccttccaacactgccacactggggaccaaatgtcaagatgagttttggtgggaacaaaccagtcacattctaaccgtagcactccagactgcactgaattttgtcagtcttccgactcatgtccgttgtctggttcaggctccccctcaggatcccacgtggcatttagttgttgtgtctctcccgtttcctcccatctgaggtttcatgacctggatgtttttgaagaggactggtcagctgttttgtagacggtgcatccccatgggtttttctggtgtgccttgtactggcttgagcttacgtgtttctggcaggactgtcacagaagcactgtgccctccgtagggcaccacgctgggactgtcacattgggatgtccagttgtctcctattgtcagtgatgcccttcttcatttggctaaggtgttacctactgggattccactggatgccccgggagctctagggctgtgactgtgaggttttttcaggtctcagatgagtggcttgatgagcaaaccactctttcactcttttttcccattgcgatgattaaatctcccgtgggtagctgctgtgacgtgatgtgagcattctgtttcttgttatccttttgctcactaattgtagcctccacggataagtcgtacctgccgcagtcctgactgtgctgttgccgatggggtttactaccatgattttctatctcatcatttcttttacatttttagttgaattaccctgtgagaaagagctgcccttcccctcccacttatttattattcagttatttgtttctaccaatactgatctgtggatatttattttattcaatgggttctaacctattactatcatttattattgtgttcaaattgccccagatttgaccaccgaaagcaccttccagctgcctcctccatcgttccgctgtgcttgggtgtgatttcacacggggcggtgggacaggccgtctctgagcagggagtgtgggtgtgagcagagccctgcaggaggggcgcagtcctgtggcagtcagaaccagctggggggctgcagcctgctctcggggaaggcctggtatgcacaaggtcagcacctggcctggagctgccacctgctcacctgtctggtttctggtgggggccctgagatcccgggcttggcactgccggagggcggggctgtgctgcggtatggatgccgtgccgtgctgtgctgtgcaggcagggttactggacataagcctggtgtggcctttcataccctggggtgccactgtctcccagtgtgacacctggtggccttgtcccttgtgaggaccaggatctgtggggcacttgatcccatgagttcagtctccccgaatctgtagtggcatccagggagggcaggtgcgcctgagcctgcctgcattctggatacggcgcctttggtcattgctggcctcgctgctccggctctccagtgggccaaccacccacagaggggcctagggccctggcggctgctgtcctggctctagaataaatacacatcccagagtcaccagtgtgggctcaccagtgctggggccctgcccccgcccctcccccggagccaccctgggtgggtggggacacgggctgggcagtgtctgaaggcctgcagagcagcctggccacagcccagacaacctggccctcagagccctggctcttcccataaataaaccagacaggatccttcgtcagatggtatggcctgatttttgttttgggaactctggacagaaggggaagcagacagcctcgggcctggcagggctgcccgcccgggagtggcagctgggcaggcgggcagaggacggtcggcggtcagcgtgccctggatagcacagtgggccccagagatcacagcaggaaaagaagcccaattcaaaggaagcaggagtgaggcagtgcacaggctctgtgtgtgcatgaggccggaggggtcctgagaggggcctgtggcccagggacccggggagatgacagcctgtgatggaaagtgaaagggggggtcctctggctgggaaaactgcctgatctgggcagctttgcacaagcagacatggaggacatgccccactgagtctcaccatcaactctcaactgcagccccctctgggggaaccgaggctttgagagaggaaaggctgatccttgttgcacagtggagtggggggactggcgttgggcgggctgcgtcccagcctgtgctctccccatgggagttcctgtctgcccctgcttctaagggggacgtccgtcgggtagtgtgtcttccccacactgctgggagccagccaggcagctgggcccttggtgggcactggtttccctctgagcacctggcccctcctggaggagcacccgctgtgggaaggagcagaccctgcctcctgggtcctcgagactggggacctgctctccgggctgagctgccacagaaagggtattggatgctgttcaaaacacgccacacatctagaattgcataccccgtcttccaacagctgcgtagactcagccttgggatcgcccagaaaattctggggtgcagtgggcatggggagtgcccccacacgggagccttagccagcctctctgcaggaatgtgagacaccagcctcagctggctccagtcgtgggctctggagcagggctcctgctggaccgtgagagagtggcctgctgctggcggaggggtcctgaggcccgtccaccacccaccggctgtgcagcattcttgtctccctgcgcctgcactcactgccccgtgtccccatgtgagaatgcccagtttagaaggaagggtgagatgggcatcccatgtggccagccctgggcgggctcctacttccctggagtggcagctttcctccatgctggatttctggcccctggggagtgatcctggcattgaccttccggcctgtccagagtggctccccaaggaacagcccgcccagctctggccaccggaccctgccagcagcctgctccgattctgtgtggacttggcgcctggaggctgttatgggctgagtgacgccctccctagatcccccagttcctttgttgaggtcctaaactcccgtagatcaggatattggctgtatttggaggcagggtctttaaagagataattaactgaaaatgaagtcactgattcaacatgaatgactggtgtcctaagaagaagcgattaggacagaagtacacacagggggacggccatgtgaggacaggggaaagatgctgtcgacaagccaaggagagaggcctcgagagaaaccgcctctgcccacaccttaattttagagctctagcctccaggactgtgagagaataggttctgctattcaagccccggcctgtgctgccctgtgatggctgcccgagcaacctagggaaggcgccggccccgaccttttgtgggagggggtgctggcagtctacctgggcagcatctcctggtggatgtgggtgagcctgctgtgaatgctgggggacggtcctgggtccccaggccctcagttcttggagtgcagccttgcagggtttggttgctctccagggtgggtcccctggggaatctggtaaggaagcatatgttggcaactcccagacatgtgcccctgccaccccagccccctgagcagacagacccaccgtgccggctctgtctctgggagtgctggtgctcaggcgtgctggtctcccgggctggttggaggaagggaggggcggtgtgtgcagacctccaaggaggcagggaggctggcagggaacagctgtgcaaaggtgttaggttccagctggtgtgggcaggtgccagcccagggaagggcctgtcgacagggtcttttttttttttttttttttttgagacaagagtctctcactctgtagcccaagctggagtgcagcggtgcgatcttagctcattgcaacctccgccttctgggctcaagcgattctcatgcctcagcctcccgagtagctgggactacagacgcccaccaccatgtcccgctaatttgttgtattttggtagagacagggtttcaccatgttgcccaggatggtctcaaactcctgacctcaggtgatccgcctgcctcggcctcccaaagtgctaggattataggcgtgagccaccgtgcccggcctgttggcaggatcttgaatggggaagttggaccttattccatgagctctcctccaccacacgtctcaaggccacaatctgctgtggtccagctggtgagacatggaagctcagaaagaaaaatcttgctttttgatagtttggcaaatgttcctgcagcacgagtcatttttcttctttagtagagagcgccctgttatttatgtgaatgttaatttgtgactggggacgttccccgacgtgggcttcatgctgaacgagacctgggaaatgtcagccagagaatctggccgggacgagtgtcagttctcgtcacaaataggcaggcctgttgcagtcccagagtctgggtctgacccactgacctctgtgtcctggctgggtctggctggccagctctgtttcctggaggctaccccggcattggtgtgtgcaggagccatggagatgggggagctggctgcagagggctgagtgtgggacattctggacaggccaggtcccgagggagccactcaagcgttgcttgatttagcagaaggccgcctggctggcccctgcgctggccccgtgaggcattcttgtcggcatcttgtttattccattttcccccttatctttctctctgtgctctccccctttccgtctctcctgtcttcacatgaattgtctgttttgctatatgccctttgtaaaaatgtaaaacaaaaaaaatacagaaaatattaataaaaagtgaaactcacccccgatcgtaacactgctgaccctttgttacgcgtttcctaacagctgtcatgccatgatcatcatgatggtgatggtgctgccagtcggctgatttatcacgtgctgtgcccagtgctagagacgcggtatctcgcttagccctcacatcagccatggaaaccctgttattatctccattcaaccctgcagacactgtccacagagaggccactcagtcagaggtgaagtaaacatttgaatcgaggcagagtgactcggaggccacatgcttaattattagactgtgctgacgtttggcacagagatatacatgattttacgtaaggaggtcatgctgcagctgggcttgccgccttcttcggtcaccaatatgtcatgggtgtgtctgttccttaagtggtcaaaaaatctgagaaactcttttagcctagcataaatctgtaaattttgtaaaattattttgcagggcatagagtgttattgaaataatctgactggctgggaacggtggttcacacctgtaatcccagcactttgggaggccgaggtgggcggatcacctgaggtcaggagttcgagaccagcctggccaacatggcgaaaccccgtctctactaaaaatgcaaaaattagccaggcatggtgttgtgcacctgtaatcccagctacttgggaggctgaggcaggagaattgcttgaacctgggaggcagaggtctcagtgaactgagctcaggccactgtactccactccagcctgggtgacagaacaagacactgtctccaaaataataataataataatctgaccatttattgtttttgttgtctgtttttgtttgtttgtttgtttttgagatggagtctcactctgttgcccagaatggagtgcagtgatgcaatctcggctcactgcaacctcagcctcctgggttcaagcaattctcctgcctcagcctcccaagcagctgggaccacaggcgcgtaccaccaagcccggctaatttttgggtttttagtagagacggggtttcaccatattggccaggctggtcttgaactcctggccttgtgatccattcgcctcgtcctcccaaagtgctgggattatggacgtgagccactgcgcccggttggattttgggtttttttgagacagggtatctctctgtctcccaggctggagtctccaaaataataataataataataatctgaccatttattgttttgttttgtttgtttagttttaggttttggtttttttgagtcagggtctgtctctgtctcccaggctggagtgcagtgacatgatctcggctcactgtaactctgcctcctgggttcaagtgattctcccgcctcagcctcctgagtagctgggattacaggtgtgcaccaccacgtctggctaattttgtatttttaggacagatggggtttcaccatgttggccagcctggtctcaaattcctaactgcctcagcctcccagagttctgggatcacatcatgcccagcctacatttattgttatatatttgttcttacttctgtcatctaatttatgttttctgtttttctggatttttttttttttttttttttttgctgtttttctagtctaccatattttctatatggtctgccttcagtcatttggaaggtatacattagttttactagttgtgacttttctaattttgagtagaattcttcagcttgtatctactgattttagaaacttaccagtaactgttgatgctaactgaagattctgaagattaggaaacgagtgcaattaaactgtaattccttttttcttcctctactctttgtctgattgttgtgggcttgtttggcaattttttgcctgcccccatttattaaagttaaattatgaatagtttatatattacatagctttttttttccagaatatatgctaaatgtcttctgatttgtaaccctcattatccctgtagcatagatgcagagggcaattccgctatttcgacctgtgatttccccacttgccaggtgtctcagttttaaagtcaagtccaggctgcgtaaagtggcaggtggggggtgctggggagggatgccaagcagaactgagacagacgctctcgagggcattctctagcagcagggttgaagccatccctctgtgcaccctctcccagggcccagagttgctcacagtggctcacctggttagttgatagacttagggctcccatctcaagatgacatggttttaccgtgttagccaggatggtctcaatctcctgacctcgtgatccgcctgcctcagcctcccaaagtgctgggattacagggtgtgagccaccatgcctgaccaagcccttggtttctaatgcagagtttctttgtaggccaatgtttcctaaacattggcctaggaggtgaactaatgggtaccaaacatgactccagaatgcatttaattctatcaaatcccagctagctttgtggcagaaattgacaagctgatcctaaaattcatacagaaatacaagggatccagactaaccaaaatgctattgaggagaagaacagaggaagggctcatgctttgtaattctaagacttactacaaagctgtagtaatcaagactgtgtggtgttggcagaaggatagacatatagattggtagaatagaactgagagtttggaaatacatcctcatattgattcttgacaaaggtccaagacaagtcagtgggggaaagaatggtcttttcaacaaatggtgttggcacacctggatatccacatatggaaaaatgaagttggaccccttcctcacaccatacacaaatattaactgtaaatggatggatcatagatctacatgtaagagctaaaactatagaactcttaaataatgtaggagtaaatctttgttactttggattaggcaaagtcttagatatgacaccagaagcacaagtggacaaaagaaaaaaataggtgaactggacttcaagaaagtccttcatgacttcagtggacactaataagaaagttgaaaagacagcccacagaacaagagaaaatattcataaattgtatatctaataagggatttgtgtctagaatatataaagagctcttacaggtcaataaaaagaaaatggtcttattaaaaatagggaaagtatctgaatggatgtttctccaaagttaaataaatgacctataagctcatgaaaagatgcttagcatcattagttgtcagggaaatgcaagccgaagcatgatgggacaccacttcacacctgctggatagctagagtcaaagagcctaagaataatgagtattggtggggatgaggggaaattgaaccctcacacactgctgggggcactgagaatggtccagcccctgtagaggacagtctggcacagttactgtatgacccagtaattccactttgagaggaatgaaaacacatgtccacacaaaaacttgtccacagatgttcatagcagcattatgcataggagccaaaaaccaacaacccacatgtccatcaactggcaaatggataaataaaatgtggtatatacatgtgatggggtattatttgacaataaaagaggaatgaaatactgctatatgctacaccatggatgaaccttgaaaacatactaagtgaaggaagccagtcacaaaaggccacatagcatgtgattccacgtatatgaaatgtccagaataggccaattcatagagacagaatgtagattagtggttgcccagggctgggttggggaggagaggttggggaaaacatggggagtgactgccaatgtgtacggggtttctttttggggtgatgaaaatgttctaaaatcaatagtggttatggttgaattgttcactttcagcatatagtttagatggctgagatgtatggaatggtaatcacagcaccataaagctgttatatattaaaaagcattgaactggccgggcgccatggcttatgcctgtaatcccagcactttgtgaggccgaggcaggtggatcacctgaggtcaggagtttgagaccagcctggccaacatggtgaaaccccatctctactagaaatacaaaaattagctggatgtggtggtgtgtaccagtaatcccagttacttgggaggctgaggcaggagaatcgcttaaaaatgggaggcagagtttgcagtgagctgaggttgtgccactgcactccagcctgggtgacagagcgagactctgtctcaaaaaaagaagaaaaaaagcattgaactttataatgaaaaatgattcccttttcagttgcattttaaactctctggttgagtcgaggggagtctcagtttggtgctgacagatctttaccagctctctgctacttactgacctctataacaagagagaagggcagtggtgtaggctttgaggtgcaaatagaagcccggagagagaggaagacactgggggtgcgcccagggacagagggctgctgggaccccatggaaggccttgcgtgccatgggacggccttggcctttattttacaggagtgggtttctggtttttggtttggttctttctccttggtcctagtagagttttagaaggatgatcggtacctgccaacgtgtgcggggtttctttttggggtgatgaataaacaggataagcagtaattcataggttacgtagtccagctcctcagtttgcagatgagggaactgggggcctgcaagggggcaggactggccatgaccgcattggaaaccagggcccctggctcagcgtccagtgcttactctccctgcctgcctcgccccccaccctgcccttcaaagtggagtctagctttccttagagcctcgctgggcatgtgactgtcggggctccttggtcctgttggaaattggctccggccagcttaggccaaaaaagagactttctggagtaaaggtctgtagggcctgaaaccaggtccagggaaggttagagtggccaagcaaagtcatcaggttctgtggagctcagaggcaactctgttgtggtcactgtgctcagcagaaccctggaaggcccagctccagccatagctccaagacagagccctagacaaggggtcgctctccaagaggaaggacgggagtggctggcacctggcgaggatcccatgagacagaggaggagctggtggagatgcgggtgaggacagctgtttcctaaccccatggacagctcctgcccgctggcgtcccttttggaaaagtggaaaagtcagtgtgtgaaatcctctgggatgctgaactgtaaaggagcccccagtggtgaggaccgagtggctcaaatcccactcgatacttcccactcctgggactgtccagtggtgaggacggagtggctcaaatcccactcaatgacacttcccactcctgggactgttcagtagtgaggggtccagcccccttccctgaaagctcccaaggttgttagagacctccctggggagctgggagaggcaagagagtgcccgagcaggctctgagaggaggcgccctgggaactgcaggcactgtgcagctctccctgtgagaccgtcattccaccaggcagctgtcacagcaggggaggctgcctggccattgccccgttgtccagcagatctcccaggttcattaccaaaaggaagatggggagaaagaatcttggagttagaatactttcaggaatgggaatcttagcagatgccagcatctgggggactcttggcaaggtgcgtgctgtgtgtgtatttcggagggaggtgagtttgagggcaacagggacttgcagccttgtcccttggcaaagtctgggtccctctgtgcatggacctgtgtgcttcctatgctttgtgccttctatgcttgattgttgccactgcaaccttggcacacacctgacagtgtttatgctggaggttgacagggttgagtgacagaccaggtcccagtcatacacaggtggggggctgctgatggctgcagctgtggcttccatgggaaggggcagtgggaaccagccagcctgggtgctctgcagaaggaaacaggatgcatgcttgtgtttcctgtgaacccctaacttccaggctgtctgtggttgaatacttaaaaattcagagtaatagaggagagctgttaagcctttggatctttataaatttttaacatctagttgccatttctagtaactactttaccatcaatccaactgcaaaggagcaggttctatagaaggaagaggcagggcaggcgttgtgtaactcaccaggatctgaatgccggcaacttgacttgatgacccgggtactaccaggctctgggcccctgcggtggcacctgaaggtcagggacagagccctccccatgatcctctctctgtcccccaggggagaacctggctgggtttgccagacatccacagacttcaagagcagagcgggactcacacttagagccaggtcggggtaccaacctttctgtaagaccccaggctggacagctgtggggttggacagacaggccaccagcaggctcccaactgagtgcttttcagcctagtgtgcttctggagtttctttaatatttattgagtggggagaggaaactgattctaattaataaaaattacatgtaaaaacagatacacttgacactggcagcaggaaaatcaaagtcccggaaaaaaatgcagcaaaacatagctcacattttgtgctttgctctcctgtcaattttcttctgtgtgttttagacagatcattcctgggatgcatatactgaagtgtttgaaaatcagggaataaaatgatctccacttcttccgtgaagtgccccccgccccgagcattattctggccagcggtcttggcaggacgtcagctgatggtcctgggggggtcagcctttggtctcgggggggtcagcctttggtctcgcggggggtcagcctttggtctcgggggcggtcagcctttggtctcgggggcggtcagcctttggtctcgggggggtcagcctttggtctcgggggggtcagcctttggtctcgggggggtgtcagcctttggtctcacgggggggtcagcctttggtctcagggggggtcagcctttggtctcggggggggttcagcctttggtctcggggggggtcagcctttggtctcgcgggggggtcagcctttggtctcgggggcggtcagcctttggtctcggggggtgtcagcctttggtctcgggggggttcagcctttggtctcgcgggggggtcagcctttggtctcgggggtgtcagcctttggtctctggggggtgtcagcctttggtctcgggggggtcagcctttggtctctggggggtgtcagcctttggtctcgggtggggggtcagcctttggtctcgcgggggggtcagcctttggtctcgggggggtcagcctttggtctctggggggtgtcagcctttggtctcgggtggggggtcagcctttggtctcgggggggggggtcagcctttggtctcgggggcggtcagcctttggtctcgcggggggtcagcctttggtctcggggggggggtcagcctttggtctcgggggggtcagccctttggtctcggggcaggtgccaccatgttcatcgtccagcatgcgttgtgcgcatcgcacggtggtcaacagagacgggcggggctgtgaggagcatgttgaacgtctgtgttggagaatgccaccgcttggaggcttctggctgtgtgaggaagcctgagcccaggccctgcttcagatggaccccagtgtgctcctgtgccctccgaggagtcgcctgcaggggtgcccttccaggaggcaaggcccagggcagcatcagatggagctagtgctgttggctcagcccagtgattgtcctcagggaggcagccagggaggggagcctgacccctgctggtcagggagaccccaaactgtcccccgggttactccggccagagagtactgcccttccccaggctgagcctggcctcattgtcacactaggtccctccagaataaccccagggcctcaggcctgtggcatcgatggctcccgacctgggctgcaagttcccccagaagatggagctgccataaggggtcctcatgccccagtgtcctgccctaattggctcaatcggcccagtctggcccagggacctgtctgggagatgccctttccgtgtaggtgtgagttctgatccctagaacctgtgtgtccccagcagcctgtctgcccatctaggcctcggtttcctcatttggaaagcaagctggctggatgaaatcacttgggtggaggcgtggcctggttctcagtgtctcccaggctgcatgtgctcctgtgtgagtgtgcacgggaaatgaccggcctcatgtacagacgagtcactggacgcttggggagcttgacaccttgcctgaggtcacctggccagatagaaagggtgccaggaagtcagaacttcacgctccaggacagcttgcccgctgccgccccccagggttaattcctgcacttcatccaatgagtttcagtcataagatggatttgaggcaccagccttctccacaccacgcaccgggaccatcagtgctggaccctcccaactcctgcactggtaaacacactgcccctgtgccagtggacaggcctggctgtgttcttcccgcctgcctgctcggtgcctcccttgggggacgtggcctgcagctttggggtcatcggttcgctcattccacaggcatctgctgagtcttcgccaggcctggttgagccctgagacccagggatgagtcagaagcgtggggcctgcagggttcccaccccctcttccgctctcctcccacagccctgctgacctccttctccgacctcggtcttgccctggtaactctggttaccactgcctcctaggcctcttccccagaagcccaggatgcctgagcccagagggtcctgcgccccttgcccttcttctcatgcccctcggagaatggcacccactttgccggccacccaccaggaccctgaattacttttctgcggctgctgtaaggaaccacttaaaacagcaggaattcgttctctcacagttctgaggccggacgtccgaagtcggtataacctgacccaaatccaggcatcggcagggctgcgctccctctggagactctgggggaggacactttctggcctctgccagctcctgggggctgccagcattccttggcttgaggccacatcgctccaatctccaaagctggcatctggcatcctccctgtctgcccatggcctcgtcctctgcgcatctgcctaatccccctccactccccggcataaggaagtgggcaaggactgcattcagggcccagccagccccagagctgacctgatcacacccgcagagtctctttccaccatgtccactaccctcacagctgccagggatgggggcctgggtaactttgggggccggttcttcagccacagacctggaagcccaccaggtgcttcctcctccctcccatctcagccggctctaccctaccacgtcctgtccatttcgctcctcacctccttcatacctgccactcgtccttgtctctcatgctcccgtctggaccattacccctctcccaggtgcctgtaacaccttctccccaggaccccagacccatttttgttccgcagcccattccccctgccgcagccaccatgcttctgaactggaatcagatcaaggctccccccagaagccctgggctgcctacaatctccctcaccagccccctgagtgatgggccaccgggcaccgtgcccttgatgctcctgtccacccacctggtcagctcttcccaccagctgtgctccgtccacctccccggccatggcatgtgcggtttcccccatatggagcactggtcctctctctgactctttgcctggccagcacaaagggattgggtgggtttgggtagatgtcacctcctgccggaggcatccttcattctggagccaggcctgatgctgggctctgtgttcctccaggccctgcacctccaccagcccctgcctggcacatcagcttcccgagggcccaggctgagtgcgccgggaggcatctccagcctccctcgctacacttgaggctaggggcagccgcccagcaggccctggggggcactgactgcatctcggtctgcagaggctcccagccagcaacaggatggggctcaccgagcacctggggtcagggagaaggaggggcagcccgtgcgccaccgtgcccccccacaaccaagatgatgatatggcagaggccatcatgaggttactttggggggggtgtggtttccgcacatccagatggcaggtgccgggggctgcccaccagagggcacactcctaactggacaggggaccccggccagcgccagctaagctggagtgtcgatgggtgctggaaatgccagcttttctgattttcaagagagtctggaaatctggtcgtttatgtgaactctcctgtttcttaagtttggcaacaaattcaagcttttaaaatcccctgcatgggtcataagcttgtgatctgaaggaaacactctgaaggctggacacagtgtgcacttccagtgtgagaccttggtttatggataatggaccagaagataaaagtgtaggagctggagttgtcatgggatgggtggacctgatggtgccagcaggctggatggcagggtatggcaggggagggcagggtatggcaggggagggcaggctggatggcaggggagggcaggagacgtgaggggggctgaatcaggccttgaagggggaacacaggtttaccagatggccgagctggggatggggtggtggggtgggagaatggggattcctgagttggcagcatggggttcaggggctgggtggctcggcagggtgcacccagcccagtgagaagcatggggtggtgcaagccgcggtctgggagggtggggcaggccaagagcctgaatgccagcatatagagcagcctgagtcccaacggaaatgaggacccagcgaggagtttgtagtcagggagggtgctggctggcctagggggtcaggggcagcagttcagctgcctgtagagtctgggctggtggctgacacagagagcaggagagacagttggggggcagtagggactggagccagttgcaggggcatgtgttccatccaagacccgctgtggtcagggcctgcgtttccaaggaaagctgggattccatgttcaagacatgaaatctcatcattctgagtgttagcttcagagctttaaaaatattgtttggcccagatggaacatgtgtgtgggcagattcaatccccggctggctgttttgacctttgtcttggactctgggctcctgggagtgggggcagcacttggcccatattgatgcactttggtggatgccctcctggggacacgcacaggcccacagctgcccttgaatgtctccctgcttctctggacggttttgactttataaacacagtaacttttctgaaagcagacagggttggtgtataggggtggagatgacccagacagaggcccctttcctagacagggtgggcggcggggggcggcctctgggaccacatgttcataccctccggccagcccagggttcaagctgagcaccagctggggtgctgggcagggtcttcaggtgggaggtactccctgagggggtctcctcgctgttccccttccttggtcttttgtgtgctggaaatctgatcctgttgtctttgtcccgcaggctggtctgatccggatggaggaggaggagttcttcatcgaacccttggagaaggggctggcggcgcaggaggctgagcaaggccgtgtgcatgtggtgtatcgccggccacccacgtcccctcctctcggggggccacaggccctggacacaggtgaggctactgcaggtgggcaggctgtgtggagagccctctgaggccctggtccccaggggagcatcccagagactcaggcagctctccacagaccagcttggctgctgaggctgagccccggtctcagtggctcagaaatgggccagctgcctggctgacggcagggcgtagcagggctgctggggctggggcctctgttctgggtgcatgtgggtgacaagcagcccagacacctctgccttcatgtctggggcctccatggtggactatgaaggctgtccaagggcccatcttctgttgcctaaaggcaagcaagtgtcgtggagcggggcgggggcccccggccaggcctgagtccagtgcctgcgtctctgagtctgtgcctgtgaagaggcctccagagccccagacagcgcctctcctgctctgtgctgccatggtccctgggagggtgcctgtggtaggtcccaaccctcacctggctgctcagggagaaaggccctgcatgctctttctggatccctggaggcatgtgccctacaaggactctggaggtgctcccagcagcctcagcagtctctgcacagactcatgggcgtctgtctttttcaactcagaacccacgtgtgccctgggcccagaaacgtgaaaggagctgccaggcggccatggtgacagtccatgactgtcgcctcagatctggcctcactgtgccagcccacacctcccagcatcccccagtctctggtcctggattgtggtgaagccagggttggtgtctgatgtggttctgcaggcccatagttctcagggtcccccgtgtggtcagggactcctggcctgtgcttggctcttgctgggagagtgggaagctgcgagctcagccctcagcctctggtcaggacccctgggtgaggagagtctggagtctggggcccaggatcgggcacacctgcacgttcacagcgagtgctccaggggcctgggctgggccagcccccgtgctgtgatttactaaggtactcccgtcactccatagcagccccgcctcatttactgtaggtctgtctgacttcctagcttgacagaaaaattgggtacagcctggcaggcatacttctaatttcatgaaacggcatcagatacctttgcaaaggaattgttccatcaggaagcccaatgtactctggagccaatcagtgcaaccggtggccccttgttccttggtgacaaatcagcgtctgctatgctgcagacagccgggccactgggtactgcctgcccagccttttccagctgtggtctcagcctcgacttatccccacccttggactattttgcagggaaggaaggaggagtaatctaggagggccagcgtggaaggggctgagcgagtgctccagacccgggggcagggccccagctttgctccttgctagctagctgctgtcgggcaagcccagtggcattagcaacccctgtgtccccgagagctcaggggctggtcacttgtgctgtgggcttggtgcttctggctggcctctcctggaagattcagggtggttctgggggcctctgctcaggcgaggtgagctggccacgtgcccttggccatgtctctgatcccagattccatatggtgcttgtcttcctgaacatggcagcccttcccccacagcctggccggccttgccttattttctgggcttctgctggtgtttggcatcttctgctgaatcctccctccacccccacccccaatccacatatctttaatgagaacttgaaattcagaacacaggaaaggaatttcaatctcagaataagcccagaaaccattggccttagaagacgctgggtgaggccagctgccaggtcaggggtgaggctgggctggaaggtgggggtttggtaatgggctgtcggggaggaggtgagcctgtccagccttagctccaggcctggggcccaggctgtggatgtgagcgtgggcctggggctataggtctggatcccagaacttggggctggggccaagtcccctttgcttgatgttcctgtctggtgtcagcagaccctgcatgaggggctcgggccttcagtgagctagctcccacgccatgcacctaatcgttcccacgtggccctgggctgagatcgacacactgactggaagggcaccaggcccagtgagtgccggagctgggtggagggcccacggtgacctcaggcgtccagctttccatctgcctgggccttttcagggcccagagtggcaactgggagatacataaaagctgtgtcctgtggccaggcatagtgaggggcacagcctgcctggcacacaactccaggacctgggtgcgggtgtgtgtgtatgtgtgtgtgtgtataggggaccctttcttccagtgaattctgagggaaccctgatatatcagtgtggccctggcagaagctggcaggaggtgctggctggcagtttcttcctgcctccccaaaagcaacgtctggaagtgggtgtgaagcaccctgctatttatgttctgccggggaaggtgacacacctgccctgggtgtcccagtggggggtgggcatctgtctgggtggcaggatatccctgcagcgtcaggggtgcctccttttcaggatgtcctgttttccccgagaagcccacgggctgctcagggtgatctcggggactcatggagcctcagggaatcattttcactaatagtctctgtcatccaagatcagttgctggattgcagattgcctgggggaaacggatagaaaatgacggttttaaagcatttcacagacaggccagggatgagtgtgtgcactgggcagcttaggcaacacccgggagaggatgttattaggaggggcaaggggtgagggagcggggagggtccttttctctcctccctggccatgctggccttggcagaagggtcctgctcagtgctgctggcctgggaacctggccaggaccggaggccgagctctgaggctgggtggccttttggggagcagtggttgaggtgtccccccaggcattctgacaggcatctccaatccctgttctctgcccttcccaaggccagctctgtgtccagggacactgtgctggggtacagggacagggcaccctgtggcattgtcctctctggtgtgtgtgcatctcatcctgtgtgggactgttgaggagggagtcctcacggagcttgaaacaataggaacattgatatggtttgtctctgtgtctccacctgaatctcatcttgtagctcccataattcccatgtgttatgggagggacccagtgagagatgattgaatcatgggggtgggtctttcccatgctgttctcatgatggtgagtgggtctcacgagatctgagggttttaaaaacgggagttgccctgcacaagctctctctctctcggctgctgccatgtgagacgtgcctttcatcttctgccatgattgtgaggcctccccagccatgtggaactgtaagtccaataaacctctttcttttgtaagttgcccagtctcgggtatgtctttatcagcattgtgaaaacggactaatacaaatgcctctctcacagctctgtgggccagaagtctgaaatgaatctcactgagccaagatcaagggtggacagggctgtgctccctccagaggctccaggggagaatctgtttctggcccatccccgctcctgggggctgccagcctcccttggcttgtggctgcatcatgccaatctctgcccccgggtcatgtcgccccctcctcttctgacgtgtccctgtgcttccctcttgcaaggatgccttgattacatttaggactcacccgagtaatccaggacaggcttctcatctcaagagccttactgcaagcacatctgcaaagccctttcttcccatagaaggtacccgtctcaggttgcagggatcaggatccagcatctttgggggcaccatgcagccagctacaggatgtgaatggccctcacgtacaaggctggccatgcagtgcacagcacacccgggaggcgcccgtctgggtcacgcggaggagcagcactgtaggcttcacttaggcctccccagggcatatagcccagaggcacagcccaggcaggccctggtcctgctgcctccctcactggaccctccaccctgtcgtgtgggagctcttccctgcatgtctaagtgccagtctcagcctggcagtcctcccccaccgcccgcgttaagggacctggagcggctgactccaagaccacgtgcacagagaagccaaccctgtgctgacactgagggcctgtcttagcttcccagagactgaccttgggactctgtgaaggttgccacacagtgagaaagaccccgagtcacgtgttgagcatgtggtctctgtttcagacacacagtgccatttgcagaaagacaagagctgcaaactcagagcctgcagggcctggcaggcaatgccaacaaggacagcagtggaggaaaaaaagataattgcacccacccttggcctggctttcatttctctccttttgatggaaacgtggagaccaagaatacatctccactaaaaagaaacagcagtgggaatgcagccacacgtggtgtccagccctggccttgccatgggcacagggcgtctgggaggccctgcaaggagggacagaccctcctcaactcccttgacctcaatttggtagaagttgggtctggtgcagctgaacatcctatcaagaaaatccagacatcagactttttatgtgaactttcctgatgttaaaatgtggcttaaaatttctggaatgagaggatgaactgagaaggctccaggaatccagccacggcgctgagctcagtgagtcggcaacagctggcttggcagggcccaggccgacccgggtacgagagacagcccctatcaccatgcgaaaggaccaggcctcaggggtctggggagtcactcaggaagtgcctggttggagacacagagacaggtcctggcacaaggacgctggccaggtccagggctcagccagcaaatccagacaaagccctctttccacagaagcctccacatcagctctctgcctccagccctgggccctgcacacccagtgggagctgtcatgcctggggtcccctcccgtgctcactatatagaccaaacaaaacacggtcccccattggctacccatgctttctgtgatgcagaggtagaagcatcttctgccctcctctgtgggctgctctcctggggctcgccccggcctggccttgggacagaggaggggcaggtgcttcccatcctggggaactgctaccaggctgctgtgcacacaccctgctgggctgaaggaagagaagtcagacagcaacgtgccagtgaccttggctgcctccaccccagacaccgccggtgccaagcctctgcctgctgctgtcaggctgcagcatcctccctgacgggcagacgaggcacgccaccacgggagcctctcagcctcgctgcaccaaggaaggccctccaggagacagaggacaagcgccggcactgggcagctcctccatgtggctgagcgtggctgccacctgcagcccacagccagcccttccccaccaggccaggaagagcccctcctgacccacagtctccaccctgtgactttgccttgagttgggtaggagttttccaggccgcaggggatcctgggggaagagtgggcggcgggggtgggggcggacctcaggcatgacagttccccctgggtgtgcagagcccagggctggaggcagagagctgtggggcagcctccatggaagcagcagccttgaatgacccaaggtggggatggcgccctccagtctcacaaagagttgagtgtttcagcaagctcgtactggttgcagtgtgagggaggctggtgggggaggctggagcaatggcacaggagagagagaggagctctgttctgtcagaccacaggactggggagcaggcgagactcatccattcagtggcgagcagatagccagccccactgacacagcggatgtgaggcttggcccaggtgggggctggggggcccaggatggggcaggagggccgtgtgctttgttggggggtgccaatttgctgaatgccaggtcagagagcctttctgccctgtagctgtcgacgtccatctcagcttcctgtggctgctgtaccaggttacccacaccttaatggcttaaaacagcacacctgcattcctcacagttcgggagctcagaactctgaaataggattttaggggctaagatcaaggtgctggcagggctggttccttcgggaggccccagggcagaatccattcctggcccctcccagctcctgggggctgttggcgttccttggcttgtggcaacattgctgcagtctctgcctccctggtcacgtggcttctcctcttctatagccagctctccctcttagaaggacacttgtgataacatttagggcccgctgggaccatccaggttactttccccatctcaagacccctgatttaaacacatttgcaaagtctcttctgccatataaggtaatgctcacgagttttgggggattaggacatggacgtccgggggtcatgattcagctgacatgtctaagtgttgaaccttgggtcctaagggagaatggagagagggctttggctggatttgcagggtgagccctggacctggccagcgtcttgtgcccagacctgtctctgtgtctccaaccgggcacttcccaagtgactccccagacccctgaggccagggcctctggcgtggtgataggtgctctctctcataccctggtcagcctgggccctgccaagccactgttgccgactcactgagttcagcgcctcggcgctggatccctggagtcttctcagctcatcctctctttccaccctggagctgagcctgcagcccaggccccgggaaacccagggagaagcactgattgtgaaacccgaggcggctccgggaggcgtgcttcagggctgagcgcacccttggcagacgccgcggcgctcctgtcctcgtgcagaccgggcccttgggatggctgttggagatgccagcgcggtgatgtggcccacgcggaaggggtgggcgggggccggcgctgggaaagccgaggctgcacattctccgaggctggagttgcctggggtcagccggggagagcaggaggggccagctcccgggcctggctggctctctggctggagtctgctgctcagagcgctgccctgtgggtgcttcccaccccctgggctgtgaaggcagaagcgaggcttgcagccccagcgagggctgggccccccttattccacagtggagacgtgccagggtgtgctccccctccacggcgtctgggcctggcactccgcctgacagcccccacgtgcgcagcaactcccctgtgcctccgacataaatttagtccctgagtctcaggcttgcccttcccccgccacctctcccctcccgacatggtttctggttcaggggtggagccgaccaggtaaatgtggctggcaagggcctggatctttggtggagcaccgtgggcaggtgacaagcctgacccggaggatggtggccttggccctggcttggctgcagccccaactcgagtgcaggggacagttctggaagaccggccagtggttctgaggagctgcattagggctgctcccacagatgcttccagcactaggtgggtgagtggggtgggcagcgggcagtttggtgcagggttcagtgtgctcagccccacccggcatgctgctgttggtgcaggggtcagtgtgctcagccccgcccggcatgctgctgttggtgcaggggtcagcgctggtgcaggggtcagcgcgctcagctccgcccagcatgctgctgttggtgcaggggtcagtgtgctcagctccacccgacatgctgttgttctggctcactaaggggcccagagcagctcacccagcccctcaggatctcagaacctgggtgctgagatctccactgtacctgggtgcagtggcacaggggctgctggaattacgcagggcacagggcgcctgcccagtgctcactgcgacacttgctctccgtcccctttccctcctctgcctcgccatcttccacagacacagtgaattgatactttctttccttcccttggatctgtgttgggaatgtcctccaaagagcttttcgggttttgcacaaggtaacagtccctggcatgcagacagtacacggctcaggggtgaagctgtgatctgctcacgggggcatctggcgtttgatcagcaactgtgggctgggcatgccccctcttttcaggtccccagcatggcagaggcaggcttctgggagagaggcatgtgtccagggcatcttttcatgtctgtgacatctgtgccttggatgtaggagcctgctggctggggtgaagtttgggcaaggagcagtgggacctgcttgggacccaggtgaggcttccttcatgccctggctgccccatggatgacggtgaaagagacatgggcaccctgcataatggggacaaagggactgcatcccatagtgggtccctagacagaggcctcttggggatagagaggggtggggcgacaggtgagaggcgttgggtaccagcatcagggctgcagaggcagctgtagggacatctgaaggggacaggaagctcttccccagcagcagcgaggacaggcctggctcagaaactgcatttgggtccgaggtccaaactctgccagtttgtgccagccggaggcctctgaccacaggccccatctcctctcagaattctctgcaggttggcagacacttcagccagctccaagcctgaaatattttctataaaaatttccaattttctttgacccgtttctctttgaaattaatcctaggcagcgctgtgctctgggccctgaaggagctctgagcggggaaaggtcgcgcagtcagatgggcgtgctggcgtctgtcttctctctctcctgctctctggcttcatttttctctccttctgtctcaccttctttcgtgtgcctgtgcacacacacgtttgggacaagggctggattcttcggctgggatgtctctcagagctcttgacttggtccctttggctggggcttgccgtgaggtgtgggctgcgccacgagcacagctggtagagaacccggccaggagcgcagctcacgcctcccacgcctcccatcccaaactgtcggcacacccagagagagcctgcaggacaggacaggaggtgacctgggcactgggcctgtgtggagaggtggctggtgcgctggtctggttgggaaaaggccgggcacctgaatgccatgcgggttcattaatgctcaataataatgctgctccccaaatcatgggggaataatgctgctccccaaatcatgggggaataatgctgctccccaaatcatgggggaataatactgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatactgctccccaaatcatgggggaataatactgctccccaaatcatgggggaataatagcattagcagctctactgcttagggggagactgaggctcagagagggcaccttgcctgctgccacaagtgtattttcctgcattcactcgtcacgttcttgctatgtgtccaccatgtgtctgacaggactgggtgctggggctgtagcagcggaggaacccgatcgagtccctgttctctgggctcacagccccgcaggggagacctggtgagcagatgctcgcagacagtggagaatcctgtgaacaaagtaaaacggggtgaaagggcagcgtgagaaggcaggtaagggagggaggcgccccaggttggtgatgatgggaaagcccagccctgggaagggtgttccaggcagagggaacagcacatgcaggagccctgaggctggagttaccgcagcgtgaccaaggggcagaaggaagagctagtacctggaactgaggacgtaatgggggagtgggaggcgtgcagggccgggagggatgggtggcactcatcgctttgaagggacggtcacggtacggggtgagaattcattccctgtgcggtggaggcctttggagggttttcggtggacggtgtggaagcagggaggagtcccggtgacagatggcggtggaggcagtgggttcaggatgagtttgaggtggagcttccgggacgtggtgtgaaggaaggaatcaaggacacatcctgcccctgagaggtcacgtggctgggaggctggctggtggcctgaggctggccgggcaggtgtgctggtgggggtggccgggcaggtgtgctggtgggggtggcaggttaggtggtctgggccacgtgcaggagtcagaattggcacccatcactctgactccacagctgcccgcttccactgctctgcactgccctggcccagagggaggtgttttcccaggaaagaaggtgccaaggccaagacccatgtgttcccagactcacggggcgggggcaggagcccccaatgcagccccacaggcagccaggccctgggatgcactgccacctcctcttgctccgggaggcagaggctgtgctctgtggggcgggctgtcagggacagtgtgaggtttggggtcccatggacgtgtgtgcatccttgtttgtctagcaggaccggtccagcttccccttgcctgccactgtggggagggaccccagactggccgggatgaatggatgcaggaactgtggcctgcacgtacttaggagtgtgcagggcagggtgtgtggctgcctctaggcctttgcaggcagagccttcctgtccaccccaaggggccgcaggcagcgctaccagctgttccccacacaaaagctgcccgagacagctggaatgctccctgctcctggtgcaaactctcttgaaactcaggggtggggacatcctgggagctgacctcaggttctgttcctgcaaataggtatctgttgctgacccggcagatggcggcctgagccagcccagacgcgctcgagccctggccctgagcagccatcagggggcacctactgagtgactaaatgaattaggaaatcccagcgcttaacagactcaccactcggggcagagccagactggctcccacagcagctcctggtttctccaaatcctcaccagcacgggggctttagtgtttaatattttgctgctccggcagcaaagcggcgttgctttttgcgctaatttgcgcttctttggttactggcgaggatgagtgatcttccctgggtttgattactctgcatgtctcctattcctaagtcctttgcctgtttatctcctggggtcttatatattgggataagccctttatctctttttagatattgactttctgtcatgttcgatacaagcttttccccaggccatagttcctctttcctttccagttttgttagcgttagttgcacaaaagtctgtttttctgtagctgagtctgaatgatccttctcctgccccgttggagccaagtttgcgttcaaggacatgcccattcaccgagggcctgcgcgaaggtgggcactcttcatggtgtcatttaataggcacggtagtcctggaagcagagagaaaactaaggtgcagggctaccactgtccaagcagtagcgggaacagcagggagcaagaagaacgtgacgcgttcctggagcacttaccgttgaccgcgtctgccagcacgctgcaggtacatcatctcctaggattcttgtaatgagccccacggtgggttggtgcttttgctgtgcccacgttacagatgaggaaactgaggtgccgacggtcgcacagatagtaagctgtagaaacagtgggagccaggccttttgactcctgcatcaggagggaggagcaggcttagaacccagggctgctgacacccagtgcagtgccctcctgtccccgctcagagcctgggctggcaaaacccggtagcctgtgaccccatctgtttgttggacagagggccttccaagcaccaaggcctggaactccacttaacggctgcagaaactggggcccagcgagggtgagtgaggatgtgtctccaggtcacttagcacgttagcttcggggagaatcttttgcttacagtggaatttgcagcattttgaggaatgcctggcacacggttggtgcgtaaatatccgtgaaaagaaagaataagcatagtgcctaggaagcccggtcgcccaggagctcactccgggagcaacagttgctccctgcaggcattggagggcttggcactgacgcctcctgttgttgccacagtgtcagggctgcagactcaggttggcagctgtgggtggctactggtcccatgggcccatgggacattgggtggccctgggcctttgctagtcccacttcctcacacttgagcaggactgacttcgccggcttgtgacccatccggcagggccctatgcccactttaacactctgtcattcctgccttagaagtcgtaatcactttttgaacaagggactgtgcgtttccattttgcactgtgccctgcaaatcaagtggccagtgctgttcatcactctttcttctgtgactctgcttcctccctgtggtctcatggagctgtggtccaggccccgaggttgaggacacagggcactgcacagtggccaaaattgggggtgcccagtagacacgggctcccttccttccaggcccaagcaccagcactttctgacagttaactgtctgtcctttatttgggaatgtctgatgccagactgcagatggcgaggaagatggccctgtccatgctggaacgacagacccggtatcaggaatgtgcccctgtgactgccacaggcccgtttggtgcctgagggcagcaatgcgtgaatcccagcctctgccctggggatgccgtcgggctggagcactgctcccagcgtgccttggccactgttccctgcgcggttgtctctggacataaagcacctgtggaatcccagggctgctccccttcctctctcccttgattcatccaacagatctctacccggcacgcacagcaggaccgggcactgggccaggctctgggaccagacaggcacagccctgacctcatacagcccacagtgcactagtcagtccacaaatacctgcacaatgaaagacttgggaagtgccacagagtgagcccgcagtcactggacgttgggctgaggcctggagtgtgggttgcagttccccaggaggaaaaggggccagggcagcagatgcgaagtacctgaggggtgaggacggggcttgtttgggggtgtggcaggaggggcagggtgagggcctgaggggactggaggtcagatcacgatggcttctgtgggctccgtcgtggaggaggggctgtgccatgcagcaggtggcatggtctggtttccgaggagggtgagcacggaagaggcagggagccggcaggaggctgctgtcctgtgtgcagggagagactgcggcctggatcaggtggccatgggaatgagagcagcggccggatcagcccctcagcgccatcgtgcaggaagggtgttgggagtcctggtaggcagtccacaggttggtcagagggggatactccttgcctggcagaaccgtattcccattccaaatcaccgtgaggctgggaggacccagatcacagccccacccggctgcctgtgacagctccacccctgtctggacctcagacctgtcgaggtggcgctcgctagaatcatttcctctgtgggatccgggcctgggaaggtccctgtgtctggcccttttctcaaggacctttcccagatcattctggacacatatttgagtccagctgcagattcctagctgcgagcaatgctgcccaggcttgagccttttttggacgactgcagggactccgtggggtgtgccatgggggctgccttcagcctcctcatgctctgcctttgacaattcacgtggcaggagctggggccgaggctggggtggccaggcttggagggatggagtcaggagaacaaagggctgagatggctctgcaagtctggccaggcgacgtccagcagggcgaaaaggactaggtgctgcccaaaccacagcaggagcacctggtgggctgcggggaggagctcaggggtcaagttgacgaggagttcagtacacattgtctgggttggcggggggcggtctgggggtgtcaggctgggaataagaagcatgatggcctgctcaggtctgcccacccaaatcagagcccacagccatgggcagtcccagccccagcgtgtgcagagggctctggagggcagagctggataacactggccccaggaaggccagagcccccaggatgagagcatctgtcctctcaaccttgcctggagcctgggggtcaggcgttcgctgaggacagtggtctcgtatgggcacactgatgggggcctggcaggtgacgccagcagagatcactgggcccaggtagacacggggtcggccagcagcaggagggcctccaattttataagagaagctggaaattgattttacttacaatctcttcattttaaactgttggcagctaattcaaaatttgtgaaagccgtgtaagggttgagcagcccggggcagtggccgggatgggggtcaggaggcggcctcagtgctggggaccttcactggagcccacggcgctcaggaccgagcttcttggatgtggccagggctgcctcggagttgaaatgtacttcagaggaatttttattttcctttcgggaatgtcaagagaggcctttccagcggttccgtttctgtgaggcgaaacctgcggtcgtcctgttgttcttggaggcagcgatgaagcccatctgtagcgcatcagcgggagccagcagcggggagggtgcagggccccagcccaggcagacagagctgttggatgcggcactgagggagcaggcgtggcgccgggttcggagcagcccctggactccccgggctgggcggacagacccccggctggtgcatctggtgcccagttccgggtctgaggttctgttccccgggctcccggcacctatacccgtgcctggatgtcctccaggcccccgcagcctggagagcaaacggccgatgatggtctcaagagggttctgcccttgtgtccagaacgtcaggtgcctgtgctcctttgttctgggcaatatcccgggagctcccagcattcttggccttcatcaccacgaggacaaagctgggcttggatttgtcccgaggccttgaactgggaaggagtgtggggactcacaggcctgtaggaaccacctcggccacctttgaaactcacaatgtgggcccttggtgacagagaccccggggaccaggcctgggcctccctttcttggtgtccttggtgctccccatgggctgtggtgaccccagtgatgggccaggcagccggggccgccagtgtgggcctggcctgcggagtccttgctctggcctgacctcagtcttctcgtctgtatgtacatcggggtgctggactaaagccaggcctcagccctgcagctcttgggcggcctcgccgccccaccccgcaatgttttatttgactcgtacaacggcttcagaaatgttgagtgtacacttaaaaatcaggaggtttcacatgaaaatctcaattttcagttccttcagaaggcctggccaccctgggcgtgttcctgccagcagcactgggtgggaggctctgtgcctcctctggatgggcgaacacaacccctccctccctgccgattcgtgcctggcccccccactcatgctggccccgcctgcctggtttgcagtggagtgtgagactcctggactctggttggtagttacacgtacataaactctctccgtctctctctcctctctctctctcacacacacgcaggcatgcacacacccatggtcagagcagacacatccacatcttcatccatgtaggaaatgctggagtgaaccgagccgcacccaggagcttccctgagctgggcaccaggagcccagggtctgtcctgtctctggatgagtcctgctgccttggcctcagctgaggcctcaggcccaaagctccatggcaggcctgacactattttccttataataagcccccgtcctctttcctgttgggcacccgtgtccccaggggcgggtcacaagatgacaacttgggacctggcggcttactgttctgtgggctgagctggctgctgggccctgtgcgaaaggcacctgtgctcccacctgaaggagcctggggcctctgctctgagggcagaacaagaccctcccggtctccctgtgggaagaaggaccgtgtcagagacgctgtccacggtggaccaaggccaagctgcgggagaggctggggacagagaaggagactggtgggtacctgcccatgctcatgtgttgggggtgtaggcagaccccagggcctaccagagcagccagtggggagcagccagttcctaggcccagcagcatctgtgcaaaggggtccagtagggtcacagtgcccgaattgtgtcacacactccagggctgcccagccctgcctgctgctgcagagcccctgatccccgaggatgaagacaccaggaaggagcaagaagtggcccctgtgccatcagtgtctgtgccgtgccacccctgcttgggggcacattggttttccacatggtgtcctttgaatggaggtgaggcgggccccagccaggccataatcttgggagacggctctacctcagggctttgctgaccccattctgagtcaggccccagccaggtcttgggagatgggacagaaagtgaggggaccccaagattgaattgtaggaaggatctgaactcactggtggaggcagagagggaagatggggatgaggctgatggaaatgcagtctgctcacaggcacaaaggccacatcggcagccctagccctgagcccaccccacagttcctgacccccaatcctcaccctctagagatgacctgtggtcaagcatgaccgattctgccccaaaaatgtgtataaatggcaacagtgacaaatgacgctgctatggtcttgcctctgactttgttacccggttcacttgccatggatgtgaaggattcactttccagtatcagagtctttctgtctacccattcatccatctatccaatcattcatccatttatccatctgtcatccgtccatccattcatctatccaatcatttatccattcattcatccatcgtgtattcattcgtctacccactcattcatccatccatctatccatccatcattgatctccattcatctacttactcatccatctacccatcccccatctacccatccatccatccaattatttatccattcattcatccatcatccatccatccatccatcattcatcatccattcatctacacactcattcatccacccaatccatccatccattcatccagtcagtgtctgcaagcaccccaggccagcgccctgctgggcactgagtatgaacaatctggtctctgtccctgaagagtctggctgggggaaaaggcagactcccagatgaaccatgacaaatgctgctaataggctgcttggcagcccttcctcattgtgccctgttgtgtttctttcagccaaaatatatttctgtgcatctttgacgccatcaacagttgataggagagtcaggcagagggggctatgggcttcagggacagtgagagggagtgtgtgtgtgacctggtagcttagagaatattcttgtgggcttaatctgcacgcccccccgacttcacccatctgggcctcttctgacctcctacaagcatttgagttgcttcctctgaccttttaaaaatcaatggactataatacatatgagtatgaaagtgtgtaatccagtggtttttggcagtgttgtgcagccatcatcaccatctagttccaaaatgttttcatcaccccagtgggaaccctgcacccagagcagtcactccccattccccttcccagctcatagtgaccactaatctactccctgtgtctttggatttgcctattctgtatacttcatagaaacccaattgataatatgtggcctttggggtctggctggagtccttctaaggattgatctaaaagctccagggccccttgtcatgggagcatcatatgcccagcgacatgaatataaaataataatactgcataattccagaataggcagcagcgtgtgtgtatgaagctcgggactgtgagacaggagggagaagtggggactgtggttaaaacagtccagagtgcctcttcctaagggaggcccctcctagttcctgcagtgagatccgtgttgacactgaagtggccttgtgccctgctgccccgccctgggatggcatatattagagggggctccgatcacctctgaactgggaaatgtggagtagtgcaggacacagcagcaggaaccacagctcccagccccaccccagagagaaaggcccatgagcagctggtgcagggactggactggagccgatgatcagatttggagttggtgtggacatggcgtgtcacctctcaggagagggggcaggaagtgaggagcctgaggccaaagggtgagaagggtctgaactcactgctggaggggcatgtgtgtccccagggttgcagcctggctggggcagccagcacagtggtgacaggacaaattagagaaaaagggatgcctttttttttttttgagatggagtctcactttgttacccaggctggagtgcagtggctcgatctcggctcactgcagcctctgcctctcgggttccagtgattctcctgcctcagcctccctagcagctgggattacaggcatgtgccaccacaccccccgaatttttttgtattttttgtagagatggggtgtcaccctgttggtcaggctggtctcgaactcctggcctcaagggatccgcccaccttggcctcccaaagtgctgggattataggcctgagccactgcgcccggccgggatgtctttttttataagacaaattataaaggagaaaaaaggacagaaaaaccaagacaaattgagatcatagagtaagatgggagaaacaagcccagatttatcaataatccaggtaaatgtaaatggattaaactcacaaattcaaagacagaggctgtcatatctgacaaacgagacaaaccccaaattcaaaatctggctggacgctatcaccagagtaaagtgtaaaggcaagaaaaagtggaaagtaaagtatggaaacagacctatcaggccgccaaaggcaagccgacattgctgtatcaatctcagactcaacagacctcaagacaggagacgctgctggggaaagacaggtcaccgtttaatgagaaaaggttcatttccccaagatgataaagcagttctaaaggtagagtcacttaataaaataacctcaacatatttgacgtgaactttgttagaaatagagaaattgacaaatttatcatcatttttgagagaatccaaccatttttttccaattggtgttggatcaagtagacaaaaaacccagcacagataaggaagttctaaataacacaaataataagcttgacattgatgaattttgcatctgacaagtagaggttatttctttttctcaagcacataggaaacacttgtaacaactggtcaattaagtgcaaatctcacagaaactaaaagaatagtgtcagcaggtcttgttccctgaccatcatgcctgtgagagagaaattaatagcccccaaagcaaaaatccccattatttggaaattaaaaaaaaatacttttaaataattcatgggtcaaagaagaaataatagtggaacttcaaaaatacaactcaatgataataaaagcactaaatatcaaaacgtggatggaaatttacattagaaaagaaaaaggtctaaaaattaaagagataaatttccagtgtgagtagttagaaaaaggcaacattgatccaaagaaaatagaaggaaaaagataatacaaaataagatcagaaatcagtgagacaaggccaggtgcagcaaagtgcctataatcccagcattttgggagtctgaggcggatggatcacctgagctcaggggttcgagaccagcccgggcaaaatggtgaaaccccatctctaccaaaaaaatctaaaaattagctacacgtggtggcatgcacctgtggaaccagctacttgggaggctgaggcaggagaattgcttgagcctgggaggtagaggttgcagtgagctgagagtgcaccactgcactccagcctgggtgacaaagtcagaccctatctcaaaaaaaaaaaaaaaagaaaagaaaaagaaaaaaaaatcagtgagacagaaaacctctgagttctgatcattgttgctgttaggaagattcggggtcagtgttgccagatcctcagtttttcaagataagtcaaaaataggtaattctgcagacaatctctgcattaaaaaaaaagtgtcagtaatctgaatttggcctgtgcacgtctttcctcccagagctgcttctgcacacagcacctcctctctgggccatcttctctgtggccagcttctcctcgatggccatttgtggacaagtctttgtgtgtacatatatgttcattactcttaggtatatgcctaggagaattgctggctcacatgataacacagtgtttcactttttgaggaaacaccaagactgttttccaaaatgtcctgcacgtagtgtccctcctggagggccggggctaggtcaccatacacagaacacgcagagacaccccagaaggccaattcttgtgtctagttagcagggacctgtctctgtggggtggggggctgctggtttctgactctcatctgcagacccctcaggcactggcctcgttgtttaattcataaattggggaggtgatggagggggtctgaggcctgcttttttggtggcagagtaatttctacattgggtccttgctgaagtaggtcaccatcaggcagaaatacgattcctgagactttttggagataacaagttcaaaccctgcctggctgggtttctagcagctctgcttccagtaccgtgtggatgtcattttcacttacgctgtctcacaagggcatgggtggaaagaactctgtttctaggtaagggatggaaggctcagagatggcacaattagaaagtggaggatctgggatttgaacccaggcccgcctgatgcagaattgggctctttctgctacactagcttcaggtgccggctgagccctgggagggaggagtgagcaaatgcatgaggctttgcctttgccgaggcaggacaagctgaagaggtctttctccttccctagagtgagcaggatctctggacttctctcctgtctagtgtttcagctggggctccactggcggaagcaatgtgcgggcaggatgcgtgatgcctgtgggtggacagtgccactgtcagaagacaagccgaggctgctatgggagggcgttagagggtgacattggcctcccatcagccaggtttcgaaagttaggagcagatgtacagggtttgtcacccaactacttgctccccttcttggttaccgcatgaccaacccagtggcctcccagggccttgcgctacacaacactggacagccagaaagcaggtaatgctgcgtcacccacagagggttgcctggggcctgggctgggctggaaatggctctgagaacagaggtaaggagtagatcattgtttaatctttcctttatggtgggtttattgagctgtaattcacatatgctgtagttcagcgtttcgggcgcataattccataatttttactatattcactcagctgtgcaaccatcaccacagtcaactttagatcattttcattgctcccaaaagaaaccctgtacccacgagccatcattccccattttccctcaagaagtgttacttcttcctttgcaatgtggatgccttttatttatttatttttttcttgctgaattgctctgactagaatgtccggtactatgttgaatacaggtggtgagagcaggcttccagtcttacagttgaccatgatgagtacttttggcttttcgtaaataccctttatcatgctgaggaatttcccttctagtccttgtttcttgagtattttttgatcacaaagggtgttgggttctgtctaatgctttctctgcatcaaccaagatgactgtgtggtttattttcctccattttatgaatgtagtgtattatatggattgatttttgtgtgttgaaccactcttgcattccacggataaatcccacttggtgattgtatataagccttttaatatgctgctgaatttggtttgctagaatatcattgaggatttttgcacctatatttataagagacattagtctgtagttttcttatgatgtttttgtctggtttcggtatcagggtaatgctggcctcatagaaagatggatattaattctttaagtgataggtagaattcccagtaaagccatctggtcctaggtttttctttattgggagtttttgatgactgattcaagctctttacttgttatagatctgtacaaattttccatttctccttgagtcaattttggtagtttctgtgttgctaggaatttgtccatttcttctaggttatttaatttgttcgtatacaattgtacataatattctcttataatcatttttatttctataaggtcggtagtaatgtccccacttttgtttgtgattttagtaattggagccttctctctttttatcttggtcagtttggctaaatgtttgtcagttttgttgatctttcaaagaaccagcttttggtttcattgagtcttcttattgtttttcaattctctattttgtctaccttcactataatcttgattatttccttttttctgctagctttgagtttctgttgcttttcttctggttccttcatgtgtaaagttaggttattgatttgagatctttattatttttaatgtaggaatttgaagctataaatattcttctgggcactgcttttgtatgtcctttaagttttgggtatgttgtgtttttattttcatttgtctcaagatttattatttattatatattctaatttatcttgtaacatattacctgacctaatggttctttaagagaatattgttaaatttctacatatttgtgaatttttaaagggtttcttctgtcattgatttctagttttattccactgtggttggagaagatgctttgtatggtttcagtctctttaaggttattgagacttgttttgtgacctaacatatgacctatcctggagaatgatcatcatacatgagaagaatacacattctgccgctgttgagtggggtgctctatgtatgtctgtcaggtctagttgatttacagtgttgttcatgtcctctattttcttactgatcatgtgccggttgttttatccatttttgaaagtggaatattgaagtcttcagctattattgtaaaatggtctatttccatcttcaattctgtcagtttttgcttcatagattttgggattctgttgttaggtgtgtttatgtttataattgttatatcttcttggtggattgactctttcatcaatatataatgctgttctttgttgtaaaatttttggacttgaagtctatcttgtctgatattagtatggccatcccaggtctcttctggtttctatttgcatagcatttctttatccatcttttcattttcaaactatttgtgtattttgaatctaaatttggtcccctgtggataagcatatagttggattatatcttgggattttttaatccattctcccattctctgaattttaattgcagcatttagtccatctgtatttaaataattactgataaggagggactgaattctgctatctgctatttgttttgtatatgtcatattctttattcctcaattcctcaaatatttccttcttttgtgtttaacacattgttttttagtgtactgttttgattcatgttttcatttattttgctgtatatttaaaagctatggtcttattggttatcctgggaattacagctattatcttaaacacataacaattttgtttgaattgatatcaacttagtgtcaatagtatacaaaatgctttgctcctatacagctctgtcttccccaccctttattataatattgttacatttcatacatgtgtgtctattaatgtagatttataattattgctttatgcatctatagactaaatcatataggaaaaaagagaagagttacaaacgaagattttggggttccctttattagtattcttcatttcatcatatggctttgagttactgtcttctgtccttttatttcaacctgaaggactttctttaacacttattggagggcaggtcaactagaaaacaaactctctcagtttttgtttctctgaaagtgtctaatttttcttgtatttttgaaggatagttttgttggaatttttagccgcaggacagtatttttttcagcaccttaaatatgtcatcccgttggtttctggcctttattgtttctgatgacaaatcagttgttaagctcattgagagcccttgtatatgtggcaagctgctcctctctcgtggatttcaagactctctttttgtctttgtcttttgacaatttgattacaatgtatcttgatgtaactctttgagttttcaaacttggagtcattgagctccttggatgtgtagaatcatgttctttttatcaaatttggggaatttggagccattgttttttcaaacattctttatgcccctttgtttctctattctctttcttgaactctcattttttgtattttggtgtacttgatctcttaggttctgttcctttttcctcattctttttccttctacttctcagattggatgattgctgataatgtaagtttgctgattctttgtttgcctgctcaaatctgctattgaactgatctattgaaatttttatttcagttattatgcttttcagctccaaaattgtttgtggttcctttttataatttctatttctttattgatattctctattttgtgatacattatgttcttgctttacttacgttatttgcccatggtttcttttagttctttgaacacatttaagacaatttatttaaaatctttgtctggcacatgaggtgtctaggcttcctcagggaaggtcttttttatttcctgtgagtggaccatcctttcttgttattttgcatgctttgtattttttgttggaaactggacattttgaatgtggagactctggaaatcagatgccccccacttcccggggcttgttgttttttatgtgttgttgcttgtttgtttagtgatttttctaaactatttttgtaaagtctgcattgttcattatatatggccaccaaagtctctgttttgttagcttagtggtcagctagtgatttgacagagactttcttaaaagccagggtaggaagaaatactctcctcgtctttgtagattggttctgtgtttgagcacacctttgatgcttagccagactgtttacaactctgtcttagccttcacttcctacttgtacagaccctaaatgtcagccagaggtgaaaacttttgagtcttcttagaccttttctgagcatgcatctcaccctagacatgtcagtggtagaatcctagattctctggtatgcacaagagctttccaaaaaccttatttcctcaaatatctccttccctaccctcttcctccccaagcctttagatatgtttattgtgcgtcttgccccaactattgtcctgtgccccaggtgtctgcagctaatacatttacctttaaatacttttgacaaacactgtctgggaaaccacttcagtcctggggaagctccgagacagttgaaacaaaggcaagccagcagatgggttaaaacccacaaccacaattctctggatataaggtccatatttctttcttttgagttttcaaactgggagtcattgagctccttggatgtgtaggttggtatcagcaacctacaccaggaatgtggtctgccatcttcatggccactgctgagttggagaataagataatggtaagcaagtaaattaaaacaccataacccactgtcaccaaaattcagtagctgctttcttcattaagcattccctggttgttgtaggtttctggttaaattctggagttccaaaaaagtcgattctgagatttactagcttatttcctgtttttgtggaggggcagaattttggagtcctctattctgtcactttggtgatgtcctctcccttgtcgtatgcatcttatcagaatctttagatttatattaacttaattcctgtgagctatagaaacattactcttatatagctctattcttccacccccatctttggttttttttgtttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcctgcctcggcctcccaaagtgctgggattacaggcgtgagccaccgcgcccggcccacccccatctttgtactgttcttgctgtgcaacttgtgttggtttttgattgctgcggtaacaaattaccacaaatttagtggcttaaataatgcaatggtattattttgcagttttggaagtcagagtctgaaatgagtctcactgagtttaaatcagggttttggcagggttttgttccttctgggtcctcctccggggaggatctgtttccttgccctttccagtttctggaggccacctgcattccttggctcatgacttctgtccttcgtcttttatgccagcaacatcaggccaagtccttcccgtgcagccatccctccagtttctctcttctgcttcccccttccccctctatggacccttgtgattacactgggcccatctggctaatccaggataatttcaatattttaaagtcatctgatttacaatgttaattttcctttacatataaccttacagatagataggttctggggattagaatgtgaacatctttggagggccacagttctgcctaccacacagctatatatgctacaaacctaacaattgttgtaattattgctttatataatttcatgcttaaagaagctgaaaaaagagaggagagtacatatatatcaacagtttgccttcctgttgaccatttctggctctcttcatttgttgcggtggattcaagttcccatctggtgtcatttttttactccagtagctgtgtttctgttcacctgctttgtgctgttagtcaaatatattacatttatatattatatgggcccaataatacaattatatacatcttcttctatattattgctttttaagccagttaagggaagaaaagagaagaaatacccatttatattgtcttttaaagttgcgtgattacctttactggtactgtatgtgtgtgggtgtgaattcaagttaccaactgaggtcacttgctttcagcttgaagaacttcctttagtatgtctgataaaatgggtctactcataattctctgtttttacttatctgggactgtctatattgcaccttaattttgaaaaatagttctgctggagaaagattcttggttgacagcttttttacattggatatgccattctgctgccttctggcttccattattaggagaagtcggctggaaatcccactgggattcccacatatgtggcaagtcatttttcttttgctgctttcagaattttctctttgtctttggctttcggcatttttactatgatgtctctgggtgtggatctcttggcatttatcccgtttgaagtttgctgagtttctcggacacgtaggttaatgttttcaccaaatttagggagctttttgccactgtttcttccatcttttctgctcctttatactcacttgcctctttctgggactcccattgtgcatatgttcatgccctttatggtttccacatttttcttaagttccgtttacttttcttcattcttttttccctgtgtccttcaaattgcataatgtctattgatctgttttcaagattctttcttctgccagttccaatctactgttaagcctctcagttatggtgcttttcaactccagaatttccatttggttcttgtttataatttctctttattgatagtctttatttgatgagatattgtcatcatcactcctttacataagcatggtttccttttttcaaagacatatttccaatggctgctttgaaatctttgctgcaaaatctgacagctgttacatctgacatctgggctttcttaccagcagtgtctgttgccgcctttttttctgtgaatgagtcatttgtgtttctgttgtgtgaaactggacattttgggtcatgtggcagctctgcatactgattcccctcccccatctctgaggctgtttgcagttgtttgtgtatttatttgtttcctgatttggttagactgttttcacaaagtctgtattcttcacagtgggaagcctcagctgttggagggcacagccttgagcgtgtgcagggtcatcccgggatgacagtgatttcagcagggctccctatgactgtccctttctctgatctgtctgttacactctctgcttcatttggtatcacacccagctactaggcttcactaattgagggatgattgctctattattttcaacaatgtcctgagacataaattgtcacatagtttgatccaattaaatttgggtagggatgattttgaggccagtctttgaaattcattctccccctggaagagatcctcataacgatctgttctcctgattttttttttttttttccagtaaataagctggtctgtggttcaggttgttgttctcatagagctgtcagcctcctcttaaattcttgccgccagaatcttcactgaagccaccactccaggtattgggcaggaggtagcctctgatcttcttggtttgcctccccctagcatggaatatttttctagcaagcaggctggacttagggtgattaggagcccagcactctcgccctgctgcacctgagacggagctcctgccctgagttagggctgggtggaggaaggtgctccggcctttcggtcacactcagcagggagttaccctctgtcactgggagttggagatgatgagaaacgctggtggcccatctatcctggtgaaatactgtattccttgactgggatctgagggaagagggagccctgtgttcttggccacacacccccagagtggaactccccataagctgaactggaaggactagaagcggggaagagagagcaagtgatggctcaggtgccaccgattcttgctgttcttactgggatttttcttcccaagatttggttgattttcttgaatagatgatgttgcttagtttgttgtgtgctcttaggataatttctagagactttaaattgttgttgatggtgacttttcaatacttttcaccagttatggttgttctgaggggaatgtgtccatggggctcctctcaccaccattccagaagtggaattctcatggcagatgattcctaatctttttttaaagggccacagcaataaggaaggtagaagacactggatatgtcagggtcattcaaggtataattagagatccaaatccaattaagccaagaaaaggaaatttgctggcacacgcgagcaagacagcaggcaccgctggcccacacgaggctgccaaggctcagcgtctctcctcctcctaggacttggctctcttctgcagagacttccttctcagattggctcttcacatacgcagccccaggcctacgctgtgagcttactgagccaggaagggaatatttttttctcccaatgttcagatctcatggaagacccatgattagtctcactccagtcatgtgttcaccccctggaccaatcactgtgctgagggcattgagtaccaggtgtgggctatgtgcccccccaccacagccactggggagtagcatgggcatgaattacccatccaccagagacacattgggtggggcaaggcccttcccgctggcggaaaggggctactggtgtgaaaaatcaacaagatggtcccccacttgccccttttaaaaaatgcgtagagataggtacacacactattttgcctatagtttattttaatgcactgtaaatctcttcgacatactcagaacttaaaaagaaacttcatgtgcattatctcttttgactacacttttcctgcaaaaatggtcacttcctgaaaaagtgaaataaattcaaattgcacaagtaaaagaaagaggaaacttgaattctgcccaaaggaaacttcttcaagaaggctgtgctcttttgattttaatacactgaaattacagaatggcctttgacatggcaattttcatgtcgttttgaacgtcaaattgattttgactctgtttggaaggcagtgaggcccaaagccctgactcatgaaagagcagaataacaacccgaactcgcctcgttttgctggacgtggaagcccggctgggttgatctgctgtctcctcgttttccaccagcgtgaggtcatctctggcagtgtgtgcctcacagaggctggctggggcagcaggtactggccactggtgcagggtcccattgcctgcgatgagggacacagctaacgttcccgaggagcttccaggcaccttgcactctgtccctggcaacacagtgacaaggctttgttcctccacccgaaacaaggcagtggcatggcctccggttctcgaaggttcactcctatcttccgctcacacttcagtttctttgtagtcttgaatcattgttctccagcatattctacagagggccttggtctacctcacccatgcagctaaacccatctattagggaaaccaacactcaagctcactcctgccattaaactctcctgagatttgagtttcctcctctttcacaaaaccggaaatcccttgtaagttaagccaagctcattaacgttgtcttctgcggcatccatagagttctgccaggagagttgaaccctgttcctcttccctttaccggacaaaacctctgggagaggtgggctcaagctctgaatctggtgacgtttatggtttccgcagcagtgtgtctattggcatcgcgtatcagggtcgagggtggcaaggcatggggtctgcagagtttctgccctcccccaaacagcaagatccacacgcactgacacgcgtcacgggaactcatttgacacaggatcaagtttgcaaaatttcccatgaggtcgaccatgaccacagctgtcaaggtttccaaaaaggactccccactggatttggccttggtcataccttaaaccttcttttgccagcggcccctatacctgcataatccgttgcagtgttgcattctgatgaccttctattttcccggttcccttttgctccgacctgtgctccagcaaacctgcaggccattgatgctgccgccttgtcacggtctctcacaccactgatccttccctccaccccttacccagcctccttctcttaaactgcaggttccctcattggagtcactcttgctttgtaacatctactgaacaatgccctagtcctggtaaaatgaaactttctacctacttcatgctggcacgggtacccctgaacaaagctcagccctgcttctgctcttgcttacgatgatgttcaccagcaaggtgccgctagcagccagactgctcccctcagtctgtttgcctccttccagatgacttttcatatcttccgtcctctgaacacctccaacatctgctccctatccgcattcacacctgacggcttccctcgtctgtcacctactctcccagctttttgctctctcagcagcaccccctaggtggagacgccatcttcgattcctctcctctcactgtgtcttaaccccacttggaccaggcctctgtgtgtgccactctgccagaggcaccctccccgaggtcatcatgctgctgcatctccctgccaatcctcagtcgccatccctagcacgtggcaggctagtccctcctgctcccttggtgtggcttaccggacacccactttcttggtctaatcacagcactcacagttcatccccgtttcctttgctgatccttcctcttcccgcaccctctggggttgatgcgcccagggctctgtcctggacgctccttggtctccctctgcacccctctgtgggcgatctcattcctcttgttgctttatgtaccatgaaatggctcccagatttgcgtctccagcccagatctctctcctgcacccaagactcatattccaactgcccctccaccttccatgctctctgtattgcccacgctcctgactccagcagaatctgcacctcatctgtctctgcactcttcaaatccaagttccaaggcatttctctacttgccaacctcaatttggaagtaccacctcagcacgcccctcactgaactcgcgctcaccctctccgcactccaccctcggccttccccagctctgtgcacggctgatccttccttccatttgcacagccaaagctctgcagttagggttgacccctctcttcctctcacactgatgagaaacctgttgagaaatctttttaggttttctttcaaaatccaccccgaccctgatcacttctcaccatctccacggttgtcacttgcgtcaagcctttgtcctcttctgatgactttgggagcccccagcagacctccctgcctccccacccccatgtgtcctcaacacagcagcagggattcttttctctaacagctttattgagatataattcacatactatacaggtcacccatttaaagtgtacgattcaatggtttttattatattcacaacatcttctccctccccaaagaccccacaccccttagctgtcgtccttcctcccccaccaccttccaggcaaccattcatccacttcctgcctctctagatctgcctactggggcatttcctgtaagaggaatcctgcactatggtggaagggtcctggggcggtccgtggtcagggatcctttgatgccttctgctggatcatgtctgtcttctgctggaaatcccacagtggctcctgcttcgttcagctcagaagtcagcacccagcacccgggccacctaccagaccccacacgacccagcgcctcgccctgggaccccgtggcctccattttccttctcactcacttgattcctgccatcctgggcctccttgcccttcttttcaaaaccccacatggggtcctccttccgcctggatgccctttctagacaccctcagctcaccctcccacctcattcgagtctttgcttgcatgttcccttccagtgggacctaccctggcgctctaaggctttgtagacagctccccccgcaccacctgccctggcactcgcagaccctgtgccctccagccccttcccgcagcactcactgccctccggcatactcagagcactggcaccctctgttccttctgctagcgtggccgctccacagagcagggagctgcggtgactcccacggtctcccaggagcagtccctgaggggagctggcccctacacagtagctgggggtgaatccgtggacacccagcaggtgaaaaccgggactcagctccctggagagacgtctgcggttccacctgctgcatgttccagagaactagagcagctccaagttccgctgtggcttccttcaagctcaggaggaatatctgtgagcccagagtggatggaactgcttgtttcttccaagccacagaacagcttggctgtttccagagtgcacagcctccccaaagtctctccaagaacatggcttcggtgtgtgtttattgtaggatgttcaaggcctccgtggggcggggcagggggaccccaagttctggttaagtaactgtcctttaacaccgccgttctcaggagccacagctacactgcggcgtgcgtgtcgggagcgatggctgcctgggactcttcagcttgtgggtttgctcttcctttctcaagcaccttgcagtacaagaagcactgggtttttgtgtcctggtgaatccagggatcaaggaaaaccagaggacacagatgctccaagatgcctccttcctttcaccattttccagacaaagcagacagggacacagagaggcccagagcccctcatcaggccccgtctcctttaattccgtcctcattaaaccctgctagactttccaacatgctgaccttgagaatcacacatcgcctcatctcccccagcctcccagagctgggcagcaccgcttaactgacgcgactggatccaggtgacgaagcctttcttgagagtagctgaagtgacactgtcttagtcagtagaggctgctaccacaaaaagcacccccaacaccaggtggcttacatagtgtttatttctttctcatggttctggaggctgggaagtccaagatcaaagtgctggcagattttgtgtctgctgagggcctaccttctggttcacacatggcaccttcttgcactttgtcttcatgcattgcaaggggcaagagagctctctggggcctcttttatgttatttctacatttttaatttaaaaaaatgtttagagacagagtctcactcatcacctaggctggagtgcagtggcacgatcctagctcactgtgtccttgaactcctgggatcaagcgatcctcctgcctcagcctctcacgtagctggggctagagatgtgagccaccacatgcaacatatttttttttatttttagtttttgtagtgatgagggcttgctgtgttaaccaagctggtcttgtacttctgtgctcaagctatcctcccgtctcaaccccccaaagtgctgagattactggtgtaagccactgcacctggccatggggcttctttgataagggcactaatcccattcatgaggccccaccctcatgacctaattaccccccaaaggccccacctcctaaaatcatccctctggggattaggtttcaacatatgaattttgggggtacaaatattcagtccatagcatacatcgaagggggaaattcttttttctgaaaccaggtcttgctttgtcacccaggctgaagtgcagcagcatggactcggcttactgcagcctcaacctctcagggtcagtcagtcctcccacctcagcctcccgagtagctgggactgcaggtgcaccccattacgtttggctaattttttttatgtgtatggagacagggttttaccatattgcccaggctgctcttgaattcttgacctcaagtgatcctaccgcctcagacttccaaagggctgggattacaggcatgagccgcagcaaagaaagtctttttaaacgattctttatcagaggcctctgacagctcattcttgttccccaccttaagcacctctggctttcattgatattgcttgcttgggtcttagggcctcagtcagggcctggaggttgggatttcctggtgaatttgatggttagtctcctggttcacccttacgggagtggctggaacaattggcgtccctcttccccaagcacctgaagacaagtcctgccctttgtgtgctcagagaggagggagggaaagtgatttctgggcccaaagtccaagacttggagggagggaagaccccaaacacagcacagagggacgatgcccatcattgctcccaaggcagctcttccccctgcctgggagcggagctgacctcatggcagagggctaggcagagtgtggttaatatctcacaaggcacaggacatctggaagctgagatgtgccaagaggctttgaggctgagcatatttcagggctgggatgggagggagattctcatctgtttagtggcagctagaccaggagggcacctgggaccaggaccaggctaggtggacatgagtggtcacaggaggctgaggctgcagggtgtctgggaaggcacttggccagatgcagagggcaacccatgccctgagggtgggggcactgttggagcaatcccagtgcagggagacccccaggatctagcaggagctctgtgcagggctcacatggttcatgggggcccagcaacagagaggaccctattggcaaccatcagcactggattctgcctttggtctgagcagaggtggtccaccccgcttcccctctccttcctctctgcccttcctctccagggcaaggcctggcctaccagcactttcgttggccctgctcagatgcttgggactaggtgggaacaaggccctctcctatgagagttcctggcagcaccaacccctaggacctgagacaaaggggccaggtgagtttctttaagggcccctcgctcattcgatttggggtccctctgatttccatgcagcctgggacttggtaggacttggacacacataggctggcacctggctccattggtgtgaaggcgtcagttctgtcccacacaccctgagcatttcatgctattctgaggcatgaggatgagctcgtattcttgctccttgtctattccttcatcccattgtgccaaaccttcatgagcctcctctcagccaaggcaggtgacccagagatgaatctgatgcatgattttacccctggagctcatggtctggttaggggacttggaaactggtgagcttatacttctgcatgatcagtggtttaaaagaaggaagcacagggtgcttgagtctaggagagagagtaacttgctctctttgcgggcctaacgagctgggagctgggttttgaagactgaataggagtctgccagaaagggcagggcaggcattctgggcagagtgagcagtgttttctcggacccatggctgtaagggcgttgcgggaacatgagcaggtccctgggagggttggcaggcaggtcaggcccatcaggaggccctagccagtgtgctcgcactcccgcacgggtctgctaggcttgggaagagggaggtacagaggattttaatgggggcaagctcaggtgaggactcgagctacagggagtgaagggcagggagcagcagcggatggggccaggtctgggaggaggctgctgcatccaggtagagggaggggctgagctcatcatggacggggagatggggaaggtgccaggatgcggtgactccttggatgtggagatgagatgggcacagcagcaatggctgatgggttggggtagggaaaggtgacaggtttgtttgggacttgttggcatgaaggtgccttgtgacaccccaggggcagttgcaggcagcagggggcggggtctggagcctggggaggtgcaggctggaggtgggtcggggggcacctgtcagcaggtccatggtcatggaggtcaaagcagcaggtgtggagcaggcagagaggagagcgagggtgaagccctgcacacggaagcccagtcctagtggatgagcagcgtccagggcacggtggactgggccccacttcctgtgggggtgcagcctccacttctctctgagatgcatggtgaggccttctccatgcagagctggagaagtcacctgaggactgcccacctgggtgaattcaggcagagcagcaggaatcccccacagagcaggggttaagcctcgagggctggtgatatctctggcatctgatggggagggcgcctgtggcaggagagggtctcttctggcagagagcttgcatgaagtccagctgccctgagccaggaagagttactgggaggacattaggaaacctgcagagtccacggggagtcgggctgtggaagggcctggcagtcggggtcctggacacaggagggtcttaaccattgtgaccaggtgtttagtgacaccactaccttttcctcttctggctcctgcggctcaaatcccacactctgtgagggagaggatgtttggcttggggagggctgtgtgcatgcagggttccaggaattccaggaaataacactgggctgctgctctgagaaaggggagaatggatgctgggccacccccagaccttggtgcctggtccttggggacctggagatggctgctcagcggcttgagggcttcagtgtagtcagtgtagtgtgtgtttctgtttttttgtttttgtttgttttgtttgtttgttcattttgttttgttttgaaacggagtctcactctatcactcaggctggagtgcaatggtacaatctcctctcaccgcaacctctccctccgggttcaagcgattctcctgcctccagcctcccgagtagctgggattacaggtgcctgccaacacgcctggctaatttttgtattttttagaggagacagggttttgccatgttggccaggctggtcttgaactcctgacctcgtgatccaccctcccccaccctcagcctttcaaagtgctgggattacaggcgtgagccaccatgcccgggctgtttttgtttttaatgtgacacattttaacaagcatagcatttaacaaagcagataatatgatacaacacatacacacaagatacactgtcacagtcatgggagatggcactgatgatgttcagtcagtatttaggcaggattggaaagaaaaatgtctctgctgtgttttgcacacttgtacacagacacagaagttttttattccaaaatgtggagttatctgcaactctgcaaattatacttgatatttacttttcttgatatatttgctgaaaaacgattctcccagtaaacagtggtgatttctcagaacagtagttatttgtcagcagcctttaactacggcaaacctttttcacttgagtttgaagggtgaacgccttcccgcctcccgacacagatgctcatggtcgtgcataatttcatgtgcttccattctccagacttgttggaaatgccatattttatgcttgtaattagtcagatgagccaaaggatttgaaatttaaacatttgaaccctaagagaatcttgaaactttaaccaaagaaacagaagaagaatgtatacaaacatgggaattgcagttcaacagccctttattaaaaaaaaaaaggtattgtgctggcagtggaatcaaagacaaaaatatgatcatcacagtctacaaggcactttaccgatctactcatcctcatcctgatacagacacgcgtgggaatcgtctgagtggcaggacctgcagccattgtcacccgactttacagatgaagcagctaagaaatgactcaataaacttatagtgatttgcttgacatgtcagagttaaaatgtaacagccccagaaggagtggcctagcacagcgttcaagagcacagactcttggtagccatgccagggttcatatcctggttctgacacttccgagcagtgtgaaattgggatagcctttctcagtttccccatctgcagaatgaagataagcatcacagctaactcacacagctgctgcgaagaatcagtgggcaactatagacgaggtgcttggaacagtgcctgagccaccttaagagcagtatggatgtttctgtctgtcagggatcccgtgtggcttccatggcgccgcacttgggcatagtcggagatttgataaaacattggtgcaatgtaacagccgcacacaggtgcactggcttagcaaactggagtttggattaatttaatcaaaaccaagtgtcgagagggcaccaaagtccaggataaacgtggaatatcttcctggagcatcgattttactttaaaaagatgcactctatttcataatgtaaaattgacactttttaaaagacagaatgcggaggcaactgtggagttctcatttttggcaaaagctgatacgggttctgccttcactctctgggatattggctaatttcctctttttttttctttttcttttttctttttttttttcctagagacagggtctcgctctgtggccccagctggagtgcagtggcacaatcatggctcactgcagcctctaactctggtactcaagtgatcctaccccctcggcctcctaaagtgctgagactgcaggggtgagccactgcctctgctgacttcactattcactgcaccgagaagactctcatgtgtatttataacaatttggataaaaattttggacattgatccatgtcagctgcgagacagggaacgacttgttatatgcaccaatttgtcctttaattacttgttaagctttgatttgtcctattatcagaattctcatcctcttctctgcaagtttatgctcgccatggtaggcgactgtagaggtcaccggccccttacagttcagcaagtgtggatttgtgcagacaccgggacgccatcagcacatcgaggcggtagacactcgtcttctcccacggtttccttctgtcccttcatttctgttgctgttgttgtttgcttttgtggaaagaacacttaacgtgagctcagacctctcagagaatttcgaagtgcacagtgccacatggtcagctacaggcacaacgttgtacagcagacctctagtacttactcgtccagcatcactaaaactttacacccattgaacagcaactccccatttcccgctcccccagctctggcagcctctatggtgtcatctgctttcatgcgtttgattacagatcctcatgtgagtggacgagtgccgtatttgtccttctgggcctggcttatttcagaatgcgtgtgcatgcggggagggggtctgcgtaccattacactgtcactgatgtggatgtgcaatacaggcctgggtccctctcatcttttggtagcccccccggctttttttttttgagactgagtttcgctctgtcgcccaggctggagtgcagtggcacgatctcggctcactgcaacctccgcctcccgggttcaagccattctcctgcctcagcctcctgagtagctgcaattacaggcgcccaccaccatgcccggctaatttttgtatttttagtagaaatggggtttcaccatgttggccagcctggtctcgaactcctgacctcaggcaatccgcctgcctcggcctcccaaagtgctgggattagaagcatgagccactgcgcaggccttgataaccctattgttttacaaaatgaaagagtgcctgacagtacatgaatggtggtatgttttaggtacatgcgtgaaatggaggaagtctgtatagacgcagacacaccgcagtgcagtggtgccagccaaatccacgctcccagaagtgagacccaaggtgacagtaactggacccaagtatccccaagtctcaccgtctctgtgtgcctgtgtgcacagccctcccgggcataacgtcaagcgtatgtatttgatgtgtgtttgaggctgggtcttgccctggcatcagcagaagcaggccctggagcgcataagtgaccaccagacctgcacaccctctgcacagctgagcatctcggcatcaatgccctgtgagtgcccagggccaggtaggcactcaggaagcctgcaggccctgggatgtccagaccgcactttctggtaatcccacattgcccatcctctgcctctgcgcatcccctccccccttgcccccgagggcaccctgcctgcccacctcacgcccagccctgcccagcctgccctgccctcctcccgccgggaccacctctgctaaatcacttaatccggtgatatgtttcctctggcaggccaagcccatccctcctgactctcagggatttgattatagtgttttctaacaaagtcaaaaacagatttccatgagaggcttatagctcagtaattctatggtgctttggtgcagtgtgccaaggcgcagggatgtacggggtcaggatgtcgagagaaaaggtcacaaaattaaattagaaccaaggagggtaagccttggcaagagaggcctgtccggccagctgacaggggcatgcgccctggagaaccccgagaaaggggagttgtgaaaatgagccatttcacgcctaattacgatttcccataaggtacttaggagggatgatgtgcgctggacttggacaattaacgtaattaaacattcatgctgcctgcggcccatttcctgcctggggatatctttggaagctgaagcatttcttttttcttggaggtgatttcaagaatggctgcagaggaagggcttcctgcggggctgggccttgggggatgtacctctgcaccccagtggggcaggacccctacaaagagtgtttcttggtggcagctgggggcctgggggccggggaaggctggatgccactgacctggaattacctctccgtcgggaatgggcagcggggtctcatgtttgtggagtgggcagcggggtctcgtgtttgtggaattacctctccgtcgggagtgggcagcggggtctcgtgtttgtggaattacctctccgtcgggagtgggcagcggggtctcgtgtttgtggagtgggcagcagggtctcgtgtttgtggaattacctctccgtcgggagtgggcagcggggtctcgtgtttgtgactctgcctgtgttttgatcacggccaagtcacttaagcccagattctctggcgtcccctcctttcctccgattctctgacagaagcctgtaaggacttccttggcttctctgggcctcaggttttctatgtgtcttacttgtggacactgatcaggacactgagggtctgacggagagagggtggcctgaccgaggtgcacagctggaggtgcctgaccgaggtgcacagctggaggtagctttgctgggaccagaacccagggcacttgctcacgtgctggctgtcacctctcaagcacaggccgggggaggagctcaggatccagccagactgactgagctgttctcaggtgaccgcacaccacagacttcagtgcagactggcagagcttcggctccctcctctgggaaggagcaccgggcttcctagctccagagttgtggatgctggatgaggaggccgtggtgaaggcaccgccccgggtctggagccccacaggagccttccccagatgctccgcaggcagtggatgtccgctggctttggttagtgttctgcctgccttaagggcaggcacagtcggcccagccgcgcatggtgggttctggggctgggggcacctccaggtctcagggcacctgccttgctgccgagagactgcatcaggcaggaggcaaggcagtggccggcataagagctgggccttgctgcggagtctccttccgcttcacacccacactggttttgggctatggcaggtggagcagggaggagccagggccccggaggtcttcaggctggggcaagtccacccccaattctgccctgctggctggagaggagaagaaaacaggctggtgcccagactgggttctggtggagtgagctgagtcaggaacagccctgtccgtgcacctggcccgttcctgtcacctctgtgggcctcaggttttctatgtgtcttacttgtgggctgtggccagcatcgttatgcctacttttcagatcaggacactgatctgtgtgcgccactgcggtgctctgcagctgattcatcctggaggccgcccacacctggggcctccggcccaccctctctctgtgctccagaccactcctgcctgagtgtctcatgggtgtctgtccttgtgtccccacagaaatctcagcccaacacgccccacacggccttctcctcctcccacgcggctcctcccgagggtcccttgcagggaaggcttcccagggtgaccggttgcccaggtcagaaacccggaatcctccctggccccactttctgcacccaagctgtgactccccctctcagtctttgtccacacgctgcctcccctgccttccaccctccttcctggctccctctccagccccaagccagggctgccctgccccctctagtctctctgcacttctgccctcctcccggcctcggccatctctcctctcctggccctccctccttggcacagcaggggcttccctcactcccaggccctctgcactgctggtcctgtgggccgtggtcaggaacacccttccccctctgcctgcctctcagccctccccatgagcgtcaggttccctctctgtgtctgggccctgcagtcctagagggcatctggggttgaggggatgctggtcctgctcactctgtggtcccagcccagcaggctcatcatcactcaaagggccccagctgggggccctgcagcccaccagatactgccgtgccagcacccagagccaggccaagcagatcggtgccagaccagttccaccccagatcacagctgggccttgactgtcagggtggcccccttcagctgccaagtgtagagtcgtcagggagcaggccaggctgggggctccctctgcccctgacccctgggggagctgctgggagagtcctggcctctcctgcatgtgcgtggcttgctttttggctggactaaggattgcagccatatgaaatgctcattgctgtcctcatccccctcccattggctgtcctggaagtcagctcctttctgcagggcagccactgcacacctttcttctgtgtcctttcaggatgtcctgtgcacacacaagtatatatatatacacatatgtgtacacacacatatataaatcctaggattagaatctctggctcaagggattttgtgtcctgtagatactgtgttttcgtttttctgactttttcctgcacactgtagactacaccgtgtgctaccctgcatttgcgattatcagggaacatgtcttggacgtcgtccacagcagcccctccagacctgcccattcctcctgctcaggcattccatcctgtgaatcacttgcttaaccagaccttgactgatggggacgttacttcttttcaccgtttcttataatgcagccgtggatatccttacacttatttccttggctacttgtatgaggacatttgtaggattaaatttgataactagaattgtggattcaaaaggtttgtgcattttcaactttgataaggatgaccacaaccctaggatggttggctggatccgtttctctcagcatgtacccctgatccgtacatttttatttggacaatctgatgcaggttgtttctttaattaagggtgaggtcgagcgtcttctcatacactgaaaagctgctcggtggctcatacccgtaataccaacactgtgggaggccagggtggatggatcacctgaggtcaggagtttgaaaccagcctggctaacatggtgaaatcctgtctctactaaacatacaaaaaaaaaaaaaattaaccaggtatgatagcaggcacctgtaatcccagctgcttggaaggctgaggcaggaaaactgcttgaatccgggaggcggtggttgcagtgagctgagatcacgccactgtactccagcctgggtgacagagactctgtctcaaaaaaaaaaaagaaagaaggaaagaagaaagagaagaaagaaagaaaggaaggaaggaaggaaagaaggaagggaaagaaagaaagagataaagaagaaaagaaaagctgctgtcttttcttttctgacaattgtcccctcatattgaaatgagagaagttctcttgtcctcctcgcagggcgtgctatgggggtgtggcttccttcttcagtgtccctctgctcaaacctctgggggagaatacagacgggcaggctgtggggctccgaccccacagcagtgtctaggggtgaatgtttgcagcccctgaagccccagtgggcgtgtgctgcatgtgctcttttactttagctgtctgtaggcggcttgtgttaaccagctcagttagaccctctaccttgtcgcaaggacagagggctttctgtatctcgggttcttccttgatgtcctggaagaatcagatcacacgtgggcttggagaatgagtgcgaggttttattgagtggaagtagctctcagcagatgggggaagccagaaggaggatggggtgcaaagggctttccctggagtcgggccgctaagcagcctgggctctcctctgactgccccggccaaactccgtgtcgttctgcttctgccggtcggtggcctgcagcgtgctggtgctcgttggtgcgttcctctcgacgtccagccgcctgtgtgttcctcccctcatgcgctcctctcgacgtccagccgcctgtgtctgcctgttagggtctcgggtttttataggcacaggatggggacatggtggaccagggtggtcttgggaaatgtgacatttgggcacaaaggcaagagtgcctgtcctcacataggtccgtgagggtggagcccttagccagggaccatgcacttccctgcttccatatcatttaaagggagcatgcccttctctacccagcacttttgtatcaataccgtttgtccatttcccttttggattgctggattgtttcttgttgatttgtaagagcgctttatgtattaaggaaattagtcctttgtctgaagcgcacatgatgtgggtgagcccttggctgtgtggggctgaattgagagtccatgagagggaggaggagcctggtgcgtgctgagtgttagttgccgtgtggataaccagggagtgttcctcaggcccctgcgtgaggattccaccataaaacacatccatcaggagctgtccttcaaggtgggaaagggatgtggagaaacaagtggggcgtgaactgcggcccgggaagcttcagccactgtgaggcagaggcaggtggactcactctggttggccagaacctactgtgctcaaaacctctccaggccagacggaggaggatacagggaaacggttgctcagggcgtggagccgaggtggcagacagacctgaggacacagctttggtctgggcgtggagctgaggtggcagacagacctggggacccagctttggttcatttcacaagcagcacagcacctacattattcttaaattgctttttgccagtatttagagatcagagacttcacatgcaaatccagatttctcacttccttacaaaaataagacccagcaacatggacctgcaccctcctagtcaccactggccaccttgggctggaggcagtgtgccctctcatccccctgcccacatggcttttctcatgggagcaaaatatttctcagtgaagagggaataagcaaaagacaagccaagagggccgcatgctccaaggaaaattgggagagtatatttctttctggaaatgcggaccgtttctctctgttcaacatgtgaacaaaatatgtctaggtcagagagatggggcatcgggaaacacgcccagcctagcagggacccacaggtcgagggtcagggaggcccgagtgagaattgctgtggtgtgaggcctgcggccggcagcgtgttgtcaggatggcgcctacggatgtcaggatgtgccgggagccatggcgacagctcccaagaaaaagaggagaagacggtggtagcgtgcacccaccgcatggctgcagtaagcgcacagcatccacctgccccgctgacctcacgccgccctcatgctctccctgtaaatgacggccaggaaggaaaccgatgtagactccacggccaactgctcccaccaaggagatacagacaatccgcccgcatccacgctgcgcctcgtcctaccctgtcctgtctccacctgctcagaagtagcataaggataactaagttttccatttatccaataggcgtttttggcccgtttatttattcattttgccaagccccatgtgggtacctggggacttagagaggggtcaagggccacctcagtcttccaggagttcactgtagagcctgtgtgtgcatgtgcacgtttgtgtgtgtgcatgtgtgtgcctgagtgtgcatgtcacatatgcacacacgtgtgacatgcacacacatccatagactcacatacacgcacatgcactcacatacactcacatgtgatgaatgtatgcatgtgcgtttgtgtgcatgtaagagcattcgtgtgtgtgagtgcattcatgtgtgagtgtgcgtctgtgagtgtgtgtgtgtgcattcatgtgagtgtgcatgtgagtatgcgagtgcattcacacgtgagtgcatgcgtgtgcgagtgcattcgcgtgtgtgagtgcattcgtgtgagtgtgagtgcattcgtgtgtgagtgcatgtgtgtgagtgcattcgtatgagtgtgcatgtgagtgtgagtccatttgtgtgtgagtgcattcgtgtgtgagtgtgcgtgtgtgagtgcgttcgtgtgagtgcatgtgtgtatgtgactgcgtgcgtgtgtgtgagtgcattcgtgtgtgcgtgtttgtgagtgtctgagtgcattcgtgtgtatatgagtgcatttgtgtgagtgtgcatgtgtgtatgtgagtgcgttcgtgtgtgtgtgtatgagtgcattcgtgtgagtgtgcatgtgtgtatgtgactgcgtgcatgtgtgtgtgtgcatgtgtctgaggagtgatcactgagcaggccagcctgtgatggtgacaccccagagcgctctcctagaggtggtgccacgcaaggctggcaaatggtagttagcaaaatacttgacgagtgaatgaacaatgaacaaatgaatgaaaatgaaggttttgggagccagagaaggagacagtgacttgtcctggtggagggcatgggcccagggcaggcaggtaggaactgttgcaaacaggaggaaagtcaggctggacctggaagcagggggaggggttgcctggcagaaagtggcaacaggactgggtgctctggggagggtgctcctgccctgggagaagcatgctggaggttcggaggcagctgggccctgcaggggctgctgccagacttgatgccctctcagggcttggcaggagtcagttcacaacatgcaatgctgtgatggcagccacgtcacctctgcagggcaggcaggagcacatgggcagctggttgggagcacaggccagagggccacccacccagcccatctcagtgagccacaggcctgccgctggctgctacctggaagggtcacaccagcttttaagcaagaagaggaaaccccagccttttaaagtagaattaggatgatttctatagtttctgcccggccagctgctggtccagtcttctgagcccttgcagtgttgagggcagctggggcccggcaagcagggcctttgccatcctctctgcaggcagggtggccctccctcccctcctggttctcagggtggccctgggatctgggcttgtagtgcatccctgccacctgccctggttggggaggaaaggccctgtgaggctgccttggggattaaattttcaggactcagcactcactctgatttctgatttcctcccttctcgaaatagggctgatcaaattaagccttgtcaacaccgtggtctgggtgctgtgtggggagtatgaggagccccttccctcctcaactgcagctgggatattctagggcaggaagcatcatgggacaggagtgtgtggggtccaccagggccaattgtcaccacccccaaactcaggcttctggacccacggagttcacacaggaagacaaatgggaggaacccccgtccctgcagggttggatggcctggcctctgggctcagagtggcggctgcactgggggcctctcggtgctgtctctgagtctgcaccttgggatttacccgtgggagaggcaggtctgagagaagatcccacagccaggcgtgaaggacaggagagaccagaaacaaaggttgggcaggcctgctcctcagccccatggggggctggagcagagggaaggaggacatgtggtttgggggcccagcagcctgaggggaaagggaggtccctgacactcactgggagagagggctgagggtctggcaagttccagggtcttgagctgaggggggcgtggtgagcattgcatcacctctgcggggggctcttctctgggcagatccagggagcctggctgctgcccgcccacatggggtttccctgccccctcaggaggcgcaggggcatgggagcgtcctggaggatgggacatcagggcatgggagcatcaagaggccccaggcctcaccacccttccacccccagcatgggggagggctggggtggtccccggggttgtcctcggtcactcctgctccttgagcaggtcctggtcagacatggactgtgcttggtgccacgactgaaagtggggggtctttgtgcccaagggtcatggtgggtgatggcagcaaggtcctcagctgggccagggccctggtactttcagctccctcttggctgctggaccaggtgcaatcaccaccatgggccattggaagctcgggatgcgggggacagagccagatgctggggtcacgcaggggtgcctgttgcctgggcccagggcttgttccctcatttgcgtaagagaggtcccgtgcccactccaccggctaccatgaagaagaaacaggaggtgtgtgaagtccctggtgcctgggcatctgaggaactcttcctcctaggaaggcagcttggtggcacagtgtggcccaccgtgcagggctgccccaggtcccacaatcagctaggaagagcctgtgcttggctgcagcaccccagcactgctgtgtgcctggactcctgacctagaggggtcaggaaggaggagggagcagaggcaggtgctgagtccctgcacgtggctcatggccgggtaggagagggcctcatttgcacagggtcgggcagcatctgagacctcccgcttgtgttggctgcaagctcttcccaggggaccaggacctcacccctgcagggcccacgcccaccctgcatgaacgcagggctcaacatcaaaggacgtgaaggccacaacaagggaaactgaggttggcaggtaaagaaatgccttggaacttggatttgaagagtgcagagatgggggaggcgcagatgctgctggagtcaggagcgtgggcagtacagagggcatagagcgtggaggggtaggttccagagaccctgaggagtgaggagggagctgcctttgagggagggggagaggcaggttctgctcctggcatggacctggctgcatgcgggccccactccctaggtggacgatgcagctggcagtgcagccggaggtgcacgtgcgggcagaggaggcagcaggccctggaccttctgagtgtgaggtacctgaggccttccggggagcaatgccaggcttccagatgatgtccaaatcaggggctctggagcatgtaccagactggtgacagggattttccgcctgtcatctgctgagccactggccaagcctccggccacatgggtcccgtggcactggctgtcagcaccccacttgccggcccccacctcctctgcgttcagaacacaacccctgggaattctcccttcctttgggacccgtggggatcttcgttttgttctgaagttcacagtgaatattttcaataaaagacctgccggcctctccatcggcccccaccacttggctgccgcgtgctgcggtgcccccgtgacattacccaggccagctccccttccctgggccaactgcccagcagagggaaggcttggagccctgggggctgtggtgagtcctggggaccctccctggcttaagcagatgctaggcaggggcagggcttgctggctcttgtcacccgccccagcctctgaaggccccgagacccccgtgaatccttggaggtgagtgggctgcagaggccgctggagagtggcacggggcaggtgcagaggagcctcggtagttcggcgggtgctggggggacgaaggggaagttgtgtttgggaacctctgtgggggctgtagacaggaggccccagccctggggtgaagagggggaagttgtgtttgggaacctctgtgagggctgtagacaggaagccccagccctgctgcaggacacctcagaggggctcgcacagctgctggtcactcagcatggccctgctggcttgggctcaacctcagcagcctcacacctctgctgggcaccatttcccaaggacacgtatctgggagccggaccagagcctggccccttttctggtcatagaccttaaatactgcagaccttctcctcgccccacactgggaggtgcaggcacagggcagaagagagtggcctggtctgatgcctcaatcgttcaagagagctgtggctgcaaagccaaaccatggtgtctctctcaggccagcacatttggctgtgtctgtgtttgtaagggcacacaggactctcgtggttgcaagagacagagagctaaatgaattgacctgaagaattaggatgtccaggggtgcatcaccttcagccatagctggatttggggacctgaacagtgtcagcagcacacggggctgccctcatctctcgcctctgctgctcctgggggaaggaggtacttagcagtcccagagtcacattttcccagcagagaggaaagcacgggagtcttcctgtgcacaccaacacacagcatcaggttccagtggcctaacaggaccccttgggcactcctggagctggggtgcagtgggattggctccccatgagccatatggggtgcaaataggggagggtggtttactagcagaaaaggtgtaatggccagacagggcaggccaccgtgctgtgcaaccccaggtggctctgtgagggtgtgcaggtgctgggcaggccaggaccttctgtgtccaccactgaggggtgtcctttgtcctctgctgtgcgggggtatgttctgaggactggcccggagaggccttctctcctttagtgcttcctttttctccctgaagcacggctgaggctgagcaggcctgggctggagcgtccatctgtccgcggggcagcccatcccgtgggagtttagagaactgtcaggactgcccctgagattcggcacagcggttcctgatgcgctcctgatggccaggccggccccaggagcccctccccaccctccgatccacctcaggtcataaaaatggcattggatgagctgtgtctgttgaagttgcaaaaattaattcaaagtcagtaataaagttataaagggctgggatgtaataatcctaatgagcatcttttaataaagtacaccagtggggctctgtgctgatggcccccgtggggctgagcctgccttctgcttcccagagcctccaaagagcctgcctgcttccaagcagggctttctgctgtgtcctgattacacttccacataaacatatttcatcttaatgattatctttaggggaatacacagccacagagcgactctctcttggttagtaagaaatggaggggatgaccttgttcccgttgacctcccctgggtggggctcctcatgttggaggagaggctgctggtgctccaggctttggtcctcctgagcctggtggtggcccctgcaggccctggcagtgcttgtgtgcaggaactgggctggcattctggcctggccatttgccaacatcatggccttagtctaattccctgagcctccctctcctcttctgggcagtgtggcagttctggctctgcagggcggtcattaggacttacgttttggggactcctaagcactggaaaaaggatgacttgttcccatccacatggttggcaggttgaggcagtagcacagcacctctgtctgtgtgcaggtgcctcagtgagtgtgccgtctgccctcaggccatcccctacctagtgagtgtgccgtctgccctcaggccatcccctacctagtgagtgtgcctgtctgccctcaggccatcccctagtgagtgtgcccatcccccccttgcgccatcccctagtgagtgtgcccatcccccctcacaccatcccctagcaagtgtgccatctgcccttgcattcagccagcagagtccagcagagtgggaaactgctcacaggggatggggcagctaaggagagggctgggaaagagccctaggcttggaacccaaagcccgcccaacagcaagatgataaaaaggtgcctcgctacattttcttctagcacttccatgacttccttttgatcatctcatccacttggaatctgtttttgcttaaggcatgaggtcaaaatttgaccttttcctccctctaaccagttgtcctaacatcattaaaacaaagaaagaaacaaaagccatttatctccccagcctgctctcttccttctgattttctcctgcagtgagcaaccatttcaggtgatcaaaccgtatcctttccttagtgtacatttttgcaacatgagtgttgctgtcttgcgtctgtgtatccataatttatgtaagtcgctctgaattgtgtctcattctgtttcttaccttttgcacttggcactctgtttttaagatccatccatctatgtagatatcaaacttctaaccttggtagcactttgtgggatgcccccaccacatttgcttctcctctcacccactgatgacccccgtgttgtttccagctcccctcactccacccaagcaatgctgcaaggggcagctccccattgcctccttacagacctgtgcaagtttgcccatctgcaagccagtccatggggccgaacaatggcccatgggccaagggtcagtccaaggagggcactgggctatccgatagacatcctgtatctttaggatatgagccgcatggtgctcttcctcatgatcccctcagtagtgccagactgccaggttgtcccctcctgctccacctccgccgtttcctagcaccgtttgctacctgtatcatttactaattttattcactgtattgctacttgagcaactatttataattacatgcaaatgaatatcaaagacgattaatattaaagcggagagctggcacacgctggcagtgtaaggagagggcggcactgcccccgctggatggaggctcccggaggtgagcagatcagtctccaggtcgtggtctgacttctgcttctccgggaactgacaaggcccctcctggggaagtcgtgagcaaggtctcgaggaagtctgggctcagcacagtcaggcacctggtagggcccaggtggggaccacgcgctggacctgcagcggaaatacggtcagagggagggggctgacctgtacgtcctgcttctaagctcgccacggcctgcctccagctctcggtggggggaaagctggaaacttctgtgaatgttgtgcgtcctcagcagaggaggggagcgcccctcatcggcacatggccaagccaagtactgccaagaacctaggccaggctctcctgggcattttgtccccgggctacagatggcctgatggaggtggggtcttggtgaagacagttcaccccgtgggtcacgctgctcagtatggctcagtcgctctccacatctggtgcagagccatcacctcagggtcacttctcgccaccctccatgggcctcccaggccatgtcttctgtgttgggctcccgttttctctatctgtgttgggcttccgttttctatatctgtgtcttactctttctttgttgccttttttgtttttgatggtgcacacctttcagtagcttcttgagaggagtgcttgtcacataaatcttttgagaactgacatgtctagaaatgtccttattccactttcatacttgatggggaatgtgtctggatgcagaattccagttggacaatcattttccttcagaattctgaaggctttcctccactgttttcctgcatcgaatgctgcttttgagaactctgagtcattctgattccaattctttgtctatgacctctcctgtaacctgattttcccccttcttattctccgggagactttgtagaatgtggctgtcttcatggccagcctgggattcagctttcttgatgtaccaagtctgttaccacttgcccatctgtttccagcctcccacagttcccttgttgtttcttcccctcctgctctgcctatccttggaggcttgtgactttaaattttttttaaatttctttactgaacttttaatgggattctagaaaggagccaaatcagatatctgtgttcaatccgccattttaacctggaaaccccacatattcttggatctgtttttggaagtttttttgttttgttttgtgtttttgagacggagtttcactcttgttgctcaggctggagtgcaatggcgtgatctcagcttaccacagcctccgcctccccggttcaagcgattctcctgcctcagcctcccgagtagctgggattacaggcatgcaccaccatgcccagctaattttgtatttttagtagagatagggtttctccatattggtcaggctggtctcaaactcccaacctcaggtgatccacccgcctcggcctcccaaagtactggaattacaggcgtgagccactgcacccagcctgtttttggaagttttattcagctccattgatctgtttctttcatgacattgacacaactacgttttcattaatattattttataatacactgcattaatttgaaaaaaatatgcctcctcattgtcattctttttcattatttttctgtctggtgtggtcttccggatgaatgttggaatcactttgttgggttttaacaattatttgatggagattatttggcggagaataattttaacaattattttaacaattattcgacggagattatttgacagagaataattttaacaattattcgacggagattatttgacggagaataattttaacaattattttaacaattatttgatggagattatgccaaatttcttgattcatttggaggaggaccaacttccagtccaggattatgtccatgtagcttcatttactgaggtcttcttttgtgtttttggagaccttagactatattatactactttttgtgtagtcgttgaacattcattagtttttgtttgttcttagatacttgggagttttgctgttatagctgataagctcttttttccactctgctttcttgcgggttattcctatgttcaagaagtcttgatctttgcattattttatgtgagatgaggagtatctgttccttgtggatttggttaaactcttctatggaagcatttctttgactgctctttcaatttcttctgaggttattggtttcttcaggttttctacttgagccatgagtggaatgtatattttctatttagtctaggcctattagaatggtgcttttaatttcagatgtttagggtttagggttttattgttatctctgattttgtctcagtaatggtgattgtgggcacggcttttgagttgtgtcctaatgtgtctcagtaatggtgactgtgggcacgatttttgagttgtgtcctaatgtgtctcagtaatggtgactgtgagcacgatttttgagttgtgtcctaatgtgtctcagtaatggtgactgtgggcacggcttttgagttgtgtcctaatgtgtctcagtaatggtgactgtgggcacggcttttgagtttttgagttgtgtcctaatgtggtaaaatgtggaacttctcccgtgtgtgcttgacaaggtcacgtgttctggctgttgggtttgaacgttaggttttcctattaattcaaatagtttctatccctacctaatgctgtatcagacttgtctggaataaatgtattacagtgctcctatcactgtggccttgtctctccttccttgcaccaggttgaagctttaggagcataaagtttcgtatcttttgtatttttttccatgagttgtttgttttatcagtttatctccttaaatgccttggttggcaattacatggtacgtttctttgccccacttgttttaactcctcctggtcatttggacttggttatgccatatgcaagtaatttgtagctggattttgttccatctcatgcttctccaactgccaccacacttttgctcctgttctcggctccccacccccagtgtggcccctccggccctgctgcacctgcctctccttctatcccagttcccaactccccagaggcccccagctcgcctctgctgggccctctgttcccagagcacctctctgccatggctccaggcccctcacagccctgcggttacctgtggggcactggggacactgaggcacaccagaccccatggtctccatcccccagggttctctatctgagagggaaagtcagttaatgcccaggcaaattcacaaatgagacaagacctgcctgcagtggagtgtcacaggaaggaagagcacggggtgctgtcgggagaaatcaggggagggctgatttcaatttgggatgaaataaggaaagttctcccttaggagctgacatttcagcagacacctgaaggaagagagcaatgagggggcggccatcccatggagaggggacagcagtcggccgtgtcactgaacagtgtggtcctcaggttttaagcatccctgccccggcccctgtccctgtcgtcccctagtggcacgcagtgtggctgtgcaggaggcagatgggggcagaacatgctcctgtctttcaagagctctgagtcccatgggaggcagcgggctcccttccttctgggtctttcagggggcctaaatttggccagcacagcggcagcagcaaaaagggcatcgcaggtgaagaggccagcccagaaaaggcataggactgagcttcgcacaggggacagcgaacacccagccacccttagcactgcaaagcccctgcctgacctcagagcccacacctgcccactgcacttgccctcagcccacacctgcccactgcacccgccctcaggcccacacctgcccactgcacccgccctcagggcccacacctgcccactgcacccgccctcagggcccacacctgcccactgcacccgccctcagggcccacacctgcccactgcacccgccctcagggcccacacctgcccactgaacccaccctcagggcccacgcctgcccactgcacctgccctcaggacccacgcctgctcactgcacctgccttcggagcccacacctgcccacaaagcccgtgcctgcccactgcacccgccctcagggcccacacgtgcccactgaacccaccctcagggcccacgcctgcccactgcacctgccttcagagcccacacctgcccacagagcctgtgcctgcccactgcacctgcccacagagcccacacctgcccactgtacccaccctcagagcccgcaccatcccacgatgctcccgaggttgcagactcagtcccaggttttctcttctctagtctaatcatacttgtttctacaattctcattctcgcaaatcacccctcagtgctggtgaagtacagaagggctccgggcatgtggacaacgttggactcagaggcctgggcgcgtgcccactcctcctctctggtggtgtggcttgtccaagtcatgtaattttcctgctccttggtttgtttccctgatgctgaaataggacgatatgctgatggtgacacgcctccaccttggcgaggggattggatggctgctgggggtatggagctgccactgtgaagggctgtgcacacacccctgcctggagactcggggtgtgcctaggatgctggcagttgcagcccttgcccacgtgccctgtgcactgtggcactgtggatgagcccgtggctactgtgacccacccgttcccctgatggaattccctggacagaactgctgcctcccctcattccatcctctccctgtttattgattgactcttcgatagagtctttttgttccattctagagactctaaaacaggatggctctggagtgcttcccacagtgtcattatttggccacgatgtgagcaaagagatctccagctgccatccaaaaggggccctgagcacagggaatgccaggaactcgaaagctctgtgttacctatttaaaagatgggatcctgccacagacacctcccttcagggtagctgcagcccacctgggtatgacttctggggcttggtcaatcagcacccccagggggcccagtgccttcttgtggggaaggctgcacacagaggaaaggaaggccaagggcagtgtcatcctcctgcctctgcaggagatgggtgcgctgatcactcatccaggcggggtgagtgccgagggatacagcagaggctgtgtgagctcccagtcaccacagctcagcagggctgggctacacagggagctcccaggggaggaggggagagcagcaaatagccctcttctgccttggagggaccaagtggaacaggggctgttagaccaggtaggcaaccagtgcaggtgggcaggcccaaggccaaggttgacttcaaagggatcactaggaagacgactcaggaccacgccaggcccactggccagagctccctatagcaaggctctatttggggaacaggtctgcaagggccagcatgtggtcagagtctcttcatggcctgggttaagcccaatgtgggaaaaactgaggtggcactcgtgattgacagggtcagggtcaatcttattgtggggaaaactgaggtggcactcgtgattgacaagctggggcttcagcctgactgccgggtcttgttgggacagaggaggacaggaggggggctgggccagagctcctgttgccccaggtctgagggcattgcagatccccctgctcttagggcttctccccttgtcctgtccagcctgagcaccactgaggcttccaggggccagacgcagggcgtggctgtcacctgccaggtggcccaggcccctgtcttcctctcctcacccactttgcctttgggccttgggccgtctctctaggcactggtcctgggtggagggatgctctagaacataatttccaaatttcaccccaaaattatcacgattaaaataatgatggcaacaataataattccatttcaggtgaaattcagattctaaatctttagaaacctttgctgtttttaatgggcttgcaacacacagtttagttaaaaactctgcctgctcggcagaagcagcctcaagacgtgccccagcccagctctgtcccgatgcggcacccatgccctcctacggggaatgtctggaggggtccctgcatggggactctggggttagggccaggaggacatactgtgataccttctggtgccagaatgacattgacagtggcaggcaggtggcctggtgagccaagccctgtgtgttttgtctccaggtgtggcccctcaattcacagacccgggctacccctggggtggccccatctcttaattcctcaagagaagctggatgttctagatttttaaaacatgaaatctcccagttttcaaatactatcaaccagatggcaccacgtgacctcaacgagtgcctctgtggtctggttttgccgagggcaccgcccgtgtgtgacccctagtttgacaagggcagagggtaacgcccggcctgttccccagggaggaagagttttcctatggaaattgccatcactctccttcccaaggtgattctgaaggtgagctgtctctgttcgttggaaatgcaaagaaataaatgtacaaaaatagagtggcgattcctcaacccccctgtcaggcttgagttgctggcgcttcctctgggaacggcatggatggccctgagtcatccaggcagctaagtggactgctcggctccccacagccctgcccgcaggcctgccggccccacccctgtccctggagtggccctggaaagtccttgctgtgtacatgcatgtgtgtgtgcctgtgtgtgtacatgtgtgtgcatgtgtgtgcttgtgtgtgtgtacatgtgtgtgcatgtgtgtgtgtgtgcatgtgtgtgtgcgccgaggggacacagaactgtggagctgggggtggcacaaggacccccgaaggtactggaaccccagcagctgctcagccctggccccacttactcctcttctctttcccagccctcaccctccgcctcgcacctccactgtctgtcttggtcttgcccacagccgggctgcaggtttgtgcctgaaacttcatgttcagtctgtcttgtctgagccaggctgcagggtgcaaggagagagcttctggccgagagtcggccatgctgggatgccatgggtctccccatctgtaaaacggaaatggccatgtccaccgagtggcctgctgtcagcactgggtgaggaagcgtgtgccgggatgagggcctggtaccaggctgcctcactgtccgagtggccgtgccgcctgcaggggccttgttctgcctccagggcctgtcctgggccaccctcacagggagggagtgcctgtccctgcctggaagaggcagcaggagagaggcgttgggggtgaaaagtgttgttctggaagactctttgtagagaggtggtgcagcagggacgctggtctccctcagctgcaggggcctcggggcctggccaccgccctgtgggtcagtgatgtcacgatgacctgcagccctgggtctgtcccgggccaggagtctctgaggacctgcctggggaatgccatggagaccctggggctgggacctggcttagacacagagaccagtgcaagggaaagggggcttccaggacactggggcttggggggcggtgggcagtgtggtctggggctgccatcgatgctgcaggtcagcctggccagccttgctgtggccttcagacgggcagtggagggctgggaactgaagcctggtccagggtggtctccaggcccgcaggacacagaacacagcagagacagcactgcacagaaggcagggacgatatccggggcagactccccaggatggcagccccaagtggccaggggcacaccctgggggcaggaggtcagtgcctgcccagggccgactgcagcggagctgccacagaggggttcatcttggtctctgcacaattcaatcaggccagaggcggtaccgttcacctggggagggggcccgggacctggcccagagatgtggggcctcgcttcagtggaggacttagcagaaagttctgggaggggcccaaggagacactggggaacatgcacagcccaggatgggcctcggtttccccagtcataacagctggcgatgacacctgggacaccagtcctttggcacctggcagcccttcgggggagaagaggtggaagggctctacccactccagcgtcgggcagtgcgggcaagggtggctctgcccactccagcgtcaggcagtgcgggctgaggttcccgacctctccatggctgaatgccagccctgggctccataaggcagacggtgatgctgggctgggtctctcacagtctcagcaggtctgatccatcgtgtggaggccactgtggcccctgctgtggctggggttgccaccaggggctggggaacgagcggtcctggaagtcacagaggtgcctgtctgggccctgctgtgtctgagacagcttggcaagtctctgccatcttcctctgcacctcgctttcctctgtaaaatggaataataccctcggttcagggtgctatgagttttaaatgagaggatggccaagctggcgcctggtaggtttgtgtccgggtgggtttgccctgccgctgaagacggtgtcctctccttgcaggggcctccctggacagcctggacagcctcagccgcgccctgggcatcctagaggagcacgccaacagctcgaggcggagggcacgcaggcatgctgcagacgatgactacaacatcgaggtcctgctgggcgtggatgactctgtggtgcagttccacgggaaggagcacgtacagaagtacctgctgacactcatgaacattgtgagtggggtggctgagggggcagggtggggcggggagggtcaaccaggggctgggcaggccagagaggcccagctgggccaggtcccctgaggctctgccgatttccttgttagccggaggtgagtgacacagtctcagggaggcttgctgggtccccaggtgagacaagttgaccatccctgacctcagttctctcgtctgcacatcgtgggtgatggtaacttggtgaggctcttcacaggctaaggcgggtttgtgcaaactccagtcgtttgaatgacaatgtcattcaatgtcccgtcatttgaaaaatatgttttcttgatgtttgccacttttaaaactaaaatcatttaaaaaggcaaccttattttacctgaaaagctaatataatagtaagacataaagtgacgttattcagccccagctggatagccctgccttcttctcgctccaaacagaagccccttttctgtttaaagtagagattcacgtgcattagagcgagggccagacaccaacccagggcccctccttaaagctcgcagtgggaggaattggggagggaattcctttctccctgtgagtctgggctattgaaaggggtgtctatgtgccaccttcgtcttctgggcacctgcccatggtctgcctaacactaagagattaaagaaccacctccccctcattccatacccccaacaacctaagcaggaggtgccaggatgctgaaccgtgtgtgggtggaggctgtgcagacctttcctctctctgcctcatgtggtcagagccactgtggggatgaggggcgtccagtcttcaaaatgcaggctcccaggggagcagactggcttggctgagtcctgcagggaaaagaagggggtgagaaggaggaccagggcacggcctggaatgtgagatgctgccagtggggccctaggggcaggggggtatttgtgggaggaagccggggcttagggagggctggaggtggtgtggaagccgggcaggtgggaagttctagaaccccgtgctgcgtgtccacacctgtggatgaatgaggtcctctggggccgggctagaggcaggcagcagggtgtgcaggtctgctcaggatctgctgcccagctctgcttttcggaccaggggtgagcccctccaggagccaagctgacacatgggtcagagtccccagggccctggtgaaaagatacctcaggggcaggaggggatgtgagtgagctgaacactggacagagacaccaccttcatgctcactttcctcttgaccggtcttgggtgagtcagctagccctctggagcccagccttatccgtacagggggccgaagtccgctgcatcggcagaattcgttttatttgggagagcgttgtcacacttaccctcatcttatttttgaaacgtacctttaatgcaataatcataataacggccgggtgcggtggctcacgcctgtaatcccagcactttgggaggccgaggtgggcggatcacgaggtcaggagatcgagaccacggtgaaaccccgtctctactaaaaatacaaaaaattagccgggcgtggtggcgggcgcctgtagtcccagctactcaggaggctgaggcaggagaatggcgtgaacctgggaggcggagcttgcagtgagctgagatcgcaccactgcactctagcctcagtgacagagcgagactccgtctcaaaaataataataataataataataataataacaataaaaccataatggctacattatcgagcccctactatgtgactgtgccgggcccatgctgggcacttgccatgctaaattatcttgggaagtcctcatgctaggtctgtgagactggcaggtataaaatcttggctgccttcacaatatgagttcttcccctagcattatgtcgccttccaacccagcggggaaaggactgggcttggaattacagtccgatggcgactccaggcctcgccttttccaggcgcgtcgttgggaacgctgctcccgtcctctgagccttagttttctcatctgtaaaatgggccagtgttttcatcgtgggggttgatgtgattacatgagataatgtcagtgaatgtgcttttcagtctctcagtagggtgaacacgttttcagtttccacataaaatgtggttttgttatcatgacagtggcactgtttagtgacagtccaggaggggtcacttctgatagcccaccaagggcgctgaccaaatgtggggcccgtggtgagtccttcatgaggctggcagaggcagatcaacctttctcctggtgcccagggtctctctgtcacaacagctggttggaggatgtctagaacgttctctcacttttgccgtccaactttattcaaaccctagtgatccagccgtaccccctattttgaataatgggaaggttcgtttctagaaaagcatgagaaatttaaaaattcttaaattgagatgagttttatcacaacagagaaaccgttttaggagacaagtctcagaagttgagaaagtatttgggccgtgtctgttgtcccctgttgcacagaagtgagcactgattcattcagcaaacgtgttgacagtgtgcttgtcatgggcacagtgggggtgtcctgcagaggcggcggggcgtggcagagagtcccggggcgtgggagaccggcggcggagggtcagcggggggtctctgcctctgatctgagccccagctcccactgcaagagcgcagcgtgggcgagggagataaggcgcggccgtgcctggagcatggcattgccctgacgatgaatgccctgcgtcctcactgagagcctctgcatgcccggagagtcctgaggacagatctaagctatgtcggaccctttggtggtcttggggaggaggggcattgagcaagtgggagcttctgagaaagggtgaccttccagagccctgctgtgcgacagagcttcccgcggtgctggggagatgctcgtctcgccctttctggggcagtagccaccggggctctggagcacttgaagtgtggctggtgtccttgaagaactgaatttttaatttaacttcttatttgttccaagagaattttaatttaaaaaattttaattgcggtgaaatatacagaacataagtcaccgtcttcaccatttttaagcgtgcgattcggtggcgtaagcacattcatgtggctgggccaccatcgccaccaccgtccacagaactcttcatcttgtaaaattgaaactgtgcccattgagtttcagccctttcctcccctccccccgactcctggcacccaccactccactttctgtttctgagaatttgactactctgggtacctcgcataagtggatcaaacaataattgtccttttgtgtctggcttatttcacttagcatgacatcctcggggccatccacattgcagcatgtgtaagaatgtccttccttttcagggaggaccagtatcccgtgtgtgggtggatcggccacattttgtttatccagccatccatgggcactccggtggccccctcatgggctactgtgaatagtgctgccgtgaacgtgggtgttccagactctgttttccgttctcttgactatatgcccataagtagaattgcgggacacagggtaattctttctttaattttttgaggagtttccacgctgtttcccacagtggctgtgccattttgccccccaccaacagtgtacagggattctagtctctccaaattgtcaccaactcttgtcttttttttcttttttacggtagccaccccgaagagtactttgtttggattaattttcacctggatggaagccgcagtgtggctggcagctgctgtgctgaacagggcagggttgggcctgtgcacagaggatctgcctaccgtgccctgtctctgaacttgggtgctatgggggcctcgaaccacaaccccaagtggccctctaaggcctggccagtggcttgtcacactcctcttgtaagtcccagctggtcacagggctccccgtggctggagcgaaagcaaaagcatggaaggacagacgtggcagcagccggctgggactgggctcccagtgaggtgtttgtctggagctgtagagcaggtggggctgggcaacggcacatccagagcccggggtctgggggccagccctgggcaatgagctgcccactgaactggatgcagagaatggtggcacagcctgtgccctgggaaaggccgtcgagccctgggaggaggagctggtgggggccctgatggtggggacccagggaatgcaggctctgaggaggaggtgaggtggtggcaggctgagtgcaggcacagctccaccctggcagccctgcactgcctcagtttccctcatcatttggggtgacttctgcctgcagagctccctttgggatctctttgtggcagagcctgggctgggatatggggtccaggggtggcacaggcagttcagcctcatcgatcacccctgtgctcccctccccagtctcccttgtagctggtgtggagctgcatggccagttttgcctagtggcctgtgtgaaaggaagtgacctgggtcacctgtggaccaaggctggtaagagcttggagtcccctccatctctgtctcccctgccacggaaaccttggaagccatgtgtcccagtaggtacagctgcaacataggctcgggccctcccgacccaccccgcgccatggtgtgagtaaggaaacacggtgtgcggtgtattgtgttcagctgctgagatggggtggattctcggcatagccatcctcctctgtctggtgcccctggctgccgttcatacgggggccggtgtttatggggcgtctattatatgtcaggcaaggggtgcagctgtgagcatgacaggacgtaaccctgctaccttgcattctgggaagggaggcacagacgatactgaagtgaaaaacaaacaggatcatttcaaataatgacaaatgcaatgaaagaaataaaatagttaggagatggagaaggaagaagggtaggggaaggcaggccactttctacagctcaggggctggtgcactggagatatcacgggagcagaggctcacgacaacggaaggatgtgggaagaggtaggatagggatcgcctgttccaggtttgggggagggggcaggcggcgccaaggccctgaggcaggaatggggccggctggaagaatggaggcagcctggcctgtcaagcagggggcacaggtaggggaagtcggggccggcaaggccggccgccgcagtcttccagaggtggaggggagccgcctgtggctccgggagcagtggaaatcactggaggggctgcttcctgtctatgttaaagacaagacgtgatattcccttttctatgggaaagatgaagctgcccttttcatctcagacttgccagaagggaagcggcttggaaatggagcacttcatgaggccacctgggcacagaaaggggctctttggtttaggcaaccacccacctgcccactccagcagcccctgctgggtccagttttcttatcttcctccttacatctagaaaagcatgttttttggtttattgaaatagtccatatttaacacagatgatttattttatttatttatttattgtgagacagagtctcactctgtcgcccaggctggagtacagtggtgtgatcttggctcactgcaacctcttcctcccgagttcaaacgattctcctgcctcagcctcctgagtagctgggattacaggcatgcaccaccacggccgtctaatttttttttttttttttttttgtatttttagtaaagacagtggtttcaccatgttggccaggctggtcttgaactcctgacctcaggtgaccacccaccttggccttccaaagtgctgggattacaggcgtgagccaccgtgccgggacattttttttgctatgtaaaattagcataaattcctgtaggtatgtgaatgtcttctcccagcagttaattgtctactacgttgttttaatgattgcataacatcgcaccatatgactgtcacacactttttacctaacttattatttatatgacatattcacatagcaaaacttatttctccattagaggtcagacatgccactaactgtatcacgttcatagagttgaatctatcgctcgtgcttacttatttccttaagctgagttgctgaaagcgaagtctctggccaacagatatgcccattttttaagctttctacactggaatgttctctgttatggtttcatctattcccgcttcattgagcaaatgactgtctccccacctcctcacaccactgagtccttttgagcagtggtaatttaattacaacggagataagtttttttgttgtaagttgttatttccttgatgttaatgagcctgcatttaaaaatatacgtgtatttgtaaacagagattattttatttttttgcttggcctattcatgcccttgattctgctgggatttgggggtgttttattcatctgaagagtctgtgtacttaagtagataaactttttgtctgtcacatgtgtgggaaatatttcccccagtcctgttgttgaccttttgttttattccgcctgggatagtttttgatgtcctacatttttgtgtgtgtgaccacagggaaagatcctgcagtctttcccttcccaggggaaaagcttctcccttgggtgatgtgtttgatgcctcctgccctccccagaagttaatcttctgagtttctgccctacttggcagctgtacttcccaagctccagttcctcaccaaccgctgactgttcttgggtttagccatagcagccctccacctgaatttctcccaaagtaagaggaaagataggcttagtgcagtggctcacacctgtaatcctaggactttgggaggccaaggcgggcggatcacttgaggtcaagagttcgagacgagcctggccaacatgacaaaacctcatctctactaaaaatacaaaaataagccgagtgtggtggcacgtgcctgtaatcccagctactcgggaggctgaggcaggagaatggcttgaacctgggaggcggaggttgcggtgagctgaggtgacgccactgcactccagtctgggcgacagagtgagattctctctcaaaaaaaaaaaaaaaaaaaaaaggaaagaaaggtgtggcggggagatagagaattcaaaggagccaatgtattacatgcaatgcattcttatttcccctcaatatctggctgctgcaaaactcgtcaggatattaccagtggggaacactggcctaaaggcagagccagtagtaactcccaggccccaacgcacaatgaaaatgtgggatcgcttgttcaaagagcagaggaaggtgccatacaaagggactattaagccacttcctttcttccttagtctctgtctctctgtctctcaactcgctgttctttttatttgctttttaatattgttctaagtgaacaaaaattggaaccttgaattattagcatgaatttcttattcatctttaaattgtgcgatggctattttaaatgcaaatattagagcatttagcttctatgtggggtcactgaaattaaacaaatgtgtattttgtggctgatccctgatgggtgcctcaggctgaccagaagtttatgacaggcacagccagactcagggaggctgggaggaagaagagaggatttcacagagtggaatcctgccgaggggaggctcctcaggtacggggtcctagcagagtgagtgcacccccagcaggaagggcacacccactggggtctgagagcttcctgccacccctggaagaacacattggctgtgccctggccagggcgtctggggaagtagagccaggcacgcccccttcctactggtgcactgctccagcccagagcgtatggccacggccaatcccatctctatgcaggtgtcactcacgggaggctcacctctgccgaaacacgggctctggccagccatccaccagacatgcccctttcctgccagccgtgggcgggatggccaccaccacgcctgccctgagatgccgtggggaatacatgcctgatcctgcccctgctgggggcagctgaaagcctgtcctggggagatgggaccatgctgcattgccccaggagccttcacttacaaaacacacatgcaagggtgagatgacgaagaacttcaagacagagctgcagagggtcaagccccaaggtcggggccttctgaggataggccctggtcatctatgaagtcagcctgtccctagggcgagcccagaaacctgagccctgcgctcagaccccatagcctgagggaacacctgctgccctgcatgtgccccctggatgccacctcagactcccgttctctgtggcctttccccagcctctgcttgggcatgtccacacacctctgaggcccaggcgaagccagccgtgctaagagggcactgggtgtgtgctgagcctgtggcaggcagggggcgggcccttgtccacagaggctctctgcagtgagttttgtttttttttttttttccttgagatagagtcttgctctgtcgcccgggctggagtgcaatggcatgatctcggctcactgcaaccgccacctctcaggttcaagcaattctcctgcctcagcctcccaagtacctgggactactggcacgtgccgccatgcctggctaatttttatatttttagtagagacggggtttcaccatgttggccaggctggtctagaactcttgacctcaggtgatccacccgcctcagcctcccaaagtgctgggatcacaggcatgagccactgctcccggcctacactggagtttgagcacacgcagctgtagccctcctggctgctggcaaccctgggatgagtctggtctcctgaggctcagcggcccttagcctggtcagagatgctgaggccccttggggatgcccacattcccccgtctaagggcagaggggtctcccttccaagcactgtgaggctaggaggatggagtgagagccgtgggcagatgtgtggcccatccagctttgctggccccccagccccgtcactggcagagtgacttctattccctctgccttcattctgctcctgctcctcccagctttctactctggctcagcctgcagcctccaccttgcgttgctgcctcccctgggcccagccgggaggataaggggctctcctctgcccaggcccgccccccgcccccgagggcattgggagaccactgtcatgtttgacctttcctgcttgggaaacatactccctgaagtactgggtgctgccaggctgggacacaggtgacattgctgaacatgcctgatactgaccctggggctttggtatttctcacattttcaaaaacttgctctgccagcgcctgggctagtctctgctcacaaaccagatgctgtggccatgtgtgtgggcctgggcacccctaaagagtgggcttgggcctgacaggcgaggctgccatgctaggaggcagctcagatgtgtgtggcacctcaagtttcgtccccaggtacagacagggactcttctgcaggctcaggtaaatgggaggcagggatgaatgccttggaagatcagagccgttgtggaagtaatatgtttatatatgcatttttttcttttttgagacagggtctcactcagtcacccaggctggagcgtagtgctgcaatcatagctcactgcagcctcaaacttcagcctcccaagcagctgggactacaggcacacaccaccatgcctgactcattttttaaagatttgttttagagacaggttcatgctatgctgcatggtggactcaatcacctgggcttaagtgatcctgctgtctcagcttcctgagtagctgggatcacaggcacgagccaccacgcctggctacagatacatttttaaaagtaaaatctatctgtgccaagacttcaagaaatataaagcttgggcccaaggctgaagcttcctttgtggcttcaagcatttcactaaagcgctaatttcaatcctactcttcccgagaagcctaaggcctcaatgtgttgcttaaatatcaggatctacaaagaccttgaactgtctttgtgagcccctggtcccaccgcactccttgtagacaggaggcagaccattgcagtgggtgatacccagcctgcagcaaggccagcgctcaacctattgctaccaggaacacgtactctcaggcctgccagaggccaccagacagatgtaaggcatctccccctgaagtggccccttttttggatggtaagcattttaaaacatcagttttacattaaagtaaatttggacgtattacttgcatgaaagcaaaattcacgtgaatttgtcaaggtaaactggagattctaaagctgtgttggcaaactctggccccagggccacctggcccttcacctgtttttgtaaataaagttttattggaacacagccacgcctattgatttatgaattgcctgtggccatttttgtgctacaacagtgggttgggtagttgcaacagaaaccatatggcccacaaagctgagaacattcactatgaggtgctaaaggaatttttgctaccaggctgtgcagaaatgtacttgcttagtgcctgccttgagctgtgatggccccaggcctccaaagtgagcatgtgcctttcactacatcagtgcacgtgggtgtacgtattagggaagtactgagcacagtgggctgctcagaccccagcccacccccacactagccttatcagctcaaaggaccggtgaggctacttcggggattctttttaaaggatagaatgaactgctcttaaccgctgtagaacggcagagcaggaggagcaggtttccgggcatgcagaatagtctctcccagctgtgttaactgcttatgttctgggagaatgcctgagcccccaaagcatctcttctgctgagggcagacacgctcctaggcctatggagaacgtggaatccaaggatcttctgcgccttcagtcgcggctataacctttgacccctcccagcacgagaacattctctgtacagtatgttctacgaccgttttttttgaatgaatgatttctctctatgccaggattcagatatttttcctcttttcatttctaatttaatccagaaattggcctggacttaccagagccttgccagggtttgcaaacaatccgaaggcatatgggctcaatttctcaccaactttcacgagtgctgagaccgcatggtggcggtggggaaggcagtggtcggacaggagtgttttcagctggtcgtggtggaaatctcgtaaactggccgcagagatgcaaaccagccaggcggaaggcgtcgccccaagtcatagttcacgagtcgctggctctggttcctgggaaagagaagaacatctctgaaactggacacgaaacacgggtcccttaagtggggggaggcaagcggggttcagggtctgctagtggtgctgtggccctgggggtgttgctggcactgtttctgttcctcacgcttgtcccgctggccttacagcctggccctgtgtgccaccaggagacacagccatgagggccagtggtgtgtgcgaggctgcacgcaaggctcagaagagggcagtgccctcacgtgctcacagtagccaggcccgaggggcccaggtggctgaaggctgttgggagtggtggggactcgggcgaccggagaggccacgcccccctgcagagctcctcgtggttccactcgcttgtgtttctgtaggaataagcagaccactgctgccagctcgctcttccatgagaagctggaaatctactttttttgggaaatctaattatttttcaatgtgggccacagattgaaattaagaagccacactgcacaggtgaagcagaacacggctgcaggacaagtctggtgtgtgggtggcctgagtgttctttccagcctagaaggaaggaggcgactgcctgtcctgctgcgccctgtgctggtcagtgccaactcccggggctgttgggagcaccactcgagttgaacaccaggaaagtgctcagtagagcacgggtgtgggaggagcatgctgggattgggagctgtcctcagtcatgttcggcactccctggactcctggcctccgcatccctgcactgggggagctcagagcacaggagtatggggagcgggatcaggacacgtgattacaccttggttcatcagggaagggtgcctggggcggctggtcagggaaggctcctcggacaagggccaccgcagttgcctctaatgaggactcctggtggtggcacagcgcgcgcaaaggcctggccgcatcgtgaatcgcagtgcgcagattgggccctgctggagcttgtggggcttggagagcgggagcgaggttgatttgtggtctacaaagatagactcctctctcttaggaggtttggggcttatgctttctatccttggaaacacccctccccacctgaggaggggaactcacatttgctggttttgcacgtgctggccctgtgcaaggaggcacacctgtgacctcactaccttgccccagtggccctgtgaggttcccttgcctgcatcaggtcactgagactgagagagacatggccagagcacggcagatggagtcacatacctgtgggaaggtggcccctgtgctggtcctcccctactgtctggcctgaagatcgagagctcccaaatcccctagcatgctccgcgggttctcatctcaggcctcactgacctccccacagcatttggagtcccctggccacacccgcctctccccgcaggccatccgctctgcctcttgctttgccttggcttctgcatagatctactgtgtcctcctgttctgaggcccacccgcctgcccactcactcccttagtgcacccggatagagcagccctaggtgctggggatgtcgtggtgagcacgggatccagaccgcagggagcacatgttccagcagggctggggaggccgacagaccagtgatggtgagcaggtggggaacactcgaacaggggtcttgtgggtggatctcacctctgcttcctcctgaaatgtgcagcaccctccccaccagtggacatctccccacctcctccctcctccctcctccgcagacctcctgatagctgatgtggaagcctcccagcatcctgtccttggcctcccgcggggaactgatggttgtcagaatgggagttagagtccctgtggacgaggagggccagccatccacacacccggatgacagcttgaggcagcctcggagcttgtcttgtgcaggctccagcaaggaggtgacagctgaaccacaagaacagaggcgatgatgtgccacgccgggctgtcgggctgacctggcgtgggctctcactccctgaggcccctcccaggctgcccctggagctgagttgcagtcaagcaatcctgggtcttcctccccagtccaggggtctccttggtggtgtgtctcagcagggttagggactcccacaaaggtgactttgtatcggacccagagagggtctgcccacctgatttttcactgagtacctggaaaaggcctggcacgtagtaggtgctcagtaaatctcttttgaatgaataagtgactaaatgaattcccataaagcgactgtgatctcagagactcccataaaaatgaactctatctgtgggtgtggaactcctcgtggctgggtgtccttatgccttcgcttctatgacagaggctgtgtctccatcgtccatgctgacgtctgaatggccaggtcccgggatacagtttctagttgcagcaggtttgccaaattgctcctcagagcctctgtactgactcccatgcccacttatgtgagcctctcaatctctctgtgcctcggcttcctcactggcacagcggggataacactcactcgcagggtgtgggaagggaaagatatcgcacgcggggaagtactcggcgtaggcggagaagatcagagccgaccagcgaggcgagcagttgttcactcggcccatgatgtctgggaagagccccagccagctcccgtcctggacaagcttttttctcatgggggccacctgcttgccttggcacagcgaggacagggccttggcagccaaaggagacggtcagctgtctccacctggtagtggagatagtcacagtggggtgatccttgagctggttttggtcacagagttggtgtctcccaagtggaaagtgggagggcatcattccacacagaggagccccttgtgcaaaagaggtgccagccctcggccaccctgggagcccgctggggtgggagaaggcgcgtgcggctgagcttggccttggtcctgaagcctggggaaacacgggagtactgagcacccaggttgcatcagcaagaatgcagaacagtccctgcctagtggagacggacagacagctaacaaacgaaggcgactggagatcacgatggtgccaggaagttaccaggatgggacagcacccgaggcagcatagggtgccccgtgggaatgttcacagagtgaggaaacttcagagcaagggaaacttccctgcagccagacaggaggaaggaaacctggctgcagcctgcaagacctcccacccgcgcctggcagggagcctggcctgggggctgcccatgctggcccttctgatcctgagcagaagtgatcacggacccttgtgcttccaataattcggcccctcttcctttggttctgggtttcctgtgtagcggtgggcaggatttcatctatctttccatctgccagagtctggcaagggagctaagccacataaacagactctggtggtgcagggggattgtgacctgctgcacagaagggcaaagccgtttcccgccaagcccaagaggcgctggaacatctgctctgggtgttggaaagcaccctgcatgactgcgctttcagggagggatacgctggcagcagacgacccttgccgtgagcttgtaatgcaggacccttcttgcagccttcaccttactcttgccctgcgctctgagtgccttgggggcccctgcccaggtcgaggggcacagtgcaaggtgatggcctgcagccctctgtcatgccttctcagtctctgaggggttcatacctgctctgccagggcctctcccttcttcctcatcatgcatggatgcctggggagtagggaggctggcctgagtcctcctcagctttgctctgaggtggtcgggtctgacgcctgggccacttaggcatgctggacccctgcccagtccaagccctatgccttgatgggtgtccactctacagcctctgccagccagtgccagctacccacgccctggccctcaccagcaggagctgctgcatcccacacacccccttctggagcgaggggcatccatgtgctgcctgaggcccattcattaacatgagatccctctccattctaaccacctgcttggccaccatgtgggttggcctccaccctcagcagagggtctcatctcagtgggaagtggagcccagaaccccggggactatctgcatctcaccctaaggcgggggcagcggtagggatagggctccggctccaagcctggtgtgggctcagcagcccgccccccaccccggcagctgcttgctgccccctcccccacaccgttcctgtcccctgatgccacagctctctcctcccatagcggcattttccttccctctttccttaggtcacactggtgacagagcagcggcagaatatgatgtgtgggggaataaaaatgcattgttctcaaattacatggtggtgctcaaacggacccaggtgaccgagctcagtcacgggatgggccgggccacacagcctctgagacgggcgtgtggggggatgccagggccgggggtggcacgagccctggccacttagggcccctctttgaaaggaaactcctcactgagccccccagggctctgtggccagggacagccgacaagctcagcagagttccagggaggcagggccgtcctgcagccactgctagcaagaatcagaatccctgacttttctcggcctttccctgtcagtggctcgcagtggccgagaggcccctgggggacactgggctctggcctgaggcctcggccgtgtccttctgcgtcctgcagcctcagcagcactggtccttccccgttctgcagcatttccctttctgatgaggcatccggtcagcgggtgggaaggtcagtccctaagtggtggcatggctgttgtttccccaaaggcgacgcagccagcggggagagctccagggctgggtcacactcgcggacgtgcctgggcacagcagcccctccagctctggaaaacacaggggcatgtgcaagctgttcactcagacctctcccaatggtgatggccaggaggagagccagggtgggtgtaagggcgaagcccaggtggaccattctgtgcatggggtcccagggaaacagcttgggctgttggaccctcctgtaatttgatgacagtttcattcagcctgtactaggtgctggggatttcacttttgtcacgcatgtccgtgtgaagagaccaccaccaggctttgtgtgagcaataaagcttttgaatcacctaggtgttgtttttacctaaatcagtctggcctggtgtatgacaacataaactcaaggatagagcccaaaaactcgccaaccaagcaaataattatgctgaacccccttgggcactctctaattggatgtcctgggtcctcccaattcttagtcctttaatacctgtttttctccttttattcggacgctgtgtcttccgtttagtttctcaattcataccaaactgcatccaggccatcaccaatcattctatacgacaaatgctccttctaacaaccccataatatcacctgttaccccaaaatcttccttcagcttaatctctcccactctaggtttccatgctgcccctaatcctgctcgaagcagccctgagaagcatcacccattatctctccatatcacccccaaaaattttcaccaccccaacacttcaccactatttcattttgtttttcttattaatataagaagacaggaatgtcaggcctctgagcccaagctaagccatcatatcccctgtgacctgcacatatacatccagatggcctgaaacaactgaagatccacaaaagaagtgaaaatagatagttcctgccttaactgatggcattccaccattgtgatctgttcctgccccaccctagctgatcaatcaattgaatttgtgaacaatacaccctctccgcccttggggtaatgtactttgtgatattgccacccgcccccgccggacccgcccttgtgaatctactttgtatgatacaccctccccacccttgagaagatactttgtaatattctctccccccaacttaagaagatacttagtaatattcttccccacccccatccttaagaagatactttgtaatattgtccccccctaccttaagaagatattttgtaatattcttccgcccttgagaatgtactttgtaaaatccgtccccagcccacaaaaaattgctcctggccgggcgcggtggctcacgcctgtaatcccagcactttgggaggccgaggcgggcagatcatgaagtcaggagatcaagaccatcctggctaacattgtgaaaccctgcctctactaaaaaaaaaaaaaaaaaaaaaaaaaaaaaccaggcgcactggcgggcgcctgtagccccagctactcgggaggctgaggcaagagaatggcatgaacctgggaggtggagctggcagtgagctgagatcatgccactgcactccaacctgggcaacagagagagactccgtctcaaaaaaaaaaaaaaattgctcctaactccaccgtctatcccaaacctataccaacgaatggtagtcccaccaccctttgctgactctctttttggactcagcccacctgcacccaggtgattaaaaagctttattgctcacacaaagcctgtttggtgatctcttcacatggacgcacgtgataattttcattgttgcttcaacctgaaacaaccctgagacacagggactattattatctccattttatagataaagaaactgaggcccagacaggttaagtaactggccccaagtcacgcagcaggattgtggcagagcccatgctggcacccatgaaatctgacctcagagtgggaatatcccccccacactctgctaaccccccaaattcaggagagggggaggggcagcctcttgccgtcgttagtacaaacccgggaaggtttgtaatgcgacctgtcttctcaacgtgcctgctggagtgccacactgaggggtgcagcacatctcttgagaccctgctgggctctgtgcattgatgagctggcctggaagtggaggagccccgtccccaccctgaggcatctgcagaggtatcagcagagtgtggacaggcacaggagacgtcgcctgaggagtgagggggtggccttgggcagagtgttcctgcgctgggtattgaaggaggggactctgaccacctcactttttgatgtatgaactgagcctagtaattctgatcctggccatttccgtttcatggtagtttgatattttgagcaagagtcacgtttcttctagcattccctctgaagcatctgctgaggagccgagggtgaagaagatctgcaatgggaacgttgattctcatgataagcccaggctctggcagccccgtttaggcaccatgcaatgcctaaactcttcctccacggaggccagcagacctctgtcccctgctcctggctgcactctcttctctgcctccatcctggtggtccaagcctggcctccgaaggggcacagagagaacagccttctcctcacttatttcagggggtcccagagaagccacagagcagcaggcccccctcccccaggcctctgacagacttttcaggcctggcttgctcctggacatggttttgccaggtgggccacaggctgcctctggtggcccaaagctcagctgagcgaaggacatgggaactttcctgaaggttggggtggctgctgttccagggcccctgcctgtctcctctgtggctggcgggccagtaggcctccccagtagggagcctgcaccggttcccccctttctgcacccctcccccaccttggcagaggacaaagtcacctctgcccagcagccgcaggccacctcccagggctcaccatcccctgggtggaactctgccaccagtgaggcaaactttacattgccatgcagagccgctccttcctcattgtctattccagaacagaaacttggctgcatctttgcataagcaaaaggcgcattacaatgtgtttccccaaacaagagagcccttggcctctctccgcacagagatggctgcggctttgaacatttccccccaaggtttaaagattccaggatcaatttctcagacagtactcaaggacattgtccctgggcttcccctccccctgcaacctgggaaaggagagctgcttctccccagcacacgcaggccttgggtagggtggatgcggaggaggcccccagggctgctggggggaggggaggggaggcccttagctgggggcctcccccatgagaggggtcacaggcctacgctgggtcatacattttgcccatttcctgttattccatatcttcaaagtgattcactccattcattcagcaaatgtttactgagcacctactatgggctagacactgctgggagcagttgcacggcaagtccaaagttcctgaggtggagacaggctgcctgtgcaaggagcagccgggctagccgctggagcacagggagcagggccagggcagcccgagaagactcagcagggccagaccctcctggcctggaggtcacgccaggaactgcggtctcatgccttggggtaggaagggtttaagcaaggaggtcactgcctctttcctttgagatatattttttaggatgagtcttttttttcaaatgctcctgagatatctaaagaattgaggggctgcacagggagagtgaggattccaggcctgaaccaaagcacaggcagcaggagagggcagccggctctggggaaggctggctgggctgtcaggagcaagggtgccatgtggggaggtatctgaagtgacgcatggagaagccagccagggccagcgtggagagggctccgaatgccaggcgaggggctgggccctgcttccgaaggcactggagagccgttgagggttttagacagtggaaggggaaggtgagatctattccgcttggtgatcgtagtgaagaatggtgtgtgtgggtgggggggtggggaggacacgagggggaccgttggggagccctaccgcctgtctcctgtctggcagagaaagtgggtggggccgggggaggagggggatgtgcaggaggcaggcatgtggaggtcgccttctgtcttcagttgctctttttgccacatcagtcgactctctgctctgcagaaatgttgccgctgtgtccttactgaggacgccagtgttttgtcgggaattacactgattactcccagtggttcccatgcccaggtgggccctgcaggcctctggccagggctgggcaggaaattttggcaattttgcagcctcctgaaaagcaggtagagccctgggatggtagagggggcaggacggggctcactcctcaggcccacggaggacaaggacactgtggagcacccctgcctctcacatgccccacaaaccctgcctgccccccatgtctgttcctgatgtatcatattaacctacggggactgagaggctggacagcagaaggagcccggccccggactgtgggttggactttgccatagcacacgcaggggcaggagaaccacccaggccagtggtcagtggtctctgggccacagtgccccatggggttcctgactgctgggaggggctgctgagacctggcctgggagggggccaagttgagggctccggagcaggatcccaagcccagcagccacccagaggagccaggaggccatcgcaagccccaccacggccttgctcaggcctgcctcccagagagtgggcatgcctggggaactatgtgctgtgctggtgtggaagggaggaagggacagaggtttcctggggagaggatcagggagagcgcaccacagttgaaggctaccagggagggagggctgagggggccttggctgcggcctggcctccttctccctggctacctgctgggagcatttgcaggcatgccctctctagctcctcagcagccagggagccccagttaatctccgaaccatctgaggcttccagaggccagggtcagggcacccagcgcaggaggtgggagctggctgctggcggacagcccacagtggagctccccagccaggggcccacgcctagcagcctgacaccccagggctcagctgcctcgaccccacctccaagcagaatgtgaggctgacggtctatcccagggagttccatgcccagcgacggggcttttggagtggttggtcacctcctgtcccaaatcagggagcaggattagatctgctcaatgttcagaaggacacaagattccttcttgagatgagagctgccaccttcggccccaggggtagggctaggagagtgggaagatcttgcgtcctgaggggcagggcctggccaggagccaggagagggccagccccgcatctcctccctccgccctgtgggagctgccggaatgcccttccagagccccagcctctccctgctcaggcggggcagatgacccctattccaatccacatcatccctcacatccgtcccttctctgcactcatccccaaagctgaaccccacattcccacatcttgaccccttccatctactttccgtaaggcacctggagtaagcttcttaaatgccccgccatcatccttcctccatgtcctcccactgctcttagagaggatttggaatccttctcctgacttcgtggtctggcctcagtgctcccctcccacctcctctgctggggcatcccttccacatcccctctgtgcttggaaggtgcctcgctgcttccaaccctgggaggtttgcatgggctgcctcctctgccaggagcgccatccctgctttgctgagctaccctgttctgtttctcaggtctcatgacatgccacgtccttccaggccccagtgggcagattcccactaatatatcctctggttccctgcctttccctcgaggccggtgatcctggagctggtctcgtagcatctgagtgtccctctccgcctcctggcaggagggctggctctgatctactcagagccacaattcatggtgaggcagtggttctgctgggtctgctgggtgccagcctcagcccagtggggaaggagagaccaggtcaggctcgcccaggccattctgggtcccagggtgtggtgggctgcacaagaggccagggtcagtttagtttgagaagtcccattgagagcctgtgaggggcccgtggctgtgctgagggtctgtgtggacggtgaggtcaacatttacacgcttaggctcaaacgtggggaaaaatgcaactttctttcattcttttttttttttttttttttttagacagagtcttgctctgtctcccaggctggagtgcaatgacgcgatctcggctcactgcaacctccgcctcctgggttcaagtgattctcctgcctcagcctcctgagcagctgggattacaagcgctcgccaccatgcctggctaattttgtatttttagtagagagagggtttcaccgtgttggccaggctggtcttgaacttctgacttcaggtgatccaccgccttggcctcccaaagtgctgggattgcaggcgtgagccactgcgcctggccagggctttctttcgttcctatatctggtgctgccctcatctcgggcactcagccccaggatagaaggaaggctgcagtctggcctgtgggaggtggctcagtctcttccccataaagcctttgtctcattccgcttgggctggtataacaaaatgccatagacccaggggtttaaatcacaggaattcatttcccacagttctgaagactgggaatttcaagatcatgttgccagctgggtcattccccagtgaggattctcttcctggtttgcagacagccgccttcttgctgggtcctcccacggcagagagagaggatgcaggctctctggtgtctgttcctataggacactaaccctatcatgagggtcccacccccatgaactcatctacccctaattacctcccaaaagccccatttgcaggcagaggcctggtggggggcagtagggatgagtcccctctgcagtagccttgcaagcaggcctgccctcctctcctgtaggccagtgcccccctgggcttgccctgaagcctggtggtgccccctagagccaggtaaacctgcaagccagtccccaactatcttgcccatgtgtctctggggtgcaggggaccctggcatctgctacacacagctgggagctgggccaccctctcaggcctgagcaggctgggccaccagttgggccctggaagccactcctactgctaggaacctgtcccctctcaggtcccaggcagcagccaggatcaagctcttttgcatttccttccttctcagatgtcaggactgttctgtatgacctgtgaggttggggttgaggatgaggagaagcctggcccctcatccctggcctttctcctctctcctattctgctcccttcagctgcagtgggaccttccctcggtcagactccatgagccaagctggccaagctttgtcgtgatagagaaagcaatactgtggacaattacagaaaccccttctctcttaagaaaaactggcttttaaggctactgtgccagcgtggactaaacaatctagtctgaccctcaaagctgggcaaggacttctgtggtttaggggtgcataccctacccccaggacctcacagggagctgcagggcactatggtttaccagcaatgaaaaaccgtttcattgtttgcacaagcaccattccattgcacctgcatgacggtttcatccccacaacagctttgtgatggggggactgcaatcctcattttacagaggaaacggagggcgatgaccaaatggcaaggcttcctggggacctgggtgccctcctcggagctccatcttgtcagccacaggggcgagatgggtcactgggggtctagaggataaccctcagcgcctacaggggttgctgacccaccctccccagacgcctacagcccggagccacggtgaccagccacgctcccgtgggtctgatgagttgtcccttgcctataggaaagagaggtgggagttgtggggagcccatttacaatcagatgtagatttgctgggcagcagttgccaagaggagctgcgtttgggctggatggtaccctcagcagggtccacatgtcatgaactctgccccacgatcggtgccatctttgttcccagcaccgatgccagcgggcctcgggatccttgtcttgcacgccctgtatgcctgtccacccatccatcatgatgtcattctccttgtgaaccctcgggtttcctgaggtgccttcccactgttttgaggtagcaatcactgttgctcagatgcaggctctacagattggagtgcagggagtgtgtgctggcctgacgtggcagcaggctccgggaagtatgtcttggccatgtccggagctgtcagcagcccctgggctcggtctgcacacagccagtccctgtttctccacttcttgatggtgccaatggcttcagcctttcagcgggtatccctgagtgcctgccaggtgctgcttagcctggctctgggcgtgcaagcagggaggatgcaggtggctgcccagcccacaggggcacacagagggctccagaaataacacaccttgtgcttgatgaggggcggctcaggcctgcggggggccttccagggggaagtgactgctgagctggcctcgaggaggagtggggtttggttaaccaacaaaggaggtgacaggaagggggctgcgctagggagggccctgggtgtgtgcggtgggaagctggagggtgggggctcagtgcgaaggaagcccctgacagcctcgagcccgggataacctgacctatgtttctggagggtcttgctggctgtgttctgtagaaggggagttcacccccctgtttttgtgccacgggtccctttgatatctgctgaagcccattggcacctgctcagaataatggttttaaatgtgaagaatgaaacacgtgtaagaatatgattgtgataaatacagagacggcgactgcaggagctccagccatcaaaacagaacagggagagcacattggggatgcagtaatatgagctttttattaacacgttaaaacattatacctggtggtgggcctagaaccgcccccatttccaagtagcgatgcaggtaggtaatccccacacccaccagctatagcttggagtgacttctgccagggccggtcccagccctgcctgtgccgcgggggtccatcacccacgttcactgttgaagggaaggttgtgtttcagctggaggctacagcaagcgtagggctgctttccctgcccacgttccatgttcaggccccaggtgaggaaaccctgggctggtgggtggggttgctcaggaaggggctacagtgatcccagcaggtggtggtggcagcctggagaggcagagggcagggggcaatgagggaggggtcacaaggtggctcctagttgatggtgacgcctgggtggaaagcatgggaagaagaaggagcaggtgggggtcatcccattggcagagccagagccagtcctagggcctgtggttcccgctgatgcctccctgtttctttcaggtcaatgaaatctaccatgacgagtccttgggtgcccacatcaacgtggtcctggtgcggatcatcctcctgagctatggaaaggtgagtgcactgtggccagccgggcctgcctccaccccctcggagtgaggggcctgggagtgaggcatgggcctccttggagagtgtgtgcgtttgccagaaccaccctgcctctccctggctcccctgaggttcctataagaaacaagatccctgctccctttcaccccttgttttaaaatgtggccattactattgttcactgaaaagagtctgttactcccagatcccaagaggaagagacataccaggccacgggggccacacagggaggcaccaggggtggtcaggaggcagagggaattgggtaaacagcagcctgagtccatgttgtttctgcaggaaggaccgatggggacagggtgagctggcttaaggttggccagtttgaataattccagtgggctctggggagtggagcggtcctgagttagttttctgggtaatgagggcagggggatagtggctcagagtgtgaagtctgataaaggaggtggctggggacatgggcgctggattggttggtttgtatctgaaaaatgtgctcatggatgagttgtttcctgtctctaaagattggttaccacttagcggggcagtccctccagagtcagcaaggctcggatgtcaaagcatcagaaacacgtggttaacacgaccctcccttggacttctgcccccgtattaaatctgtggcctcctctcctctggcctcggctgctgtcccagctgggctctcttgcccgtcccacttcctcttgcagccaaacctgggacgtcctttcctggcggtgtgcatgggtgtgtagccgccagggacagtgacctgggatggcaacacgggatgctgtgcagacagaggaagagaggagccccacggtacggcccgtgtagactgcaaagtgcctgtaccagccgtgtgggaagcactttgtatggatgaatgcccttaatctacagggcagatggaggggtgcacactgtgactctgcccatttcacagataagaacaccgaggcttaatgtgacttagtgacatgcccaggtaagcagccagggccatccagcacccgaggagtcaggcttcttacccagacagcagaattcgagcctgtggtctggctgtgcatagaaaatcaaatcataataggatcaaatacatcagataattatataaaagttgaactctgttcaaagagaatctcagtctcaaaaaataaaatcaaactgcatacaacttataaggcacacgatgtaaaaatgatgacgaaggactccggtggcagaagggatcccaggaatactaagtagatttggggccacttccctacacccaccaagcacctcattccacagtgaccgaaggcacccacagggcggatgccagttgcaggccttcgtgtaccccaagagaacacaaaacatcccaaaacaaatccttggaacaaaggggaaattggcaaaaacctaactatgagagtctctaatacacttttaaaagcctttcacagattagatgctaataaggcatagaatttttgaatgacacaatgagtaaagctaaattagtagttatatcactgtttcccttgccctacagaaaaaaagaaagatgaaccttcttttcgaggaatcatagaacacttaaaaattacagaagtgttttgggtcataaagaaaatattgtgaattttatacagctaaaacgattttgtccatgttcgctgatgaaatgcctaaaagtaggggtgggggcagcagaatttataaacctaaaaaaatccaattcatttgaaaacattaaaaaaaaaaaaaacctactaggggccaggcatggtcgctcacacctgtaatcctagcactttgggaggccaaggtgggtagatcacttgaggtcaggagtttgagaccagcctagctaacgtggtgaaaccctgtctctaccaaaaaaatacaaaaattagccgggtgtggtggcatgtgcctgtagtcccaactacttgggaggctgaggtgggcgaattgcttgaacccgggaggcagaggttgcagtgagctgagatcacaccactgcgctccagcctgggtaacagagcaaggaaagagaatattaggactgcagtacagactatttggaacactaataaaaacaagagcactactgtcaaatcttttggaatgtggttaaagctgtattcagaggcaaattcacagatgttttccaaaagcttcttccttgggtgatatgttcgacacacattagccctgccttcaactcagtacatttgaatgaatttcaacagcaacaaaaccaaaaacttaaggaaagcaaaaataaggaaatagttcagaaaaagcagaaatcaataaattagaaaatggaagaaacacatagaatcaatgaagaagagagctttggaaaaagcaaccctctgacctatttaatctagaaaaaaagagagaaggcacaaactaaaagatcagaaagagtatatgtaatgtgactacaaaaagatacttctcctggcagaaaggaaagcatgcagggccatctgcccactaggaagctgttgggaggctctctgcagccggccacttcggaggtccagggatgatcagtggaggagggatgtgcagggcatcctctgccagtgaatgctggctaggagggcagagagaggctcgctgagccctctatcccaggtttgtggcagggggctttggacagatgcagagcctgggggtgggccccagcccagcaatccggttccagctctccattcacaggcggggaggtggggggggatctttggactatcccatgtggctggctgcctgcctccagtggagttccctgttccggccttccccaagccgggtctttccagcctgtcccttcctggccaggatcctctggtgttttaggaattctcaagcctttggcatgagagatggacagagttatatcctcttttggaagtttccaaaaatgggaaactcctggtcctggggctagaaaggggagaaaagattatcccattgattggtctgggtgccaggtggcggcttgcattttcccccaggttgctcctacattgtttaaaaagaagaattttgtaattgactagggttaattgcttaccagtgctggcaaagctttggatcttatttggcctgaaaagtgtctgctctttcccagtcttgagtacttgatggaataaagcctcctttattaattactccttagcaggctctatgctaaattatcccgaccctaagccttttctttttctttttctttttttttccttaactgcctcaggtaggtagaaggagtatgtgatcacagtcagaacatttgcagaagagagtcaaaccctgaaggtgagaatttgaggatctctatgccagggacacggagatcctggggaaattgaggatttcctgggatgtgaatatttcaaagctgactccaaaaaatggagaatatgccataagtcccataaccatggagggaactcaagttcttcaccttttccaaagttttgccagtgcattcatactcatttgcaagcatttatcaggcaagactaatacaataccctgtaaactcatgtattctgaaatctacccaatgtgtctttcgtagtcaatgggacccttatacccaaagatgccaaaggtagcccgtcaggacaaagtacagacctgtctcacttctaaaaatagaagtaaaaatcccaaggcattaagagtttaattgaataatgtataaagagaaacttctaccgtgatcatctagggcttatcctaggaatgtggagattgtttaatatcaggaaatctattcatacagttcatcacatcagtttccaaatgacaaaactcatcctctaacaaatactgtttgaagggcttctgtgtgggaagtgctgtgctgggaatattcactggcatagtctctgtcctcaggggaccgcttccagaaggcagatctagacaaggaaacaattgtaccagggctcagggctggatggaggagacgcgggtcaggcagtctttccttacaaggtcaggaaaagcaacgggaggaagtgaccgttccacccacacctgaagatggtccagtgaagtcaccagcatagagatgctctgagttcataggctgggaggggagggagggcagctgaacccagagggacgagcacagggacaggaacagcagacccaatgccaaagacgtcggaaggagccgatcgcaaggagcagagcagacctgcgtctcccgccaaggggtttggcttgcccatgagggcagctttaagcagtgacacgatcccatgtgcatttctaagaagatcactggctcctgtgtgcagaaggggcaggtgggagcagtggcttaggagacagtcactgccatcaaatgggggatgctggcagctggactgggaccaggcctgggtccagggatacagacaggaggacagaggaggccacttcgagaggatgtggcactaggtgggtgaaggcggagagactctcagctgggtagatgatggtatcaacccctgagattggggagcacaggagggaagctgaagaggtcagctgagatgtgcagttagaggtacctggtgccatcccagcggaggaggccaagaagatgtggatgtgggtctggagccctgcggggtctggagctgggggtagcagaagcaactgcaggcatgaggagcttgctgcctagggggagcctgggagagaggcctcagggctccagtgttgaagcctctggcagggcaagggcgtgacggccccgtagcccctcacagggcactcctccttttccagatccccagaaaactagtaacagagggcaacaggacaaccaagattgtatttaaaggcggaaaaagaagcacatttccctaaaagtgttctgcacagcgaattcttaggatatgagtagatgttacagaggactatagaggggtcccaaggtcaaagaagtctggaaaatgctggtcaaacaaaggaaaatgggcattcctgggggtgaaatttcccggagactttcctgtggagctgtgcatggtgtacctccgagagtccgagcagtacaggtggtctctgaaaactttctccacggaagcttcttgctcagcagatccgcagcctgctgaacctgctctggggagcactgccctggagatagtcttggaaacaaacaaacaaaaaagacccataaactagttactgtggttctgaaaatcctagatacttgtatgtgacatgaaactagtattggaaaagagcagagacaaattctcattgtttgctgttaatcatgtgtcgggaaaacctaaaagaatccacggtacaacttgtagagttaggagaggagtctggtgatgtggccaaatatcagaccattgtttaaaaaatcagtagcttctgtgtgaaccaaaaacaacagccttggtagtggggaaaacagggagagaaaatttccattatggtagtaaccaaaaatgtagaatacctggaatagtcctgacaagacaatggacccattggaaggaaattgtacctgattaatgataggaagaaagtgatcacaaatgaagacacaaatgctgtcctcatgggaagctgggtataatcgagaggttggcctttcccagattcatagttggaaatgttatgaagtgattctaagcaccatctaggaacacgaacggtcaagaatggctgagacagctgcggaacccaagcaaggaagagacatcctccaaaggaacatgaacggtcaagcatggctgagacagctgcggaacccaagcaaggaagagacttcctccaaagcaacatggacggtcaagaatggctgagacagctgcggaacccaagcaaggaagagacttcctccaaaggaacatgaacagtcaagaatggctgagacagctgcggaacccaagcaaggaagagacttcctccaaaggaacatgaacggtcaagaatggctgagacagctgcggaacccaagcaaggaagagacttcctccaaaggaacatgaacggtcaagaatggctgagacagctgcggagcccaagcaaggaagagacttcctccaaaggaacatgaatggtcaagaatggctgagacagctgcggaacccaagcaaggaagagacttcctccaaaggaacatgaacggtcaagaatggccgagacagctgtgggacccaagcaagtaagagacttcctccaaacatcttgtaaagtgaagataattaaaatagtgccatatgtgcataaactttcatagacagttcagttgaataaaatagttgaaaatacccctcttacaaataacctaccgtgataaacacagaatgcttattgtgttataaataaatatataacataaatttaataaataggaaattaaattatcatatgacaaatataagccaatacaacattcaactatttaaatcacacaaatcaagaagaaaatattggttgtcaagagctttctaagcataaatccaattgaaggaattgtaaaggggaatatggatatatttggataagtataataccaaacttctgtcaaaaaacacaatgaaaaggcaaatgacaagcaggaaaaacatttgcaatgtgataaatatatcttaatatataaaacctcctctaaatcataaggaaacaaaattgtcaatggaaggaaacaaagaaaaaaatccaagtggctaagagaaagcccatatggaaaaatatctaactctactgttaaagaaataaataatacaccatttataaagcatcaaccctgttaagatgaagagggatttatggctgggtgaatgaagcaggcacactttgagtatgagtacagatattctaaggaaatgtagcaatatttatcactgcccttaaaaatgttctttttttctttctttttttttttttttttgagatggagtcttgctctgttgcccaggctggagtgcagtggcgcgacctcagctcactgcaacctctgccacctgggttcaagtgattctcctgcctcagcctcccaagtagctgggattacaggcacctgccaccacacccagctaattttttgtatttttagtagagatggggtttcaccaggttggccaggctggtcttgaactcctgacctcaggtgatccgcctcggcctcccaaagtgctggggttatggggcgcgagccaccgcatttggcctttaaaatgttcttgatgtttgcccccagacattcatttctgtgaccccagacattcatttctacaactctgttccaaagcagtgatcccagctgtgggccaagttttaggaacaagacaagggtcatggcattatctctcatgtgaacaacagcaaacaacctatattgtccaataatagtggtctagttaagtaatgataaacctatgtggtagagtattaggctgccacaaaattgcattttcgaaacatgtttaatggcattgggaaatggttacagtctaaagctgtttgttgtttgaaaagcaggatctcagttttccgtatgatctcaatttggtgtacaaatatatttaccaaaaagactggaaggaacacatcaaatgtgaacaggatttctctgtgggcagtaggctaattaattttcattttcttctttgtactttactgaattttttaaattcaatatgatgagcatggtttttattattattattattattattattattattattaagagatggggtctagctctgttgcccagactagagtggagtggtgtgatcataactcactgcagcctccatctcttgggctcaagggatcctctcatctcggcctcccaagtagcttggactacaggcacgcaccaccacactcgactaatttttttttctttttttttttgtagagacagggtctcactctgttgcccaggctggtcttgaactcccaggctcaaatgattctcctgcctctgcctcccatagcactgggattacaggtgtgagcagctgagcctggaccagcatgtttcttttataaacaaaacactgcattttaaatttgtgaaatttaaattttttaaatgattttttaaaaaatcatttaaaaatggtaggatccaaatgatgccgtttgactgaattcagcactctggagaaaggtctccggtggcatgccacagggctctgtcacgctcagtcctttatttctgatttcaatgaagacatcaaagagaattcatgctttcccttggcacgtcatctctgcagtgggctggggaggagtaatgaggtttctgtgttccaccctatgggcgctagctcacgcttcctgtggctggggcagggggtccacctgcagcgggtccacctgaaggaaatgggaaatcttggagtgaggacgcaggctgccataggtacgtggtctcccctgcatgagaagcccacgcccctgggttagcaggcaccaccctcctggccagggcctccttggcccctgcccctcatgcgccttgcctgcagaagttctgctttgctgggacccccacccctcatgcacctgcagaagctctgcttcactggggccatgctggggccccacttccacttttggcagagttgggaatggggcagtgggcaggggaccggttgtcaggtgcagcctgctcttcccagggacaacatggggacatgtgcaggccctgggggtgctgagatccatagccagcaaaccagggcagctcatgcctgtggtgggcaccgggcaacttctgcgacccaggtacaaagagaacagagaggacataggtgaactgaggctggccttgcttccgcctcctgctgggaaggggcttgagaactgatggtggtgagggattggaagacagaaccggaagctggacgcacgcttccagagctaactccagatggaaccagcttacccccggccccgagggctcagtggacccgcagctgaggaggcaggggagaggcagtgctgggttgtgaggggtgtgggacccaggacaccccagtgcctgttcccaggcccctcagcctagcttggaggacaacacacagccggtccctctgtcagaccccgggaattcagggatgattggcctcctggaatgttctggaacattccagcattctgggcctttttttctgctcctaactcatgcctgcccagagtggggctcagcaaagctcaccccatactctgcccacctttttctgcctggccctaccccgccttcctcctagaagcctcccagatcaagcacaggaggcagtgatgggggtaggggacgccagtgcccatggggtccgctccatcccggggatctcctgagttgatcagctgagtgtagactgccagaagagccgggcctgcccgctgctgtgcccttctctggggggttctgggctgtgagaggggaagtgagccgaggctatgagtcctcgttgctttaggttggacctactgcaaaagtgcaggaaatagtagagcagaggaggtggcactgctaggggctgggctgaaggcttggggtagagggcacagcggctaggaaaatgggttctggtcatgggccctggctgacttagcgaatgtgctgtgggccacagggcttgggagcagcgtctgtgggaccggaggagccatctgccatccccaggtggccaggggagaggccatcctgggagcagcagtacacagtgcacctcaatgccaaagacctggctgttttctttttcctatttcaaacccatcacagaccaatacttccgtaccatacgttataaatgaattactgggaaaagcaaatgtgacaaaaaccgaggtatccaaaaactctaggtctggatttttattattaaattctgtggacataaactcaacccgtccaattgctataaaagtttctagtttctgtacttatctcactgtggactggaacagtttgtgtccaccaggcacagacttcactttgcatagcactgggggaggccctgttttcaggtctctgaggtgtctgatgaacgtgggaggagatgtatccttgtgcccccaaagcatccggccagcccagagcctctggcttcccgagcagctgctgtttaatcccagggaggtgcatgaacgaggaggggagaggagccctgtgtccaggcagtagcagcagacaagacagcgacagagtggtgagcaccggcaaggaatacagcagggtggcaggcaataggggaccatggatggagcagccaggatggggacttcccagccaagatctgggggcaaaaggcctagctcctgtgtccaagggaacagaccccttttgctcacagagaagcacagccagggattctcgatggggctctggggacaaagtttggcacatggtggggatgaattctgatgagctgctcttcaaggaaccacaggcttcccgtcaaggaatgaggcccccgtctctagaagaattttagcatggcaaaaccaaggcgatggcagtcaggagggggctgagctgtcccccccacggtggggacagactctgggggatgtgagaccatgacccagacttgggcagaaagtggcccagatactcggttcctgttattcatcccaaattgtgacagaaatagaccagctccccacctgccgctcccccattgcctgtcccccaggcctcaccaggctccagtggggataaaattggtagcacttgtttgagtgacatgtttgtcttctagcttatgagaagcctctgagttatctcaagtttttcctaaaacaacatttttctccatttcttaaaaaaaagcagaagaaaagagatgatcttattttatacaatataccaccagccagggagcagagcatcggcaacacttgaggttgcatagcaactggcttttcaattgattttttgagaaggtaccaaagctactcaactgttctcattttaaatatttcctaggatgatgaaaatcaaagcaaatggaaatcagagacttggggagcatcagagaaggacataaagtgtcttgttataaaaaaccaggtcaagacaaagtgtggaatgcttgctggaatttttcagcattggaggtgaaaggtctgagaaattctgcatgtgagtctcttagtggaaagcacgagaagagaggtgctgggggtgggggcttggtgtgcccacccacccacctatagggtagaggatttagagtggcccagccatggtgcaggaaggccaggaagtgaaggtctggggaggatatatcaagggccctggggatctgggacaggggatgaggtgggaaacacaccccatgcctcaccccagggacagccccctgtcctcctgagcatctgggtcccaacccccaacctgataggggtgcaaggcatgatggcccacccacatcatcctccatccacctcctcacccagacctacctgggtccagagaactaggaggcactaaggctggacactgcccttgggaggtgccttagtctgtttgggctgcaataacagaaataccttagactgagtaatttataaccaatggaattgtgttactcactgttctgggggctgggaagtccaagagcaggacgccagcagaactgatgtgtcgtaaggacccattcctcctagagggcaccttctagctgtgccctcgcatgatggaagggtgaacaggctccctcaggcttcttttgtaagggtgctaatctcatttatggagactccaccctcatgacctaatgacctctcaaagaccacacttcctaataccataacattggttctcagctttcaacctttcaaatgtgggggacacaacattcagattctagcaggaggcccctcttctgcctccccacaggcctgcactggctcatgcctgggaaggctcaagttgagaatcctgttctggcagcttggctctctctgggaatagcttcccaggctttggggaagatggctggaaacaaaatgctggaacgatatgggagttctggcagagaaatgaggtgcacgcctcctgccccagctctcgtggttctctgtcgtgatgagatttgatctgtaagccctgcctggaacaagagacctccagccttgggggagcccactttgcactcagctggggggcacggtagaacatgtgctcacagagcagggatggtgggaccttgtccctgccattcattctggctttgtccatactcgtgggacctttggtgagcaatttaacatcatggggccttagtttcccccataagaggaggtctgtgaaaccccagcacacaacaggaatgacgacaatcataaaggcgttcgtgcaagtgactgtttgtagagcttcttctgggacaggcaccgtctgaagccctttatgtgactttatgccctcacccccatagcaaccctgtggagtagacgctgtgatcatccccatttgacagtgaggaccctggctccagggggcgagcggcctgcccggggccacacgctggtggagccactctgctctgggaggaggggctggactctgtgatcccggctggtcaggagcaccagcttcaggctccttgtcctggtcccctgagggtcagttgctcccaaccaagagtgactttgccacccctccccccacccgggggacatttggcagtgtctggagagacttttggttgtcacgactagggggagggttccactgggttctggcaaggagtgcccaggggtgtgctcaacatcctgccatgaacagggtgcccgcctcacccaacaggaattatctggccccaaatatctggagtgctgaggttgagaaatgtggtctgctcaccagaacccaacctccctgctgtcctatcctgcacctgtttaggaggctggtctgaggcaggagggcccctctgggatggggacggttgagaagctttgctgaagccgcatccccttgggggcatgagccagccccagcgggtaggccagtccccagggactggtgttatactccatcagtatcaacagcacggcagagacaaggacaagggacatttgtgggcgctgactgcaccctgcctgaactgtcatgggcggaagccccccagctccaagctcggagctgcagttgtgcccattttgcaggtggggacaagtaaggtaacttgcccaagaacagagcagatgagatatttcggccgggcctagagctgcccaggtgacctcacctgccacctgcagtggacttggtgagcctcggtcgcgtggcggcctgcggggctggctgagtgcgccttgcccagcaggcagagcctcctggcggggcgggcgcggttccagcggaggcggcctccaggctgctgatccccatcccggtttcctcccacgtctccttgactgaaggagggaagagcatagataattcagctccttccagagcaaacaatggaaatgtcggagagcaacgattggaacagaactttttgctcaggtcataattgatgtatttagggtgaggcccagaggctgtcttggggccgctggggccccgggagcccgggtgcggccgcggagtctgggcgccgggtgcgtccccggcccgggccgctgttctcgcggcagcagcgccacctggtggccgctcgggcccggcccttcctctgcccgccccgcgcggggggcagcaccccgacctctttccggctgtgggactcaggcgagtcctttcagttgtctgagacgcagttcgtcatccggaaggtaggaaaatgaagtggaagcgaggtgtcgtgtgccaagcctgagcctagcggggcgctccttgcggacggtgacttcctgctggggtcagcatctgccggggcggccctttgggctcacttccccaggcctcccgagaacgtccccgcagccggcgcctccctccctgcccagcctggctcctgagggtgctcgtgttcattccttcatcactgagcgcccagcagccggggtcctctggccgcgttcgctgcctcatcctggcatggagagcagaagccgggattgctccgtgaagggaggagtggggctactgagggcaggcgtgggccagggctggggcacagactcgggcccagcaaccacccggccctcaaggagcttaggctttagtgactcagaggccagcgacagcaacaggcacatccccagtaggtgccccatctggcaggtgaccgatcgcacgcaggaggagggacccggcgggcagctcagagccagggtcccgcggccaggatggggctgggacttggagctggacgcagcctactcgtccacccaaggcccacgggccccctaagctcctggctgttccctgaggcccgtggggttacccagacccctgcaggctgggcctgaggttcaggggcccgcagtgtttcctcacccttgccctggccaagcctcctgacagccctggggagcattcagcaaagtgaccttctgacccaaggtgagggccatcaagctcttgcctccctaaggccctcagatctgccctctccacctcatggtgggatccctgggtctttcaggcatgtcctcagaccctttccagcccgggccaggggagccaaacaggctgaacccggaggaaacaccatccttcttgggaccaggctcccggtgctgctgtgggagggccccaggggcctggacgagtgtctgcctcctgcatctgggcagctctgtgaaccagcatagcaaggagggtctccatgtggacataggtgggcactcatgatggccaaggaggaccctgcactctggaagagccagcctggtccagggccccagagcactcgggcagtggagcccagttgggagcccatgtctgcagtggtcgatgtcacctccaaacaggggtggcagagccctccatgaggggtgacgactgtcctggggcccctgtagaggatccgatcagcctcttggaagctcatctgttcccgtgctctgagctagggtcagcccactcaggactcctcctgcatcctgggctggatgggcccctggacttcatccacagccctactgcaggcttctcccgcctggctcttctggggccctaggctggacctgggagttctgggagctgctgccgctgtgaagagtctgccctcagaggccctgcctcactcaggaggtggaccctgcagctaccatgcagccccagggcctcgaaatgtccatccccggtcatacagcaccatctaccgccccctgctctggaggctgggtgcccgcggctgcccctgggagggactggctgccctgtaaagtccctggctggtcctgcagccaccccctttgcagagcccagggtgctacggctcactcctggtccccccctcagcacagctaggaacaggtggagtcacacagacagactttcctagaggagccgtgcagagccgagcaggcagctggaagtcaggtgcattcaggactgggagggacgtagatgaccagggcgagctggtgaaagactcctcagtggaaacaagcagtgcagcctccctcacttctggaggagatccatatatgagaaatgtgtcttcttctcgctcaggggaagcacagttcccaggcttgatacatagcaagggcacaggatggtgggggctggggtgccccaggcagcagggacccatctggcctcctgcatgcaggccaggtggcagaggagcaaaggaggtcgcatcccagcaggtggtcccgctggagcccaagtgacccacaggggagttcactgcatgtcaggacagtatccttggctggaggtctcagcggagagacctgagcttggctcttcccttgggttccgactgcctccagtagcgagggccttgccctgtccacggccagcccagacttccctcctgggccgcagacctgtccagctgccccgatgtctctgcctggacatcagtttctttctgtgaggagtccttagaggcatgcagaacccaaggctgcctgtagctctcatggagtgggaggagtgggtggaggaaagggggctctggggtgcatgagcctgagtttgcggatggttgttttgggtgctgccaccaggcaaacccacttcagccagttttcagtcctttcgaacctgtgctccatgggcctaacatgggtcccagctacggcttgggactgatcacccacaagggctgcacccccagaagtgggagagctcccaaagcaaaacagcccagctcttcccaacgagcaagctggccaggaaagacattgccgtgaccatgtttcctgcactgcggaccccacgctcttcctctggcacttgccgtccccttcccgcgccgcctcttctgccttgctaccaatccccaaagccagacactggtgccgtctctgcctcattgctcccgccctgcagccctgatgcctctcagctcctgccaccaggtcctgaccctcctgacgtggcaccagccacacctgcatgcatctcagtgccacactgtccccttctatccccactccttcctcactgacccaaagggctgttttaagaatgcacacagaccttgccctggcctctgggcacaaggtcaatgtctgggcctcatgggtaccccatagcccttgaatgctccagacccagcaaggacaagatctctgcccctgggctcctctgtgcccgtcagagataggctgggaccttggagatgttgggacgttggcagagagagagaggaagcacaagcagctctgtggcttgtcagttaagctcccagtggcaggttgagtcctggggtgcccggacactgaggtaaccctctcctctacttcttggggtaccccctgctgggacccaggctcccagggtctagcacactctcatgtctcctgaagtcctgcctcccagggctcccctggccccagtgcagcttcccctccctgtgcccatgcaccccagccctcccctctgccccctcctcagggagtctcctcagaaccccaaagccagaagggggtcatagacccctttagctctggaccctgcagcacaacctccttggggttggagaacgaaagtggcaggctgccttcttggactgggccgagaacaaagcgaggcaagaacaaaaacacaaatcaatatttcaataaattgtcttgccgcagcagcaagatcactttggctgctaagacgggctgggaacccaggctgaaccacagaagccagcatctgggaggagagaggtgatcggccagagtggatccagtctgcaggacgtggagaaggggctgcccactgcagggctcttattccagggttctggaataaagtggtgacggggaggatgcgttgttttgtctgcataactgatttcaatttgagccagtgtttactattaggtaggtgtctgtagaatccagatttcacgattgacctgagaaatctgatccagcagctctgggcctctgttcctgccagcactgggcggatgttgctcccttcagctgtgcctgggcacctgggtttgccacagtcctcgccactccttatcaccgacccccactctattctaatagggaaatattcctctgtaccctttctccttcaaaactgggaaaacacaagatggacttacttttcgtgcaaccagcctgcctcattgacttgtcacctgccttgctcctgtaggcgcttgggtttctagcatcctcccggtactccccacaagcccacacactaggatagcggacctccctgcacacccccagcctgcctcagcctggctcctcccgcagctctgtcctacacactagcctcattcctgcctctggtcctgatattggggcatgtctttctggctggactcttgactcctcctcaaagacttggccagggcccttctcccactgagaagcatataaactgcccccagaacatatcagctgcccccagatcagacgccatctttcatgggccagcgagtgtcctgactggggtccctgtggtcccccaaaggaggaagcacgtggctcagattctcttcgctgcaagtgacaagagcacaactcagaattggctttcacaaggagaggaacttcttcaggcataaatgacacccgtcagtggcaggcagccttcgtgatggccgccagtgacccagtctcttaatgtccatgccctgcggtaggcgggactgagattctatcaaaagcagactgtggcttctgtaggggaggtgccttctcttgttgtctcttgggtccctcgagcaggggcgaccgtgtggggtaaagctgacatgggtgacggccccaggaggggcccatacggtatggtgtgcaacagctcagctggggcccgccgtgaccacctgaatgagcctgggagctgacccgcctccggtacagccttcagatgagactgcagccccagtcttagctcgacagtggtctcatcctcctttaatccttggtggggggtctcctgtagtgcaggggggctccagccgctgcaggccccccacctcacaccttgcctactccttggcccgctttggttgtatgttcaccctgatccttcatggtggccaggaaggcgtggtgctgggattggccaggcctgcctgcccctgaagcctggggtctgactcagattaaaggaggggaagtttcacgaaagggaaacaagggcaggcagaagtcaccgcaacccaccagggcatcggaagggaccgtcccactacatggggcttaggaccctgagggcaggtgagttcatcttggacaggactcccttgacactgatgctgggagacgtgccctggaggaagcaaggcccctttccctggagcccagcaaggctaccgagctgtgctgggtgtcctggatggagacactcacactgcagcaggggccctgccaccaccctagcaaaagcgcttattagtgacctttgtgctgaccctctgatttggatttggactggcaatttttaaaaaatgtatgttaaaaagtcattcttgtttggtttttgattttgctcttactgttatttttaattggcatgtaataattgtacatatttctggggtagggtgtgatatttagacacgtgtatgcaatgtgtaatgattacatcagggtaattagcatatctgtcacctcaaacattatcatttctttgtgttgggaacattcaaagtccactcttctagctatttgaaaatgcacaatacattcttacggattccaggcgctttccggcactatagggcactaacgcttattcccccatcttgccgcacttttggatatgttaaccagccttggcaatccccagcccgctgccccccactctccaggaactactctctatttctgtgacatcaactgttttagcttccacgtatgagtgagagcgtgcagtatttgtctttctgagcctggcttatttcatttagcataaggtcccccaggctcatccatatctgggctgccaatcttaagttcagcgagtacaaccaaccacaaggcccacgctctagcaccgaatcacatccaccccgagtttcccttccttcttgtgccatcccaagctcaccccctagctggagacagtgagaagggacattctttcgcccgattcctccttcagaactgtgacctctcaaggctacccagaggcggatactacctggcagggactcgagatgagctgcaggggtcaggcttggatgtgatgcagatacccactcccttcctcctgtatcaattatagtaggtgaggttatgctacagaaacaaacacactttgcatcccagtggcttaaaacgaccaagatttcctgctcacgctgtatgttcaatgtgggttggcggaggattcgggtctcatcgtcactcaggtcctaggtgacagagcagccactgtctttatgttgccagatctcgtgccagaaaggagagctctctgaagggtctcaatgggaaattagatgctccaaccgaaaagagacatgccccacttttgctcacagctcattggccagagctagtcacatgctcttcctggtcatgatgggaacaggaagtgcacctccccttgccctcctccagcttcctctggtctgtccacttctatgccaatgtcccacaagtcttagtcacaggacatcacactctgatttatgacttatttcatcgggactcatggaaaccttgttagaatgagttatcttatctcccaggagcaggaaataaagtctttacaattaactctgtgcttgggacttgggaattggtctgccatcttgtcagtcattgactgggacccctgggaacgacttgtcttacctagccttgaattgtgctcccttcttctggaactaactggcttgctaacaataccctttgttgtttgttttgttttgttttgagacggagtctcactctgtcgcctaggctggagtgcagtggcgtgatctcagctcactgcaacctccacctcccgggttcaagcgattctccttcctcagcctcccaggttgctgggattacgccaccaagccagactaagttttgcatttttaatagagacagggtttcaccatgttggccaggctggtctcaaactcctgacctcaggtgatccacctgcctcagcctcccaaagtgctgggattacaggtgtgagccaccgcgcacggccaactttttgttatttatagacacaaagagaaatacgtggctctactttgtggatacatttatgcaagagaaaaaacacctgcatacgtagcttccaaggaatgcacatctctattttatggccagataaatccttaaaggggaaaagaacatgcccaggactcagaggggctctcggttctcttggagggaactacttcggtgtttggagtctatggtgagaacagaaaccaaaatgcctgctgtgaggattgtggaggaaaaaaggaagggtgccgctcacagaagccttgcttttgaaatgatattgtgtatgtcttatttaaggaggaagtttagggcagtgagttgaatctagattttggtttcagccttcttgggatccgatctcaattctcctacttcctagtttcatgacctgggcaagcttcttaacttctctgagtctcagtttcctgtccaagacaggcttcttagtcctgaagtctaaatgggagtgcctgctgatgtcatggtgcagagagagtgtgcaagacgagcggtcccgaggccaccctagctgtcaggtgtgcgtcatgatacaaaatggaatgggatggttcccgggggcttcccatgcatagttcctgtgggaatcatctgtgtatgcccttgttcttgatatggctgtttttctattaggttgatgccaaagtctttgccattacttttcatggcaatactgcgattacttttgcacccaccaaatatgtcagttgctgtttcttttcctccattgtgttggtttctgcaagtaccttcacacggggggaacgtataaggtgatctgcttcctctggccttgcacaccacactggaatttccgcctcccctgccacggaccctcccaaaactgtgagctctttggggtgaggtccacatgacatttgccttctgtggaggccttgcacggaacaggtgcctcatagaacaaacacagggacttctggaaatggggtagacggtgggactatgcgaggccttagatgacgtagagcttggcttctgcatctcacctgaaaactgcggtgactttgtgtggaaactcacgcaggtgagtgtgactggggaaacttttcttccctgtcaaagactggagcccagtgggagcaggtcctgagagtgaccgggcagggcctttgtaccacctggaacagattcccagtggatggggtctgtcaacactacagcctgctcggccccccactgggccaccaggcgccaacctctctcttccatttctctccatccccctgcagtccatgagcctcatcgagatcgggaacccctctcagagcctggagaatgtctgccgctgggcctacctccagcagaagccagacacgggccacgatgaataccacgatcacgccatcttcctcacacggcaggactttgggccttccggcatgcaaggtgagcctcacccatgcagggccacagaggcgtgaagctggaaatgagcccctggccatgcaaggggccccgggagccttggcccagcccagggaagagtgtcagggcagggaaggccgtggccaccttagctgggtgagggtgtggggcagtgcactgatggacaaatacatcattagaagagaatccagtgtcctgaattggacctatgtgtatagggacgctaatgtgtcacaaaagtgacatttcagagaagaggaggaaaacagcctaacaaatggtgtggggccaatttggaaagaaaggaggcctgtcacctccactcactctatagacagagagcatctcacatggattttaggtctaaataagaaacgcaaaataatgaaagaagataacgtaggtggatggctccatgttcttggagtaagagatgttttctttaaaaagagacaaaaggccgggcgcggtggttcacacctgtaatcccagcactttgggagtcggaggcaggtagatcacgaggtcaggagatcgagaccatcttggctaacatggtgaaaccccgtctctaataaaaatacaaaaaaattagcagggcatggtggcgggcgcctgtagtcccagctacccgggaggctgaggcaggagaatggtgtgaacccgggaggcggagtttgcaatgagtcgagatcgcaccactttgctccagcctgggagacagtgcgagactctgtctcaaaaaaaaaagagacaaaaaaaaccaaacaaaccatgaactcaatggaaaaaactgataaatagtagcacatttcaaaagtttgtgcattaaaggcacgctaatccactgggggaaatatttataaaaaaggatttatatctgaagtatgtgaagaacgcctacaaatcataataaggataataaagacaatccagtcagataatgggcaggagactcttatcaggctcttgacaaaatatgaatgagcaataaacatatgaaaaggcactcaacctcactagacattggaaaaatgcaattaaaacaatgaggctgggcatggtggtggatgcctgtagtcccagccactcgggaacctgaggtgggaggattgtttgagcccaggaagtgagctatgatcacaccactgcactccagcctgggtgacagagcgaggccttgtcttacaaaaaaaaaaaaaaaggaaaatttaaaaacacaatgaaatatcaagacgcacctaatagcatagctaggttaaaaagactgaaactaccatgtctgggtgaggagtggatagctcccctcaaacacagcgcagccaggtgttgccctgaccatgtgatgagagtgctgttggctgttttgtcttggggagggcactaatggggagcagagctatcccctaggaggggaaaccgacacagcttttatattaagtgacctgatccctcatttaaaaatgtgaaattggctgggtgtggtggctcactcctgtaatcccagcactttgggaggccaaggcgggcggatcacttgaggtcaggagttcgtgaccagcctggccaacatctctactaaaaacacaaaaattagccagtgtagtggcaggtgcctgtaatcccagctactcaggaggctgaggcaggaaaatcactagaaccccggaggcagaggttgcagtgagccgagattgtgccactgcactccagcctgggcaacagagcaagactctgtctcaaaaaaaaaaaaaaaaaaaagaaaaaatgaaaggacagccaagggttaccagatattttaaaaaaaccaaaacacaagaaatccttacagcatgaaaaagatggaccaagatgtaaaacaaaacaaaaagtttgaaaactggctctaagagaaaatagagataatttagagacaagaaaagcatgtttttaaaagtagtattcccagaatgtttgagaaaatacatccataaaccctaagagttttctatgaaaaattagagaacaacaaaccatttgtataaaattatggataggatgggggaagtaaaaaattcgaaaggtagacggggcgcggtggctcacgcctgtaatcccagcactgtgggaggccgaggcgggcaggtcacgaggtcaggagatggagaccatcctggctaacatggtgaaatcccgtctctagtaaaaatacaaaaattagctgagcatggtggcgggtgcctgtagtcccagctactcaggaggctgaggcagtagaatggactgaacccaggaggcggaggttgcagtgagccgagatcacaccactgcactccagcctggacggcagagtgagactccatctcaaaaaaaaaaaaaaaaaatcgaaagctgaaataaaaagtcaaggccatctcccaatgggagcaaaagacaaaaagattaacatgagagaaaagttaggagacagaccctccatcgaggaggcacactctatctaataagattccggagagagaaaacagccacaaagtaaaataagagggaagaaaacaaagaaaaacataaagatgcgctttcagatctcgcaggctcctgtaatgctgagtaggatgaatggaaagcctcccacggaggcagatgcatctgcaagcctggcatacaaagggcaaagaggagatggcaacgttccactcaggcacacagactccacgctcgtctcaaaatctgcagagcaaaaaatgcagattttcctgtttattacaacgggaaaagacaagggttagatcacgatgcttctatttttaggcgcgtacaccgccagctcacccggggtcccagtggccctccttcccttctctgtggaacgcgtggcctcagggtctctcagtggggcatggcaggagtgagggcaggttggggttctgaaagtcagggctccatgcttggcaggcctctaggaagactcccaggggtacaagcagagacctcgtgtggcacccatagccctgtaggcacttccctatctttccaagccgcctccctctgctgagacaggagctggggaagtgaataggtctcattatccatcttcctcagtttgacgtggggtctctgcgtcatgaacttctgccaccctccccctggccctgggctgtcgtaggccactggcctcatcttctacggcggctctgacctcccagtccgcaccagccagccccctgctgggatattctgcagggtagtgtggcccatcggctgaacagctttgcagccttctgcggcattatggaaacaggtctagctagggtctcaaggaccccagagaaacacggggagacccaagaaacgccccccagaggaggtgggcttggagggtgtgataccaggcagacgaggggcaggatgcctctagcagagagaggtgtggaagcaggtgctgctcaggggccactcagtgaggcaggcagggggcagaggcaggtggcgtgaaagagaacggcaggcaggaaagtcaggtgtcagacaagccatagcaggtgacatctgactaagcagagggccccagctgcagtgtggctgttacaggcagaacggccacggggcttgtgtggtgacgggctgggggcctgctgtcagccagatgtcacaggctatgagctgtctgctgtggtgtcttctgagctgtgccagccgggggcagttgcctgtggtagagagggcattggggccttgaggagaagcagcgcctgggagttaggccaggcctcaccttcccggccaggctatggcagcatctggagccgcctcttgtctcctcccaggctatgctcctgtcaccggcatgtgccatccggtccgcagctgcaccctgaaccatgaggacggcttctcctcagcgtttgtggtggcccatgagactggccacgtgtaagtggcctggggaagggtggggcacagaggggccaccctaggatccccagccctggctgcccacttctcctctgtgccttaagagggacacgccctgtgtcaaagccacttggggtgtggtctcctgtcttcccagcgctgggcagtgctggcccgaggcccacttttgctgaaggaaccaattgaaggaggaagggcttgcctgcagactgagcaggcgctctgggccagctagagctggggaccttgccccattatcacatccaagcccccaggcagggtgggctctaccccatgttatagaggaggctcggaggtttggagggtggctcgccctgggttagaaacctggaggcagggaagccacggtcccccccaggtgtgcatgcccctcctggggacaggatacctgggggactgcccgctggacactgtctccccagagtgcctcggctttcaaattgcagcaggtagatggtcggtgccacccggctcagagtgggccaaggtcaggaggcccgttggggaaagatggggcaccctcctatcatcggggtggggtgggactggcagacccgtgtgccagtgggattcagccagctgcctcggccctcgcaggctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcagtgagtactgcccatgtgccccgtgggcgacccctcagtccctggggtcagctctgggagggtgcaagtccccatgcaccagagccagagccctccgacctcaggtcctctaagcttgtgtgcgggggaggagagagggcacacctgtgagagaagcctggtgtctggaggagaacccattgtcaggggtctgtccttgaatggcaagtgggcacggcggctaccctggggtccgctcaagccaggtcctggtgtcttacaccaaggacaagagatgcagcagggaaactgaggcagcacagccaggggccgggatgtgcaggtagggctgccatggcagctccagcaggggcctcagctgcctccagggctgtggatggtcagccgcgctgaaggctgctcgcggcaccgtgtgtcccccacagctcctatgactgcctgctggatgaccccttcgcccacgactggccggcgctgccccagctcccgggactgcactactccatgaacgagcaatgccgctttgacttcggcctgggctacatgatgtgcacggcggtgagtgtgcagccctgcagccgggaccctcccaggtctggggggaggcgtgctggtgtaggggcagctcccgggacagtgtgaggaccggcccagtgtggggagggcagagcggccctccagagtggcagcctgtccctctgcacccaccactccccaccccctaggcaccctgagcccacctggcaggcccagacgtggtcctaggcaggaagcacacgggggacaggactgtgaccagggtgtcagccaggggcagtgagagcctgcagaggtcaggagggctcccaaggaagaagggaggcctgcaggctaagcggaaggagagggcattcaggaagggagggccacggacgcagaggccacggacgcagaggcctggaggagagcgcggcaggcacaggagcactcgctgctctccagggccaagtgccagggctgagccgtcagaggaaccggccatcggcatggaggccacactgtgggagcttcagtgtctatgagcgtcttaatgctcgcctctgctgcatgaaggaaagaagcaaagtagtcccattttacagatgaggaaacagagacccggagaggctaggtaacctgcctgagcccacaaagcgagcaagtggtagagtcgagtaccaacgcaggagggccacctccttccaagactccctaaggagcacagtggactcgattctcatggcgatgggggctctggaaaggcttgagtaggggaggctcagggccacgtctgagtttcagctgatccctcagggacgtcctgcaggaagtgctatcaggacaggaagcagaaaggccagggaacaggactgtgaagtccaggggaggccgaggctgcagagagggcaggcctgtgggggtgggggtagggcttcgccagggtttaggagggaaatccacggcaaagggtcagcaggtgcccacctagcctcaggctggcacttagggcccagctgcccgccaggctccctgaggtgtgcagcctccaaagactggaggcagagaggcccagccgcgtccagggatgctgcagcctccacaccgtatgggcaaggtcttcaccaccccagaatcacaacacccaccagcctcacgggcccatcatgggccagtcccactggggcatctcaggttccagaacccgggggtgggtggcatccctgggaggtccctgaggtgggagggacctggcaagctatggtgctgtcttccagttccggacctttgacccctgcaagcagctgtggtgcagccatcctgacaacccctacttttgcaagaccaagaaggggccccccttggacgggactatgtgtgcacctggcaaggtgaggcagcatcaagggctcttggagggcagcagggcagaggacaggaatcttaggtgcccgggtcaccagggacaggccctgaagtgggggtgggggccctctcaggggacctctgctgccctctcctttcccccttctaattacccctcacacgctgtacgccggagctgcctccaccctgtgcttctgatgctggagcacacctggcatctgagagttcctcatggtgcttcatgccccccactcaggaatccccctttaaggagcaatttctggggtcctggcagccttcggtcacccctgggcactgtgggtcacctcacctggaggccagcattggagtcctcgggcccagcatgaggcttaacctttccatccccaggacctcagtgtttgtcccttgttgggcacactgtccttcgaggtcccttgatggctgccccaggcccacttcccaccctctggtgactcttgaaagaaggacttcttccctgttgtcctcccagaactccagacctgattctcatttgttcagatgaaatcacacacccactcctcagccagttacttgctagggggctggcatatgcagatgagctaagcctggatccccacccaggaaggctcagccccactgagaccaccttggccctgcagtgggggcagggagtagggagtggacaccggtgcacatcccagccaggcctaggacgcccccaaactgtatggacctgtggctccttgatggaagtctttggctcgggactgggccagctgcctaattttagtctctggcggagcttctgaaagaaacaaattcccaggcccatccttgaagacttttgtttggggtaggatccaataattgtttttggtgttcttttttaaactatggtaaaaattctcacaaaattcactatctgaaccactttacacagttcaggccgggcgcggtggctcatgcctgttatcccagcactttgggaggccaaggtaggtggatcgcctgaggtcagaagttcaagacaagtctggttaacatggcaaaatcccgtctctactaaaaatacaaaaattagctgggcgcggtggtgggtgcctgtaatcccagctactccggaggctgaggcatgaaaatcgtttgagcccaggaggcggaggttgcggtgagccaagatcgcgtcgctgctctccagtctggatcacacagcaagaccctgtctcaaaaaataaaaataaaagtgaagtgcaccattcggtggcatttagtacatttgcaatattgggcaaccatcgccactacccggtcccagagcttttcatccctgcaaaaaggaagcgccatttatcagtcacctctcccctccctcctcgccccatcccctggctagcaccaacctgctttctgtctctatagagttgcctattccggaatttcatataaatggaatcatatatatgtggccttttgtgtctgactcacttcattcagcagaatgtttccaagggccatcctgtgtggcatctatccacattccatttctctcgatcgctgaataacctcccgtcgtgtgggtgtgccacatttggtgtatccgtttctccacggagggacatttggttggtttccaccttttggccgtcgtgagtcacgccgctgtgaacatttgtgtataaggttttgttcgaagacctgggaattggtgtttttaagatgtgcccagacttaatgaagggttagaagtccgaagtgagttgttggtaagttgctgggggcccagtgaggccagaaccacccagctattccccttcccacaggccctcagcagaaggagcggggcagaacatctgccgtggccccagggggagcttcggaaaagctgagttggagaacaaggccagctaagcatggctccccgcccgccgcacccaccccaggcagggaggaggcagagggaatgggaggcaggccctgcacaggcatgctggttcagggagcaggagcaggagcaggagctggtggggcccccatatgtgtgtgtgtggctggcctgcaccccagctgattgccccctgcttttcctgcaaggtagaagtggggcagagggaggtctggtaaggacagtgagcagatgcaaccgaagtgtccccacctcacagagaccacccacctggccgcagcccttcactcattttggtggtaggatcctctgcatttagcccagtaagtgaaattgccttttatgtattaaagatagttgtgctgactgaggggcagagctggggctctgctcagcctcccctggttcccgaggagcacaggctggaaccgacctagatcaggattcggtgtggggatgttgggggaacgtggaagacgggctcctcccgggctgctgtcagaatccctgaatgtgggtctgtatgtttccctgtcctgtgcatcactgttctctcacgctgtgattttacatctggaaagcaatcatcttctctcccaccctttcccgcaaggaccctgagtggtcatgcccagcttccatttccaggttaggcaccgtcttgcccagttgggacaggaggaccactgcgtggctccttccatcctcctggctcctggttcctgcggccaccagtgacttagagtctgccccggccgcagccttccacggtgccaggacagctcacactccatcttcctcagcttcggctgctctaacagaaataccgcagactgggtggcttacacaacagagccttgttcttcgcagtcctggaggctgggaagcccaaggtcagggtgccagcaaggttggcttctgggaggaccctcttcctggcttgccatcttcctgtggtctcctcacatggcagggagagagggcatctctctcaggtctcttctcatgaggacatcagtcccactcatgagggccatcacctaacgcttcccgaaggcccccacactgggggttagggcttcaccatatgaatttgaggggacacacgcactcaggccacagcactgccttacctgggcccctcctcgcctgcaaccccacctgcgccactggctgaggggaacgccagccagcatttctctgggttgttcccctcccctccatgctcgagtgaggggagctttgggggcaagagatgaggtaatggtgcccaggaaagagatggctaggaccccccaggggccgggagccaggcctgcctggccccagccagttcctgttggcccagcctgatgggaggagcccttgaccacctgcccacagtacccccctccgtctgggagggagaatccagagtggcggcctctgcagtccccacgtggctcagactgccacaaaggcaggtctgggagggttttagcaaggcatgagaatgaggggcctttgctaggaaggaaggggagatgtgggcacaggtgggcgctaggtggggcttgcccgagcgaggaggaccaggaaggaagcacgggaggggagcagctcaggcatggacacaggaggacggctccccagcaatgacctcagacacagagacctggtggcaggaattccagggcgcactttcagggccagcaccgtggggagagtgaggcactgcacagggatgcgacctcagcagagggctcggccagcgccacgtgcagctctggagcctttcagagttggcccaattgaagcaacgtttgaaccgcaaccctgaccagtcactggctatggctgtctgcaggaaaggggactgttcctgggggctgttcctggagaagaactcagctgtgagccatgagcagcccacatgctccacagcttgaggaataaacgacttggtcctgaagagggatctgggtggcacagcacagggtctgctgtgccaggcgtgtgttgaggagatggaggcgtgcacaggggcagggagggaagggagtgcggtctgttcagagccgccagcgctgcagtgctgctgtgctgggggaaggtgaccctgaggcgtaagtagaggccagtcgtaccgagtctttgatgccagccacagggcttgtcctgctgcgagtggggagccatggaggggctttgggagggaagcagaagtcgatttaccatgaagctcatgatgcttacgctttggggtcccttgctcacaggagccccttccgagaccctgggagaggccaagccatgtgtttacatggtcacatttttgtaaattttgcaaaaataagatattttaaccatacttgattaacagcacttctcttttcattcctgcttctcattgatacaattctcctcccgtgggtgccactgatacacttcccctcctgtgggtgccattagaatggccttgggcattttgctgctttggctacagagaaaatggattgagggcatttgttttggcttattgccatgattctgtctcttacaagtagagttaaatgattgtgtctgtccaggtgtaatagtagcttccagaaatactcgccacaccgctgtgccaactcatctagggtcattgcagaatacaggctgtgtgctggccatttccctcagatctttgcagaaaaaggtgcctcagcggtaccggaggttgtcactacttctatatgggcagtattttgtttgatttttaggtttgttttatagatggagtactttaaacacagatccaacatggatatttctttagaaaggccaagtgtaacaagatggtctgcttgttcaaaagctggcttaggccaggtgtgatggctcacacctgtaatcccgacactttgggaggccgaggtgggcggattacttgagatcaggagttcgagaccagcctggccaacatggtgaaaccccatctctactaaaaatacaaaaattagccaggcatggtggcgcatgcctatagtcctagctactggggaggctgaggcaggagaatcacttgaacccgggaggtggagcttgcagtgagtcaagatcatgccactgcactccagcctggacgacagagtgagactccatctcaaaacgataaataaataaaacataaataaataaaagttagcctagcctcacaacatatggatgacaataaatgaagggctctaaaaaatttcaaagacagaagagaaaccgcaatgaaagcgagatgcagaaatgttggttacgtctgaaggcgctgttttcacttccgttttgaaagtggcttgggaatgtttccataaaataaggaagaaatgacagactgtgatttggatatatgtatcaaatataccttttatcattttctaatttatttattagaaaggaaagaaaattcagataaaaattaatgggatatgaaactaaagtagtagaaaatgagcaaggaaataaaaaaaataataactctgacttcaaaaagctcattgtcaccaaaaaagaaaggttttatatcaaaccaaaagcagttgctcattaggaggaagagacacatatcaaagaagttaacaggccttggagcgtttgacagtctcattaacgaagaggagtgaatctgatgaacacataggaaaatggttcagacatctttctgatttgccatgaaatgttgacaacatcaaagacgccagggagctgcgaacgctgccactgcagtcagggcgtccacggcaactgctactgagcgttgctcatccaaagagtgtcttaaagtcaagctcccacagagaaaacttgaaatgccctgaaaaccacatcaaggacggaaaccagagagcacctcctccaaatgtcatcatcctaaatgttcagatggcgtcacccataacttctttaaagtactgatcattttttaaaaagaaagaatttccctcaatatgccagggccaagtgctggccaactccatctgctgcctgtttggttggtattggtttttttccctaacagctttaataaggtgagatctatatttaaattcactttttaaagtgtacaggccgggtgcagtggctcatgcctgtaatcccagcagtttgggaggctgaggcaggaggatcacctgaggtcaggagtttgagaccagcctggccaacatggtgaaaccctgtctctgctaaaaatacaaaaaaattagctgggccttgtggtgggcacctataatcccaactactcaggaggctgaagcaggagaatcacttgaacccgggaagcagaggttgcggtgagccgagatctcgccacttcgctccagccgggacaacaagagcgaaacttcgtctcaaaaataaataaataagtaaaagagagtgtacaattcagtgattttcagtgtattcatagagttttacagccatcacaacaaacaagcgctggaacatttttgtcactctgaaaagttccaaaccctttagtagtcacctcaatccatcctactctcgcccaactccagatagccactcgtagccactcatcctcttgctgtctttatcgattttccaattctggacatttcatatcaatggaatcatacaacatgggacattttgcgcctggcgtctttcacttggcataatgttcacagggctcatccctgttgtagtgtgcagcagccctgcattccttcctgttgctgaatactaatccactgtgtgggtattcatcatttattagttgatggacatttgggttgtttccacctttcggtaatgatgggaaataccgcacaaacattcgtgtacaaagtattgcgtgcatgggtcgtttttcttggatgtacacctagaaatggaatcattggattttatggtaactccatgtttgacattttgaggaactgccagtttcccaaagcagcctgttttacattccaactggcaatgatgcttcagatttctccatatcctccccaaaacttgttattttatttgttataccaatcctagtgcatgtgaagtgatatatctcattggggttttgatttgtatttccctagtgacctatgatgaccgtcttttcatgtgcttaatggcaatttgtatatattttttgtataaatgtctatttagatcctttgcttattttttcatggagttatttatatttttattattgaatcctaagagttttttatttattctggatacaagtctgttatcacactcaccagtgtaagtggtctgcaaatatttcctcccattctgtgggttgtcttttcactttcgtgatggcatcattgaggtgcaaaagtgtttaattttgatgaagtctaatttatctatttttacttttatcacctgtgcttttggtgttgtatttgagaaaccattacttaggtcaagaagatttactcctatgttttattctcagagtttcagctcttacattgacatctgtgatccatttttgagttaatttttgtgtaagtgtgaggaagatgtccaacgtcattcttttgcatgtgaatatccagttgtctcagaaccattcgttgaagagactattccttttccattgaattgtcaaagtttaacttatcaaatgtaaaggtttagttctaggcttttgttctattccgtcggtatatttgtctgtccttatgccagggatacactgtcttgattactgtagtttaatagtaagcttcgaaatggtgaagtgtcttcccactttgctcttttttcaatattattttggctattctacatcctgtgactttccatatgaattttaggagcagcttctcaactttgcaaaattctagtctgcattttgataggaattatgttgaacctgtagatcagtgtgaaagtatttccattttaacactgatcaatgaacattgagatgtctttccatttacttagaacttgaacttctttcaatgatgtattgtaatttttagtggacacgttttgcattccttttgttcaatttattactaaggttctttttttctttttggtgctattgtaaatggagttattttcttaatttcatttttaaatcatttattactagtttatagaaatgcagttgatttttttgtatattggtcttgtttcctgaaacctcagttaatttgtttgttagctttaagttttgtaggggattctttgggattttctatacagaagatcattttgtctgaaaataaagataatatactgttttaactgccattttgaaagtggttccagaatgttttgataaaataagggagaaatgacagactctgattggaatatatgtgtaaaaagtaccttcttttattattttcaaatatatttgttaaaggaaagaaaattcagataaaaattaatggaatatggaactaaagtaataaaaaatgggcgatgaaatcaagaaaaatgactgacttcaaaaagctccttgtcacacacacacacaaatctattccgttgcttttcgtgtgcttaatggctatttgtcctcacgtcagcagggacgaaagggcaaaaagggacctcgctagctccctctggcgcttttataaggcccccaatcccatccaggatgacctcatggcctaaggatctccttaaggccccacctcttaaaactgtctatgttcaagttcactgattgcatctgctgccagctcaaatctaccactgagccagctaattagtttatcttttaagtttttgtaccattcaactccagaatttctatttagttcttcttttttttttttttttttcgagacagagtctctgttacccagcctggagcgcagtggcgcgatctcagctcactgcaacctccacctcccgggttcaagagattctcctgtctcagcctccgagtagctgggaatcacaggttgtaccaccatgcctggctaatttttgtatttttaatagagacagggtttcaccatgttggccaggctggtccagaactcctgacctcaggtgatctgcccccctcggcctcccaaagtgctgggactacaggtgtgagccattgcactcagcctctattcagttctttttataatttctatctctttactgagattctccatttggtgacacgtcattcctgtactctcctttagttctttagacatgatttccttttgttctttaaacacattacttatagctgctttgaaatctttgtctgctgagtcagacatctgggcctcctcagtggtagtttctgtcacctgcttcatttcctgcgtatgggtcacactttcctgtttcttttcatggctcagaaagtttccttgaaaactggaaactttagataatacattgaagaaactggataatgatcccctgggccttgctgctactgtttgcttgttgattttagtgccctggtcctgctgtttcaatgaagcttatgtcccctgcagtgtgcagccactgatattgctccccagaggtcacagccttggtcatatgcagtcaccctgactgcacccctgcccctaatgccctggggtagtggcattagccaggctctttgactatctctttcccagatctttccattaagcttctggtcattctgcctgtattgctatcacacccaactgttagccttcactaactgctagctgctactaacagctagtgcgattgattgctgtattgtttttgacagtgtcctggggtatatagcttgctctacaatatgacctaattaaattctagacctttcacaggggcagggtgttgccagtatctgaggtgtattgagaccttcaggagggctcttagctgtctttgtccctggttctgtctgtttaacttctacaggttgagcatccttaatctgaaaatctgaaatccgaaacacttctggttccaaacgcttctggttccgagcatttcagataagggacactcaacctgtagctggtttaacattttgtttgttgctattaggaccattggcctcctcttaattgctcactgctaagacccttgttgtttttgacagtgcccttagacatgaacatcctccacgctctgtttcagatcaaagtcagtccccttagggagagctgtgaagccttctgttctgactctccctctgggcaggcccctgcaccactgagccagagctaaaggagcagggtcagtggcctgcttctcccagagtgacattcctggcctacagactgctcactagatgggaatggtagccactagtcttctgggcttgcccctttcaacatggaacctctaccctataagcaatctggggaggggctatcaggtccaccattcttggcctggtgtacctggagcagagcttgtgccctatgagtggggcctgggtgggggaagggggccccaggcctcttggccatcccaccagagagagactctgcaacagagttgagagggatgacaccagtggcctgggtttctcagtatgaaactgtagcctcagaccgggagcttggagtagaggcagccccgtcttcttggcagtaaagcttctgtcacactgagctagggcaggaatgggggagggctgtggctccaatgccatagacttttgcttttcttaccaagatttaatagattttcttgagaaaaaaaaaaagcttcttcatttgttgtttagaccttaggacaatttccagagactttaaatggctgctttttaaaaactaattttcgtcagttactggggagagggttcaccaacctccttacacttccattcaaagtttctgtttgctgcctgtttttgtaaataaagtttacaaaataaagttccaataaggaacacagccatgtccattcatttataggttgtctatagctgctttcaagctctgatggcagaattgattaattgcaacagagattatatagcctgcaaagtctacaatagttactctctggcccttttacagaaagaatttgctgaggaatggtttgctgagaagagtttgccaaggaatggctgcgttctctttctgttctctttgtggaaacagtgctacaaaattaggtcatacaaagaagggttaaagagtatgcagtcggccgggcgcggtggctcacgcctgtaatcctagcactttggaaggctgaggcaggtggatcacctgaggtcaggagttcgagaccagcctggccaacatggcaaaaccctgtgtctactaaaaataaaaaaaaaaaaaatgcaaaaattagctgggggtggtggtggacacctgtaatcccagctactcgggaggctgaggcaagagaatcgcttgaacccaggaggcggaggttgcagtgagccaagatcgtcactgcactccaacctggggggacagagtgagactctgtctcaaaaaaaaaaaaaaaaaaagagcatgcagtcggaactgaaggaaaagttctgtcagtcaatgtattagaagtccttgttctctgttttttggttgtttggtcattgtcagttttaaaacgtttttgtgtgatgtattttctcatttcaagtcaataacccattttgcacctaatttaattctttaattttgcaatcttcttcttaaagtgggtcccctaaactgtagacgcttcctccccctagaggaatgagagcactgtgatcagattaagatgtggaatcatttttcctacatgccagcattggactttattcctggtttttaccatgtcagcatattacttgtcccttttttccatagtatttcctctaaattgccttttttgcttaaataaaccttgtatgtcttgcagtcactggcctgataggccagtggtatctttataaatgggctgtgtgtgggcacccaggaggcatctatcctggcggcgtcatgtggtgcagcttccagctgaggggacacagagctgctagaaggcaggagggtgggtcagcaagcgggaggcagggcaggccagcccctcactgtgcctcttattgcctctggccaatgaggcctgtcttctgggggctctgagcatctaggggcgaggagggtgagctccccctgtgccccagagtggggccaggacgtgtcccagacactgcaggctgcagagcgcaggactgtccccacggcccggtgtgagggtgagtggagggactggcttcctgtctttcagcattgttttaaaggacactgcatctggctgacacctgacatcctcaaacgggacggcagctggggcgcttggagtccgtttggctcctgctcacgtacctgtggcacgggcgtgaagttcaggacccgccagtgtgacaacccacagtgagttggccccatgtccccctggccttgctgagtggcagctgagggtccaggagaccctctccagccagccctgtcctggagggccctgtggctgcacaccagttctggagaggtgcagggcaggctgccccgcctgcctcaccctacctgggagggggtgacggctcaggggacgcttagctctgcctcttaccccttcccctggccggggcccacagcccacctgcctgcagcccactctagacagatttactctgtctctcctggccacgggcatggaggagaggagggaggaccgagctggggaaatgggggtaagcgggggtggtctctcagcccccccgatgctagcacctgggcagctgtttgcagccaggtgagggcagggtcgggatttgtcatcagtgtctggctgcccaggggagggacaacctgtagagccggcccatgccagctgcatccccatgctcagctatacctcagccccacccgccacgcaggccccatgccctgtgctgtcctcctgccccttctcattcctcccacctcacccccacacaccccgtaaatatctcccgggcccgtgctccctcctcagcccgcagccactttctcatccacaccctcctctccctcctccactgcctgtctcctcctgcctgaacgctcaccctggcctcacccagggagtgtcccgggggggctggcatggagggagaaccctccacaaacatcagcgttacccccgtctcccacctgcgcagcgggctcttacgccgcaggccctgcagctgcttagacacacagagcttcggtctttcctttttggcctgtctggtattttaaagattttgatttgcctgaaaatattgacaatctgtaatttcacattagaaaaacaaacaaaacagatttccagcctccaaattgggcatcacagatgcacagccgggcccagttaccagctggcgggcagggctccgggtgcgtcccggctgctgcgctccggcctctgcggccgctcctgggtcctgttcactcgggctgctctccttgctctggccaggcccgagctggaccctgcggagccagagaggacccgcagtcacggctccgcggagggatcccgcagtgggacagcctccctcagcagcacgtgtgaacacgctcgtgcatggagccctctcctacccctgctgtcctcctgccccaggctccaggctgccctcccggccagaagcagacagggagccccgtggcccctcctcaagcacccctggggcttttacgccagactcggaaagagattgctgggcatttagaacctcaagaggcagtgtgtgggttggtgctgttcccagtgaagcgaagacgttgcagaaacgcagcccgccttctccacagggagaaaacccagcggccgtgatgcgtctgctttgtgccaagacacttgctgagaactgcagcaccgggactctggggcctcagcatgcctctttctgtgctaggctcggtgcccagggccagctgcagaggagactcactcagctcctgccgtgctggggttttcgccctgtggggaacacagaacctaaacacccaatcacagcttcctgttcatctccaagcccaggcatcagtgctggggaggaggtggcaccagggctgtgagcagatgctgcctccccacaggaaccccaggagggaggatgtggccatcctgtcctgtcctttcaagagcttcactctgaggcctgacaggctggacaactgcccaggtcttacagctaggacatggcagggcaaggtccctttgctcagcagagctgccccccggacacctgagacttagggatcccccctaaaaagatctcacaagggcacccgggtgctgcctctttccaatggcacggagcggcaaggcctttgctttctcctccagcccggccaacgggggccgcacctgctcgggccttgcctacgacttccagctctgcagccgccaggactgccccgactccctggctgacttccgcgaggagcagtgccgccagtgggacctgtacttcgagcacggcgacgcccagcaccactggctgccccacgagcaccgggatggtgagcccttctgggaggcatcagtgggggctcagcaggcaggccctagggtgggcagggtgggggcttgtgcctctgatcctgcatggggcaaggctgccgcgaccctgggctggcaggagagcccaccctggctggtgtggctgccctggcccactcctgggtggggcattaaagttcctagcagggctgcaatcccagagcaccagaacaccccagagtagctgaggacatggaagaggtggccgggctgcgggctcggcaggggccgggctcctgcagttcaccgtgggtggacgaggcttgagctgtgtggtcagctcagggctgaggccagggctgaccctgccaaggaatctggtgacctctgaccttctctattagtcgggactctcagttgcgagtgtcagaaagttgactccaaccggtttcagcactagaaggcatttattggctcagggacctgaggagtctggtggccttgggcatggcagtgcttgtgtggcagctggggaccctcctgggacggactgtaaacacagtccttgtttctcctccatggctgttgccctagcccagcagctgctgcctcatgtgggccagtgcagggttggaggtgacacagcagatggggtccccctctggcggaggccacagtctgggggcccagcgttttagttgcctcagataaaggctgagaagggaaggttccagggacctgagtctgaatcgaggcaggctggcctcattctggatttcagagattgactgaaaaggattatttactttttttttttttgagacggagtctcactctgttgcccaggctggagtgcagtggcgtgatctctgctcactgcaacctctgcctcccaggttcaagctattctcctgcctcagcctcctgagtagctgggacttcaggcgcacgccaccacacccggctaaatttttgcattttttgtagagacagggtttcaccatgttagccaggatggtctccatctcctgacgtcatgatccgcctgcctcggcctcccaaagtgctgggattacaggcatgagccactgctcctggcctttttttttttttttttgagatggagtcttgctccgtcacccaggctggagtgcagtgtgcagtggcgcagtcttggctcactgcaagctcggcctcctgggttcaagcgattctcctgcctcagcctcccaagtatctgggattacaggcgctcaccaccacacccagctaatttttgtatttttagtagagacgggtttcaccatgttggccaggctggtctggaactcctgacctcaagtgatccacctgcctctgcctcccaaagcgctgggattacaggtgtgagccatcttgcctggcctgaaaagggttctttagatagcaacccagcaaacagacatttgcagcctcggaggtctccaagcggggcctcggggatgtgagagccgggctgcaccaacagcctggctggcttggttgggaaaagctcttccaaagtccacaaccaccagggtcaaaggcttaggagacacagagacaggaagggggctgctgtcacccacccctttccctctctgtctgccctggagggtgggccacgtggggacccttgtggaaatttctcctgcttggtgcctcctttgcacacacatggggaagccatcagggctccttgcagacccccagctgcttcccttccagccaaggagagatgccacctgtactgcgagtccagggagaccggggaggtggtgtccatgaagcgcatggtgcatgacgggacgcgctgctcctacaaggacgccttcagcctctgtgtgcgcggggactgcagggtgagtacacagaggccggcacggggggctaccgtgtcaagtctcagcttcctgggtactgacctcccccttttcggggtattggcaagatgcatgaggtgaagcatacgaagtgtcagaaacaatgcccggaccagggcaggctcttggcaaatgtctgtttacccctcccctgtgctgggagcctgagacttgagtatgcctaggactcacctggagagtttggactccacctcagacgtcctgattccacaggtcacggtggtggcggcctgggagcatgaatttttaggagcatcccaggtgatttccaatgcacgtgacctacaggggacccttgtgaagcaggccccatccttgcaccctgcagggcactgggcagcttcttgctggatctgggtggccactgtgagggtcactggtttggtgctttgtagaaatgccctcctctgttttcttttattatgatgcctttggcttcaatctttggctgtcaggaaaaacaatctcgtgtcacctcgccatgtgacggtgacatgaacatagacttgtccctgccaggctcccccgaaaacaaccggaagtctctgcttagggcttgtgtagacaggactgatggcaggagtcgtggaggctgactctggcttgaccttcctgagaaacagccgcatcggcaggaaggcacctctaggggagtgggcgcagggacagcggctgggggctggagccgggagctggagctggagtcgggagctgggggctggagccgggagctgggagctggagccgggagctgggggctggagccgggagctgggggatggagccgggagctggagctggagccgggagctggagctggagctggagccgggagggtgctcgagggctgctctgcatttgctcctgtgacttcggcagggccgggaggctgggctatacagctggctcagagatggcgacaccaaatacgccaaaacaagaacaggtggtgtctgctctgtacccttgggattttaatttatggaggtgacccagtgaggacgtggggaggccaatgtcactgagagggctcctgaggaaggcagggcagtggaagggggacagctcaggaatggccagtttgaatcattccagtgggctctggagtttagggtggtccccagtagcctggtacccaaccctgggatgagttagggtgcaagaatcttggtttggtatgtgagtcctggataaaggaggtgcttggggtatagactgaagactggctggcttgcatgtgaaaggtgtgtccccaacccagtgctttgctgtcccttagaactggatacccctgggaggtgtagtctctccccagacaggaagatttttaagatgtcaaaatatcaagacataggacgttttgaaaaacaaaaacataattaatacaggcagcaagcatgggaaacagttgtagtacaagtagcttcagatggcagctgtgatcatggttgtaaacctaacggggagggaagatcactaatgcactgtctccgtgggtgtggctatcacgtcactcctgacatgggtattaaagaaggataggggctgggcgtggtggctcacgcctgtaatcccagcactttgggaggccgaggcgggcagattatttgaggtctggggttcaagactagcctgaccaacatggtgaaaccccgtctctactaaaaatacaaaaaaaaaaaaaattagctgggactacaggcagcgactcgggaggctgaggcaggagactcacttgaacctgggaggcggaggctgcagtgagccaagatcgcgccactgactccagcttaggcgacagagcgagactgtctcaaaaaaaaaaaaagaataggttaaatattttattaatgttgattttgacaggtaatagcaggttgctcaattttgcataattagaaaacataaatattcatgcagaacctaatactgggtcaaaaaataatatccaactggattctgtctgttaaagaatatcaaaacttggccgggcgcggtggctcaggactgtaatcccagcactttgggaggccaaggcaggtggatcacctgaggtcaggagttcaagaccagtctggccaacatggtgaaaccccgttgtactaaaaatacaaaaaaaattagccaggcatggtggtgggcacctgtaatcccagctactcgggaggctgaggcagaagaattgcttgaacccaggaggcagaggttgcagtgagctgagattgcaccattgtactccagcctgggcgacagagcaagattccgtctcaaaaaaaaatgtaaaaataaacagcatctcctgcttgccaaacataaatgttcatcaagccagggacggtgcctgcctgggcctcgatgagtcccctgcccaagaccagccgcgtgcacaggggcccagacggaaactgccaggtcgagacactgctgtaggtggcaggcaaggtccgtttaactgatgactagacgcactctgattttggagataataaaagatgaggccaggcaaggtggttcacgcctgtaatcccaatgctttgggaggccaaggcaggaggatcgcttgaggccaggtgttcgagactgggggcaacatagtatgaccctgactctactagcaggacgtctcaagtgctcactgcctcctcccccaacagaaggtgggctgtgacggtgtgatcggctccagcaagcaggaagacaagtgtggcgtgtgcggaggggacaacagccactgcaaagtggtcaagggcacgttcacacggtcacccaagaagcatggtgagtgggtccctgctctccaccctggagcctggatgcctgcagcaggctcatgcccggacagctgagggcctgactcatcctggggctgtccgggcttatgactgttctggggagggggagaggtctgtgacactgagggggagggagaatcctaagtcggggacagccccagctgggtgccagggtgggtggggaagaggagagtgggggccggggtcacaggggttagagtggagaatgccagtatatgaggatgcccgggttgggccttaaagactagcctggaggcagcagctttcctggtggcccctctcaggtgggtcctcaaagccagagaaataccagggtcctgggagagcctccggaggagctgccttcaagagcgaggcccctccttgcatggtgcgaatttgagcggcgccttcccttctcagttttctgtgtctttccacatcaaaaaaaggttacatcaagatgtttgagatccctgcaggagccagacacctgctcattcaggaggtagacgccaccagccaccatctgggtgagtctcagagccggacaacttgacgtcctcaggacctggctcctctgggatcaatgggcagagtgccaggggtcaggggtcaggggcccgggttgtgcagccatgacctgagccagggcagcccctccccaacctgtccctctgctcagcccacctgggccctttcccagggtcctccccttgtggagaggccagggtttgggatcagagggctccgcttggcagcagctatgaaaggacatatatgcaaaacatgtgtccctcagtctacaggatgactccctgtcccctgttctcacagtcggggcgggaaggccccctgccctcgggaaggcaggcagggtctgcaggcagcagggtcctgggcagccctcccatcccctcagcaaggccagctgtcaggtgggtgcacacagtgcacttacattttcaattcgtttaattttaaattcaagagattccagctaaaatagggatcctggtatctcctgaaaatatggatgttctcacacctctcggtgcccctttccacgaagcagcgctgcctgggagaccacgccctcccaggccacgcgggaggctctcaggacctgtccaccctccctctgaaggtgcctgggccctaccttctgggaattcatgggccaaggtcagaagtgataccagggactgctggggcccctggataagtcccttccccaatctgagccccacattcatccccatccccaggaggctggacaggattggggctcccacgctgccgtggaccagcacccacgctgcctgacaaacataccatgcccttttattttatctcccttttgttttattttattttgtttttatttagagacaggatctcactctcttgatactcatttttctttcttactttttttttttttttttttttttttgagtctcgctctgtcgcccaggctggagtgcagtggcctgatcttggctcactgcaacctccgccttctgggttcaagtgattctcctgcctcagcctcccaagtagctgggattacaggcgtgtgccaccatgcccagctaattttttgtattttttactagagacggggtttcaccgtgttagccaggatggtctccatttcctgacctcgtgatccgcctgcctcggcctcccaaaatgctgggattacagctgtgagccactgcacctcgcctcttaagaggaaactttcgactgctaccctaaatataaaaacctgtaccacttgcctgaagcaggtgaacagaaaagtcagtttctgaacaaaaagacatttctgtcccaacgctgcttcctgccaccgcctctggggctgaggtcgctctctgtggaaagggagcaagggccagagagaaggcagggacgtgtggcaccaagcagaggctttgtttgtgagtggacagaattacaggggacgtgacagggaatgattttctcactagtgccctgtctgcggccccactcacatcacccagctgccccgcagcagccaccccccacactgcagagagcatggggcttcctggctagccaggtcctctgctcctagatgacctgagtgtcacccaatcaggccaggcctcttctggggctgtggggagctgctggggcctcggctgggccatggtccctgatggggtgggggttctgctgtttcagccagacatatactcaccccatggcaggaagccctactccagcagggtcatgtgctcgcctgtccagcagatgccctgcaccgcgtacagacccctcccagccatcctgccccgggtggcctctaagcgcccactgagtgctcccaatagggtatgggtaggtggccttgacggctactgagtggcttccaaggggagccggcacctccagggctggtgggggcagaggatgcgagtggagggtaatctggtcccgagggagcagtgatgggcaagcagggctcccagagccatctgggctgtcgtggcacagaggaaactggccgggggcagccagagagacaaggggtccagctagctgcccccactccccgaccagcccaaaccagtgggcctgggtcctgctcttgggtgaccacaacgggggacttggtcttgccattctcagccgtcaagaacctggagacaggcaagttcatcttaaatgaagagaatgacgtggatgccagttccaaaaccttcattgccatgggcgtggagtgggagtacagagacgaggacggccgggagacgctgcagaccatgggccccctccacggcaccatcaccgttctggtgagtccaagcagggctgggcccagggaagggtgcgggtggccactgggggagggatgggggtgcctgggacgctgagcctcctgacccttcaggtgacactctgcgtggcccctttggcctgcctttggcaccaaggggctccgacttggtcagagccaggaagggacatgcatccacgagccggggctctggaccccacatgacccctaggtgaccttgggcacactctccctttgagggtttcggtttcaccatctgaatgacattcacagctgccatcagcatgctcgttcgagtgtgctgttacattggaatcggtgacactctgggaggtgacgctcagggtctgggaagctagatgcccagacccaggttgagctggactgtgtctctaagcaggatgggaccccagatctcctggttgtaggaaagtaccacgggggctggattttcaaatcactttctttttacctggttttgaggaggtcagatcactttttaaaatgtaatttaactgcatagggatatattttatttgtcaaaaaaggtacatatcacaaataaggctcccatgctctggagcccctccctaaggtgggcatgctggcattgggattaatccaccagcccccagcgctccacacgtgggtgcacctgtaagcaggtgcagcagtgagccaggtatgccccgtgtaccccctggcaccctgcctgcctcgcctgcagtgacttctggccccctggacgtgcctttggtgacctgcctgcatcagtgtgtgagcagctggtcctcggcactcacggtttctgtatttgcaaattcacctgctcactaaaattgattcgtgagccccaaacggacacgcacagagtggtgaagtgtgagtcgcctgccacacgtgttcccagcggaggtgggagcaactcagcacgctgtctgcttgtttctgctctcatcccacaaacaggggttctttctgcagtctgttgagtgtcacatacatcacattttgtgctattttgggggcgatttcgctgttgaaaatcaccctgagcctgttgctgaagtgctgtccagtgttcctaagcccaggaagcagtggtgtcttaagaagaaaatacatgtgttgaataagcttcgttcaggcatgggctgcagtgcgattgactgtgagttcagtgttaatgaatcacagtaaaaattaaataaagtgtctttaaacagactcacacataggccaggcgcagtggctcatgcctgtaatcccagtactttgggaggccgaggcgggtggatcacttgaggtcaggagttcaagaccagcctggccaacatggggaagccctgtctctactaaaaatacaaaaattagccaggcgtggtggcgggcgcctgtaatcccagctactcaggaggctgaggcaggagaatcgcttgaacctgggaggcggaggttgcagtgagccgagatcgtgccactacactccagcctgggctacaagagcgaaactccatctcaaaaacaaacaaaaacaaacaaaaaaataaacagactcacacataaaacaaggttatatattgatcgggtaacaaaaatgttgagacagaggctcacaggaacctcaccctgtgccccctggggtaatggctccctattcaagaatttggtgctcggggcgacttcatggaatgtaactgccatgaatgatgagactcctctggagtcggcctcggctgccgttcctaagctggctggggaggaagcatggagggcaggtcaggcacatcaaggctcttgggctggcacaggtcatcccggtgggagacacccgggtctcactgacgtacaaatacatgatccatgaggactcactgaatgtcgacgacaacaacgtcctggaagaggactctgtggtctacgagtgggccctgaagaagtggtctccgtgctccaagccctgtggcggaggtgagggggtctcgaagctggggacctgggtgacatgagggtgaccacgagaaggtagggagcatccctggggtggggccagcgtgagcaggggccgaggagccacagcagggacctttgcctgggtgggcaagggcttagcggcaatggaggggccggtgggtgggcaggaaggggggtgctggggcattgggtcaaatgtggccaaagggtgtgtggggcatggaccctgtatttgtgggcctgcttcagtgtgggggtgacaggctggcctagcaagaggttgatgtgtggacacctcagaaggatcatgccgtggcattggcaggatcgcataggcaagactctggcagtgcagatgacacctccagaggcttctctctccgttcactgggaaaagcctcccagatgtttctgggacagggctgagcacagaggggtcctacccactctggaccccagagagtctgcagttgatgggacataggacccagaggcagacaggaagcgctgatctgttctgcgtgctcctgggggctgggcgataccaggcaagtgaccaggacagtcctccctcgatgccatgctgggcccacacctggaggacaaggagctcaccaagaggtggggtcactccctggcccaggcagatggaagggtcctcttccagggcccctgggcacccccggccccacaccgggcctggatttcatcagcgcatccacccctggtgattcctgaaatctcctgggcctgtgtgctcttcccatcttcctggccattccccggtcctggcacccaccttcctctggactggcccttgtgtgtccactctcaccccaaagtaaccgtttgagggaacacatcagacaatgtctctctcttcctggtgtcatagtcttcaacagcttcctctgctcttaggataaaaaacaaaattctcctcatggcctccagggttggggcaacttgttggcctctcccagtatatctccaccctgtgcctcgcccccaggtcctggccacgccggccttaagggcttttcctggatacacaccatgtcccaccttggggcctctgcgcaggcttctcctcgcctgagcccctccaccgccctgccaccacgtcagcctccccagcctctgcttcctgggatgcctccaggcacccagaggaggtcaggctttatctccatgctttctttggtcttacccagcaggccagggtttcgaagcctgggcatcactgacattttgggctctgtcactcgccgccatgggggctgtcctgtgcacggtggggtgtcaagcagcatccttggcctttgctcaccagatgccagtagcaccccttcccccagttgtgacaaccaaacatgtcccagacgtggccaaatgtcccctgctggagaaaatcacccgggttgagcacggctgctctgggcctgtgggaggaagcatgcgggctgcgggcccagtgcttgcccggctcctggcttgcaccaggcctgctgggcatgtgaggtcaaggtagaagcggtgcctagcagtagcaaggaaatagggcctccactctgacccaggagcccagtgagggagaggcagcctaggggagaaaatggcctctcctgccctctcgcccctccacccgggacacaccaaggcctccccccagccagccgcaggctcggtgccctgcccacccttattgtcatcacaagggtgagcaggaaaacgaggccagcactgctggtgcagcccacccctccttgcaccctcgggcagggcatgctgccccaccgacccccgtcgagctctctgccttcagggtcccagttcaccaagtatggctgccgccggaggctggaccacaagatggtacaccgtggcttctgtgccgccctctcgaagcccaaagccatccgcagagcgtgcaacccacaggaatgctcccagccagtgtgagtgcccccagctcgggctcccactagaggagacaggccaggggccaccaggggctcccgtgcttggaggtgtggggcctgggcctggcatcatccgaggcatttgaccaagtctctctcaccacatttcatggaatctaagatgctgcagggcagaaggcgcaccccagcttcaaacccgccaaactgaacagcatcttagagatgacaagaaacagggatgcccagatggggaaatgggggttcagaggcgcagggctcgcctcctggccctgtaccatggggtagatgtttcttaagcagtggctttgacgttcaggccctggggctgggcccagctgcgtttctgggtccagggacctcagtggggaagacagttgggaaatgggcaggtgggggccacataggacagcgtgctgagggaatccacactgctcttgagctctgccgagaaggatttgtgacgtcagcagaaggtgaggccaggtagcagggcccagaccctaaggaggctgggaaacctcttcaggctagggacctccagagccaccagctccaccagggcctcccagtggtgacatgcatgggactcatggtcagtaggacctggggcagctgagcctcagtttcccctctgtgcaagcctggacagccagcatcttagtgagaataagagaaggtgcaccggggaggggtgcaggctgccctctgtgctcgctgtctacctgggctgcagggagcggcgctggagctcagccaggcaggttctccaggtgctgcggaagcctgactgtgccccgctctgccctggcaggtgggtcacaggcgaatgggagccatgtagccagacctgtgggcggacaggcatgcaggtgcgctccgtgcgctgcattcagccgctacacgacaacaccacccgctccgtgcacgccaagcactgcaatgacgcccggcccgagagccgccgggcctgcagccgcgagctctgccctggtcgttggcgagccgggccctggtcccaggtacgcaatcccccgatcccgtgtcctcagctccaaaactgagggtggacaggcatgcaggtgcgctccgtgcgctgcattcagccgctacacaacaccaccacccgctccgtgcatgccaagcactgcaatgacgcccggcctgagagccgccgggcctgcagcagcgagctctgccctgatcattggcgagccgggccctggtcccaggtaagcaatcccctgatcccgtgtcctcagctcccaaactgagcttgggtgggactgaggtgaccagagcattcccctttcggcccgtgggcctggatgtagctcctgtcctgagccacatcctgtgggtttcacggcgccagtggctgccacgtggtcagtgctgtactaagaaaccagtggaatgtgtgtcttcactgcacaggcagaggcttctgcatgatacggggtctggaatcccaggaaactgagggtagcccgggctccgaggcccagtaggatgttcggggctccaggatcctaggggacgcctgggtctcatgcagaggtgggaggggacaaactcgcaggaggggagaagagcagggcgtgcttaggcttgtgctgggaggaagaatgaggatggactgaagggcttcaggggtggtcctaggggcagggcctgagagccagctgaggccaggacagagctgacgtgagctctgacagcccggtcacatgcagggcccacgctggcagagctggaggagcgtgtgtcaggggctccccaagaccaccctcaggctcagtaatccactagaaggactcacagactcagaagcgggactcgcagttgcaggggcttacggtgaaaggatacagagtagaatcgggaaaaagaaaagtcacaggcaaggaggttgggaggaatccaggcgcaggctcccggtgtcccctcccagtggggtcacggaaatgccctgaattctccctgcacccatgtgtggcaatgcatgtgaaatgctgccaagcaggggagcccaccagagcctgggcgtccagggttttcaatggggtcagctacataggtgtgacctcagactgtagaggaaaagcaggtgttccccatccatcactgttggtatgaactacccagaccaactggtactggtgactcaaggcctcaggcaggcaaaaacactcttaataggtggagccttccatgagcttggttcccaggagctgcacaagggccagtcttgaaaacaggcgttggccgggcacagtggcttacgccagtgatcccagcactttgggaggcccaggcgggtggatcgcctgaactcaggtgttagagaccagcctgggcggcatggcaaaacaccgtctttacaaaaaaattaaaaaaaattagccagatgtggtggcgtgtgcctgtactccctgctcctcgggaggctaaggtgggaggattgcttgagcctgggaggtggaggttgcagtgtgctgatatcgtgccactgtactccagcctgggccacacagcgagatcctgtctcgaaaccaacaacaaaagaaacaaaacaaaacaaaacaaaaacacagacctttgttgggaatgtgcaggctttgagcaatccaggtctgctgagtcagccttttcctgtgcacctggtgaggcctggagaattttccttgggcaaggctgggcgtgactgctccttctggcacctccctggtcagtgtggtggagcagtggtggtgctgggggctggaggagccagtgagggcactagtggtggaccctcatgcccaggattgtggggagcctactggcgcctcctaggctgggtcagagctttcccagtgccccacctcaacccctgcccagggcacagcaggttctcctgggccttggacctcctccagccagagaagtgaggctgtcactgagagtccagcagcgccaggcctatgccagtctgtatatgggcactgtctcacagcagctcagagagacaggcatgtgggtcccttctttagagccccaggagattggggctgcccccgagggtggggcaaggcaacctgaaaccccactctccccactgtcccacacctcctcctgagcgcatgggtcatgtgcctggggactgtgggctcctccagctctgccagtgcgggccctgtgtgggaggtgaaccctgcctggcgactctccccctgcagtgctcagtaacctgtggcaacggcacccaggagcggccagtgctctgccgcaccgcggacgacagcttcggcatctgccaggaggagcgtcctgagacagcgaggacctgcaggcttggcccctgtccccgtaagccacctgcagcccctgcccctgctcccagcatgcagcagcccagggcgggggtgtcagaggcttggttcaggcaaatctggctcttcccggagagtagctggactcaacatctgtgagcatggagaagcggggcactgcaggccaggtctgggacctttgcctggcaggaaatggagggagctgtgtggagctgactcgcccctccctgctttcagggcactgcagactcacggtgacagcaggactcggccagctagggaatgctggtggctatggtgtagggggtgcctgtgtgaatagggggacgcctgtgcgagtagagagtgtgctctgtgacctttgaggagaaccagaatacctaccacgcacagatgcctgtccaaacgctatacatgtgtcacctctaaggtctccacacagttcaagactggaccgtgcctgccacagttcccttctatagaggagggagctctggggggtctaggcacctgcccccagctggggagggtgtatccaggatctctcattcccctggcactctctgtccaagctttctgggagctcagagctcgagtcagcaggtggaacccggggcgcgggcagggtgcaggggcagaggagccggcccagaaaaggaggcggcagggcctgcatgccagggcagcgagagggacgggatagctgagacccagctgagaccccggctgctgtcaggaggggcaggaggtgggcgtggacttggcagcggaggaccctttgtccgcccggggaggcgagggccttgaatgacgcttccccaggaccccgggagacccggagcctctctgcctggggtgggggccccagcctggtgccctgcggccgcagcccctctctcctccctctaggaaacatctcagatccctccaagaagagctacgtagttcagtggctgtcccgcccggaccccgactcgcccatccggaagatctcgtcaagtaaccgacccgtttataactctgcctctgccctccagtgcatgccctgcgccctgtggagcttgccttgggcccccctcctctctgtctatggaaagctcccctgactctgcgggcgcgctctggggtgaccgttttctcccgggcctctgagctcggcgtccgctccgggccgcgctgcctgctggcgggggctcgggcctctgctggggccgaacctggttggtgatggcttgtaaaggggcaaagatctgtcgtggttgcaggaggggccggtggccaaagggcgaccctccgggccgagcccgtcccggcccgggggggttcgcggtctcgcggcgtcgtgcggggaccccaccccgagtttccggcactgccaggtgcttcccggctgccaccgccgtcgctgctgccgccgaccctttgctgagcgtgtccttctgactcgtggaactatggcccgcttccgcccggccttcgcgcagctcacagccccgcgcggccctgtcctgcgggggtccggtcgcggaggcggcggaggggcgcggggacactccccacctccactgtccgcccgtcggccccggtggccttttctcgcctcgcgcacagctcccccgccgcagggctgagagagagagtggccgtctggtgcgcgcgtgcctcgcccacgcgtgtgaaccactacagaattacctcaatttttattgcttttttgcttagaaaaactatgtagaagatgccttaaagttgaaaggtaacgggattggctgccaactccagcttcagagggggaacgtgggccagtagaaggcagggaaggtgtaggggagccggtgcgttcatccaccttttgccaaggttgaggtttccaagtgcagacggcttctctccttgggctgagcggtgcgcaccgtccgtctccgcggactggagtctgccctgatgccccactggccagtcggcgctgactgttgcatggagcccccgagggtgctccacagcgcggccttacacccagggggcgaccccctgggccctgagccgcgatccatgtagcactcctccccgcccctccaccccagccaccgcctctgttcacaccgcacccctgccgggcggccggcccctactcccgcggctctgaccgccgttctgtaaataactggtgtgcacctgcgtactaatctcacgactgttaacttccaactttgacgaggccatgcgagcgacacgcgcgactggggaaggtgcaatactgtcctgggcatatgcactttggtttatcagggatattttattagtgttttgtatgtatttaatgacgtattctataggttccattgtcgttgcttttctggttttttttatgagacgttagcgtgtgccaaagtgactgtgaaaatgacctttcattcttactaatgatggaaagacctcctgtcatgcatcccacaaataaactcaataaaagttccatgaaactgggtgcgtgggtttggcaagctgatggctccttctctttttgggggcccagacactgaggagttgcggggcctcactcagtagcattaactaccccggtttctaatttgaatgactttactgccccactccccactgcccaacatagatatttagggcccctccccctgaaaggtgtatctcccctccccaggtattttccaaaatctgatagcaaaccgtgcagacaccccaccgtgactccgggttttgaatcatgtcatatgagcacctcgcaagaatatctaggttctatatggaggtctcctcgtcaggaaaagggcccgagatgggtttctcctcatctttggagcagagcctgtggagtgggaatgtggggtcagtagcccagacattgctagtccaggtcacctgccgtgagccaccagcaggtcactaccctggctccaggcacagttctcggccttgggctactcgtccaggaagggagaggtgcccatccggctcaggtggggggctgggccagccccgggaaagcctgggtcgggagaggggcagggcagtggtggctctctgggcaactggcctgcccatgtcttccaaggtcttcccaggcagccacagggcctgtgttctctcacattgctgaaaatggccagaaagagggtctgggttcaagagggacctcctgacctggggcctgggctgtgtcctgcccatggaagtctcactcctcccttttctgtaccactgaggagtcccaccagggagagggaagaaagcgtggaaggccatgagaaagaacagtggggagcagcccagtgtcatggggacaggccttgggcatagggccgggcccgggggctagcctggggagggagcaaccatggtagcgatggctgagttcagcctgcccagagctcagatcattgatcatcaaaagcaatcgcagcttaaaggagacaagaagcatcagggaaaattgggtcagacagtgcttccctccactcagtctctcttcccagagatgggtcaggagcaattcccgctaagaggctcctaggccagagctagagacgccgcctacagcccaggtgccaaggagggcacatctggaggggggtgcctcttgcttttttaaccagctgcatgaccttttgaatgttggcatgggtgtctgagcctaccactcctttactgagaaatgagaatgaggtattctccatccagcattttccaaagcatgggaaatggaaggtgattcggtggtgcataaacatagctggggctgcactgcactgagcggtcccttcctagttccctttatgctttatggtgacctcaggaagaaagcctcacttgctaccagctttagcctgtctcacatttgctcatttcccttcagctcagagcttggcaggcaggagtctctctctagaatttgatgagttaaagtgtgactttgaaattgactttaaaaggactttaaactttttttttgtattcctattttagggttacctttgttcactgcagtagctttccatgagtggtaatagtataaggtcttctaaaacaaattttaagtgtaaaaaggagttaatttaaaggatatgactaagcaaataataatgcaggtgctgttcaggtgtagccaagatcgtgggagtagcctacagtgacttaagtttatgaaaactgtgtttactctcaatggttgattgtcattcactggaagacaataggtctcactacttgattgctactggaaatggccgaagaccaaatattgtaaaaccacagtgttcatcttggcggagaggcatcgccagtcattacctcaggtgcatcactcttctctgtggtccgtgatgatacttaaaaatgtacaaacctggggcatctttaagatcagttggtcatgatgactttgaaatttttctaggctattttgaaattttcctaggctatttgcatagtcaatctcttggccaggattttatttcaattttgtatttactcattgacgtatttttatttttttaaactaagagcaatgccgcccactgtggggagaaaatcagacatagaagtccagtatgtagaccaggtggaagggggaccccacctggggctgccacccctcactcaatgggcatttatggagcactttctcgtgcatggctctgacctaggcgtgcacttgacccacgatcagtcaaccttttctgtaaagggccaggtagtcaatattttgggcattggagcccacatggtctctgtcacaggactcagctctgcctttatagtgggaaagcagccacagataagaaatgcatgggccgggcacagtggcttacacctgtaatcccagcactttgggaggctgaggtggatggatcacaaggtcaggagttcaagaccagcctgaccaacatagcgaaaccccgtctctactaaaaatacaaaaattagccgggcatggtggcacgcacctgtagtcccagctactcgggaggctcttgaacccaggaggcggaggttgcagtgagccaagatcacgccactgcactccagcctgggcgacagagcaagacttcatctcaaaaaaaaaaaaaaaaatgcatgggcatgggcctgatccaataaaactttatttacaaaaccaggtggagggagggacttggcacactagccgtagatggcccaccactgtaccaggctgatgtgattcctgcttttcagggatcccagcctggtgggggagacagtgagggagtggagatgtggataaatgtgtaacaccagccttatctgtgtgaaggaaaaactatgggcaacaggagagggggcagtgtgcagccagggtgtccctcccagcaccatcaggcccaggctccctcctttgtcaaagcctatggggtagggagaagggaggccaccatcagctcttatccagaaccccctgtgtttccctgagggtagggctcagtggtttcacaaaccaggctgctggagaggatggggtggggcagggatgggagctctgtgtctcctccacccaccttcaaacagtactatcatcagcagtccgagtctatctgtttcatatattgggcacctgtgtaagatttttatctgagaaaagccttctgccagtttcaaaatcctgacagccacatctcaggatcttccgatttgatttctggcatctcccctgggtaccaggccctcccccttcctccttggcactgtgagcatggttcttgggctcagtgtcagggagatccccacttctcctgatggccgatgggttttaactcccttttcatggtggaccctgcagccagtcatgtgttctccttattttggccacgtagaagctcagggccgaagtcgggcaccctctgatgcatgggcctccctgcattcttcttgcctggaaattgccattttcagattcaaaatttccctgttttgaacttcctcagttattcacattgatctttttcataccttatcttttttatgcctttatgcattatttggttcactgttctaggctctggggctctgccctgtggagctttcaggataatgaaaaagtctggcactagtcattcatctgacaattagatgcgagcttggctgggaaggcacagctgctgagaccgtgtgctgcagagaccttacctgctcaaggaggtcaggcgatgcctgcctgaggaagatgtgctccaactgcccctgaaggaggaagggtggtagctggaggcaggagagaggcattgcatgtgcaaaggccctgtggccaaaaggagttccatgcagagcaaggagtctaaggccagagggaggttggaaaggggaaagggacaggtcagggacttcaagtggcggggggtggggggggggtgccgtggtcacatcttcagtgagaaaacagcattctgactgaagcaggatagctggatgacatgggtgaagaatggacacagacccctcccatagtgcagccaagaggcagctcagccagggtggaggtgggagacggggaggaacaagggcatatctgagagtgtctaggacggggcacccaggtgtttggcttgtgtgcctgaaacaccatgcaccgagacagggtgggcagcagaggccctaagctcacgctgcaggggttgggtctcgggcttttgggacccacaggcccttggtggatttggcttgtagcaagtctgaagcttcaggggtttggagctggtggtctgtcaccagcttctaagggaaaattacaggctggagcagtggccattaagaagcaggacatcagaaccactggccctcgatggaaggaagggggtcttgtctgttttggacagcttcaggtgtagattgtgtcatatgttggtgtatgggataactgtcagatgtggctcccatccaatgcctgagcctttctccctccctttctccctccctttcctcctccctttcttccttttgtccctccctccctttccttttttcctttctttccttccttcagttcctccttcctttcaccctctccctccttccttcctttcaatagtagatgagttcaactaaggagagtgagggaaaaggagggcacgtcgggggtttgtgtgggaaaggtctgaagtcatcactgtggagagtagagagcagctgagcagagaccacaacaggcggtgttgggctcacggaggtcagtgattcggaatttatactggatcaagtatctcctgtaacatgacttattctttcttcttgagtgaattttttaaaatcatcttaatttttgtgttgtggaatgaggggatggggagagggaaggggtgaaaacttgggaaggagacagagagtaaagagagtgtgagcgcaagaagagttgatgggttgaatgaacatagccgcagacagaggtcgagatgggccagggagaagatggctgggtggaaagtgagagataatggtggcttctgtggagagtcggggctctccatgtaagctggaccacagatgaccagtttcttgggtggaaaggaaagagaaagatgtgcagggtggaacgattaatctatgtgagggcagcacgtttctttgggaaatggctggatgcgcaaggtggcggtgctatagggggatggagcagaggctggaaatgaggttgttgggtaagttgaggcaagtataagaaagcccatgcaggtttgggtgatgtttaactttcctttaggtgctgttcagttaaaagatcgtccggggcatctgggtcagaatgggagcaacatcagggagttgtggagcatggtggggccacagcggccctgggatttgctatattgggtcttaggaattggctcttttaggtttaattttgttatagttactacttagagattattgtagagtcaagccttgccacagaatttcactggggttaccactgggatgtcaaatgtgaagatgtgataaagtcctattctttaagatgagtttggaatcactctgtaagaacaaacgggcctcatttctttctcaaactttaagagatactgaaacatccaggttcaactggggcctgcttggaagagggaagccttgctcacagcttgtgtgtcagcacttccaggcaggggtccctggacactgcctgcactggggatgctttgacactgaacccacacagactttctgcctgggctcacttgcctctgtgctgtctctgggctcttccatatgcctcctccagcaagctgcaccctgtgggggaacaaagtcccccttatcttgtcctttggttatttgtcccacttttctttttcagagggccactgccaaggcgacaagtcaatattctgtaggatggaagtcttgtcccgctattgctccatcccaggctacaacaagctgtgctgcaagtcctgtaacctgtacaacaacctcaccaacgtggagggcaggatagagccaccgcctgggaagcacaacgacattgacgtgttcatgcctaccctcccagtgcccactgtagccatggaggtgcggccatcaccaagcacccccctggaggtccctctcaatgcctccagcaccaatgccacagaggatcacccagaaaccaatgccgtagatgaaccctacaaaatccatggcctggaagatgaagtccagccacccaacctaatccctcgacgaccgagcccctatgaaaagaccagaaaccaaagaatccaagagctcattgatgagatgcggaagaaagagatgctcggaaagttctaataaaatggaaagatagcatccctagcatttttttcttgcttatagagatattccatgggatagcaaatcctgtgtcatggagatgaagtcaaaattcctgattccaaaaggttttgagaaaacaaagagggggaatgacgtaagaaagataggcatgagcatgtggtaactaggttagcacgtgtgcttcccagcccaggagcgaccaaatactgtggtggcgtcaggtgtgcagtggagaggaatatagaggctgtatggcctccctcagtgagggcagggcaagagggatcactctgagagaacaaaaataggccccaagttgctaagcagtgattgggaaccttcctttccttggcggagatgcatgacattccctaccgatccccagacacagcctgtgggactcttaggagaaatggtgatttactgaataactgacccgttgccgagatgagtacaatgaagtggaggtgatgaactcaaatcgtcttccagggccaggcggctgaccggggtgagcgtagtggcccgctggggaccatggccgccctgacagccacacccacctggagctgacttggttctggctgttgctgccactgtgaaatctgtatctctctccatctctgctctactatccccggccttgccagacagtgttctttttcggaagaagtctagatttttgcatgaaaaaaactcaatctttaaaggtcgactcagaacattttaaggaggcctccacttggtctgatgcagtcttgctaattaagaactaaaggccttctgaccttcttggtgctcatgctgtacggcatctgaatgtctcgaccgagtctgagccgtgcagctgtcctccacctgcgaaagtaatgagaatcctatcacgggacataaggataggtctaaacagggtccatgccaagaaaacagtggggtgctctcccaggcctctcccctgtccactaaccctggccttgccggctgccttccaggctctgggggaagagctcctgcattcttccctggccaccttggctccagggctccccagagagcctcttccctccccaagtacctgagaaagatgagagaggcacgtgctctgctgggaaggtccagtgagcggttcaagggcctggaatctccctacggccaagtctaagggttctgggattctgggctttgtgggctttgcttgcttgctgggaatgggctttccctgtcccgccctgccccacctcgcctctgtctctcagaagctccagaacccagcagtgacctgcaaaatgtggcctctgatgggggcttagggtgggagatggggagagcctacattgtcttttgctccttgaaaactttaatagctcctattttccagagaatggtgctttgtgagcaacatgcgagtaagagagaaataggaggaagggggagtaggggcggatgggagaagagtggctcatttttacctctcactgccttgacattttgtgaacgtgaagcttaaactttctgggcttacaagacccaggggcacgtcagctccttagatgggctcagcctgacacataattcttaaacctttcctgtttaagaaacttctagaggctgtgtactctcaccaatcctcttcgagaatttgttcatgtgtatttccccattatatggatgaggctcaggataacagcatagtggctaccttctactgagttttgaggtgctaataagtatgtttgtctgaggctgcacatgtgggtggctctgtgtgtatgatccaagggacaaaatgacgatgtaggaaccagcaagaacggaatctgggctgatgcttcagtctccacctgggtgatggctagcctcccgccctccaccaccgcatcccacacgtgctgcgcactgtccccgtgtctcctggagaaccaaactggagaaaacctttctgagtatctctcatagtaccccttccttaagaagatgtggtttagagcatgtgtg

SEQ ID NO: 17273 - DNA, 41126 bp, Human
ttctttgcctcagtttccccatgtatgaaatggaggtcatacccccatcttcaaagtgtggacacagtttataacacatgcaaaaagtattcaaaaaccatacaaatgaaagcgcatgacggacatccctacttacatgtctcataagcaatctcaaacttaacaggcccaagatgaaattctcaatcatcccccaacacctactcctcacctttcccacctcagtaaatgtcaccacttcagtactctgggaaccattcttggttttcctcaaccaatccatcatccagtcctattcactttttttttttcctcgagacaaggtctcgctctgtcacccaggctggagtgtagtggtgtgatctcagctcactgcagcctcgaattcctcggctcaagggtttctcccacctcagcctcccaagcagctgggactacaggcgcgggccaccacaccaggctaatattttgtaattttgtagagacggaatcttgccatgttgcccaggctgctcgcaaactcctgggctcaagcgatcctcccctttggcctcccaaagtgctgggattacagccgtgggccactgcaccaggcccttcattcacttctatctgcactgtcaccaccctaatgtaagcgaaaatcatctctcacatgataatgaagcagccaaaatggtctctgggcttctcctgtactctctccagtccacaccagggctctaaaccctttaaactacccactgttcttgaaagaaaccaaacttctgaatctggcttaaaagaccctacatgacctcttcccctgctgctccctcaaaccactctccccgtccctgaccttgtgccagcacactggcgtttctgtagttctcaactgtattctgtttcctcctgacaaactcttaatcatcctttgggtctcatttcagagctgggtccccgccatacactctcagagcaccctgaagtacttaagcatttgtgtaattattttattacaaaaagtataaaatcacaaacttaaaaacccaatcgactataagctccataagggtaagtactgtcatctgtttggttcacctctgtatccccaggaaaacagggtccagcacacggtctgggctcaatatttgaacccagacgaggtgaggggggacaaagtagccacctaaaaatcctaactcaaaaagataaagttctaaccgtatgtggatgcccattttgtttcaactctctccacccccattctcaacggctcaggccaaatcatacatgggaccagatacctcaggtctccaagctcaggcagcccccgctgtcttccaccccataaagttctaagtccaaagtgagcccgtcctagctctggggcgagagaaaacaggcctctttcgcccctgcaggtgagggtcccggaccgcccggaggcaggttcctcatccagacctactggccaggactcctccacactattccgtgcagccatgacgcacgcagaccgcagcacttcgtcagcgaagaagccgctgagcgcgaggcgcttcttcgcggcttctcaagcaccgttcaaaccgcgcgtcgggcccaagtgcctagcttcgagtcgcaaagcctcagatgtccaccctattcaaggagaatggactgaaaagacgacgaccccggtcctctctctttaagaaccacccccattcgagcctgacgggggctctcagtaaactcgcgagagccaccggcttccgcccgcttcctcctctcgccttgccgggccggaagaaaggtggcacctcccaccccccagccttacctcacaaggcggcgcggacccagctgcagccaatcggcgggctcattgtaggctgcggggcagagagccaatgagaagtcgcggcggacgcccagcttctcctcactcgcaccggccccctcccttccgcctgccgccttccactccgcccctggcggaggaagtgatgtcacaggccccatgtgagcggattgcaacacatgcagctgcctggagagagggagccggtgtcctacgtcagagccgccgccgccgcggagccgccgccggggaggagcagccgctgccgcccaggactgggcccttaggtaaggcacagggagggaaaggccggtgacctttgtggcgagctgcaccggacgggaggagagggcctctgggggatggcgaggaagggggccgctctgccccagcggcggcgctaactctgtggtcttggtgtctccgggccccgccgggccgctctagggaggaggaggcgagaagatggcggacgaccccagtgctgccgacaggaacgtggagatctggaagatcaagaagctcattaagagcttggaggcggcccgcgggtgagcgccgcgtccggcaccctccgtgccctcttggttcccggacccctcaggatggacgcccccgcgccgcatggccggatgaggagaaccaggcactagccaactcccgccttctggatctctgggtagtagcccctgacccaggggcgagggtcggcgcggttggcccgagaaggggtcctttccccgcatgggggtaaggggcccgcgctccccggtttagatcactcggcccccctcgtggtaggccaccgctacttttgcacctctcccgggcccttaagtccaggtcctccctcttcgggctccaggtgctgccacccgactcgggtgctattgtggcaaagtgttcggccttcctttcccagggcccttccctgatttcctcttctcccttcatttctcagccaggcctcattaaaatggcctctcccttctgggcttctgagacccgggtgggtgaagtttggatgggacgggaagcagaggtggccagggacagcttctttctgattcctgatttctctgggtcttccacctgtcccaagatgacttctcccaagtcctctaattaccccggagcttcctggttttagctgttccaggacccacctataaactgaaaatgccaacgtacgcgcgatgtgaggggtgctgggtaggttttggttaatgaatctgcatgtgtatgtccaggagaaatacgggttagggggccgtttgataggaatcataactacagagtccctgctggcatttctctgaaacttgtggggatatcgctgtagagaggcgcctgatgtgcttgatgcttgttgagtgagattcataattgaattaaatgggctttgagtcttgtacattttgataagaaactgtaggtgtgtccattggggggagagtaggctagattaaaattagctgtgtgtgtgtgttttcttttttttttaacgttgttcgtttgaggaaggtgtgccaggggtattcctgtttcttttattactttattttgttcctttcccagtcatagaaactttttacttacaggaagtgcccccccccccaaaaaaaagtgtttggaacattattacatacttgtatgtctgagcattcttagaatagtagaatggcctgcctcaggccatgtgaaaagttgatttcagcacaagaatttgacattctggtttccagcccaggattgtcatttatgggtagatttgcaattttagaatgacagcccctccaagctcttcattattactgttatatgaaacaggatgtgcttaattgtactgaaggcccaattcacaggttggttttactagtgttttgttcttaataaattagggacagttctgtttggaatgaggcttctaaaagtttggccccattcagtgacgggcttgtgctcactccttcggtttactggagaaacgttagtttaatatgaatcgaagacagcggcttgttagtccttaggtttttctttgaattcaatagaatatccagaccttcttaatgatcttacaggaacttgtgccgtatgatagagtgaccagttattcccaaaatgtgagaatactgtacagaaagggtaatataggtcacgacccattatgttgcactaccaagaattagccaggttcttttgtttcagtaggatcttgttttgttacttgaagccttcaatccagtattgcattttatagattgctgttgttgcagtattgtatataggtggatgtgacctctggatttgttcttactgctttcagtagcaggcaggttcacacattttaatttgcatacgttatattctctgaaacagtccaaaaaattaaatcatgactataatttgcctgtttgaatgaagtaacattgaagatgacattgcttaataagtaacagcattcctttctactgcttaatgaaggaaactcattcttaaatttgttctacccatgttacctagccactagaaacttttaagcgcctctttaaggcttttgaaggctttacctctttgtttagcaaagttcagtaaagtttaaagcatgctaaaaatgaagttataagacacaacttgtatttcaagttgttgagtttggatatttcagacatgattaagctgtctaaaatagctggaggaccttccgctacacattgtggttaataatcatgtcctactttgcttttaatcaggatttggttgcatcttgatcccatggaaatttaaaatcttggccatctctgagtattggtaagggagtcagaagattccccagtatataccagtttttggaggtgggaatattttcattgccaacttgtgttaaagtcagactctagattttcatagatagggtacagtggaaaatgttattcctactttacctagtgataaaatatctttagaagaattgtaatgggctttaaagacttaagtggatggcaaaatgaatctgtatttgctgatgttttggggatactctggttttcaggaggaaactgaggttttcaggcatggttattaggacaaggtagtgagacttagtggttgagtaacagtattgttttggaaatgaaaaagccctttcctccccttagcagtgtagaattctaggcataggaatcatggatttgtttttaacagtagttattaaaatatgctagaataagagtgattttgaaattaagataatcctatgtggttatctcttgatatatgacccaaatttaatgtagcttgaaaaaggaaccacctgcaaaatgggctcactaactacatctgaataaagggaagtatgttggcaaaataatttattaagcacatactatattatagactgtgctacagtacattattaagtcatttaatcctcacaagtattgccaccatttggtagacaaggcacctgaggctaagagataatttgtccaagatgtcacagcaaaaatgtagcagagttcagaacttaaaccaatgtgctataatgggtatattttattttcagaaaatacaaaactagatttccttaaaatgtagtctgagctataacagattctattttatgttacacgtgtgtagaagagcatttatagaggccacattactaaaatggggaacttcatagcattctgttttgtaaccagcatcatacttaatcttctgagttgaaaggagtgtcacacataaacttgatttttgatttgggtagaacatgcttatttggtttcagataagcctggtcgaatgttagtttgtgtgtgctagtaaaataaccagttaattattttggtagacataggccccacttaaagttgatggtagttcttccctgttcatgattgctcctggtatatgctccacagttggcttatgaaggacaaatgtatacataaaccaatactgtggttgagggtatcttgaataaggaactaaaacaggtcaacgtatgttggaaaaagggggagaattattggttgttttttcccttggtgttttctgagcaggcaagaggtggcctcagaaataatgttggacaccttatagttttaaggtaatgttaataaaatcataactagagcctgtgctagccagggacagtggtgaatgtgacaaaggaatggacagtgttaatttgggttaggttgtgtctgtgggtgttaaaatgtcttcacttatcttcactaggaaaccttatgtgtttcttatccaatgaacacttggtcagataaccctcataaccataacccttgtttgaaggtcagtgagcttgcaaacttctgctgtagtgtttggacattttaaaaactgtttacttaaaaataacttgttgatatcttaattctaaatgaaataaaattggttgttcctgcccccaaatataaccatttttaaagaatccccactgaattcctcacattatatagatttaacagtgttttggcgagatcattgaataggttaatgttttaaatcttagagataattaatatgaacagattgcttaatttatatactttgaataaattaaggtatgttggatgtgtttgagtaccttccccaagtaaacattgttggttaatagaatattcacctaaatggtggtggaaataatattctcaaagcactgaatttcacattctttttttttttccctcactatcgttgaagggctggttgtagctaaaatgatacattgtggtctttgatacaaatacctgaaccatttaaagttcaggctcataaagaagactttttttgtcctctattctggctctttccatgcctcccttcccccaaactgttggttagacaaattaataggccacatgaggactgggcacgttgactcacacctgtaatcccagcactttgggaggccaaggtgggtggatcacttgaggtcaggagttcaagaccagcctagccaacatggtgaaaccctgtctctactaaaaatacaaaaatgagctgggtgtggtggcttgcacctgtaatcccagctactcgggaggctgaggcaggagaaatgcttgaaccttggaggcgtaggttgcagtgagccgagattccgccactgcactccagcctgggcaacagagtgaaactctgtctcaaaaataataggggcccaggccgggcgtggtggctcacgcctgtaatcctagcactttgggaggccaaggcaggtggatcacctgaggtcaggagtttgagaccagcctgaccaacatggagaaaccctgtctactaaaaatacaaaattagccaggcatggtggcgcatgcctgtaatctcagctactagggaggctgaggcaggagaatcgcttgaacctgggaggtggaggttgcggtgagccgagattgcgccattgcactccagcctgggcaacaagagcaaaactcagtctcagaaaaaaaaaaaataataataataataggggcctggtgcggtggctcacgcctgtaatcccagcactttgggaggccaaggtgggcaggtcacaaggtcaggagatcgagaccatcctggctaacacagtgaaaccctgtctctactaaaaatactagccaggcatggtggcgggcacctgtagtcccagctactcgggaggctgaggcaggagaatggcttgaacccgggaggcggagcttgcagtgagccgagattgcgccactgcactccagcctgggcgacagagcaagattccatctcaaaaaaaataataataacaataataataaataaagaccacatgagaaaaaagtcaagaactagactattttaagttttgtgagaagagatgaatatagaacaaacaactacagacttctcactctttccaaattttggtttccacatgtgtaactatggacattaatcttggattaggtggtaacagttgagataatatgggttaaaatacttaacaccacatttgccacatagagagtgctctgtaatgttagctctttccttttgtatatacaaacattgattctgtagagataccctaatggagaactgtattattaaaagatcaggatacagatgccacaggtctgaactatgagaaagaggagaaatagatgagagagaaaagaggtagtaaagggaagaggacagagtatatatgttagaaaggatgtggtggtggtccttagtttcctccaagtatgtaggctgcctgcttcaactcagaactagtcctaacagccgttgtatctggcatggtgttctatgcactgtgaacctaatgaacaattactccctttgaatttcaagtcttgacagacctcctattgtaatagcagatatacttatgcttccagggaaggaaggcttactctggacatattgcaaggtaagcaagagtacataattagagtatcatttaaggcagagtgctgtgtaggttataggtctctcccatcctccacaccagttggaccctttcttcacagggctcgttttctttgaacttgagattgaggatcggcccagtacagcaccaccccctgtcctgggatggtacttcattgttaaaaaagttagtgtcagctttgcagcagggctataaatggtcttcgatcctatttgaagagtaggaaggagaaatttgccttcccactgctggatctgttcaactaagaggctggacagtagaaattacttctcagtccagcctattctctagggctctcagaatagaaccttctcctaggatacattctgtaggtgtcttttaattcttcagcagcctactatcttagtgagggggagaaggaattaggaaggttcaggctttttttccccggcaggttagaaattgagagtctgaggtttctcactgggtactgtcctcagagagtatgatgaagctccctctgatacggttttatcttatgccatttgacacacatccttgcccactctctttactcttctcacaatcctttcaggttcagaggacttgacattttcaggtgcctggcaactggttcttatcatacagatagctctgcatgttgagtttgtactcttgttttcacattttcatttgttcttctaagatctcctttagaagaatgatcatagtcaaaataaaaggttctttttgttttcctgctgtgtctgtgaccttataaactagattttcctccaaaatacacatctgggtatatgaatatgaagccagaaatgcacttttactattaaccagtaagctaatgggcttcaccaaacatctgctgtgagttgggcactagacattttggaagaaatatgtaataaaatgaaaacatgatctgccacacaaccatggaatgataatataaaccattttcaactccatattagtgagtacagaataacacagtacatgttgaaggggatttagtataagcagatgattaaggtctttttttttttttttttttttttttttgaggcggagtctcgctttcccgcccaggcttgagtgcagtggtgcgatctcagcttactgcaacctccacctcccaggttcagctcagcctcccgagtagctgggattacaggtgtgtcccaccaagcctggctaattttttctttttttttttttgagacggtcttgctctcttgcccaggctggagtgcagtggcgtgatctcagctcactgcaacctccacctcccaggttcaagcgattctcctgcctcagcctcccaagtatctgagattacaggcacccgccaccacagccggctaatttttgcattttttagtagagacagagttttgccatgttggcaaagctggtctcgaactcctgacctcaggtgatccgcccgcctcggcctcccaaagtgctgggattacaggcgtgagccaccgcgcctggccgaaattcatcttttattaaaaggaggttgcagtgagccgagatcgtgccactgcactccagcctgggcaacatagccagtctctgtctcaaaaaaaaaagccaattattcatccatgggcttcagtttccccatctgcttcatgggggaactaatgctttcttcttcttctttaaaaaaggtaacattggctgggtatggttgctcatgcctgtaatcccagtactttgggaggtctaggcaggtagatcactgaggtaaggagttcaagaccagcctggccaacatggtgaaaacctgtctctactaaaaataaaaaaattagttgggtgtgttggcacatgcctgtaatcccagctactcgggaggctgaggcaagagaatcgcttgaacccaagaggcggaagttgcagtgagccaataccagcctgggctatagagggagactctgtctcaaaaaaaaaaaaaaaaaagaaactagttttctgaggatgagtaagcatacatttgacctcccccccttataaccttataacagctctgtgaggaaagctattattgccatttcatggatgaagaaattaaagtacatacagggagtaaatagctgcctaatatcacagcctttagtaagggtcagtgccagattctgtactcacttttctgatttcaaagcctgtggtgctaatttgtacaacactaccttgccctttggcaagtatttcttttgctgaatagagacgtctcccattcccttctgaaaggaagactcttgtccatggagatttgtaatttagtaggaggagcaggtgtgctgagactcaggtgcaaagatttaaaagaaaacagacatgctatttccaccctaggaagaacttggatactgaacatgtttattcttgacgagcatcagtggagagagaaataacttgttgcaaaatccctccccaggagctcattcgtatattagaaagatctaagtagtgaagtaatgaatcccgaacactggttgtgattgcagtctcttgctttgcactgttgtaagaacactagagaaattttccagcttcaaagctgcttcctggtggaatattccactgggtttgtgaagatcttttaatttttctttttaagactaataatgcctatcattgtagaaaaagtgtacacactctaccagatgtgtacatttttgttttagatgactgagtaaatctttgttctctgggggatagaaagctaaaatgaacctttgtgaactttattctgaaaatgtttggacatctgagttattctgtaccctagggtggaggttgctgtaatgtctcagtaagttccggtcttggtatttctcccatttggtaatagcatctgactctaaggtcaattgcataaactaatttcaggtaactttcctagtccctttgaagggtaacagaatcatccctcctaatttgatagtctaactaaaccttttataaaaggcagccccatccacctcctaacatgcctcatagatggtagtagcagagggagtggggtggcattaatgtgaggatcaacaaaattaaaatgacacttcataagggttggttttgtttagtgctggttttcttaaggtaaacgcctaatatagtatgatggtttgaacttttaggtgcagtgaaagatggggacagttagtcaatttaaggcacattagttcctctccaaggactgacaatttgttgttggtttttgttttgttttgtttttgaggtggagtcttgctctgtctccaggctggagtgcagtggtgcgatcttggctcaccgcaaccactgcctcccaggtttaagcgattcttctgcctcagactcccaagtaactggtactacaggtgcgtgccaccacatccagctaagttttgtatttttagtagagacagggtttcaccatgttggccaggatggtctcgatctcttgacctcgtgatccgcctgcctcggcctctcaaagtgctgggattacaggcgtgagccactgtgcccggccagatttttttattggtattttatttggtagtttagaataaatctctggtgtttgcttaaaaaagagtatatagagatgatggtaggaattggccatttattcatttttcaaatgtttgagcaccactatgtgctaaaatgatttttgccctcaggatgcttatatacacttgggctgggcccggtggctcacgcctgtaatcccagcactttgggaggctgaggtggatggagaggtcaggagttcgagaccagtctggccaacatggtgaaaccctttccgtactaaaaatgcaaaaattagccaggcgtggtggtccgtgtctgtaatcccagctacttgggaggctgaggcaagagaattgcttgaacccgggaggcggaggttgcagtgagtcgaaatggcgccactgtactccagcctgggttacagagtgagactccgtctcaaaaaaaaaaaaagaagcttatatacacttactgtaaacaatgtgtttcattgtttgatacttggtggaagagaaaagagaagttgagtatcaggtccctgtgaagactggccataggttatatcagaatactgaactcatgccacacaagttttagaaaggaatgaatttctatggttctcccttatgataaattacagagtttccagtgttctggccatattatttttggtatagctcttttgttctgtggaagatttggcaagtcctgtaatcccgtaaaggtgaccatcatctgctacaaaaaatcagctcatacttcaggacctaacaggattcaaataagacttcaaccccatctgatattacctctctcccctccccatttctagttgggctgtgctacttctttccaactggtactactggtggaggggaggcgatagtcaagaactagagctccatctcattaccatttagtgatcagttactatctgctctccaagctaggcacttgacatatatgatctcgtagaatcctcatgatcttgtgaagtaagtagaaacagacccacagggatttgtgtggtttgccttcggtcacacggccattaagtgatagagctggacgtgagcctgaatctgggctcctcctattctgttcccatattaaccccatatcaaaaagaccatcttagtttaaaagtttaaacttagttttgcaaatttgggagaagaaaaatggaaaacacacagtgaataaaacaatgacagttttggaaatggagtagaaattgaagaggaactgattgattttcaggtggtgatccatgtaatactgctggcttagtgactttcccagaaatgatctggctgagatttatttatttatttatttattttattttatttttttgaggcggagtctcgctctgtcgcccaagttggagtgcagtggctcgatctcggctcactgcaagctccgcctcccggttcacaccattctcctgcctcagcctcccaggtagctgggactataggcgcccgccaccacgcccggctaatttttttgcatttttagtagagatggggtttcaccctgttagccagggtgatctcaatctcctgacctcgtgatccgcccaccttggcctcccaaagtgctgggattacaggtgtgaaccactgcacctggcctctggctgagatttaaattgagctttgtgaggcaggcacagatgggagcttgaaaagggaagtggtgaaaaatttggccatccatagcctaggcacaacccagccatcaaaccctgggatgaaagcttcttggggagcatgtactgtacatcccggttagggagtatagtaagcagtgtctaaaacgttcctggtcctaacctgaaagtagttaacgtgatttacaagtgatgacttggatggcagagtacttgagggggagtgagtgttcgggctggtaaagttgagtatctctgagctgtcacaattcattatggttgtattatagctaggttgtcttaggttttgggggttttttgatttttgtttttgtgctgctataacagaataccacagattggtgttctggtaagggcctgctctctgcttttaagatggcaccttgaacgctgcatcctttgttggggaggaacactgttcctctcatggcaagagaacaaaagagagatggcccactacttataagcaccttattttatcttttttgtgtgcgcgtgtgactgtagctctcaggtcttataagcaccttattttaaatagcagcatgaatctattcatgagggcagagccctcataacctaaacacattccatatgccccacctttcaatactattgcagtggggattaagtttccaacacatgaatttggggggacaccttcaaaccatagcatagggtaaatgcagcaagcaactgctctgggttcttcttctttgggtggaggtgaggttgtggaggcttgttaccttcagcagacctagagatgaccctgtgaagaaagcaagccagatgcagtgattctcaaccctagttctgcattagaatcttgcgtatttgaggccgggcacagtcgctcacacctgtaatcccaattctttgggaggccaaggcagacagatcacttgaggtcaggagttcgagaccagcctggccaacatggtgaaaccctgcctctactaaaaatagccaggcattgtggcgcgtgcctgtaaccctagctacttgggaggctgaggcaggagaattgcttgaactggggaggcagaggttgcaaagatcagagatggcgccactgcactccagcctaggagacaagagtgagactctgtctcaaagaaaagaatcagctgggtgcggtggctaaagcctgtaatcccaacactttgggagactgaggtgggtggataatttgagatcaggggttcgagaccagcctggccaacatggcaaaaccccatcactactaaaaatacaacaattagctgggcgtggtagtgggcgcctgtatcccagctacttgggaggctgaggcagaagaatcacttgaatccagcaggcagaagctgcagtgagccgagatcacaccactgcactctagcctgggtggcagagcgagactctgtctcagagaaaaaaaaaatctttcatatttcaaaattgagactgtctcaaccaaaatcatcaccaccctcactctccctattcagaaactattgagtcaggatggaggaagaagggatcttttgtgtctgagcatgtattcttttattttgcttctttagaaagctctaaaaggattcagggctgggaggtatgcaaactgaagtgttcttgagcattgttgatgatggtgaacattgattaagatccttgtgggtcaggcgggcacggtcgcttgcgcctataaccttagctgctcagtgagtctgaggtgggaggagtgtttgggcccaagagttcgtgaccagcctgggcagccttgtgagatcctatctcgaaaataaaaagaaaaattagctgagcgtggtggtgcgtacctgtagtcccaggctagggtgggaggatcacttgaacccaggagtttccaggttacagtgagctgtgattgtgccactgcactccagtctgggtgacagagcaagaccccatctctaaaaaaattatctttctacttgagttttgtttgggatttatttggtttagttctgttacaattcctttttttcacctgtttgatttttcagacgttaaccctctgggcgaagcattgatgaaagctttgataagccaaagtgcccctaaaaccaatgagaacaagaagagaatctgagtgcagaggcccctgggagctttgagggatacattgctgtatgttgtctcttgttttgcccagtttttacaacctgcatgtgacacattgctgtaccccatgattcactagttctttgatttcggaagaggagtatagggatagtagaaaaacgaaggaaaactattacagttaaagaaggttgtagtttgcctgtgtagccagcatctccttagtgagagctttatttttcattttcccctgaagggtgttcactttaaaagacatggaagtattcagcttccttaattttattttgggtgtttacacaaactggtctaacaactttgattgacttgcaggagtgagggtaaatgaatgtttatcttgtttggaaactttactggaaaaacgttaatctgcttgttttttttgtttgtttgtttgtttggttttggtttttgttggttttgtttttgttttttgagatggagtctcgctctgtcacccaggctgtagtgcaatggcgggatcttggctcactgcaacctctgcctcccaggctcaagccgattctcctgctgggattacaagcatgcactaccacgcccagctagtttttgtatttttagtagagatgggtttcctcatgttggccaggctggtctcaaactcctgaccacaggtgatccacctgtctcggcttcccaaagtcctgggattacagacatgagccaccatgcctggcccagtctgcttgtattaaacctaacatacaaaacatcagaagttattaaagtaccctttaaatttttaaagtgaaagccatccatttaataatctgcatttcccctccctagtcaggtgtcttattttaaaggtaaattcagaaacttaatgtttcccccatagaaggtagggggagggggcatgcagggaaactagtgaaaggtaattttttgcacctaattcaaaaggaataagaagccaagaccaagtttcaagttttgtttcatttatcaactttgtagaaatctaccaaacaaaaaacaattcttaggcaagctacacttttgagccattttttaaagtggaatcctataacaagattacattcttaggtgtatttgctccttggtcctctggaatgttacatggatatggaatgtaaggttgcccaactgggctatacagtagggttgcttaatgaatgtttatcttcttaaactatcagcagtggaaagtaagtagctgcttatcttaaggtcattgctttgccctccacatcattatcttatttgaagggttgctgtaaggcattttgagttctctcagttaatttgtcccaaatttctcccctctttagccttaaacgttccaaatctttggggtttgttgcctgttcttcctcagctctgagactttacctttgccatccgttttcattccattccctgccgactgcatcttaggaaactattctctgtaagtcagagcatgtcggctttttaaaaaaccaacaccttttaagaaaaaacttccagccgggcatggtggctcacgcctgtaatcctagcactttgggaggctgaggcgggcggatcacctgaggtcgggagttcgagaccagcctgaccaacatagagaaaccccgtctctactaaaaatacaaaattagtcaggcatagtggcacatacctgaaaccccagctactcaggaggctgaggcaggagaatggcttgaacccaggaggcggaggttgcagtgaggtgacatcgtgccactgcactcctgcctggggaacaaaagggaaaccccctctcaaaaaaaaaaagaaaagaaagaacttcctacaaacccctagggttgtaggccccttgagaattggcttaccaagcataagccagtaaaattggtactcaagtgttttccccatcttttatctcttcgtattctccctgtgcatgagtggacccctgtgtcaggtaggtggcacctacagtctagattgtgatggaagttctgtttagttgcccagtgtttccagtctcttccaaagcaagtatcttttctctccattggcatgtatgtagagtttgacataactccagaaggaattatcaaaaaggttttttggaaattacagtttagaagcctagcaagtgttggtgatgataactgaagcagtgtatcataaatttccttgattccgtggtttggccagaatgcttgctcccctatccaaggggtggcagcagagcacacaccatactgtcctgtgtactgtctttgattagcttgtaatttattggggaaaatagcacagaagtttatgaaccagccttcaaggtagacacccaaacagaattctgatttttggatatgtaactttggctgccaatctgagagtagctatttttgatagtgggaggactggacagccagctcatctagttagaaagaaaactgttttctgggccgggtacagtggctcacacctgtaatcctagcactttgggaggccaaggcaggtggatcatgagctcaggagttccagaccagcccgaccaacatggtgaaaccacatctctactaaaaatacaaaaattagaaggtcaggcatggtggctcatgcctgtaatcccagtactttgggaggctgaggtgggcggatcacaaggtcgggagatcgagaacatcctggctaacatggtgaaaccccatctctactaaaaatacaaaaaattagctgggtgtggttgcatgcgcctgtagtctcagctcctcaggaggctgaggcagaagaattgcttgaacccaggaggcagagcttgcagtgagctgagatggcaccactgcactccagcctgggcagcagagcgagactccatctcaaaaaaaaaacaatagctgttgggcatgatggtgcatgcctgtaatcccagctactccagaggctgaggcaggagaattgcttaaacctgggaggcggaggttgcagtcagccaagatcatgccactgtactccagcctgagcaacagagcaagactccatcctggggggcagggggtaggcgggaagaaaaccattttctgcctggaaaacctgtggaattaaccactaggagaaaacttccagggcaagaggtcctgttaatgagatcccttcccaatgcaaataccgaagacactatagtacacgtttatgaaattttgctttatgaaaataagctttctaggacccaatttgagatattttcatattttaaacacctgtagttaaaagctaatatagggggtttattttcgttcccctcacagtgctgcttctgttcttactagtcacttaacacgtaagcccatttaatttgactctgtaaccagctttctgatttctttttcttgccagcttccactggactctggataggtgagattttattaaagctggcatattgggctactgtgagatgatgcactctcagtaattaggggaaagtttagatggttctggcagtctaactacaatattaaacttatataccctttaagggtatagatccaataatctataaggatctcaggaagtaactttcttacagtctcgtgaaatatcagatagaaacagtttataaagtgataacacatttctttttttttttttttttttaaacagagtctcactctgttgcccagactgaagtgagtggcgtgatctctgctcactgcaacctctgtctcccaagttcaagcgattctcctgcctcagccttcaaagtagctgggattataggcgtgtgccaccacacccagctaatttttgtatttttagtagagatggggtttcaccatcttggccaggctggtctcgaactcctgacctcaggtgatccacccgcctcggcctcccacagtgctgggattacaggtatgagctaccgcgcctggccaggtgatactgcattttttagtgtgcttcggttcatatcagatcagcctttgccttcaagatgtaagtcagctcaatttatactggtagctattgtactaaagccagcctttagatcaggtcagggcagatttgggatttctagtttcctatatgttgtagatttgattctgtttatactgctgcttgttctccttataaaattattaataggccagacatggtggctcacgcctgtaatcccatcactttgggaggctgaggcaggcggatcacgaggtcaggagttcgagaccagcctggccaacatagtgaaaccttatctctactaaaaatacaaaaattagccaggcgtggtggcgcacgcctgtactcccagctacttgggaggctgaggcaggagaatcgcttgaacccaggaggtggaggctgcagcaagccaagatcgccccactgcactccagcccgggtgacagtgtgagacttcatctcaaaaaaaaaaaaaattattaatagtaagctggtttttcttaacatgataaaattagaatttattgataatttagtaaaaacacaaattactacttctcgggaaaacatgctttggcttttatgggggaaactgtcaggttgagaccaagagacattaaaagaaatatcctgggtcctattatttttagtcatgatgaatgtattttgtataccatcttcatataataaaattaacttccaaaaatgtaaaaaagaaaaaaaaagggaaaggaaggaagaaaagaaagaaagaaatatcctggccgggcacggtggctcatgcctgtaatcccagcactttgggaggccaaggcgggcggatcatgaagtcaggagatcaagaccatcctggccaacatggtgaaaccccatctctactaaaaatacaaaaattagccgggtgtgatggcgtgtgcctgtagtcccagctactggggaggctgaggcaggagaattgcttgaacccaggaggcagaggctacagtgagccgagatcgcgccactgcactgcagcctggtgacagagcaagactccgtctcaaaaaaaaaaaaaaaaaacggaaagaaattttttttttttttaagagacacagtttcactctggtttccaggctgaagtgcagtggtgtgatcacggctcactgcagcctcaacctctagggcttaggtaattctcccacctcagtctcccaagtagctgagattacaggcacataccaccatacttgcctaatttttgtagagacaggtctcactatatttttttggtttttggtttgttgttttgtgacagtctcggtctgtcacccagtctggagtgtagtggcacgatttgggctcactgcaacctccatctcccaggttcgagcgattctcgtgcctcagactcccaagtagctggaattacaggcgtgtgccaccatgcccaacttttttttttttttttgagacagagtctcactctgtcacccaagctggagtgcagtggcacgatctcggctcactgcaccgcaacctctgcctcccaggttcaagcagttttcgtgcctcagcctccagagtagctgggattacaggcatgagccaccacgcctagcacacccagcaactttttgtatttttagtagaggtgaggtttcaccatagtggctaggctggtcttgaacccctggcctcaagtgatctgcctgcctcggcctcccagagtgctgggattgcaggtgtgagccaccatgcccagccagggtctcactgcatttcacaggctggtctcaaaactcctaggcgcaagcagttctgcctcaagcctcccaaagtgctgggattaccagtgtgagccacctcgcccagcctttcccctttaaagtgcattatttcactgtttttccagagttgtgcaaccactaattttaaaatattttccttaaaaaaagaaaaacagtatttccatcaacctaaaaatccctgtaccctttaacaatcactctgcattcctccctctcctcagcccctggcaaccactaatctacctttgtctctctggaatgcctattgtgaacattttgtgtaaatggaactatacaatatgtggtgttttttttgttttgagacagtttcactctgttgtcaggctggagtgcagtggcgtggtctcggctcactgcatcccccacctcccgggttcaagcgattctcctgcctcagcctccccagtagctgggactacaggcacatgccaccacgctcggctaatttttttgttttttccttgagacggagtctagctctgtcatccaggctgcagtgcagtggctctatctcggctcattgcaacctccgcctcccgggttcaagcgattctcctgcctcaccctcctgagtagctgagattacaggcacacaccaccacgcccggctaatttttgtatttttagtagagacggggtttcaccatgttggtcaggatggtctcggtctcttgacctcgtgatccgcccaccttggccccccgaaatgctgggattacaggcgtgagccactgtgccctgtctacaatatgtgttcttttgtgacagtttttacttgatgtagtgtaagggtttttttgtttgtttgtttgtttgtttgttttgagatggagtcttgctctttcgccccaaccagactgcagtggcgctatcttggctaactgcaagctctgcctcccgggttcacaccattctcctgactcagcctcctgaatagctgagactacaggcgcctgccactgcgcccggctaattttttgtatttttagtagagatggggtttcaccatgttagccaggatgatctcgatctcctgaccttgtgatcctcctgcctcagcctcccaaaatgctgggattacaggcatgagccaccacacctggccaatgtagtgtaagttaatgcaatatgtcatttattttattgctgaatagtttttagcatatgaatgtaccacattttgattattcatttatcagttggacatatgggttgtttctttttttcgtttgttttgtttttttttttactattatgaataatgcctccatgaacattgaagcacaaatttttgtgtgttacatattttgtcagttctcttgggtatctaactaagagtagagtggttgggtcatatggtaactctgtgtttaaactcctaaggactgccagactgttttctggaagtattgtaccacttaacattcccaacagcattgaatgaagatttcgatttcttcacatgctatgtctttgtagaaatgtctcctcacaccctttgcccattttttatttgggttttttgttgatgaattatgagtttttacatattctttatattctttacataaatcttaagagataatatgatttgcatatattttctcccattctgtgggtctttttactttcctaatgctatcctttgaagtccaaaggtcggtttttgggtttttttgagaatgaaagcaagttgattagagaagtaaaaaaaaccaaaaaaacaaaaaacaagagaatggctactctgtagagcagcctaaaagtttttaattttgaaatccacttgatgtagatcatctaatattttaaatagtcgtttatccatgttgtgactaaactaagaaaaatcaggatgagaaaagaaatgaaacttacaggaatcctttttgaaaaggaatcacctagaatgaactccccaggtgattttcatctgcaaaaaattgagaactgaactactgttttggggaagtgcatgctctaaaaaattttaacttacaggctgggcgcggtggctcacgcctgtaatcccagcactttgggaggctgaggcagggggatcacctgaggccgggagttcgagaccagcctggccaacatggtgaaacccagtctctactaaaaatacaaagaaaattaactgggcctggtggcacaagcctgtaatcccagctacttgggaggctgaggcaggagaatcgcttgaacctaggaggctgaggttgcagtgaactgagatggtgccactgcactccagcctgggcaacaagagcaagactccatctaaaaaaaataaataaataagttataaatggactaagtagttgatttttaagaatttttttcgttgtaaaaaatacataacatgaagtttaccatcttaaccatttacaagtgtatagttcagcagtattaagtacattcacactgttgtgcagccagtctctaggacttttcgtcttgtaaaactaaaacaactattaaacaactgcctagttccaccttactccagttgctggcaactgcatttctactctctgtctctatgaactttaatattctaggttacctcatgtaagcagaatcatacagtatttgtccttttctgtctggcttatttttcttagcataatgtgttcaaggttcatccattttgtgtgtcagaatttccttcctttaagactgaataatatttcattgtgcacacacaccacttttttttatttgttcatccaccagtggatgtttgggttgcttccacctctaggctattgtgaataatgctgctatgaacattggtgtgtaagtccccgctctcactcttgggtatgtaattgaaagtagaatggctagatcatatggtaattaggtgttaaaaaaaaatttttttttttggaagagctaccacacttatcccacatggctgtaccattttatattcccactggcaatgcacaagggttccaatttctccacatcctcaccaacactttgtttccttccttccttttttgagacagtcttatactgttgcccaggctggagtgcagtggcaaatcatagctcactgcagtttctaactcctgggcttgagtgatattcctgcctcagcctcctgaatagctagggctacaggcctgcatcacgtgacacccagctgattatttattttttgtacagatgggggcctcattatgttgcccaggctgttctcaaactcctggactcaagtgatcctcctaccttagcctcccaaagtgctgggattacaggtgtgagccactgtgtttgctttgcatagaagtaggaattttccgatgagatatttcttgactggtagtgatgataagtgtctttggaagttgtagacaaaaaagatatgttactggcattggtgttgaaatttaaagggggcttaaaaatgggttggtaactgctcagaagggacctcccatgtggcagggccttgatggtatttacccatttcctttagattttctagtttatgtgtatggaggtgttcataagggtctctcagaatcattctacttctgtgagatcagttgtaatgtcacctttgtcatctctgactgtacttatttggatcttctgtcgttttttctttgttaatgtagacagtggtttatcaatcttgtttatgctttcaaaaaaccaacttctggttaagttgattatttccctggattttggggtcttaattttgttcagttctgctctgattttagttcttttcttttgctaggtttggaattagtttgctcttatgtttctggttttccaagtatgatattggatcattagtttgatatctttctgacattttgagatacgcatttaacaagtgccccataaacatatgaaaaaaatgctcaacatcattaatcagagaaatccaaatcaaaaccgcaatgagacaacatctcacacacatcagcattgttattattaaaaagttaaaaaaccaaaatcttccataggtcagattttggtcccgttttttagttctaaaaacttgagtttggttgggcacccagaatttatcaggctgtcagtcattcctccttttaatcaaactcaaatgcaattaatatgttgccatttaaagagaatgagtttgtgagagagagatttttttttttttttctcgagactaagtctagctctgtcgcccaggctggagtgcagtgacatgatctcggctcactgcaacctccgcctcccggattcaagtgattctcgtgcctcagccacctgaatagctgggattacaggcacttgccaccatgcccagcgaattttttttttttttaattgagacgaggtttcactctgttggccaggcttgcctcgaactcctgaccttgtgatccgcccgcctcggcctcccaaagtgctgggattataagcgtgagccatcgtgcccggccgagagagagagatttcataactgggacatttctgtgacttccacagttctcctttcccatcattagaatactaaattcttgattacaaatatgcctagactttggaaagactcattgcatcatcctgtcatggcgtctcccactcaaccaccacatttgaaggctctcccacggacagattcactaccaaattccagcctgttgacactccttatttatcatagatagcttctttctttaggaaatgaggtgtttctcaagtatctctccaagtgtattctttacataacttacctcactattcaatcaaattgagcactagattctgaacactgttcctaactctgtgtatacgttcataaacaagactaatatagtccctacattactcctttgagagtgacctgtttccataactttggggcatctccctgtagcttgcttttaccagagagaaacatgagtttacttacatgatatttaaatccctaatgagttattctttcttccacagcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaaggtaatctggagtttgctccttttccttctctacacattttggttatgttttatactgtgatgctgctatggtgctttgttcactaatgttcccttaagtcggctgtcatcagtgtctctttggccttggtggttagcttttttgttttgttttgttttttgtttattgaaagttaagtaggccaggcacagtggctcatgcctgtaatcccagcactttgggaagctgaggcaggtggatcacttgaggtcaggagttcgagaccagcctggacaacatggtgtgaaaccctgtctctacaaaaaatacaaaagttagccaggcctggtggcacacacctgtagtcccatctactctggaggctgaggcgagagaatcaactggacccgggaggtgggagttgcagtgagccacgatctcgctgctgcacactagcctgagtgacagagtgaggcgttgtctcaattttttttttttttttttttttttgggatgagacagagtcttgctctgtcacccagagactgaagtgcagtaatccgatctcagctcaccacaagcctcccaggttgaagtgattcttccgtctcagcctctcgagtagctgggactacaggtgcccatcaccacgcctggctactttttgtatttttcgtagagatggggtttcaccatgttggccaggttggtcttgaattcctgacgtcaggtgatccgcctacctcggcctcccagagtgctgggattacaggcgtgagccaccaccacgtccagcctgtttactttaaagaataaatcgtactgaaacgtctcagaagaagttttaaaattagggagagagttctgcctgagagatttcaagctttttctgctttatttaaattatgacttaaaggatcaggcagggaaaataggctatgggaacattttctattaattgacgaaaaactagatatggggtaaagtagaaaaattgtttgtgttctttgcagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggtaagaagtcaaacccagaacattttcatcgctccagaattctttccccgtacccattagcagtcagtcccccatccctcccacttacctgtctcattctaggcaaccactatattttctttccatagatatgcttgtgctgtacttcttttatttttatttttttatttttatttttttattttttttttagacggagtctcgctctgtctcccaggctggagtgcagtggtatgatctcggctcactgcaagctccgcctcccagattcaagggattctcctgtctcagcctcctgagtagctgggattgcaggcacatgccaccacacccagctaatttttttgtatttttagtagagatggtgtttaaacacattggtcaggctggtctcagactcctgacctcgtgatccacccaccttagcctcccaaagtactaggattacaggcatgagcaaccccgcccagcctggacattttatataatggaatcatatagtttgtggccttttgtgactggcttcttttactttatacttttaaggttccatgtggtagcattcatcagtacatttcatcccttttgattaccaagtagtattccattgtatacctatatgccatatttcatattttatatagcttctcgtttcatcagttttacatttgagtggtttgcactgtttggctgttctgaataatgctgctgtgaacattcatggacaagtttctatgtgaccatacattttcatgtttcttagatttgtggaatcgtgtaggttatatagtaattatgtttaactttttaagaagttgctagactgttttccaaaccgttgtaccattttacaaagctgtctgttttcaaaaagtaaggcaatttacatttattatgacactagtcattcagcatgttttgagacagagtctcacactgtcgcccaggctagagtgcagtggtgcaatcttggcccactgcaacctccatctccatggttcaagcgattcttgtgcctcaagcctcctgaataactgggattacaggtgtgcaccaccatgcctggctaattttttgtgtttttttagtagagacagagttttgccatgttggccaggcctgtcccaaactcctggcctcaagtgatctgctcgcttcagcctcccaaagtgtgtgtgtgtgtgtgtgttttgatttttgtgggtacatagtaggtgtatatggggtacatgagatgttttgatacaggcatgcaatgtgagctatcacactatggaaaatagggtacccatttcctcaagcgtatatccattgtgttacaagcagtccagttatactctttgagttattgcactcagttttcacataacaattgtaaaatttttagtagcagaactgtaagaactcattttcccccctttcccctgaaacttttgagtgacaaagctgccataggatgaacttgaacagtggaaaggaaacctcattagagtgacctaaatcagtcaacagtagaacaatcaagaattcacagctggctccttagttcattctcttgcctttcatcaacctagggaaaaacctctacagtggaattagaactgacatttgtcgacagtttacagtggatgatttttgctaacttgatgggaagtccatttatagttggatcttggtcgactgcatagacaatccagactgtttttctcttcactaccacactctacttacagcagagggtttttcagggagcctctcagccactgaaaccacttacctgtatctggttggatgaaagccgattttgaatcttgttgatttaaacagtgccaggtacccatgttgtctggcttttgctcacttactgagttagccttgttggcttttttccaaaccttaactccttttctaagatactgtttaatcttgctaactttgtacattttagctttaactgagagggttatatcctgtttatcagggtaattatatattctaataagggatatgcctattccctgataagcagatttattaaaaacttcaatctacctaacgggtcattttgataaggctatattattaacgtgcaatattcatattcatgtcttttttctttttctttttcttttttctgagattgagttttgctctgttgcccaggctggagtgcaatggcacgatctcggctccttgcaacttccacctcccgaattcaagtgattgtcctgcctcagcctcctgagtagctgggattacaagtgtgcaccaccacgcccaactaatttttgtatttttagtagatgagatttcaccatgttggctaggctggtctgaaactcctgacctcgagtgatccacccaccttggcctctcaaagtgccattgcaggcatgagccaccacgcccggccacaatattcatgtcttaatgccaactatctagcatggtttgttaaagatggattcttagttgatccatctgctttctagtcaattattgaaggggctattttcttaaaatggaatggtaaggccaggtgttgtggctcacacctatgtaatcccagcactttgggaggccaaagaggaggatcagtttataaaaataaaatggaatgggtaacaatttcttacttccaaagagattgtcccctggcaattagagatcaactaagtgtgtagtattccgattccactgtgagaactcttatctatgtatgtcccaggactgtttcaatattttctctttgggaaggcataaagggatataaagttaacatagaaggaaggttttcctcataaaactcagaatcattagctgcaatacctttaaagacatgctggctcatgcctgtaaccccggcactttgggaggctaaggcagaaggatcatttgagtccaagacttcgaggctgcagtgagctatgatggctactgcactccagcctggccagcaaagtgagaccctgtctcaaaaaaaaaaaaaaaaggaacaagttaaagtttttttgttttttgagacaaggtctctggatcacccaggctggagtacactggcacaatcttggctcactgcaacctacacctcccagactaaagcctttccaagtagctggtagggactacaggcacgtgtcaccacagccacctaatttttgtatttttttgtagagacagtgtttcgctacgttgcccaggccagtctcaaactcctgagctcaagccatctgcctgccacagcctcccatagtgctgggattacatgtgtgagccatcatacccagcttagaactctatattataaaactgaaactgtatccattgagcaataattccttgttcccccttttttccagcccctggcaaccaccatttgactttttgtctctgattttgattactccaggaacctcatataagtggagtcatacagtatttgtccttttttgacagggttatttcacttagcatgtattcaagtttcatccctgttgtagtgtgtttcaaaattttcttcctttttgagattgagtagtattaactgctgtatgtaatattgctataaacatgggcatacagatatctttgtggttttatatttacatgcccatgtcaaatgtgttgaaaagcttcacatagatatcattcgttatttccttattgggttcaaatttgtccataagagttacatgtttataactgaagtctataaattattccgtagaaggttttcccacagtgctaatagcatggtgagtggagtgaaagggcttgtatatatcctttcagagtttttttgaccttagcaaagctttgggattcaccgtgtggtacttgtgtttgcttttcaggctcttacagcactactttcagatgatagcaagtttggattcattgtaatagatggtagtggtgcactttttggcacactccaaggaaacacaagagaagtcctgcacaaattcactgtggatctcccaaagaaacacggtaatacaggaggagaacatgaacccacttactttgtgtctagcaataagaaaacagtatggtgggccgggtgcggtggctcacgcctgtaatcccagcactttgggaggccgagccgggtggatcacgaagtcagaagttcgagaccagcccggccctgtctctactaaaaatacaaaaatgtgacgggcgcctgtaatcccagctacttgtgaggctgaggcaggagaattgcttgaacccgggagacggaggttgcattgagccaagattgcgccactgcactccagtctgggcgacagagtgagactctgtctcaaaaaagagagagagagaaaacagtatgatgtgaggggagtgaatccagatgatggggagagaagcctcctgtaatgactggtgcctcattggtacttacagctcctctcttgacatagacttagtagtcgctctctgaaaacaagtagcagtttatgctgaacgtttagttaagggaatggtgatttttctttgtccttttcttagatgatgacatgattattttatttttaatttgaagacatcttgtagttcttaataattgcctttttctcttgctacttttgtgtcaaaggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcaggtaagtaagaagtagatgctttattatgtaagaccctaggtaggagtaggtgagtcctctgtgtgagcactggaacagacacatctttttaaaattccttgggttaaaaacttgcctctgagttaaacagcaggtttacagatgtttatcaggaaacattcccctgtgcttttctgaaccccttctcttctgaaatcaaccatttttaggtgggcttcttatggatcctgtggaggttccttgtttagttgggttgtcagaattggctgtagaatggagtttgatttcaaagaaactaaaacctgttccttattttctttttctgatttattcttggagatacatagcagcaaagctctcagcagtatgacagctgattcagcctaaagcatttaaagcacattttataacatgggctcagccataatacactttcaagatctggaggaagtagccttatggtagaaggtcccccaaagaaattgcctttaaaaaaaaaaaaaaatatatatatatatatatatatatatatatatatatattttttttttttttttttttttttttgagactgggtctggctatcttgcctaggctggagtgcagtggcaatcatggctcactgcagcctcgatctcccaggcttaagtgatcctcccagctcagcctcccaagtagctgggactacagggatgtgtcaccatgcccaactaatttttgtactttttggtagagacagggtttcaccatgttgcctaggctggtctcagaattcctggactcaagctgtctgcctctcctagcttcccaaagtgctgggattataggtgtgagccaccctccccagcccgtcttaacctctactaccttatttggcaggagccagtggtcccccctttcctccacaataacttatttttgtttgcacttaatgagttgtcctatagtaggtctaataaaatgtgtgatataattggcagtgctgttcactttaagagcagcttttgattaaattgggctccttccccatatttagacttcagtgatcataatgctgagctttgcataccattaagagttagtgggtttgagtaaaggtgttttaataatattttaaataagtaccagtaagtactaataatattttttttgtgtgttagaggttacaatcaaaagttttaaaattagttgatatatcctatggtggtgaaaatggattcaaccaagctattgagttatctactgaagtcctctccaacgtgaaattcattcaagagaagaaattaataggtatcggtgaaatgcaactacttattctgtgaaatgttttcgtgtgtgtgtgtgtgtgtgtgtgtgtgtgtgtgtgtgtgtatgtatgtacgtgattgtatgtatgagacaaggtaccaaaaatgtaaaaaggaatatttagtatttttattaactcttttgcctcagtaaaagcattattttttatcttctttagtcattaggtcgaataggtgtgtttgtatctactagggaaactttaatatatatcctgttgactgatccctaatcgtaggacgatactttgatgaaatcagccaggacacgggcaagtactgttttggcgttgaagatacactaaaggctttggaaatgggagctgtagaaattctaatagtctatgaaaatctggatataatgagatatgttcttcattgccaaggcacagaaggtatgagaattagaaaataaggttgctatttgttactgagccaggaagcctggggtggagatttgggagggatggctgatttcaggagcaatcagaaggtagatctacccattgttccccagtccttcagtctgtagcacattcctgcatagatttttctgcttgaactgtttaacgtctgcttaagattgttacatctgctgaggaccaggactatatcttgaacatctctgatgttccttatggttgaagcattgtacctagtagacactcagtgtatgctaacatgtttatggaaaaaatgttgagagattgagtccctgagcccttttctcatctaacctcatcttatggagcttacacagattagtatatgagagccaggttaacacattttttcctcctaatactacagaggagaaaattctctatctaactccagagcaagaaaaggataaatctcatttcacagacaaagaggtatgtgattattttcttggtttgatgatacgtgcaagcgtaaatccgtgtgttagagtactggctgtgtagagggtgagctttgggaaaccaaacctcatactaattgggggtgctgtgggaggtggtcatctatctgccacatacgaatctgatttcagggaaggagctgcagctttttttttttttttttttttttttttttttgagataaggtcttgctctgttgcccaagctggagtgcagtggcatgatctcggctcgctgcaacctccacctcctgggctcaagtgatcctcttgcctcagcctctctggtagctgggactacaggcatacaccaccacgcccaactaatttttgaattttttgtagagaggcgttttcaccatgttgccctgggctggtctcaaactcctgagctcaagcaatccacttacctcggcctcccaagtggtgggattacaggtgtgagccaccatgaccggtctttttttttttttctttgagatagggtcctggtctgtcacccaggctggattcagtggcacaatcatagctcactataacctcgaacccctgggctcaggcaatccttctgcctcagtctactgagtagccaggagtacaggcacaagccctcattccctttttttttttttttttttgaggtggagtttgctcttgtcacccaggctggagtgcagtggtgtgatctcggctcactgcaacctccacctcccgagttcaagcaattctcctgcctcagcctcccgagtagatgggactacaggcgcccgccaccacgcctgactaatttttgtatttttagtagagactgggtttcatcatgttggccaggctggtctcgaactcctgacctcaggtgatccacctgccttagcctcccaaaatgctgggattacaggcgtgagccaccatgccaggcagcctaattttttttatagaaatggggtcttgctgtgttcaccaggctggtcttgaactcctgggcccaagtgatcctcctacattggttttccagagtggtgagattacagacgtgacccaccatgcctggcctggtttttgtttgtttgtttgtttttgtctttgtttttaagtagttaagcaatcaggaaaacatttcattatccttgaaatttaatagggaggaaaatgtaatttacataatgcctctcctgcactgtgaaacctgtgctgctttcttcacttgatcagctcttccactgcagtggcttctctggtttgctctaagtgcatcacaacagttgaaagtatgaccctcccgtatgagataggtttaaatgatagcttcctcaaattctggtttggagagctttgttctctacgaggccactcccaaaagcagtcctggaatgtctcttctgagccattgaatgggtgctgcttagagacactacaacagcctgacttctagagtcaacagtaggaatcataagctgaatacccactgagtttttgtgttggtatttcatagctgagggtagagcctgaggagaagtgttgtttgaaataatccgaatttctctgctgatatccattaggttatcaaaaccagagatgacttacagagctttacacacagacatgcctataaatgggaggatgagagtgataggtgggcaaggggctgtgagagggactaattagccttcatatatcctaatcccccatttttgtatctcatggtcatccctgtagaccggacaggaacatgagcttatcgagagcatgcccctgttggaatggtttgctaacaactataaaaaatttggagctacgttggaaattgtcacagataaatcacaagaagggtctcagtttgtgaaaggatttggtggaattggaggtgagtagcaaatcagcaaaccaaacttaaaaccagggtctcaggtcaaggtccctcctggctagccctagccctgcttccggtgaggtgcttattatctgctgggataggtgattgacgcagcaggtgcaggttcctaatttggacccatgtttattattacctctttgctttctgcaattctgcaagagaatagggcttcccttattcccttaccagccacctacacacatgcccatcccatgaacacaggtaatttaccttttggtttgtttccccaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaatgatttttttaaccttcatacatagaagcaaaaatactttaactgctgtaaaccttcaaaagttaatagaagtgagatcatactggtttgtttcttattttgattggagaaaaattaaattgctgcatttcgcagtgacccatttacatggcattctcagcttagactgcgtaagaagaaatatatgtggtgaaatgttggaaccatttctctcttggtctctgtttaatgttgaaagggtgagctaataggaggcactttcaacttcactccctcacgctaccccgtccccctccagactggcagtttcaaggatgcaaattgcattgcaaaatcaaactgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgctattgctgggattgggagaaataaaacatgcaatttaagtggaagcgaagaaatttaaagaggattttattttgcttgggtcaatccttgttaaaagggaggtggatgtgttttccttgtgttggatggcatgagattatgtgaatgttttgatttattaaaatgaactgcaaggtttttcacaggaacgacagacatgtatgactgcatgtaattataaactcctgacctcctggtggggttggagcatctgtttcaaatgtgggacttacaagcacttctcacatgagaaattaggggcgggtgggaagggatgggacacagcttctggcaccatggatttaagaccatgttggatccaaaagttggcctgaaaccctgaagctgatgcttcacagctgggctgtaagtcagacttgaacccagctgatatgcaaggtcatggcgtgcccagggtggtgacagttgaacaaagtgtatagtacgtgcccagtggtagcgatggaaaaaagtataccaaatggactttgaaggaccaaaggttttaaaagtcaattggtatcacctccacactgactagggtagtggggtgcatttggttttcaaattgggtacttttaacactttagtgcctgactgctgttctttactgacttgattcagtcactcgtagctttattggtctgaaccagctccttgttcccaggttacagacctgcctatcgttccaataatcctgtttcacttgaatgaagggagtatgtcttaaatgtaaagtttctggttctcacactgtactctgaggtccaaatactgtctgtcaatgtgtaacctgatgtctcaaccccctgtgagaagagtccattatttggtgttcaccaacgtgggagacttcaccggaacaggcttttttgctttgggctctgctatttgtttgcagaacacccaagagcgagcaaacatgctctcttcacagcagtaccttagggttttgccattgtaaatgggtctgatgtgatatgacaagaccagagaaattggatgtaaatttacatttttgaatatgcttgttgtttcacatgatacatttagggtatgcagctccttttgtagtttttatttttactatttaagtttggaaatgatgccaaatttttgtatttctttaatcaatgtgttctcttcggtgatatatattgcattatatattgatgtgtgtatcaatatatattgatatgtattacacttacacatacaaacacatataagagggggtgaaaaccgtagcctttgcattctctatagcctctgcagagagatactaagcagcaaaatcttggtgttgtgatgtacagaaatggagaagagtattaaaccatatttaagaatatactttgtgtgcttgagattttttaggactggtctagaaaggcctgaactgtggagacagttctccaaggcatacctcagattagtcacggccaatagcatttcagccttgggtttgagttgtgtttactacatttgtctatggaaaggtatatgcaaagtttttctgaggtcatgatcccagagttatgctagaagaagaaggttcaggttgctggggccaaactaatttgtattctcccccattctatatgcatgccaaagggaatcttgcttttttttttttttaaggtatgttaagtatattatcccataacccagcatcccatggaggtagatggtgtacccaattttacaggtgatgaaacagaacaaaagaaggttaagtagcagctctttagtgataacaccaaaattttatcccaggccttattccaaagttctctctgtatctgtctttgagtcctataatagaatggtccagatggaatagcagaaactaggcctgggccctctctctctcccacgctccttcatcttacataccttacactgggtaggagagtagtagcccacccaaaagcaggtcaggggctggtccagaggagcagggctcctaggccaggttcagagcagaagaggatttgttttctttgttttcccccaaggttgaggtgcttaaagagcctctttggtagtttaggaagcctagttgaggagccaaggtggtgcatggtttgctttctccaggtttgagaaaactgttttaagtaaaattgaccagtaatggcacttggcgtacttttcacccattttcttacctgatctaggtgatagctctgacgacgaaactcaattaccagctgggaaggggcgaacatgcctgtgctggtggaagtgtaattttccctcctaatgcgtgtctaggtgctgttcttgaagacaaaattgttggaaggcagcacagtggtgcaggatatatgggctgtggtccttgcctgtctgggcctgcagcacttgccatcttttgttctctggctccaagacgcatgccatgacactcccagacaggcacggtggatttagggctgagagccaaggtggaatttaagtttcatgccagcttctcctttgttgccagcttgagtgaatgccaggggattcctgcctgccaagtccagccctgatgggactgggtctcaggggacctaggaactgaacagccaagtggtgtgggagcatccgattagagctagggaagcagggcacagttacttgcttgttttgtggcagtttgggtgctgcaagttgctgaggatgtggctgaatagcaggcactagaaataacaggtgaaaacaattcaccacctaaagggttctctgtaaatcaagtctaaaaccctgtctggtgaattctgtttcagatacagccatctccaggagtccttccctgaaactggcaggcttacctggggcttagctaagagcccaaaaccaaacaagggagtcaagaaaagctctggttctgctgggcaccatggctcacgcctgtaaacccaacacttcaggaggccaaggcaggtggatcacccgaggtcaggagttcaagaccagcctgaccaacatggtgaaaccccgtctctactgaaattacaaaaactagccgaacaggtggtgggcgcctgtaatcccagctactcaggaggctgaggcacaagaattgcttgaacctgggaggcagaggttgcagtgagacgagatggcaccactgcactccagcctgggcgacagagagactgtctcgaaaaaaagaaaaaaaggctctggctctgcagttaactgggtttgtgacttcacagtatcaggcagtccctgaatctgaagtgccgtgccagccagcttcccaggaagctatcaggagagtgcagtaggaagcaggatctctgaggtctgaggtagaaatcctggcgccacctgagaggctggcaaattattcca

SEQ ID NO: 17274 - DNA, 38207 bp, Human
tgggtggttttggaaaaggcaacatttgagctggaaaacagggatgtaagttctcactttgggctgcagtttctggcttgagggtgagggtttgacagggacccgcccctttctgcctagattttctctgccacctttctctaccattgtatcaatattattatcacatggccctgagttggaaccatcaggtcctgcaaactccagagcatctacttactgcacattggccccccccaggggaattggtcccagccaagggtctctaggaaagaggcacatcaactagatgtggaacacactccggttttggaagtactggttctgttctccagggcatcagaatcctcctttttgtgaccctgctgccttacaggaaagaaacaacagttgaaacactgggaattttccccaatagggagaaggcacagaaaggagaaagctaaagaagagagtgaaagaggcccaaagagaatggaaaagtgagagcaggccatttgccagggctcattcctgccatccagccccagctcctggctgctcagtggacgcttctgccaatgctcacagccccacaggcctgggcccgggagtctctgctgccacccgtggtttctctccctgttccaccatcggaaccccatgccccaggctctctcccttgaggccacctcagaaggagataccaaggggaagacagctctttaagaagtgtagactccatgttaaattgagaccccgcagacagatacggctttgaaacaattgattttctgtggtgtcatagggaaacctgccctcctcaaagttgcgaaaactgtcagggaccctatgaaatggagcgggagtcacaagttttctacccagctctaaaagaggagacaaaactaacactggttcacaatagataacagaacggcttcagcaaagggcaagcaagcgtagagagatgctggagaagaacaaggcactttatccatgtcccccacagcaccctgcctcagcgccggggcaaaagaatctttgtgtgagcccagggagtcggcagggacatgaggggttgatgcggcacttgctcagagcaatcgcagtgctgccgctggaattatctttctcacacagttcccagtagtggttaaaaggctctgaggtcagtccgcctggcccactagctaagggctcttaagcatttaaggactctttcaacatttgtttctgttagtttctaaaacttggaacagagggccattgatttaactggtataacaacgtgtgggtacattgcacttgttaccttggaaatgcctctactcagtctcacctctgagctgagttagtttgggaagatgttgagcctacaggtagtggggagatggtgagattcaccaaggcatgtgttgtttgtgattgattgggttgggaaagtttcctgactgccaaaacctccatcagacactagccggggattctgtaaatctcagaattccaaggggattggattttgaagaaaggagatgttcacgtacaggctactagaattcttgttctttttttttttttttttttaaagaattctgaagaagaaaataagtaagagatctaaaacagaaccatattttgccaggagggcagagcagggctgctttgttcaatttgttaagagggtcagggaagcatcagaaaagataaggagaaaaatcaatcagaaccaagtcactgttgtgagtttcggcagcgtctgaagtagccagaaggtactgagaaatgtattttatcacatatagtcttattttcaccctaccgtattttctgttaacacaaggttcctttaaagtcaagtatgcagccctaaatcttatcgacccattaatatttcatccaaaacaatgtaacatcttaaactgaaacctaaatgtaagctttggacacaagcattcaaagacaggtatgttgtacagctggactatggtgagtcaagtaacattttcatttctttttttcttttagaaacagggaaaattgaccaagagattcacaaatacaacaccccaggattcactggttgcctctccagagtccagttcaaccagatcgcccctctcaaggccgccttgaggcagacaaacgcctcggctcacgtccacatccagggcgagctggtggagtccaactgcggggcctcgccgctgaccctctcccccatgtcgtccgccaccgacccctggcacctggatcacctggattcaggtaaagtcttcagcaacctcaggcaggttgcttcatttctttaaacctcagtctcttgggactatggaatggatttaataacagaacctcactggtaatgtcattggaggattaagaaagggcaaaggaacgttgtgagtacggagttctcagggcagcacttagcacatctgaaatactcagggccagaaataaataagttgaaggtaaagaatgtaggaagtattaactcttcaattaggttaaatgatgacttgcctaaactgatgtctgcgccatgactgtgggtgatttgatcaattcactgtctcacttttgcctcttatgactcttaatgacttgctgtaacataatctgtgttttaatttaagaagagatttacctaaagcaatatagagatccgtctcctggctctgtatttatatgaataatactggtggcttccagatctttaagaggtgcctttaagcttgcaaaactctgtggatttagtcccacttctttgagtgggaagacatgtaatttgaaagcacagggctcaaatgaaaggatgtagctgttggctgaaaaattaattggatgaaaagagtatacacataaccctgggtgggagacagcctattaagctgtatctcaggagacttaggtcgtactcctagctccacctaaattggccttgggcaactcaagtgacctgcccaagcctctgctttttcacccataaggtgaagaaggggaggggagtgtaacctctaagtgacctccgaatccaacattcagtgggtctccaggcaacatgtgatgttgctgaagctaaaaagaggaagaagatgaggcaggaagcaacagctaggaggcctggattccagcaccatcactgcctctcaccagcagattaaccttaggcagttttcataacctcattcctcagtttccccacttcctaaatggagataagacctaacccttggaattctatttaaagtgatgtgtttaaatctgacgtgttttatcacaagcgttaaagtttagctacaataatattaataatctaatattattatattagacacaatttgctataatgcttgaaccttgagtaaagacttccaaatcctctccccctgcaaacttgtaatttgtaacagttcattctctaaacctcgtgcatttgattgctttaatcatgttccggccctgcacatggagtgtgtggcttcagtgcagctattgtcattgtgattccttgccagggctgtgctgcaaagctttgtgaagcttagagagaagccaaaattgccctgttgtcagaataacccatttacagacgaaacaatcctctttgttcctcacacatggattcctagaacttgacgcggggcgctgtgagctaagggcacgtatgaagaattcccttttatgaatgttgttaagattacacagcgggctggcttgaacaaaggaaagcattcctaatgctgaaagaagaaaagtaagagtgaaaatacaagaggagaaaagacatgtcagggccacagaggaacagagatctctcagataaattcctccaaatgcccgagtagacaaataccgtgaatgatctttgcaaggcaggagtccttccgctgtcaaagggacccactgcctgaggctgtgagcacctgtggtctgagtcagggccaatagactagtttctaaaacatctagatcctaccttgggccaatatgagttttatgtattattacttaattaggaacttgtttgttaagatctgtgagatatgactgtagggaccaaagagtttttgttcctttactttaaaaaaatcatgctttgagtgtgacaggttttttttttttttttttttttggagacagacagagtctcactcagttgcccatgctggagtacaatggcaccattgcaacctctgcctcctgggtttaagcgattctcctgcctcagcctcctgagtagctgggattacaggcacccgccatcatgcccacttaatttttgtagagacaggatttcaccatgttggccaaactggtcttggactcctaacctcaggtgatccacccgcctaggcctcccaaagtgctaggattacagagtgctaggattacaggattcttttgattgatttatgaaaatgtatatagggaacatatctgtatttgatgttcaaatccaaattctgtaattctgatattatggtaggcctgtgctatgtaacatgagatccatttgcagaaaaatttccacttacacttggagagttcttacccagtgtccagcagatgaagtattaatgcaattgtcattataccaattacaaggacagaaaacagttgaccgggctcggtggctcacatctgtaatcccagcattttgggaggctgaggtgggtggatcatgaggtcaggagttcgagaccagcctgaccaacacggtgaaagcccgtctctactaaaaatacaaaaattagctgggcgtggtggcgcacgcctgtaatcccagctcctcaggaggctgaggcaggagaatcgcttgaacttgggaggcagaggttgcactgagctgagatggtgccactgcaagactctgtctcaaaacaaaacaaaaaaacaacagaaaacagtttacaaactataaggcagaggtttattgaaataatatgattttcctcttttaggtgaataggaacatgagagacaatgtgggttgaggggctggaaggggcagaggacagacgtagaaatgagggaaggttacttaacagcagcctctggttgctcagtgtcagggaggaaaaacttttcctctgtcctcttaagttcagtacctgggggcctgcaaattaagctgataaaagacagattaacaggtgggcagggggaccttatttatatgcatataggagcttgaaaaagaagaaactcagtaagtagttaaagctagaaacttatatgcccagcttagtagggaaaagaggcagtgggggaaaaggcctctataggaggaacagatggatttctagaagaacaaatgagagataaagagtttgtgatagtgcttgttcatgcaggcctgagtgatctctgtatctcattcatggccataaaacttccctggagagaggacttacggtaggtttcttgatcatcttcctgggagtaaaagccacccgtaagagggaggtatggcagcctcatttttccagaagtctctgctttttgtcagataaaggaagcaccaagaaggcttctttctgcacctattgaatccccagtggcttcagtttaaaatgagttccataccaactcgggttctaagtgcatccctcacatcagcaattgcactctggtttcgtgagcctaaggtcatcattctgaatttggactttacggttttgcacttttctggtaatatttcatgtttgactagaataagattccttgctatcagatatttaaaaacaaaacagtatatacacaaaaatgcctttctacctgtaaataacgtgaggtacttgagtctgtgtagggttaggatggaaagaaaataacatgagagctcgtgagtcctggcttgactagaggacatttggaagtagattatctcatctggtgccttggaagtttattcctcaacaagcagcaatgggtctcctggaagcttttttagaaatgcagaatctcaggcccctccccatactgactaaatcagcattcgtgttttttagcatggttcccaggtgacttaccactgcaatttaaaagctctaatcttgtatagtgcttctcaatctgggaagcactttaaaactacctggggagctttttaaaacccaaaactacctggggagctttttaaaaccctgatgtcaagactatacttctgtcagaggtgtctgaaccagagcaactccatctcgaataggggctgggtaaaataaagctgagacctactgaaaactggttgcagtaaagaagccagctaaaaccatcaaaaccaagatggcaatgagattgacttctggtcatcctcactgctacactcccatcagcaccatgacagcttataaatgccatagcaatgtcaggaagttaccctatagggcctaaaaaaaggggaggcatgaatgatccaccccttgtttagcatataatcaagaaataaccataaaaatgggcaaccagcagcccttggggctgctctgtctgtggtgtagctattcttttattcctttttgttttattattatactttaagttttagggtacatgtgcacattgtgcaggttagttacatatgtatacatgtgccatgctggtacgctgcacccactaactcatcatctagcattaggtatatctcccagtgctatccctcccccctccccccaccccacaatagtccccagagtgtgatgttccccttcctgtgtccatgtgttctcattgttcaattcccacctatgagtgagaacatgcggtgtttggttttttgtccttgcgatagtttactgagaatgatgatttccaatttcatccatgtccctagaaaggacatgaactcatcattttttatggctgcacagtagtccatggtgtatatgtgccacattttcttaatccagtctatcattgttggacatttgggttggttccaagtctttgcaattgtgaatagtggaggaggagaggtgctctgctttttagagtttccagtttttctgctctgttttttccctatctttgtggttttatctacttttggtctttgatgatggtgatgtacagatgggtttttggtgtggttgtcctttctgtttgttagttttccttctaacagacaggaccctcagctgcaggtctgttggagtttgctagaggtccactccagaccctgtttgcctgggtatctgcagcggtgtttgcagaacagcggtttttcgtgaactgcgaatgctgccatctgatcgttcctctggaagttttgtctcagaggagtacccggccgtgtgaagtgtcagtctgcccctactggggggtgcctcccagttaggctgctcaggggtcaggggtcagagacccacttgaggaggcagtctgcccattctcagatctccagctgcgtgctgggagaaccactgctcttttcaaagctcagatggaaatgcagaaatcacccatcttctgcgtcgctcatgctgggagctgtagactggagctgttcctattcagccatcttggctcctcctattcttttattcctttactttcccaattgatacagtttgactatgtccccacccaaatctcatcttgaattcccatgtgttgtgggagggacctggtgggaggtaattgaatcatgggggcaggtctttccatgctgttgtcgtgacagtgaataagtctcacaagatctgatggttttataaaggggagtttccctgcacaagctctctctttgcctgctgccatccatgtaagacatgacttgctcctccttgccttccaccatgattgtgaggcctcgccagccgtgtggaactgggagtccattaaacctctttcctgtataaattacccagtctcaggtatgtgtttattagcagcatgaaaacaaactaatacactaataaacttgctttcactttactctatggatgcaccctaaattcttggatcttgcgtgagatccaagaaccctctcttggggtttggatcaggaaccctttctagtaacacttccatgcaccatttctatagtttcttaccagagaagtttctctgaacatgtggagcaccggaaaccacgaggaggcggctcagcattcactcctgagcatgaagctggctcttggtggtgcttctctgcaattgccttttgctgctgatgatcactcttctcttcctttgggagagtgaaagggaaaggaagccatctgaagggtcttcatggttattttttaaaaagaaaaatcccaatatctagtactaaacccctgacggaccaaatcagaccctcggggggataggagggacacaggtgtgtgtgatgtaaacccccctccccaggagtgtccagtgtgtgaccaaggtcaagaatcactcaccaaatgaaagaagggtccctttggtaagtgcatcaaaataaggttaccaaaagaaaaaactgaatacccaaatactgcccaaaacatggtttatgaaaaacaataaagccgttaggtggttaaatcacaaatagtaaaggctgtaccatcaagcttgcaaagagaccaggctctccggccattttataaggaagctcactcagaggagatgtttttacctaaacttgaggagaactgatctgcctgtttgcaactggaaagcagacttgaaacaaacaaatgaacaataaatttgcagtgtggggcaggactcggtggctccagtgaaagcacctcattatgaggaagatgtgaaattattactgtgttttgaattggctgctaacctactctgaaagatagaaaaagatgctgctttaaaatgagggctgtgcttttctgaaaatacagcaggtgccttgctgtgaagagtaaggaatcatatggccttatggttaaagggatcttggcaaaccagggctactcaatccatacctataccaggatgtttgcatacctataccaggatgtttgttttgcaggaacttggtgttagaatggaaattagaattgaagacatctacccataggtctggtgatctttctgctcccatacctgtctttctactgtctgagatcatagtaaatgataaaaacagaaaataggttctaaggtatgctggctttagtaataagattctttttctcatctgtaacactactgttacacttctataacaaacactatttgttacctctccaatgtcctttgggctctatcagtgttttctaaaatgagggacatttatgttggtcaggttgtgcactgcacaactataacagatgtcatttgtagtgcagtctctggcttctggagcagtgcagcatgtagcctagatagggggtcgccattatgggaagcaaatagacatggcctcgtgtaacatacaaagcaagtcatttcctgttcatttgtctttcagtccttctgattttataaagagaaagtctctatttggttctggcacgcttttaacacctctcccatgattgtattttaccttataataaagagagaacaggcttctggttagtgcctcacaggcaatagaattactcagtagggatgtaaagttttatcaatagatttatataaataagaaatttaaccaattttgtgaaaataagtaaataaataatacttggattttacagtatatgtcaagaaaaatatgaaggtgattttcacatgattggagtttgggaaacactgggcagtagagaaagatcaccccaagcgctagggcctagcatggggctttaagaacacatttttatagggggatgaggtaaacaaaagacttacacattatgatttaagttgacttgatttaaaacaattctgctctattggaaacatccaatctttttttcttctagttatttccctctttgataataagtacagcctgtttctaaaccattatatggtccttaggaatatttttagaacagtagttacaaggtagaaaaagtaacccccagccctgagttaaggtttattttaaggtcacagaatgccaggcaattgccgtgatttacctctcagaattatggactctgttgtgtttcttcctttttgtctaatttagggaatcttatttgcttggaatgaaaaggatttgccagcaggaagacagccacagatggcagtgcacattctgtaaaatacaaaaacaaaacaaacaccagaaaaaataaatccaagagtctgatcccataaatttctgcactaaggagcaactccaaactgcacaccaagctgctttaaaaggcgtttgtgttaagccttagagtgttttatcacattcgtgatatttgatacagaatacgtcagaccaaaagccacatcctaggatcttctttaaaatatcattaaaatagatgaagcattttaagatgtaaagtttcatttcctaagggatcctctagttgtaaagattgcagctagttgttgttgttattattatttgagatggagtctcgctctgtcactaggctggagtgtagaggcgtgatctcggctcactgcaacctccacctccggggtacaagcaattctactgcctcggcctcctgagtagctgggactacaggcacgcaccaccacacccagctaatttttgtgtttttagtagagacggggtttcaccatgttggccaggatggtctcgatctcttgacctcgtgatccgcccgcctcagcctcccaaagtgctgggattacaggcatgagccactgcgcctggccacagctagttattttaaaggacttctagtaggtccaggctagattctcagcaaagtttgcatggtatgtgatgtgtggtgcatctcaccccagaaaggacctgggagtccttctgtaaattgctagcaggtgaattcacagcatccactgtaaccttaagttatctggttctctgccctaacgctaacctgcatctgacactgggaggtccttgaccaggaattctcacagctcctccaacagggaagtgggtaggagatggaaaattcagaagcaggagtggagggaagggagttaacacccaattctccacctcccccagaaccaaggccaggattgtcaagaatccagggttcagaatcccctgccaagctggtccagtggattcactcaggttggcagagtggctgaaaaccagccctcttaggcacgtgggtcttctcccagatatattaggaactagatggaacttggcacttgggatcactcagtgtaacaaccccatacccccattagacttgagtatacccagcactgagctaggaactcaggcttcccgtcaccacatcggacactttaccactggccacagattggtttctgaagacctcttacctccatcgttatgacttctaagttgatttctgtctatattccaagtttcctttctatcatctggccataaaatatttttatatcttcatgtgcaaagagttatggatataaagaactttttaaaattacatatatcatctattctgttttctacctaactacaagctgatcattggttttctttaccacctgcaagcacttaaaagtaatcattcctgctcttataattacatcttaattatttctgaacagatcccttttctctccttatgctaagactgcatgattaatgcatttttatctctcacactcagtctttttattatgttatttgtctttttccctcttcagtcaccaacacagttcacacttaatcgtgtgaagaaaaactatcatcccttgcttgctaatgtgcattttcctgcaaagatccaaattccacttttcctgcaaaaacaccaagcgcatttatgtatctcaaatcaactatggtattagtcttacctatttttgcctggtcattttagttgtatcccaccttttgtttctacagtgttttcatagaaaatcagtttctacagtgttttcatagaaaatcacattgtatccatgattttgttgagtcaaaggatatgtgtgtttttaattttgatactactacaaaccatcctctaatgatataatccgattgacagtccagcaatctatgaataccttttccccacatcctcaccaaaacagtgcatcatattattcttttaaatgtggctgttctatatgaaaaataaaattttcttgttatagtttgtatttcattaattatgagttgggttaagtatctttgcatatgtttatatatcatttatatttatttttccataaactccctctttatattctttgctccaataattatttatatctttatattctttcctattgatttataagtattcttaatatattaagtaaattagtatttttaatgttttccttgtttcatctcaatttttttgaatttatgggatttttttttccatgtaaaagttactaaattttacatggtgaaatgtaaagtgttttatggcttttgggttttgtgacataccttctccatttagaacttattttttaaattattccatgttttttataataattttgtgttttatttgtaagttctacgtattttcttccctggaaatttatttgggtggaaggtggaaggtaaaaatctcactttattttttcccaaatggcccactgttccagccccattggttgaggctccatcctctccacctttaccatcttctaaattcccttcatttctgagtccctactggactctctggtctattacattgatatgatgccttgtgacatgggagcaaactgcagtacttatcattgagcttttattatcacatttagtggctcatagagctaatttccctttttttctgagttttttttcccagaattttcctgttcatccttgcacatttgcttttcccatgtggatttgagaattttaatcattttattggaattgtttaaaatttttactgggattaaggtttatgtataagttcattacctggtgatgcccagttacaccatgcgtgtcttctccatctctctccaagttgcgaaatgattcagataagtgtcatccagattttaatgtgcttagaatcacctgggggaaattagcaaatgcagattcagctggtcaaacatgggattagagattctgcatttccaacaagctcccaggtgctgctgatgcagcgggtccctggaacacactgggagtggcaaggagataagcagccttgaggcactgcctctggtagatttcataggtttcccctggaaaaccacttgagcccactgcttcttgtgggagcagatctttgacaactctctcaagttattttatgataatctgtctaattagattttctttctcatctaggataatacccgttattttatctttttctagaaattcgtgcatttaacctaggttttcaaactcattactgtggagttgaacagaaacttgttaataatttaatttccattccctttttcgtgttttttatattgaatgtttctgttgaccccccccccttattgattagattatgtggcttttttttttttcttttctcaaagaaccagctcttagatttatttgtcaattctttgttttctttctactgtcgtgtcttctttaaatttatatttgctggcctctaactttctaatttgaatgtttggctctctctcttattttccttcttggtggggtgtgtgtatcatggtcttataagaatgtgaaccgaagtcaacaaatcttaaactccagccatgctctcttctgaccacacctctgctgccccagccccgcctccaggactgcaccctccagatgtaattgacaccaatggcttgcactagactttttgctaagggacctgaaaagaacttagaggctggcgtaagttgccaaagccttcccacatcactgagagaatagacttggcaggcttgtgttttgaaaagcagttgggggtgcgctctgtcaaggctcagccatgatgaagaaataatcaaagagcaaaacgtcacttaagtggctaaacatgactggcagcagggttggattccccttcagcatcgaacacctcacaggccatcctctgtgtagacgggctgctttctagtggctccacaggcctggccgtgtcaggggctgcctttattcaaagacttctgttctgtcttaaccaggatcacttaactctctgaaactccagtgataaaaaagcaaaaccggcacaaacatacagctttggaactatctccaaggtcattgttttttcccctgccgcgaatttctttcattcctaattttcctctacctttctttcccttcatcccctacgatagattttgaaccccagggaggttaggactctgtcccgttcttctccctgggctgtccaccctccgacccccaccccacctggcatggcactcaaaggtgcattttcctggggtctgtgcatggaaatcattgcagctgtcagcctgtgtcacgtggggctggctaagtgcggggcaacgcggttgtacatgttgccatggtgacttctctgttgatggcagaaccactgactccagcaagtcacagtattcatttttgcgtcatgctcgtgctacaggaatgctatgagtagcccatgaaaatggaggcgagttgagctcagtgttatcccttgacttgtgtgtctttccttacccccagcgatcccccattcagatgcttcctactgtaccgcatttttgagtattcttcagtatcatgcttctgttacagcaccatatcactcagctatggaagcactcagaggagcacaacaccctctaaattatccgccatcacttcttttacggcctcatttaaaaagacaattgtcagaattcccaggtgtgaattctcacaggggaatctctgtcagtcaccacctggaaatgttagttccacctctgctggccaatcagcacctcatgtccttgctatgatctctacagttgcagaagcattatcctgatgaggtttttaacacatcaccacatgcttttcagagaaaagtccttttataaataccaataactaaacatgataaattgcttcactcctttgagatctttgtctgattccacgtgctctgcatagactattcagaaattctaaagacggatgcagattcctaattctgctgttgagtttgttcctgagagcaacgctgaaagacttttaaaaaattaaaatcagctttatgttgaaatgtaattgtacataaatagccatatgaatgtggggtacagttattttaaacatagaaaataagatgaattgttttggaaattcccctttaaacatgctaaaatgattttcaatcattgacgggaattttaacttttagaaaactggaaaggatacagacaaaagtagtgataacttaaatttgtaaactattttatttgttgaaatgctttaatgcatgattttgttttatcctggaatggccacatgtggtaggcaaagtggacattatcagccacattttaaagataaggaaaatgcagctcagagaaaataaatgtattcattccctcagcaaacactgactgggtggccacagaagtgcggtgcacaaccctggctgcacatcagtcacctggggagcttttcacaaatcccaatgcctgttccccatcccagaggattcctggtgtgcatcaggattgtgaagcaatggggactgagtttatagcaccttactctaaagtatgcagagactagcattatgaagtggaaaatgcatatatttcagattcagttatttttttcccactattccttcctctcaatgaaaattttggagtaaaacatataattccagttctttattctgaactgtcttactattttctatcaccctttaaatataatgcagaagtctggaaggatatgtaatttgcatacctgttggtgaaatccctgctactaaatacactttgctttttcttgttccacattccccttttcgacagggaataaatcatccccaaggctgctagagccaattaaatattttttcacactccgttgacatgaatgagaagaactgtgacagagccacacggctcatgccaggactttatcacgctatctttataatgatgtgagccaggcaccagggaggaatggtgtggggaaccatcaggaagctttaataaccaaggataatttgtttcatcagtttctccttgatggccatttgccatttcacctgtcaggaagcaaaactagttgtcttgtgagatctcaggttaactcaagaagagaacagctcagacaacaatggaagcatatttagcatggagcttttatactcagttctctgaagtcagccttcttggaagaaaatacattgtcttgggattggaattataaatttcccttgtgctaatgcaaccgaaaagagtatttcaaaaccaagagccgaactgggcattcataaaagacttaaaatatgtgtagaattaatttttaaaagcactttaggtttgcccatgccccccttctaaccgcacagtggagacagaatctggtcagctgtctgtggtctgggtgactccaccatgttctcagcaacgctcctcatctatgtattatactagtttctgaaaacttaagaataaaaaggatcaacctcacattttgatgaaatagcagttacaacacaaacatcccatgcctattggcagaactggtccacagagcgcagaagcacattcatcgtgtaaagctgaaaacagcgtcttctgcaagttgagataccgaggttccagcagaagataaaaagcatttaaaaatatttaattattcactgaactcctttgaaagacacaggatgacaaagcagatcaataatattcagccatttccaaagggtccatccacagccaaagtatggcctttgaatttactagaaatttccacagagggagagtaaaaggaatcccttcatccttgcttgagtcctaaaataacatgcgcctaagtattctcacaaatgatgaagcgcatctcttgagtagacttaaggtgataaaatgttattttcactgagctcccaagccatacatcatggaagtccaaagcccttactgataattgcataatgcccaggggatgtgtttctctgcagaagtctgaagacaatagatccagggtctcctgaagactttcatcttatgaattgtgcgaatccctgaccactgcctaagaggaaaggtgaaatacatcagagaatgtccttaaaaatatccctttttgacttactataattggttgctttcctcttttaactatcataattttctcagccaccctctccctagaaactggggctatttctatgactcagcaaacaaccaattcttgctaatactgctttgctaataaggaaaccacaagttctcttagctgagactcctgtatagcaggtgtgttcacaaaacttggtgagcacccatatctgagacacagcattccataaagccagaggcagtcaccgaggctgtctgacataccataatatgcccgtatggcttcaggctttccaccctgatctggctgtatcccgcattgcacccatgcagcagcagaaccagcagtaagaatgttttgtcaaaaaacaaatccataaacttcaaaaaaatccacggtacagtatttttaaaaatacgtctagccaggcgcagtggcacgtgcctatagtcccagctacatgagtccaggagttcaagatcagcctgagcaacatagcaagaccctgtctctaaaaagaaaattttaaaatgcatctgttctctctcatatatgcctttaaacgcatccatagcatcaagaacctaaatgccaacatcccaatatttttcctccctgataaacttgctttagagattcaacttgtatttttgctttgaaccaggaaaggtatccaaggtcatactaagataaccatttattaaactctttggctgttttttcctaaactgtaataaactccccctctccaacattcaaaataatagtaaataattctctctgaaattaacacagtgttcctattattgctttcacaacactaaaaagaaatagaactaacggagtcgaactgtggggcattctggcaggcaaatcattaaattcacacaaatgattcggccaagggaaaaaggacaaggttctcagaaggaattatttcagctccctctcagacactgctttaaattaaaacacacacacacacgagcagctgaagacctgagtcaccaatggtctacattaaatttctgcaactgaaagtcaggcaggtattcaagcactctgggagcctgttagaaatacagatgcccaggtcccccacccgagaccaactcaggcagaagcagcatttttaccagagctcagggcatccgtatgccccttaatgtttgaaaggtctgaatcagagtgctctcccccaaaggcatctcagactgagatagaaattgaagaaaaagcctaaggaggttcagcaactttttcaaggccgaagaacccaccagttacacaagtgcagagccctttgtccctgacattcagagccctgcatgcataggaagtgacagccccttccggggcaccctgctgccgccacgcgcattctggaaactgtgcagcaggagaaacagcgttttccttcagaccggggtttaaatggcacttcccgaatttatattcccctagatttggggcttcttccttcttgcactcctgttaacatcagcatgaattcataaactccctgcagcggaaaggaaaagaagccgcgacaaacctcaacgaagagccgtacggcactgttaaccaagtgctccagtcctgccccagtgtttacaggaaattggttccaggacccccaaagacacccaaatccacagatcctcaagtttctgatagcaaatagtgtggtaaatacctacatataacctacacacaccctcccatatactttaaattgtctcttgtagattacttgtaatacctaatacaacataaatgctatgtaaagagttgttggccaggcacagtggctcacgcctgtaatccaagcactttgggaggctgaggcaagcagatcacgaggtcaggagttcgagaccagcctaaccaacatggtgaaacccaatctctactaaaaatacaaaaattagccgggcatggtggcgcatgcctgtaatttcagctactcaggaggctgaggcaggagaatcacttgaacccaggaagcagaggttgcagtgagctgagattgtgccactacactccagcctgggcgacagagtgagactccgcctcaaaaaaaaaaaaaagatttgttatgctggattgtttagggaacaatgacaagaaaaaaatatctgtacgtgttcagtacagctgaaactttttttcccgaatatttttgatctgagtttggttgaatccacagttggggaacccgtggatgtggagggccagctggatagctgctcctggcagtgaggctctctgatccagactttcaaggttcaccctgagaactacagtaagatacatgagagagtcctgaatgaggagtcgaaagacctcgtcctcgtagcagcgactctggcacccaccaaccatgtggctttcacctaattatcatccattctgcatttttgcctccttaactgtagagaggttgtggaactacagaatctataaaggccagctgtcacaatcaatactttacaagtgcccacaatattttacaataactttgaccattgatttataaacaattataaccaaacattaggactggaacaatttgcccacctgagaaataacaagacatttatctcacatgaaaatggacaccaaataccttaccttcgtgtttattttatgaaatacaaaatctgagcatatattaataatgagctatttttttcttttttcttttttttttgagatggagtcttgctcttttgcccaggctggagtgcagtggcacaatctcggctcactgcaatctccgcttcccgggttcatgctattctcctgcctcagcctcccgagtagctaggactacaggcacccaccaccacacccagctacttttttgtatttttagtagagacggggtttcaccgtgttaaccaggatggtctcgatctcccgacctcatgatctgtctgcctcagcctcccaaagtgctaggattacaggcgtgagccactgtgcccggcctaatgagctattttcaattaaaatacctctttatcgttaatcagacaaaagagtacaatgtcagcctactctgagagcattaagaaatctttttcctgaaaggcaattgagacaattcagaagttaactaagtaactgatggaaagagggagtacaatggaatcaattgcccactcagtcctttcatataaaagttggtttaaacaatcataacatatagccgatgacgacaaatttgtttattctgtttctcttcactcgacctcttttggtcactggatcttggacaatcatgaaagcagctgccactttctcattcctttaagaagctggaaatgtaaagcttgtttaacttttcaagtcaggagccaaaaagtcacaatcaccttcccctgtttgaaattggaaatgctggctggctactttttttttagaaactaggaagtgaagggtagagagagaaatgtgaaactcaggatcatgtcagtacatgccacataatgctctgcctacggaaaaacctgctgacttagagaaatcgctccctcccaaaaatgtgattagcagggatcctctcttaaaataaaacaatgtcccttatatcttcagcatcttagtcgataaccatttgttttcatatctgtttcagaaatatcaatagtgaatggctaaaaacattatttaagaaaaacaatcattttctgctatataactcagatttgaaaacagaataaaatgtaataaaacaaagaagctaagaacaaaggcagagatacctcatctcgcccggacccactgtaaaaataatgttgcaatttaaattaaattataattaatagcagcagttttgttgaagtgtctcaaattattactttagatgctgaaactccagtggtttccatggagatattttctctaggagatgtcagatatgatctaatttttttgtctctgatatatgacaacctgaagcttccagagcctttcattttggggggttttatgttagatatttcaatttatttttatatgcacttcaatatgttttgtttgcaattggtttctgagcctaaatattttgaaacttagtaaataagaaccacaaccaccaaatttatcttctgtagttaaaaaaaaaaaaaaactttactctctccttattcactaggacagacaaacatacttctccttgggtgaggagcatagtagtgcatatgtgtgtgggcgctaaagccttagccaggatgtttactaagtacgttcctgggagaagactctcccatcatcaattcctccagcaatatgtcctgcctggcctgtgctcggtggaggaggggaggagagctaatctctgagtggtgcaatggaaacatggtctacaaatataggaacacggatgactacacacaagggcacgtgcaagggaaatatgcagaaatatgtgggcttttataagactctaaatcagactggaatggcaccatgctttggtggttaacatggagtgtcatttggggatccgcaagagaagtatgttgaatagagtctgtgcttatttgatgaaagactggtcttgagaatgttatagctagtctgttttaaattaacacgccaaatttggacctactcactgtttcccaaagtataggttccttgatactccaacaccactaaaattgttcagctctcccagcaagctgggtgaggggaacgtggatgttagcagtagaataggtgagctttattatccatgtctcagtcatgtttcttggtctccgtttttctctgtgcgcatttccaagaggatgtttgttcccaggggaaaggtcagtggcaataaaatgtatctatcaaaatagcaattgtgttgatcgccagaataaaatggctttgcctcaagggggtaagcactcacatgcattaggacaaccaggcttacagcataaataaatccaggaaaataggagtgctcacactaaacaaacaaaagattttgcccttgaaatgtataaggattcctgacctgaggattttctacaagttattttctaacaataaccaaagtccagcggactaggagtcactaatatattttctatattcaatatgtccatctcctttgttaggaagaataagaaacctgcctcactgtaaggatttagttgagactaggcatctgactttcaaaattctacctgcatagaaggttttgttatcagaagaagctaccgatgtttacatacctcttaatcaactgattttaattatgccagccaatgaacatccatttagcccttgctactgcattgttagtcactggaactgcaaacatgattaagattggtctctgacttgaagaggatgactgtcatgtaagaagtcacaagaattaagattattcccattgagaaaagggacacacagtctgaggtcgctgaggatactttcaggaaagtggtaagatctgatggacaaagaaaaggatagtaaaccagatgtccagacagagtgccatatggcagagaaaaggtgtgtcaactggaggcatcaggaactcctatgagacgggagagttccctagaccccttcactggacttgcaacagggtacagctcactcaaaccttttgcgggacggcgagcacacaggcaagtgggtgccaccgctggggtgaacgcttttggtctccagccccacagcagcgtctacggggtatgttacaattaatgctgttttaacagttactgtctggggatggctaagtgttaaccagctcattggagacagggtgacagacttttaccccctgccctcttggtacccaggtccttgtctggcatccaggaagaatcaggtcacacagttttattgagtgatggaggtggctctcagtgggatggggagctggaaagggatgaaatgggaagataattctcttcagtcatcctcagcgaaactgctttccaactgtccagttacctcttcaacattcagatgctgcttctcctcttgatgttcagccgcttgttctcttctctcctctgccacactgctctgctcctctgccagtggagcttggggtttttatggttacaggactggggggcatggcaggccaggctggttttggaaaaagcagcatttgggtgggaaaacagggctgtgaatttctcatttagggctgtgggctcaggtttgtgtgtggaacccttgccagggactccaccctcttctacccagtatttccctgcctcctgtccatatcacctatacctagaatgttgagttggaaaagtgaccccaggaaggaaggggcaggagagaaatccagctcaagggagtctttcttccctatgccaaggagttcagatttacacccaaaacaatcgtggaatatttttaaatgttcctccctagctcttgtcattctccttgcgtcatctcaggtaactccttccactatctccgtatgttctgctactgtttttatccgtaacctcaagggaaccagattaccattgtaattttttttttttttttttttttgagacggagtctcgctctgtcgccagggtggagtgcagtggtgcaatctcggctcgctacaacctccgcctcccaggttcaagcggttcaagcaattctcctgcttcagccctcctgagtagctgggactacaggcacgtgccaccatgcacagctaatttttttttttttttttttttttttttttttttgagacagtctcgctctgtcaccaggctggagtgcagtggcacaatctcagctcactgcaacctctgcctcccaggttcaagtgattctcctgcctcagcctcccgagtagctgggactacaggcgcacgccatcatgcccagctaatttttgtatttttagtagagacggggtttcaccatgttggccaggatggtctcgatctcttgacctcatgatccacttgccttggactcaccgtgcctggcctaccattgtaattttttatcactatatttaatatatttcgaaggtacatattatttaaagaaggtcggccgggcgcggtggctcacgcctgtaatcccagcactttaagaggccaagaccggcagatcacgaggtcaggagatcgagaccatcttggataacacggtgaaaccccgtttctactaaaaatacaaaaaattagccgggcatgttggcgggcgcctgtagtcccagctactcgggaggctgaggcaggagaatggcgtgaacccaggaggcagagcttgcagtgagctgagatcgcgccactgcactccaacctgggggacacagcgagactccatctcaaaaaataaagaaagaaagaaataaagaaggtcatgacggggcaggggataagggaagacaaagaaaaaggaggtcaggaaatttctgcgtttatcaaaaggagacaggaaatatcactcactcacaaagtatccaaatatctagtaaatatctccacctgggtgccccattagcacctccaactcaatatgtccaatacaaaactaattaattcctcatcacctaaaagggctcctcctcccatagtcccaacccaagccaaactgtctgcaagctgggacttcctcaacccttcaactccttgtccctttctagccttcaaaaggcagggtagagaagattgttgactttggaacgaaccctacacctgggttctaattttaactagactattcacaagcttagtgactttctagaaggatatggactaaatagtgtccagagaagagtaattataatgtcaaaaggtctggaaaagatgggcagtaacggtgcaagttttcattcctgaaaaatagcttttggtctttgaagggtggcttatgccagggaattgtatacattcataaccaaatcttcctgtgcttatggtttatgggtagcatgacttatcaggcaatttactgtaaatggacaagttcataattgaaaccacatccatgcttcagtatataatctaaagactatataaaccaaactcttcaaggatgcgtagaataaacagaccatgtcggaccaagaagttctcattagctaaagaactttattctttgtctattttattgttcactgtatatcctcagcacttggaaagaagtctgacatatagtaggcattctataaagatttagtgaataagtaaatgaataaatttgaagagaagattcaggtttaaaaaagaaagccaaggtttttattcaaggtttttattatatgtttttatataaaccagttttattcccacgggataattttaggactaatcttatatctgatgataagcctaataaatgaaagatctttgcattcttgggctgacatttgggattgggaatattaatccacactacctaccccagaaaatcctgaagggaaatgggaaagtgagctgatgagaaagtagctgactacactgtactacatgttggctctccccatttccctgcctagctaactggatttaggattggaccaattggccgggcatggtggctcacacctgtaatcccagcactttgaaaggccaaggtgggaggatcgtttgagcccaggaattcaagaccagcttgggcaacatagggaaaccccatctctacaaaaaataaaaaaatttgccaggtgtgatagtgcatggctgtggtcccagctactcaggagtctgaggcaggaggaacacttgagcctgggaggtccaggctgcagtgagccatgattgtgccactgcactccagcctggtcaacacagcaagaccaaatcttaaaaaaaaaaaaaaaaaaaaaaggattgagccagttaaaacaagcaaaaaccatcagtggtctcttttgcatcccccagttaaagacttggggaatatgaaatccttgaatacccaagagttaagttcactttcatttgtagcttgcttagtgtctgtgcttttactcagtcaactgatagttgagataatttggaatatatatacgtatctatctaaaaagtataattttcctggtcctaaacaagaatatcaagtctggccaggtgcagtggctcatgcctgtaattgcagcattttgggaggccagggtgagtggataacttgagatcaggagtttgagaccaggctggctaacatggtgaaaccctgtctctactaaaaatacaaaaattagccaggcgtggtggcaggtgcctgtaatcccagctacttgggaggctgaggcaggagaatcacctgagcctgcaaggcagcagttgcagcaagccaagatcacaccactgcactcactccagcctggacaacagagtgagaccctttccccacactgcccccgccccacacacacacaaaaaaagaatatcaagtctaaaagagaaaggattaaatcacatgtgttgaaagaatctggaatctccctttttggttgccatatttccaagagaagaggaggaaaaagggctctacctgcttttcatcattatcccggataatcttggaagtccatagcccaggaataaattagtgttagaaaacggagtatgtagcaatgttctccctgaatcataacataaacctgtttgcctggtgtgtacacatttcattgtaccaaataagtacttctaaattctttttacatttaactggtgccatccagtagccagagcttgctttagactaaggtgacctgcttctgttggaagatttaccttaacttctccaacagaagaccaacaaatgtgaattgtttctgaagttggattaggtcctatggatgacagaagatagtctgccgacttgcagatggacttcgggatctatttgcctttaccgggcttaaaatttgttttatcttagagaaatacctaaatttaacacaactgattcttacgtttataatagggaaagaaatagaaaattcactaggcagttaatattcttaactgttttgaattattacccccttacaaattcctaaagtgtgccagtgtcttattacagccatgaaaaatacaagtttaaaggaatgattcctttttaaactttttaatactgtagctgtaaaaagctcatctacaaatacattgaatgccaccagttgtgcatggggttaaaagtggatgggaagcagatttcaaccaaatgtaagaaacatattcaaatgcataaactcgtctgtctgtggaactagagcaggccagctcaggtagctctaggattctctaatattgctccaagtgggaagtcgtgtttacctaggccttgtgcaaagagaaacagcaggaacagggatggaggctgttgtgattcttgtgggagacaatggcaagacgggtccatctgaaatggagatttcatttgggaaaacaggaagtgttgaagagttgcatgaagaaataggtatcaaattatttgggatcaatagtatacttgactctgacacttgactctttctttctctacagccagtgcggattttccatataatccaggacaaggccaagctataagaaatggagtcaacagaaactcggctatcattggaggtaggtgatgtctagaggaggcttatatggggctactcaactatggaaagtaatagttgtcaataacatagtagtctaggaaaaaaagttttctaggtttttacattattcattttgctgtttaaagattatgacatatgatgtgaagaaatatagtaaatatagccgggcacagtggctcacctctgttgtcctagcactttgggaggccgaggtgggcagatcacctgaggtcaggaattcgagaccagcctagccaacatggcaaaaccccatatctactaaaaatacaaaaattagctgggcgcggtggctcacgcctgtaatcccagcactttgggaggccgaggcgggcggatcacaaggtcaggagatcgagaccatcttggctaacacggtgaaaccccgtctctactaaaaatacaaaaaattagccgggcgcagtggcgggcgcctgtagtcccagctactcaggaggctgaggcaggagaatggcgtgaacctgggaggcggagcttgcagtgagccaagattgtgccactgcaatccggcctgggctaaagagcgggactccgtctcaaaaaaaaaaaaaaaaaagaaagaaagaatatagtaaatgtaacctggctactttttaatgctggcttgtaaaaaacaaatagcagtggaaagctggacagactcagaataattaagtaggtagtagtgaccatagccaggacatttctttatccccctcggatatttttcagtcttatcctttcgcatccaaaatggtccaggatagcgtactataaaaaaatgaaaaggaatgctgggtgcagtgacttacgcctgtaatcccagcacttcgggaggccgaggcaggtggatcatttgaggtcaggagttcaagaccagcctggccaacatggtgaaaccccatctctaaaaatacaaaagttagccaggcgtggtggcgcattcctgtaatcccagctactcgggagcctgagacaagagaattgcttgagcctgggaggtagaggttgcagtgagctgagatcacaccactgtactccagtctaggtgacagattgagacctttctcaaaaaaaaaaaaaaaaaaaatacgaaaagggaaatgccagtctgatttcagttatcataataaaaattatcagaaaatcactggaggtcattattttaagtgaaataagctaggcacaaaaagacaaatattgcatattctcactgatacacaggagctaaaagatttacacacatggaggtagaaagaaaaacacgtaacagagattgggaaagttgagcaggaggaggaaggagaatgaagagaagtgggttacagggtgcaaacatacagtaagaaagataaaaggaacaagttccgggtttgctagcagggtaggatgactatatctaacaaaaatgtactgtacttggttgatgaacccctaaatactatgacttgaccactattccttatatacgtgtaacaaattttctcatgtaccccgtaaatttgcacaatgaaaataataaaaactaaaaatgtatcagaagatttaacaagctgtagcatctaaaatattccagtgttttcttctcaccatggacagctacataataatttgactctcctcggatagccactgagcctcatgcgtagatcgatattgacatccctgttaccattaagatcccaatcctcactgtcttttgcttttttaaatgaacttaattgaagtataatacgcatctataagtgtaacaagtccgtaacttttatttattattattttttgagacagagtctcactttctgttgcccaggctggagtgcagtggcgtgatctcagttcactgcaatctctgcctcccgggttcaagcgattctcctgcttcagcctcctgagtagctggaactacaggcacgcatcaccatgcctggctaatttttgtatttttagtagagacaggattgtaccatgttggccaggctggtctccaactcctgacctcaagtgatccactcgcctcagcctcccaaagtgctgggattataggtgtgagccaccgtgcccggccccaatcttttttatagtttgtggttggtttgtcctatctaaaaagtctgcctacccaaaggttttgaagattttcagctttcttctagaagttgtatcactttatcatttgccatcaggtctttaatcacttcgagttaatgtttataaatggtgtgagagaagagtcaacgtcagtattttccaaatgaatatctagtcattccaagaccatttgttgaaaaaaaaaaaactatacttttcctcaattgaattttcttggcacttttgttaaagcaactgacatatgtgtgtgtgtgtgtgtgtgtctattttctgggctttttgttttgttggtctatatatatctttccttagccaatatcatgcttgctttattgttgtatctttttttgttgagatgggagtcttgctttgttgccaggctggagtacagtggcgcgatctcggctcatgcaacctccgactccctggctcaagcgattctcctgcctcaacctcccgagtagctgggattacaggcacgcaccaccatgtccagctaatttttgtattttagtagagacagggtttcaccatgttggccaggatggtctcaatctcctgaccttgtgatccacccacctcggcctgcaaaactggtaggattacaggtgtgagccatcgctcccggcctgttgtatctttatactaagtcttgaaataaacaatgtaagttctctaatcctggccaggcgcggtggcgcacgcctgtaatcccagcactttgagaggccaagacaggttcattagaacatcttaacgatatttagtatttctatctttacatggtgtatctatacgtttatttgtctcatcagtttctctcagcaacgtattgtggttttcaatgcgaagtcttgaacagcttactatttcattaatttcattttctaagtgtctctctctggcatataaaagtataattgatcttttatatcagccttgccttctgtgaccttgctaaatttgctgttagttctaataactttttttgtatattcctcagaattgtctacctagacaagcattttatctgagaataatgagatttttttacttgtttctttccagtctatatccttttgttgtttcattgcaccgggtaggattttcagtacaaaagtgaataaatattgagatttgacaattttgcattgttccctatgttaggggaatgtgtttgatctttcactatgaaataggatattggccgtaggtttccaacagatgtcctttatcagattgagaaagtttcttctactcatagtttactgaaagctgtttgatgaatgggtattggaagttttccaaatgctttttccacatctatttagatgatcatattgttttactccttatttgcttaatgtggtaaatcacattgctttattttttaatgttaaaccaaacttgcattcctaggattaacattatcataatacatgatcttttttacatattgctgggtttgatttgctaaaattctatttaaaagaatattgtggccaggcgtagcagctcacgcctataatcccagcactttgggaggccgaggcaggtggattacctgaggtcaggagttcaggaccagcctagccaacacagtgaaaccccgtctctactaaaaatataaaaatcagctgggcgtactggtgggcgcctgtaagcccagctactcgggaggctgagacaggagaattgcttgaacctgggaggctgaggttacagtaagcccagatcgtgccattgcactccagcctgggcaacaagagtgaaactccgtctcaaaaaaaaaaaaaaaaaaaaatatatatatatatatatatatatatatattgctccatagttttcttgtaacatttttctggttttagtgtcaggataatgctggtctcataaaatgaattgagtagtgttttctcctcctatattttaagaaagatgtgtaggattggtctaatatcattaggtaatgcttgttagtagtattgttcgagtcttttaaatttttgctgattttctgttcaattgttctatcagttactgacagaacagtgttaaaaaatctccaactataattgcaaattggtctaattgtcctaccagttctgcccgtttttgcttcatttattttgtacttaggttagatttatacacattaggaacattatgtcttcctgatgaattcacccttttgtcattatgaaatgttcttcatttctactaacaaccttgtcctttgtctcatattaacgtagctattccagcttatgattattgtttgcatatcttttcccacccttttactgttgacctgtatttaaagttcatgtcttgtagatatcatatagtaggcatcttttttatccactgtctctactttttaattggagtgtttagatcagttatatttacttctgttttatctaatctgtattatttcatccagtatttttttctttttccattttttttttttagacagagtccccccccccctcacacaagctggagtgcagtggcacgatcttggctcactgcagcctccgcctcccaggttcaagcgattctcacgcctcagcatcttggctagctgggatcacaggagcgtgccaccatgcctggctgatttttgtacttttagtataaaagaccgggtttcaccatgttgcccaggctggtcttaaactcctgacctcaagtaatccgcccgcctcagcctcccaaagtgctgggattacaggcgcgagccactgctcatttcagacattgtgtgtttcacctctacaagttccacgttgtctcattttttttcccctcattttgatcatgttttcctttaaacccctgtgcaggtttctaatagctattgtactgtcctcatctgctcattccatgctctgtcctttctgtttctaatagctattgtactgtcctcatctgctcattccatgctctgtcctttctggctctccttctaattgactgatgtttcttctggtcaagtgacattttgctacattttttttctctgaattatttttctctgcagcttgacgttatttagatgtgttttaaagctttttcaggacagagctagagtagtctttattctaggcctattttagcaaacaccttcagcatgaccattctatcaactgtattaaatgctctgattgttcaatgaggtctcttcagtgtggttgttggactataaacatctcccagccctccgtgagctctggttttttgcctggcctgtggacttttattctgtacatgcacatgttagtattattcggccacaaattcagagagacttatgtgcagattattagggttctttctatacatagctctctcgcgcgcccactctatctcccctctccattcagggaaaccactgtgctttcttgtgctgcccctccctacactgctgtccaaaaatcgctgccagccagaaaactaggaaaaatgtaggattcctcctttttgtttctctgttctcagacatcatggttcctttccgcctgttttctaatgtctgtagactgtcatttcatagactgtgtccagtattttagttacttttggctggaagacaagttactcctgtttttcctgttactccttcatggacaaaaacagacatcttacttcatttttgttatctttgttgttttggaggttgtgttttatatgggagagggctgtgtctgacggagctgtagtgaagtggggacagtgttggagggactcccaagccctgtctaacctctcgtgcttctcctttctccgtcaggcgtcattgctgtggtgattttcaccatcctgtgcaccctggtcttcctgatccggtacatgttccgccacaagggcacctaccataccaacgaagcaaagggggcggagtcggcagagagcgcggacgccgccatcatgaacaacgaccccaacttcacagagaccattgatgaaagcaaaaaggaatggctcatttgaggggtggctacttggctatgggatagggaggagggaattactagggaggagagaaagggacaaaagcaccctgcttcatactcttgagcacatccttaaaatatcagcacaagttgggggaggcaggcaatggaatataatggaatattcttgagactgatcacaaaaaaaaaaaacctttttaatatttctttatagctgagttttcccttctgtatcaaaacaaaataatacaaaaaatgcttttagagtttaagcaatggttgaaatttgtaggtaatatctgtcttattttgtgtgtgtttagaggtgttctaaagacccgtggtaacagggcaagttttctacgtttttaagagcccttagaacgtgggtattttttttcttgagaaaagctaatgcacctacagatggcccccaacattctcttccttttgcttctagtcaaccttaatgggctgttacagaaactagttcgtgtttatatactatttcctttgatgtcctataagtcggaaaagaaaggggcaaagagaacctattatttgccagtttttaagcagagctcaatctatgccagctctctggcatctggggttcctgactgataccagcagttgaaggaagagagtgcatggcacctggtgtgtaacgacacaatcagcacaactggagagaggcattaaagaaccagggaaggtagtttgatttttcattgaattctacaagctaatattgttccacgtatgtagtcttagaccaatagctgtaactatcagctgcaataccatggtgaccagctgttacaaaagattttttcctgttttatctgaaacatactggatttatatatgtataagcgcctcaatggggaattagagccagatgttatgatttgtttgctctttttcttttatagttatagcaaaaatatggataatttctagtgaatgcataaattaggttgcgtttcttattttgctttaaatctctggtagtttttccacccctgtgacacaatcctaatagacagtgtcctgtaaatggacacaacacaataaagtcaagttattattgctgttactctggatgatatggaaaacactgccatattttaaatcaactactccacgtgtttttccatccaatcacactgctgtgattcagggatctttcttctaaaacggacacatttgaacctcaggttcatcacaaacctggtacctgttgcttcccagaggatggagaagtgtagttaatcacacctcttagtttaatctgaaatcttgacccagttatttaacaaataaatacctcattgattatatttaaaagtaatacacttcctgtaaacaaatggggacaatgcatccaaaaaatctttttaaacagattacacaaaaattatttccagaaaggctaccatttatcatcattatatttcaagcctcttatacttaataagcactttctaaaaagtcttgagatcccaccattctgaggaattcaatatgatcactttttccttctttgcctgggagaggttaagaggcggtttcgaaggtatagatgctattgttctgatggcccggctgaataaaatggaaattctagtttgttagaattatgcattctttttcaagattctcagtgtgcctaacttattggagcacatcagtttcttgggtaatggaaaacattacctagagttgccagtggcacattacaccagtacagagcacattccaaaggagacattggaccagttaattcccatacaagtcaaggtaacagaacaaaagggaatcctgatgcccttttaccattgctggttgagctcaggcactgtcatggacacccttaattttaaaaggttttaatcattcttctataaaatacatttaaaatggaaaaatacttaatatcactaaatatcagaacaatgtaacatttacaaatgacatattgaaagcaaaggctgttttatttagccaagatgattaccattaggagttactttatgtattgttgaaagcaaattttaaacatgatgttttagaagtgtttctgatttttaaacctggtttacaggtattacttctgcacttaccaaataatgccagatggaaatttattatttcttgcaattcccatgatagctctgttctttatgcattgtctcaacactttcccttttttcccaaaatgagtagagaattaaagccacccaaaacagcttctgctactaaaatgttctcatcctttctcctccctctccttttcctgccacaaaaggtgaaaaatgagatccaatcctctcaccaaaatttcaaacctaggacactggaatgactgcagggatcagtggttctcccatatcaccatcaattaagacatataggacactgtcttccttcaagagggttacaatgtggccatcagacaggaaaccaaacggtggataaagtattaagtaactaagtgccaaataaatgctggaaatcttgacctctccttgggattatgggtgtaacaaaaatccctacatctgtttatgaaggccatattcagtacattttaaatggtaaataatctgtttatgtgaagaaaaagaattaagtctttcttccaactctctccttggatagcctagcacagtgcagcctccataaccatgacattcccgcccaagctctcagtgcctaatcctgctttgtcattcacatctcacaaaatcttgacatcttacattccaatacattatcaagcaagcacaagtatgctggtagtagcctctttaaataatatgtatagacaacaacaacgacaaaaaatagactgttttaaagtttcagggaaagttggtggctgatttaaagttgtgcaggaaacatcttctgtgtatgaagcaaatgtcgatgttttgaaaagctaggagatgactttgaatgaatgcaaggttagtgagatcctaagctctcaaaatagcatattccctagagctcaagaaagctggtccaggaggttgaaaaagctattttgttgttaaattattttctggcccttcttaatatttaaaaatgtatttccccttgtggctttcaaccacctgctcaaaaaaagagacttgttacatgaaagttttcattaaagagctgaaaacaagaatttagagagccattcctagaaaatgtcctactgccctgcatttgacaaacaagcatcctttactaacaagagcaggaattcagaggcacaagaaaaagcattggcatgagccaaagagtctgtcttaatgttacttttgaaaatctgctgagcggccaccatatgcaggctgagagctgggcacaggcgaagccattggaagcacttcaggaacaagcacacagctgtgggacttgaacatgcaagtgttcaggttgtgtcaagaagcttttctttccttctatgatggaatctgttcttttctatcctacttttttctctcttcctctcctcaccacattataccctgctcttacgcagtaaacgttttaatggcccgtttatgtctcatgcctccaaacaacactgaatttgaaaccccccattttttcttttcaccaccctgttgagcaattttcccaaaaaaagggcagcaattattaaattgaattcaagtaagccagccaaagataggtcctaaattgctagtcccagtagaaccacctgatcctaaaccagtgcgaaacaaacagtaacaatgtccccagctgacttcagctaagaaccaatggctcctacccccgccccgcttttttttgttgttttttgttttgttttgagacggagtcttgctctgtcccccaggctggagtgcactggcgcaatctcgggctcactgcaacctcctcctcctcccacattgaggcgattctcctgcctcagcctcccaagtagctgggattacaggcacccgccatcacacccagctaattttttttttttttttgtattattagtagaagccaggtttcaccatgttggccagggtggtctcgaactcctgacctcaagtgatccgtccacctcggccttgcaaattgctgggattacaggtgtgagccaccgtgccgagccagccccattttttaaatgatgttttggttaagagtggaccatgagaattagctgacagcatcccctttctctctccctgccttggtgggaccctccctgtgtgaccttggtcaagtcctcgaa

SEQ ID NO: 17275 - DNA, 40130 bp, Human
tgacagcagacagtggtaacctgtctgtaatggaaaacactaagagactacctaccaggagactgttgtcaagctaagtctgtcctttttctgaaggcaaagcagccactctgcaacagttttgatgtgagaaaacaagggctgtaaaagggagctggcggaagtggtgacataaaggaagaggctggatgtactaggaagagctggctgaaatcagtgactcataaagctgcaaatcgcaaatcgcatgaaaacttgcgtagcaatataatgttgataaaagcaccaggtactagaacattaggatgtttgcaaagtatacccaagctctttaacagcaaatgcagtaccaagaaatataattcaagtgatagagattaatatcccaaataaatattcggcatgaagcactgtggtacctaccaactcagtggctgtggaacttcaactttctgaccgtccacctccaggtcctccaattccttaaaatatttgttctttaagcaatggagaatctcttttgcgtggctattgaaaaataaggaagtttcaaactgatctaaaaaactaagttaatacattgtatcttcttaaatttaagactgcaagtgttttaaaactaaaaccaacttttgcatggagagtaaacattctttagtcactacttttacactgtatgccttcaaaatttaagcaatccacactgtttgagccctaagagcaacactgcattccttctctcctaagcatatcctaccgttaagttttacttgcgactcatttagaaagatgtaactacaaagatggagggggggcgcggaggaggggagaaccaaggggttttatgcattctctataaattctcttacgttccaaaaggtaagaccctcagcttccctcctggaagattccccaggagccgaatcttcctcagatctcattttcatttcgtcttctaaccttgcgcctgcaatacctccgtgaccatttcattggaccctgtgctccccacctcaatgcttcctgaatccaaaccgctgaaacgccacggttctctggcactgtaacacttgtcgaagaaaacaccgtcgcctttaacctccagcatcctggccccaactcccaaaaaatcaggcactgcctccctaccttttgtaaccagtaattcttaaagtggccgggagcggctccctgagagcgtccatgaactggccccactcgccctcgggcacgatcttgagctcctggtagtagtgctcgaacagcttgttctccttgacgatctcggggtagcctccttcccagccctgaggaaggaaagagacgtctaccccgaggcccaaggaaccgccccctcgccgccgcctcgcaggcctcggtgtccgggaagcccaggaggagcccctggcccgcccgccgggtcccggctcctaccgcctcgccgcgctttccaccaccctcggcgccatcctccgcgtcctccggccgctgctgttgctggagccgccgaccccgcgaccgccgccccatagcccacgcggccgcgcacgcagcacgcagaaaccggcccgccacggccagaactctagccctacacctcccgggacttccggccggaaaccaaggccccacgtgtccgggcctggtcctttcggggacctttggggaccgtccaggaataagcccaaagcgcacaacccgtctttcagaaaagcggcgtgacagggaaaacagcgaacagctctaaggggaaaaaaatgctccaggaagcagccacaaaggcgtctccgcgcgaagcgcccaggtttcccacgcgggctcaaggagctccgcggacagcctgaagccgcgcgtgcgcagagcggcgcggggttactgcggccccggcgtgggtggggcgcttgcaggtccctccccgcgcaagtgctcgccccgcccccggggccgcacccacagccccggctaccccggagaagcctgacttgagaaccctttctgcagagtcccggcagtgcgggactccggtagccgcccctccggtagccgcccctcctgcccccgcgccgccgccctatatgttgcccgccgcggcctctggggcatggagcacgctgcccagccctggcgatggcaacggcgacgggggtggcggaggagcgcctgctggccgcgctcgcctacctgcagtgcgccgtgggctgcgcggtcttcgcgcggaatcgtcagacgaactcagtgtacggccgccacgcgctgcccagccacaggctccgagtgccggcgcgggccgcctgggtggtgcaggagctgccctcgctggccctgccgctctaccagtacgccagcgagtccgccccgcgtctccgcagcgcgcccaactgcatcctcctggccatgttcctcgtccactacgggcatcggtaacgtccccggcccccggccccctaccctactcccggcccggcgtcctctccgaccctcccctcactgcccggtgccctctccccgaagcctcccccacccagatgccctctccctgccagatcccccggggcgtcccccatctgcacgggtgcccttccccgagtcccccggccccgggagtttggaaaccagaagggattcgtctggaaagggcgggaaacaaaggactggaagggagtgatggaaaaaaacatgatgaaactgatctggaaagagccactcagtggtcctaggtttggtttccttagccgggcgcggtggcgcctgtctgtgatcccagttactcgggagtctgagatggaagaatcgcttgaacccgagaggcggaggttacagtgagccgagatctcgccactgccctccagcctgggtgacagagcgagactctgtctcaaaattaaatatataaaaataaagagttaaaaagtaaaaatgtaaaataaaaatgaagactagattttgttcccttagatcacgactgtgggggcgggggggagggggttggcctagagtctaatgctgatggtcggtcttgagggccactggtttctactcctttctgccggttccccttttggtatctttggtgatggtggagctgttttctcccagccaagtgatcagctgcaactggaaacctggtgtcctaaaactgcctagcagtttctccttataggcttgatcactttcagagactttcatgtccaccttatgcaagggaccccaggattgtgggggtggaaagccagcaaccttaaaccttaaacaaacgaagtcttaaagatgacttctaaatctttcaaggtttttgtttttttgaatatttgaaaactggctgtgtctgaaatcttcaagccttctaataagttggggttctctccaggtcgtatcttttggcttttacacagccaaagcaaacgacaggtcgaaagttcaaaattaaattttaaacgttttcattcaggctctggaaagcttcacagttaaaaaggatgtctctacacccaaggaagttgaactcactggctgtgtgactatgggcagtttacccaacctttctgatttggggtcccaccttaaaacactcacttcccagagagacaggaagaactcagtgtgtgtttataagcctctcttctttctcctggtgtcatgcattccagcgaagagaaagtacacagctccactacttggaaccagtgttgtacccagcacagtttttggtacctgagttccctgaaaaccagcaccttaccctgtaactggtgcagtctgtgtcctcagtgtgctttgatgacttgcactttaaacaagggcaagtcaacattcatcagaggcttagtgagtactgtgtgcctgaaactctttaccattgctttattttttttttggaatgggatcaaccattgctacaatttgaatattagtcagactttgctgtttgtatatacttttccataaatataccagaagctgtatgtctgtttctttatggctaaaagcaatctcaggtcagagtattcggtgctatcctagtcccatcactcatgaccccggatgagttactaagctgccccgcagcaaggtttccccacctgtagaatgggcatggtgatggaacccccctgtgggatcacatgaatttagagcaaaggcaactccctaaaatgcttgcatggtgctggcgcatctgcgtgctcagtacacaatacctagcactattttgcattgctgtgaatgcacatccagacatgtactctgtgtgtcattcatgtgcactgctgccagcctcatgtgccagcaaaactgtggtgttggaaatcaagggaacactttacaaagttttgcctgacatcccaagtggaagctttttaacttgagacatcatgtttcattgtacctacattcactcaagcagaaaaatgaatgcagcctcccaaagggccagagtcaccttgaatgatagaacttgaacagctcattcatacagagtagaacacggaggcacagcatgctgctgtcttccctgaggctgttggataaggagctgctgggatgaaagcccacttcctatactaatagtttaaaagctgctccaagaggattggctgggtcaggtatagtttttttttaaattgctaggctatttttttttttgagttgtacatgttattgtgtacatagtctatgtggtttggggacatttacattttccaaatagaaaagataaacattttccattctacccaagcaactaatttattaaacagtcacttgatctaagtcatgagcacttggaagagaaccagagtggaaacagcatttagcactgaacacaaaccatcccagcagcccctggaagcgtcctggagccctttatttgcacagggccctgcagagaacggagaacaccacacccggtgagaggaggctgtgggtacaaggatgactcttatgaaaggcaggagaaaagtgagcctgaggaggcgctggccaggcagagccagtagcaccttacacaacctgacaggtgtgcacacaggccctgtgctgacctgtgaggtttcgctggagtgaggttgggccctgccttggggaactagagcctcttttgggagtggcaaggaccagagccaggtccagggactttccacagtccatgaggcctgaaggcagcagcagagctacagctcttcccagagcaactgactgttctgggaacaatgagtacaggacagtcaggtcaaggagggaggaaaggtgaaggaagggatagagggaatggtgcgctttcatgtatttattcagcaaacacttaaggaagacttacgtgccagtgaggatttctggacctggcgttgtgctggggatatagtgacaagacattccctttgagttgaggagtaaaagacaggttatggagaatctatggggtcttttggacacaaacaccagggagggaaggacaggctgcctggaaggggacagggctggggtggggggatagccatgacgcaggacgagctgtggtcctgaccagttcccccaggagggcaaaggacattttcaggaacatctttagggctcacggtagcgacaaggattgcctgcctcctatctgtgctgaagcctccttctgatcccagggcgcttgggttcttgggtgcaggggcggcagcgtctcactggggccctagtcatgtagagcatggagtggcgtctggcatggtggcagcccctggaggcaggtgccttccccagcctcctggcaggcctccctagggccttccgaagcctgtgcctactcctatcacctttgccctctgctctgtgattacagtgacgccccgctgcatttaccctgttccctggccctctattttgtctccctgggctggtgctgtaacccaggtcctcatcatctgtgttggttcttgctgggcttcttcactcttccccactggtctttctctaccctcgtttgtaaatcctgctttgctagacacagcaaaagtctcccggagtcaagggcattagctctgaactgtgtcggagtcgctggggggctttgcagactgtgcctgacctcaggctctttctctccacccacgcagctttgttcagtattccctgaacccaggctgctttgctcatggattttccttccccactatcagcagtgaattagtcaggggattgtctctgcattgcacattcatttaacaaataactccgaggagcctgagcaggaggtgccgcttgccacgggagtcctcagtgactgcctttgttaggactggtggccaaatggtgcccagagtgcacagtcagatgcccagaggcctcctctttctgacacctgtcccaggtttgtactcagccaggtccatgaccttgtgggactttgcttctgtctttatctctgacgatggtgcctcaaaacattgcacctactttgattccttgtatctctcgtgtaatcctattaatgggctcctgtggggagcctagcccagcttcacttttaaatgtgcggtgggtaatgttaaaacacagcagggaactttgagggtgaagtgtgttaaaagataaactcaggtgcattaaaattgtagtttttttaggctgggcgcagtggctcatgcctgtaatcccagcacgctgggaggccgaggaaggtggatcacacgaggtcaggagatcaagaccgtcctgaccaacatgctgaaaccctgtctctactaaaaatacaaaatttagctgggtgtggtggcgcatgcctgtaatcccagctacttgggaggctgaggcaggagaatcgcttgaacccagaggtggaggtgcagtccagcctgggcaacaagcactaaactccatcttaaaaagaagtcatagcgttttttggagcagaccaattcatgaatcagcaccaaaccacaagcagtatgagctccacctagaaggtgtgtgggaaagccattttgtaagacgtgtttgcacaagcaagacaaaggaagcatttgattggtcagagtggaaagttccggaggttagtgggtggtttctccttggaacaatctctcattagaagtcaattggcagtttctgattgctttaagtttccttccactgttgggtttccatgtgcttatgtaagacacaagacaccatctcagcctgatggccttctaattaatttgttttaataagggcatactgaatccttggcccttgcctcatagattggaataatctgagaaaagaaaaacttctattcaaaagtgtaggatgatgaaaagtgaaataatgatagccaagcacttattttaagcatgctttgttggcagctgtgcaatttggccatcatttcaaaagtcttttacagaaggaaaggctaggcgaaaggaacagacccaaatctaggaagtgccatagatttcaatggtctcacgttgttaggggaaaaaagcaataaagtcgatcattaaaattaaccactctcagttttaaacatttaaaaattattaaatccaccatgacctaaattactcccatataaccaaattctctatttcattgttcccaaacttgggggtacaacattataggttgtcctgaaagatgacgtccagtcgctttgagagtcaaatcatttgctgaataaatgccttgttgttataagtaaaccaagggattattattccagtttgttgggaaaatatttcaagacatacttctttagttccctgtgtgaattaaacaggcatagaacttgcttgcaagacgacaaaacccaaacatcttactttaaacgctttaaagaatagtcattccaagtagttgcttgcattttcatcctctggaatgcatactgtgctatattttgagtctttcccctttggagcaggtcccatcgagcatatgagtatgaacagttatttaccagttacttgggtttatactgtatgggtaattctgcccgtttgaatagctggagaaatcactcaagtgctgcttaggagcagacgtttgagaagctcagagttctcagtgcccttgtgtgggtgccaccccacagccctcgcggacagtaagaatggacatggaggcagccccgatgattttgttcttttcaataatccatttttcttcctgggtgcttatagggcactttctttttccttagatggataatctgtgtttgcttgtttattaatttcgcctgattttctccaagcctttttaggaaattgaatttagcccaggaaattgaatttctccgtgtctctcattctgtctgttctgaatgttaggtgccaggacttaagatacttgtcaatattgtatgtgaacaaacttacaggtgaaatacatgcttgttgtagaaaacttagaaaataattcaaggaaagaaagaaaagttgcctataatttcatcttagagataaaactgacgatattgtggtattatctttttcccatatctttcattgcttttaataagtttttttctaagcagtagagatacacacatacacatacaacatcttgtaacctacttttagcagttggtaagtatttcttctgacttaatagaaacacttaatgaaaatgactgacagtgaggatttcatatgcttgggccagacattcccatgtctcaacgggtcctcatggtgtggtggctggagcacctgggaaaagggacattgccagccagccctgcctctgtgatgttctctggccatgtcaccatattcctgtgagcttccacgttctgatctgtaaaatagggataatagtcacagttttgcagtgtaaaaaaagggcatttagtataggattaggaattattagaaacactttgataaggaactataagatgcacttttatattatatctaagcttgtaaacttaaccaaaaggcaactgcaaatcgtcctggccattaaagcaccaaataaattctggcacattaatactctcagttcagctccatcatcaaacatgtctcccattcctggtggcctcacagacaccaaggtttgcagttttcatgggttataaaaacaacttgatgaaaagcaagtcttattcttttttttttttttcaattgagatggggtctcccagtgttgcctgggctggtctcggaactcctgggctcaaacagtcctccttccttggcctcccaaagtggtgggattaccaccacaccaggccaaagccttgttctttgcctggaaagaaataagataaaataggaaaattataacatgacagagaacaaagtgtcagatttaatcttacatttactctgattaatcagcaaacagaatctctgtgtagcttcccagacctgactgttttgtattcgttagcttgtaatcagaacagaaaacagatatatgacacattactcaacatcctttttaatccaagtgcttcatagtttctcttaaaaatggtttccatcttaagggactgtcaccttcttgttcaatcctttattttctcaaagagagggaatagttgtttcccattgttcctctatggaagggtgattttgggtgcgaatgggatggtgtaggagaaggggctgtgagtgcccatgcctgtcctaactggggtagtctgggccgcagactgatgtgctgtgagttccatgagtaatttatgtccaggcaggtgcacccaccttccttgctatctgaaattggccccatggccctaagtaggaccctgtcatttatgcctggggtccgctgcactctctcaagtgctgtcgtccctctagagtctaaacaaagactcaggtaaaagccatgcccagacaccttcttcccgaccccaccccacgcgagttccaaattggccacagtcaaaggaaaatcttcaccgacaacaatggatttccaaggaagtaaactgagtaaagctaaagggaatggcccgcaagaagaaaagccttccaggagatgctgagaggggcagagcgcttccttggagcggagtgctaggtccaagtcagagctctctagagggagggaagtcaggaagaagatctcaccttctcctagcaactggaggcagaggcagcactcccctcctctcccctgtccaccactctgttgacttcagcggttttatgacaggcctataggcatcagggttactggtgtccccttccagggcaggaatcagagaacaccagaagagactggtgtcgatctttgtaaggctcggtttccagtccttgcagttctcagacattcacatgagacaaaaaagagggacaaatcttatcctgaggttctttgtgaatgtcttatccagggcatgtgctagagcagaagtcattcaaaaatgcagctacgcagaagcacgtcctcactcccagagcacagccaaacctagaccgcagcagctgcagccatgtagcaccagtgccctgagcaagttgatgtcaagttgatgtctccaaaatataacacacttgtgctaattcagactaattgtcagcaggcttttctggaaagagccaggtagtgcatatcttaggctttgtgggccaagatactgggtaggtatttacgatgagagaaaacacattttcacaaaagtttcagtggtaaattcaaaatatattatcttagtgcattttttgtaatatatgtctaatgagaagaatagaattcttttcttggtgagggataacatttcacttattgggattcaaagttagtgtttcctattatcaacatctattgtaaatgttcctctcttagtgttgatctgtcatgagattttatgtattttatctctataaatggaagcgttgacatcagtccacatgtatatgattttaattgagcatgatcatcacttggaaggcactcatggaatcctgttagattcttctcttgatctttgcctttccatatggtattacattacagattcatatcttcctatggaagattagatggcaactcttccactgcacagctaaatggattttgaaatatggaaatccaggttcacacactgtatttaaacttagaatttatatccactgcaaactcatgtgagcatggagagctcacttcttttaattttaatagcatggaaagtacagaacgcagtttgatatgacttgtgattggaacaatggcagttgtcatcaaaatgactttaacacagtatgagttttgcacaagtgctgttttgccttgcagctttaggttgaatttattatcaagtctgcagtaaaagctacttaagcccttcagaactcaataatggtggtgagggcagttcttgctcagaaaagtttcagtctcagctctgagctcaaaataatgtgatgaaactttattaagccatcaaactggtgtgtttatgtgggacaaatcggcatagtcagcttatttgtgacaaaaagttagagaactgatgatagttgagtccatgagagggattgtcattcactgttgacactatgggcttaatcacacacaacagattttctgcaaaagacctgctgatacaaggaatagcatgaaacaccttacatttttacaagtttgtaagtttgtaatttgttttttttttgtcccatacatttttatcaccatcatttgcaacagcttagcagattccactttggattctactaaattcgtgttttctcaacatctttgaaaatattctcaccggtagttgttctgcacagactatctaaagagcctaacccttcattcacttcagccttgatgtgaactcctcaaataaacaactgagccatatcagtaacatccatagactcacccagagccgacaaagactgctcatcatctgccttgctttttcttttttaattattattttgagacaggatctcactctgtcacccaagctggagtgcagtggcatgatcctcagcttattgcagcctccacctcccaggctctgatgatcctcccacctcagtctcccaagtagctgggactacaggcatgtaccaccacacccagctaattttcatattttttgtagagagggggtttcgccatgttgcccaggctagtcacagccatctacctgccttggcctcctgaagtgctgggattacaggcatgagccactgcatctggtcctgccttgcttaaatagactgttgagggtgctcccagtgtccttaactcctctagcaagtgttctccccaaaaggctaattgtgagaaacaagtgtgtattctctggacacgcctctttggttgctgctgttgattaactcaccattgatgcacagctttccttgcttcactaaccaatgagccgcccgataacctactttggttgcagcctcattttcctttgttttgtgaagaaatcctgctgccttggcctctgtgccttaaatgttctagtttttctgaccagtgcttttctgtgagttgggaataggctggtgagtgcagagtctgataatattatcctctattatattcttttgacacagttctagtgtcattgccagctgacgtttttcaggtcagaattcaacccacaacttagaagaaaattgggagaaatggatcaaggttcgctggatgtgattctgatatgccagagggaacgtccaccacatacgcagaatgtttcctgggagttgcttctctcacactgcatttgtccattgtttaaatgggtgacatccaatgcagaagtgtcttaagccattttcaattctgtgtatttcaaccttgctaatattttcccttcctctttttcaccttgccttcctgttatccagtattgaatttaggatggatttttttcaggtccagaggcccgacctcttatgaactgagtcctttctattttaatagacatcttgctaaaccaaatccaggccttacattccccttttatgtcttgctctttttttctgtatttcctcaaacttagaatttgaacactttctcacctctatcctgcagtttgcctagtgggaaataacttgaggccgtaactctcagggaagttttctctcaactttctcataccggtgtcccttttgctctttgccgcattgagaatctcctaagctgacttcagaagtgggctgcttgctcttggtacttctcagcttggtacactgaggggtagagtgagagccactctgtcttctgccattaattctgtccatccgggtctaacacaaggcctcctgttctggttgacaaatgggccgaggcaggaaggatgtctgatcacaagacaagattgcctcctgtttttaagggagcctatgacagtccaagaagcccacacgtacctctgtcaaaaccaaattctgcttgttccacaggaaatgttggtatgcaagcacttgcagtgtgcctacatcccaaatgccagcccatggtacccattgtctgcccggatctgaatcatgattccaaggcgcagagagaaattgctgggattcgttgttcttattcattgcttggcaacactgcagcttccaggagaatacccacctcactgatgacacaacatctgaatgcacacttactggccaacacgtgctttgctgtaaatcagtatgaagtcttcctaggggtcctggcctgaatgagatgagaaccttggaggctgcttttgactcatgtgaatgtcttccccaggagttaagtgggagtgctggggagagagtggcttgaggatgcacagccagcatgacactactattatgtgattactgtcgacgttcataaccataactaatgactaattatgactttaccctggcgcacatggtcagaatggaaacaaataacaagctttacagtttttcctgctctattaaggtataatttacaaataataaaattcacccattttaagtctgtaatttgggctggtcgcggtggctcaggcctgtaatcccaacactttgggaggtagaggcaggtggatcacctgaggtcgggagttcgagaacagcctgaccaacatggagaaaccccgtctctactaaaaatacaaaattagccgggtgtggtaacacatgcctgtaatcccagctactcgggaggctgaggcaggagaatcgcttcaacccgggaggcggaggttgcggtgagccgagatcacgccactgcactccagcctggaccacaagagcgaaactccatctcaaaaaaaaaaaaaaaagtctgtagcttgatgaattttggtgattgcatatagttgtgtaatcatcaccgcaaatcaagaggtagaacagctgtattcctctaaaaaactccctttgtgtcattgtggccagtctccaccctgactctatttttgccttgtctggatttcgtaagtctaaattcagtttcacaatctatttttttttattttctttattattatacttgaagttctagggtatatgtgcagaacgtgcaggtttgttacataggtatacacatgccatggtggtttgctgcacccattaacccgtgatctgcattaggtatttctcctaatgctatccttcccccgatcccccaccccacaacaggccccagtgtgtgatgttcccctccctgcgtccatgtgttctcattgttcaactcccacttatgagtgaagacatgcagtattttgttttctgttcttgtgatagtttgctgagaatgacagtttctagcatcatccatgtccctgcaaaggatatgaactcatccttttttatggatgcatagtattccatggtgtatatgtgccacattttctttatccagactatcattgatgggcatttgtgttggttccaaggctttgctattgtgaacagtaccacaataaacatacgtgtacatgtgtctttatggtagaatgatttataatcctttgggtatatacccagtaacgggattgctggggcaaatggtatttctagttctagatccttgaggaatttggttggtaggctattaattactgcctcaatttcagaatttgttattggtgtattcagggattcgacttcttcctggtttaatcttgggagggcgtatgtgtccaggaatttatttatttattctagatttttctagtttatttgcatagaggtgtttatagtattctctgatggtagtttgtatttctgtgggaccggtggtgatatcctctttatcattttttattgcatctatttgattcttctctcttttcttctttattagtctggctagcagtctatctattttgttgatcttttcaaaaaaccagctcctagattcattgatttttttgaagggtttttcatgtctgtctctccttcagttctgctctgatcttagttatttcttatcttctgttagcttttgaatttgtttgttcttgcttctctagttcttttaattgtgggttagggtgtcgattttagatctttcctgctttctcttgcgggcatttagtgctataaatttccctctacacactgctttaaatgtgtcccaaagattctggtatgttgtatctttgttcttattggttttaaagaacatctttatttctgctttcattttgttatttatccagtagtcattcaggagcaggttgttcagtttccatgtagttgtgtggttttgagtgagtttcttaatcttgagttctaatttgattgcactgtgatataagagactgtttgttatgatttccattcttttgcatttgttgaggagtgttttacttccaaccatgtggtcaattttagaataagtgtgatgtggtgctgagaagagtgtatattctgttgatttggggtggagagttctgtagatgtctactaggtccacttgatccagagctgagttcaagtcctggatatccttgttaattttctgtctcattgatctgtctaatattgacagtggggtgttaaagtctcccactattattgtgtgggagtctaagtctctttgtaggtctttaagaacttgctttatgaatctgggtgctcctgtattgggtgcatatatatctaggatagttacctctgcttgttgcattgatctctttaccattatgcccttcttcgtctcttttgacctttttggtttaaaatctgttttctcagagactaggattgcaacccctgctttttgctttccatttgcttggtaaatattcctctatccctttattttgagcctatgtgtgtctttgcacgtgagatgggtctcctgaatacagcacaccgatgggtcttgtctctttatccagtttgccagtctgtgtcttttaattggggcatttagcctgtttacatttaaggttagtattgttatctgtgaatctgatcctttcattatgatgctagctggttattttgcctgttagtttatgcagtttcttcatagtgtcaatgatctttacaatttggtatatttttgcagtggctggtaccggttgttcctttccatgtttagtgcttccttcaggagctcttgtaaggcagtcctgatggtgacaaaatctctcagcatttgcttgtctgtaaaggattttatttctccttcacttatgaagcttagtttggctggatatgaaattccagatatgaaagaaaagaaaattcttttctttcagaatgttgaatattggcccccactctcttctggcttgtagggtttctgccaagagatctgctgttagtctgatgggcttccctttatgggtaaccagccctttctctctggctgcccttaacattttttccttcatttcaaccttggtgaatctgacaattatgtgtcttggggttgctctcctcgaggagtatctttgtggtgttctctgtatttcctgaatttgaatgttggcctgccttgctaggttggggaagttctcctggataatatcctgaagagtgttttccaacttggttccattctccccgtcactttcaggtacaagagtcaaacgtagatttggtcttttcacatagtaccatatttcttggaggctttgtttcttttcactctaagtcttctcgctttatttcattgagttgatcttcaatgactgatatccttttgccacttgattgatttggctattgatacttgtgtatgcttcacgaagttcttgtgctgtgtttttcagctgcatcatgtcttcacctgttcttctctaagcaggttattctagttagcaattcctctaaccttttttccaggttcttatcttccttgcattgggttagaacatgctcctttggctcagaggagtttgttattacccgccttctgaagcctacttctgtcaatttgtcaaactaattctctatccagttttgttcccttgctggcaaggagttgtgatcctttggaggagaagaggcattctggctttttgaattttcagcctttttgcactggtttttccccatctttgtggatttatctgcctttggtctttgatgttggcgatatcgatactattttttttcggtttgttagttttccttctaacaggcccctctgctgcaggtctgcctgagtttgctggaggtccgctccagaccctgtttgcctgggtatcaccagtggaggctgcagaacaacaaacattgctgcctgttcctacctctggaagcttcatcccagaggggcacccgccagatgccagccagagctctccagtatgaggtgtctgtcggcccctactgggaggagtcttccagtgtggatacacagggggtcagggacccacttgaggaggttgtcccttatcagagctcgaactgtgtgctgggagaaccgctgctctcttcagagctgtcaggcagagacgtttaagtctgctgaagctgcgcccagagccgccccctcccccaggtgctctgtcccagggagctgcggttggctctgcccagttcgaacttcctggggctttgtttacactatgagggtaaaaccgtctacttaagcctcagcagtggtggatgcccctccccccaccaagctctagcatcccaggtcaacctcaaactgctctggagcagcgagaatttcaagccagtggatcttagctttctgggctccatcggcatgggacccactgagccaggcactggagagaatggtctgctggttgcgaagactatgagaaaagcgcagtgtctgggccagaatgcaccgttcctcctggtacagtctctcatggcttcccttggctaggaaagggaaatcccttgaccccttgcacttcctgggtgaggcgatgccccaccctgcttcggctcgccctccgtgggctgcacccactgtccaaccagtcccagtgagataagccagttacctcagttggaaatgcaggaatcacccaccttctgtgtcgatctcgctgggagctgcaagaccggagctgttcctattcagccatcttgcccgcccacccttcacaatctattaatatatagagagcagtaatattgcccaaaaagggaaagttaatctttgtggttaatcctctcccctgagtctcattttgccttttctagaatttcataagtctaaattggatttatttcattggtaacagtgctattcatgttgtctttctttcttctcgggtcagttttggtcatctgtgtctttcaaggactttgtctatttcatcaagttgttaaatttattggtataaggttgttcataatagttccttattatctgagtggatcacgtgagcccaggagttcaagaccagactagagatcagacatagagagaccctgtctctacaaaaaaaagtttttaaattaaccaggtgtggtggtgtgtgcctgaggtcccagctactcaggaagctgaggcaggaggatcacttgagcctaggatgttgaggctgcagtgagccatgattgccccactgcactctagcctgagtgacagagcaagaccctgtcttgaaaaaaaaaaaaaaagagttccttattatcctcttaaggtctgtaggatatgtagtgatgtcccctctttcaatgtgttatacacttatattaaaaagaaaattcaaacagagaataacattttgcattctctttataattttctaatttcttgtccttttattttaactccttaaacctttagtaaaatgcacctaagccagtgtggtacaacagaacgtgatctttctttttttttttttaattatactttaagttttagggtacatgtgcacattgtgcaggttagttacatatgtatacatgtgccatgctggtgtgctgcacccactaactcgtcatctagcattaggtatatctcccaatgcttcctcctgccccgcggccccccaccccacaacagtccccagagtgtgatgttccccttcctgtgtccatgtgatctcattgttcaattcccacctatgagtgagaatatgcggtgtttggttttttgttcttgtgatagtttactgagaatgaacatgatctttcaattgccccgatttacatttaagctcagccactcactagcttgtggccttgagcaacttactttaccactctgagtcttaattttatcctctatcaaatgtggataagagtgcctctgcctggttagctgagctgggggcaaggagttgctgggggaattgggggtggggctagcaggtgaaagtgctcagtgaatggaagccattgcaatggtgatggatgatgtgatgatgtgttccaaatcttattacttagactaggactagttaatggttttaggatagtggaaatcttgagagcctcttgaagcccctagttttctcaaattcagtgtattctgttttatattgcatgtaagtagaatctggagtttgtacactgtggtaaacatgattgaaacgtggtaatgctttattgaaaaatctgctttttggctggatacagtggctcacgcctataatcccaacattttgggacaacaaggcaggaagatcacttgaggtcgaagtttgagaccagcctgagcaacagattgagacttggtctctacaaaataataataataataataataagtgtggtggcacatgcttgtagtcccagctactcgagaggctgggacaggaagatcgcttaagccctggagctcaaggccgcagtgagccatgatcaagccactgtactgcagcctgggcaacacagcaagaacctgtctcaaaaaataaaattaaaatcaaaatccacttttagcttagatataataaattagtataaatgttactgaggatgacatttgtacaagaaagtaagatttaaaacccaaatcatttaagataggattacagaaatgattatctttaattttttaaaaaattgtgcctgtttcttgtttcctaaggtgcttaatttacccatttctgatgcgaggaggaaagcctatgccactgttggcgtgtacaatggcgattatgttctgtacctgtaacggctatttgcaaagcagatacttgagccattgtgcagtgtatgctgatgactgggtaacagatccccgttttctaataggtgagtgtccacagcagtgaactccgccttgttcacatcattgcttttatattgatgtcccagtggtttctaatgagaaagtccaagcttcctgtgagaacaaagacaacagagaaagcagcagcaccccggagtcccatgggagagcccagctgtctcagcacagctgggggcagagaggtgacgcaggtgctgggcaccttcccccgcacgggcaggcactgaagcacaggtgcctggtcaggccaagaacccaaaaatagcagtgggctgtagcagaatgagcagggactaaagattgagaccctttggccactcattgaccacataatctcctgcggttccttccatgacatgaggaaaacccagactgggttagcttcctacagtgcagcttctgtgattctatgaacttgaatcaacttttaggtctatgaagttgttgaatttttttatttgtatcagttaatgtgaattaatgtacattttcaacctctaattataactttttaagttctaagcaaaaatgaaaataaaacagccatcaaaaatatttgcaagagcattaaaaattaacactctggctgggtgcagtggctcacactgtaatcctagcactttgggaggctgaggtgggcagatgacttgaatccaggagttcaagaccagcctgggcaacatggcgaaactccagctctacaaaaaatacaaaaacgtagctgggcatggtgacacgcaccatggtcccagcttactcagaggcactgaggtgggaggatcacctgaggccaggagatcaaggctgcagtgagccatgattgtgccactgcgttccagcctgggtgacagagtgagactctgtctcaaaaaaaaaaaaaaaaaaaactcagggatcttatatataagaaaggttcttctatatatttgtttagtctatcctagcatttagatattaaaccatactgaggtgttgcttacaatggtagcatgctaaaagtctgaagtcagtctgtcagatttgcaaactaccctgcagtgcttcaccttaagctacataaagtgaccttacattgcattgtgctttttctccatgtgtattaatttataatcatagaaataaactaacacttggatagtactttgttgctgagagatccctttcacatttctcagccatgttttttgttggtgaattagaattttattccaaggtttcatcatacctgaggatcgttacagtgagacacctgtccctcctctacaaaaggagggttggctgagaaggcgtttcaagatccttttctagctccagagtctgtgcctccatgaaatgctagactaaattctttggtactaaactgttgtacactacccccaaatatcttcttggtttacctgctttttgactactttattttcttctgccctacctgtcaagaggaagaacaggcttttgagttcctgtgcagatcacacgatttatgcctccccatgttctctgaggcagaaaggatgtccctaagatgtgaaaggtcagaagagttacacagctggcccaagacatctagacgcagtgaatggcagagcggtgatttccaccacctcaccaagctgagcttccgcaagtggtaacaaggaataagaggaaggggaatttctttctttttttctttttaactaaagatacagattttaaatgtttgccagagagtctcatgggactcacctctatggtgaacaacaacagaagaaccctcctgtttaaagtagctccgcagatggttcgcatcacgtagaggtgactgtgaagctggtcagagattccaaacaccaatcaattgtagacagacctcttgacttctctacaattaaacagaaggatttgaaaaggaaaaaatatgccaagtggaagacaatctaggttaccttttgtgtgttatatttattgcctagagtttattgtttttgtgaggaaacagacgtgaaattacataaataagtaattatgcctactgtagttaccatgaagtaataagcaaataataataatatatttttttttttgagatggagtttctctatcgcccaggctggagtgcagaggtgcaatctcggctcactgcaacctctgcctcctgagttcaagagattctcctgcctcagcctcccgagtagctgggactataggtgcatgccactatgcccaactaattttttttattttttttagtaaagacagggtttcatcatgttggccagactggtcttggactcctgacctcaggtgattcacccgcctcagcctcccaaagtggtgggattacaggtgtgagccaccatgcccagcaaatttctaacaaaaggtttttcaaaacagcaaaagtggttaatctaaaatattttatagaaagattttaagttttttttttgtttgtttgtttgtttgtttgttttttcttgaggcagcctgtcatccaggctggagtgcagtggcgtgatcttggctcatggcaacgtgtgcctcccaggctcaagcaattcttgtgcctcaacctcagagtagctgggattacaggcttgcgccatcttacctggttaatttttgtattttcagtagagatggggtttcaccatgttggccaggctggtcttgaacccctggcctgaagtgatccacccaccttggcctcccaaagtgctgggattataggtgtgagccactatgcccagccagattttaagatcttataaatggaattaaatatttagcttagatgaacacaagtactagttttcttccaatctaagcaataaagggagcttgtctcctggaagaaacataaagtaaccatgttatttagacaacatgattcctttctagaatctcatattggaagccaaattacctaggggtgaaatactaaaatcccaaaaaggtagcaaatcaactataaatgtatggatccaataaatgacttacaaaacgtattataaaacttggtatgaactgctttgcttaggaaaaaaaaataaaagctgattacagtggcaaaatcagaaggaagaaatcttgaaacccttgctatagaccagaaggttttccatgtcctttttctaactgtgaaaaagtattcaatgtcactggtgatgactcagataataatgatgccccacgtgtacattgatttaatattgaactgaatgccagcactaagcagcatctgtctttcccattttaaaaaagtatatcagaaccatcaagttaacctctttttatcaatatttcttttataaaacactgttttggccttttgccttttcttgatggaattaattgatgtgatactaacaactctcctttaagtgatgaaaaatccctgcggattcgtaagaataggagagaaaactggggataccgtgggattctggggagaaccatgcaggcggccacgggagactcttgtcaagaaccgaggaggaaggactgaccgagcaatgctgattgatgagcctgcaggaattctgctgtgggggaaacatagatgcgcattaatttgtttaaatgaggttgtaaataagagaagaccagagatctactcctaggaactgccacccttcaaggggtgacgtacagccagtggtgacagagcagcacaggagcatcacccctcctggttcatgtggtggagatggcagcattgcctcatgcagattttgtgagaaataagtgggatgcgtctgtctggtgggctgactccctgatgctccctggaaaggagccgtgtgcccaagtcagatttctgtccatacttgtcatcctgaagatgtagattgtgatgaacaggtcaaagtattttgagtacattagatgatgtatttgtattattagaaaaacaaagccctgcttggcatacctgacaacagtccttaatggtttttactaccagttatggctaatatgttacactaacaatggtaatctgaagggttgcaataatactgttcagtcaggctggggctcgtagtgaaattttacggtttattagccataatcatcttgcaatttttttcctttaggttttggcttgtggttaacgggcatgttgataaacatccattcagatcatatcctaaggaatctcagaaaaccaggagatactggatacaaaataccaaggggtacgtacagaaagtgaagaatttctgtgaaagttgcttgccatggttcctggctattttagtgttgccagctctaagaagtagtagcgtagtagttattagctacaagttttcagtgtaagtcatcattattaataacaagtgctattgttattgtcttattagaataacaaaagacccaaatctagctaactgaacagttattaaacaaagcagaaactccagttatatctgtgcttgggaagagaggatgaggaagaatttatgattgacgaggagtgtctgacacttttgtttctagcagtataatggaatagatactttgaccctcctctgaaaacagtttaaaacattggaatattttgaaaatcttcttaaacgcatcagtatactatcaagaaaggaactaatcatcagaggacaagatctaggtgaatgttggaatctggagcgtgtcttttgagaatttgtgatgaggcgccgaccaccatgctggtttataacccagattcgcactacttgtatagtatgaaaaatctcaagccataaattaatttccgtggcctggggtagtggtggactctcctggccagcaaaagcccagatccccaaggggatgtgcattcaacctgagtctcaaagaacccaatgtgccacgttccacagagtaagaggcacggtcacaaggtacagaacccacaaggaagtacagcaccatgagggagagcgtaattcaacatgaaagatttcagatgttagaattaatggaaacattataaagtgagtacttgaaatgctttttaaaaggagtagattacaattaggagtaagaagcaatgtaccataaaaggactagaaaccaatagagcttcagaaaaaattttttaaagtacataaatctaaaactttaatggagaaagggcgtgacatcacttagtttgaaattcttccacttatgttcctagaaaccatatgagaatagcaacaaaaacaaacaatgctacaaacctcaaattacttaaactgtgaccctgagaacctggaatcagcaaagccagctccagacgtgatggtagtgtgatagaagtggcagagaagagaaaacatgacagagtcctagacaggctgctgatcacctattcagcccctgggtggattggggaagaatcctctctttggtgttgggcttatgagcaaactgcaccctcatggggtcatcccaaggagccgcttcctctggcaggtacagtggctgggagagcacagtgtaagctggatggtggccccctcgcttcctgcccagcacccttgcatggggaacagcatgattccaaattaatcggcaagtgttcatcccctgaaggagagggccctgtcctgaggaggagctgccatgagccagactaagaagggacagggcacagtcctggggaaggcagaatgaaaaggtgcagaagataccagaagccacagactggcagatttgagaaacaccacttccaaaagaaagggcatccccagagacggcaggatcccatgggagggccctcctgggccaggctggttacggaaaggcctgcggtgccttatacagagggtcctgtccactgttccacagtagttgagatgccacaaaaacttttcagcccctgtccctccatttcctgctctcagtgtctgatccttgttctaatccaacatattcaaacctgaacaacaaaaaaggtacaatccccaaatctgtgcagtcataacattaggacagcaaaaaagcagcaaaacttacctgagcagaaacgtgtttcacaaagcaggggaaaattgtaatcaaaattccaacatgaattttaaaatgtgaatggaggccaagcgtggtggctgacgcctgtaatcccagcatgttgagaggccgaggtgggcagatcacatgaggtccagagttcgagaccaacctggccaacatggtaaaaccccatccctactaaaaacacaaaaattagctgggcgtggtggcacgtgcctgtaatcccagctacttgggaggctgagacacgagaatcacttgagtctgggaggcagagggtgcagttagctgagatcatgccactgtattccagcctggacgacagagtgagactctgtctaaaaaaaataaaaaaaataaaatgtgaatggagcagttgcagagtctatacccatcagctaaagaacacctgcgacgaacccgcaatctacaaacttattacctgtcgcagtaaagggagacctctccctgtgatgtttccccacagcatgtagccgccttcctgaagctagtaatcaacccagcttcctgacggcctgtggccatcaatggcatctctgtgaacagacaggccaaaggaaatgcagaagcttggctgtaactctcaggcagcaggaggtgacaccagacatcggtgcagatgacatgggacacatgagacttagggaagaaaatgcttctaaaattcttaatttctcctctccaagtactaaccaggctcagccttgcttagcttccaagatcagacaagatcaaaattctttatttctaatcatttaaaaaaaaaaacaaaccacagaagcatgttagaagatagaaatggaaaagcaaagaatatgaaacctagactgggtgcagtggctcacacctgtaatcccagcactttgggaggctgaggcaggaggatcacttgaggccaggagttcgagaccagcctaggcaacatagccagactcccatctccacaaaaaaattgaaagaaaattagccaggcatggtggtgcacacctgtagtcccagccactcaggaagctgaggtgggaggatcacttgaacccaggagtttgtggctgcagtgagcctcgatcataccactgcactccagagggagaccctgtctcaaaaaaaaaaatcttttttttttttttgagatggggtctcgctctgtcacccaggctggagtgcagtggcgcgatctcggctcactgcaagctctgcctctcgggttcacgccattctcttgcctcagccccccgagtagctgggactacaggcgcccgccaccacgcctggctaattttttgtatttttactagagatggggtttcaccgtgttagccaggatggtctcgatctcctgacctcgtgatccgcccaccttggcctcccaaagtgctgggattacaggcgtgagccaccgtgcccggccaaaaaagatcattcttattgtgaatgatgttttggtgatagctggagaaggtagggaaaatatatccatcctaggcacattgaagtccatgaagaagaaatccaaagcattggaacagaatatattttaaaaactaattcaagaaagcttttgtgaagtaaaacaagacacaagagcgtctgccgtttgcaggtacgcaccctataccggaggaagtggacaggaaacagtgacgatcatctgcacgtgccatgagtggcttgtaagggaaagttcgttagattcttcagggcagcgttccgtgccagggtcttagaggcagcaacacgagaggcccaaggaacgtggaagccaaaatattatcctagctttggagtccctcatgtaaaatctgtcaggttttgaagactcaggtgtagggagtctgagtgctgtgccccatgaagactccaccatggtcggctttgtgaccagctcccttcgctgcagactcttaattttgcagggcgttttcatgtgacacattgatggtttctaatacacaggtgtgccgtctacatccagtgactccgtgaggtctttcagaaacgcttcgcaggactctgttaatcatggtgccataactggttagggtcaaaggagcaagtgacaaaatgaacaaataaagagataaagagaggtgcacaggtgtgacgtccatagtcagtacatacaggctgaactagggcttaggacaagtgctgtgggctgtgtgtgacaaccagtttgtggttttgtaatgtggcatctgtaagcagcctgtgtctcaagaggacattttttagcagattggcatctgcaggttttccagtctaattccatgcttaccagtccacccatacggttccaccacaccgtgtgtcccacaccagacacttaagagagaaggttcactgagcaggcggcatgcaggaaggcatcgtggccccagccctgcccacaggctgtctgccctttgggtgactggcatctgcagggtatggtacaaaggtccttccacgtctgggattcacctgcccagggctctgatgaaatacagatcatgattaacgtaatcttgtagaaagttgaagcagttacagaaatgggtgaataagaaagtgaaagtgactaagctccatggcccagaaggaacagcgctgtgaatgctttgggtccattcttgcaggtgcttctgcaggtgcacatgcccacacatggcgaatgacattctatttattgggcattaagtttgatatttttatgttttatattgtcattaaaaagttcacttgtcaatgaatattgatatttgtattagtctgttttcactctgctataaagaactacctgagactgggtaatttatgaagagaaaatgtttaattgactcacagttccgcatggctggggaggactcaggaaacttacaatcatggcagaaggcaaaggggaagtaaagaccttcacatggtggcaggagagagagcgagtgaagggggatctgcctcactctttcaaaccattacatgtcatgagaattcactatcacaagaaaccgcctgcatgatccagtcacctcccactgggtcccttccttgtcctgtggggatcacagttcaagatgagattgggtggggacacagaatcaaaccatatcagtattattttacaattctgaattatttcaagcttacagaaaagtagtagagagttcattattgcaaacgtctacataccccaccttccttaagaaaaagaaaagcactgtgctgtctcgggctcagcaaaaccattttctttctttttaaaaaaatagaccatctcaggctgggtgtcatggctcacacctgtaatcccagcactttgggaggccaagagaggtgggtcacctgaggtcaggaattccacaccagcctagccagcatagtgaaaccccatccctactaaaaatacaaaactccaaaaaaaaaaaaaaaaaggtagccaaaagccctcatgcatgcatgtaagttgcagtgtgctcagagatgtagtctctaccctatgctgcagtatttgctgaaattggtcttatgacttagggcgtaataggtttgtcttttttttttttttttttttgagacagagtctagctctgtcacccaggctggagtgcaatggcacgatctcggctcattgcaacctctgcctcctgggttcaagcgattctcatgcgtcagcctcccgagtagctgggactacaggtgtgtgccatcacacctggctgatttttgtattttcagtatagacaaggtttcaccatgttggccaggctggtctccaactcctgacctcacatgatccacctgcctcagcctcccaaagttctgggattagaggcgtgagccactgcgcccagcctaatttttttttaaaaaaagctctgtccttacatgccttcagaattttctcagctctgcagacatagtgtccagttggaacctggggcagatcacaccaggcctctctaaacacacttgagtaaccacaaagctacagcctgagggtgagtcccaagtccaaggaggggccttctgccctccctctctgctgggacccttctccccacccctcatctggtctttggagtgtgccagccattgctgtctgcctcagggcctttgctgcatctcttctcctgcctggagcactcctgagagcacctccagcacctgccaggctggccctcacctgcaagccttgaatcgaccctcaccttccctgtggcctgttgccagccactctgtgatagtgacctcctccaccccatcccagctccggggccccctcactctgccctgcccctcgctactcctccccctccatgagctgtgtgctctccttgttcatgacactggagttcatggttctagatgtggggagggtgtctgtccaagtgcctgggcagggcatggcccataatacggactcagtgcatttgtgaagatgtgacgaatgaatgaatctgtgcttgaaaatgaatatctttgtccctcattgctctagggttctatctaggtccattttacatggtttactctgtattctctgcttgcatgatccatcagcaggtgcactggtttattggtgtcttccactgtaactgtatgtgtgtgtattcacatagacaggtattgatatacatatgtagttgatgatcagaagttgtgatatgaattagtaaaccatgtaacgctggatatgtcttactgattaacattctgtaaggataatatttttccgttcttgaatttatgttctccaggtaagtattcactagcatctctgaagtccgtatttcattttgtagtaaatgcactactttggtctgtgttttcttctaggaggcttatttgaatacgtaactgcagccaactattttggagaaatcatggagtggtgtggctatgccctggccagctggtctgtccaaggcgcggcttttgctttcttcacgttttgttttttatctggtagagcaaaagagcatcatgagtaagttttaaaacacttttaccatttgtaatttgttctttgactatattattaccatttttcaggctagatttttgaagtgttaatttaaatcgctgaattccagtttattctgtgctttggccaaacaagtacaaaaccaaatagctgtagaatcacccagctctagggaataatcaggtccacatcagcacagttgttctctataccacgtccttagcctctctgaattgacagtgctgaattcagtggtcaagttagacaccaagcaggggattcagggctctgaatgggaaatactgattaaaacagatccctgactgagcaatagccaatggccagcttgcgaatgctgcaggttgaggaagtcctgaagaggtaggtgaatctcagagcccagcgacactggcagaactcatacacacaagagctctccagctatgtggtggcttaggccatggctctgaacctggggtccttaatgggctacagaagctctgcatgccccctaaaatgacatcattttccagagaccgggtccttggcttttatctgatcccccaaaaggcttgcgagccatttgaccaacacactcataaagaaatcaaagggactgggcgcggtggctcatgcctgtaatcccagcactttgggaggccaaggccggtggatcacttgaggtcaggagttcaagactcacctggccaacatggtgaaatcccgtctctactaaaaatacaaaaattagtcaggcgtggtggcgggcgcctgtaatcccagctactcgggaggctgaggtacgagaatcccttgaacctgggaggtggaggctgcagtgagccgatatcgcaccactgcactccagcctggttgagagagtgagactcagtctcaaaaaaaaaagaaaaaaggaaaagaaattgaaggatgtcaaggctgaagtgaatttagagaacatctttctaatccaatggatgaggaaactgaggttcagggagcagagtctgaggccagccaggagccccatctcattgacgggaagagatctcaggagcaacgtgggatctttacctgccctgacattggcgcgtgtccctgacaataaatgatggagactgggcttagcaagcggccagcctggtatgcacatttactatgtcccctgagccacccacttcatccactcaaaacatctaatcgaaatctccaatgctgctgatgctacgaggtgcaaaaatgtataactctgtcctacttcatggagtttatcatcttttttgggactaaggacagagagaaaaagctaaaagaagaatagattgatatggtatagtgggaagagtacctaggtgtacttcccagcctcaccacgagtttgcagatgcaaaggatgattattggagataagaagaagaaaggtcatatctgaagtatctctttgtctaattttttttttaagacagcgtctcactctgtcacccaggctggagtgcagtggcacaatctcagctcactgccacctctgcctcccaggctcaggtgatcttcccacctcagccttccgagtagctgggattacaggcatgcaccaccaggcctggctaattttttatattttttgtagagttgtggtctcactatattgcccaagctggtcttaaactcctggactcaagtaatcctcacacctcagcctcctgaagtgctaggattcgaggcgtgagccaacgtggctggcctctttgtctaatacttgaagaagtgatagcataaatgtgagctctaagagcagcgccccgcattcttcgagacactccatcgtgccagtggcctggtattttcacgcatagacagtgaggagagagcgagatcagagagccacgacctacctaaatcccagagctgctgagaaaaacagaggggtctgcggaaagttgagtgagtgccgaaggcagagagggtttgagaaggaggctcaatgccaggcatggcagaaaacactgtgggccaggaatgggccttctgtgctgagaactgtgtctgccagaaggtcatatgagagtcctaagccctggcacctgtgaaagcgaccttactggagaacgttatcagttgagatgagaaggggaaacgtggatagacgtacaccaggtgatcacacagagtgggaaggccatgcgaagatggacacagaggcgggggcgatgcagccatgaacccaggaacacgtggtgccaccagagctgggggaaatgggactggaaccttccctgaaccttcagagggagcgtagccctgctgccaccttgatttccaactcctggcatccagaactgggagagaatcagtggccgttattataagccacccagtgtgtggttaactttgttctagcagccacagggaactgatacgccagccttccagccatttaaaattgactgggaaagtaagggcaggagtatgattggtgaacccctctgttttctcctccgccagatgactttgttgtcaccggtttggttgaaatacaacgttatctctctaaatatacattctacaatctgacttcctcccctctgcgcccgctgctcccagcactgcacctggcctgggcctcacttcccggtgaagatgccatccttttatattcctaatatttgatgtgaagaagtgagtaatggctcatttctcattaaaaaaaacaaatgagataacactgacgtttaaaaaaacacggatcagagtaagattgaacatgggcacaccaagtcagtggcaaagatgttttctcaaatgaaatcaggaaacaggaaagcccctctcagtatttgaatatgaaacatatagaaatggaaaataaataattcagttatctaaatgaaagtctttgctaatgaaaacccaaagatagtctttgcagaagagttcatgagttgaaagagctctttgtcattcatttgctgtttaaattggtgtcagtgtgaaaccagttttaagccctgaagaattaatcaattcagttttgcagaagtatgttcagaaatgtaggacttacaagctgagaataaaataaaaactcctttttaaaaaatattttcataaacccaactaattaagccatcaaataaaagtattccaaaagaaaacatgccaaggatctattccttgcactccatttataatgttctttttttttttgagacagtctcgctctgtcacccaggctggagtgcagtggcgcgatctcggctcactgcaagctctgcctcccaggttcacgccattctcctgcctcagcctcctgagtagctgggactacaggtgcccgccaccatgcccggctaatttttttgtatttttagtagagacggggtttcaccgtgtcagccaggatggtcttgatctcctgacctcgtgatttgcccgcctcagcctcccaaagcactggaattacaggcgtcagccaccgcgcctgactggattataacgttctaaaaacaaaattgtattcaatgaaatctttctataataatcagtatttaaattcataaatgattgcattgatagttaatgcattgatttctaggtcagaaacagtcaactgtgctgggttgctaacaaatattctcttaaagggcaaaatttaaaggtattctaaggagtaagaaaaatttaatcatttaaaaataaatattttatttctatataatggtttctgtgaaatacacttaacctcttcagccaacatcccttcattgtgtgagaacaccctgacctcacacatgttctttctgatgtcacggagcccagccttgctgcccagcctggtgggggggcgcgttttctcggcatcctgcggcagtcctgtgtttcccatctcccacctgccctctcgtgtttgcccatttcaggctctcctgctgtcatgtactctgcccttgccttttcgggccagggtgcccatcttcccacgggcagtttctgggagagaggcgctcacctgctatgtcactgtgcggcggccagtgccgctggcccatggggaagctcttcagcacttgcaagtgctggatggcctggatcccagcaggcctgtgaacaccttcagcctctaaccagcgaacatgtttgcaatgcactttcgcaggtttgacaccagctgttaggcttggccacgttgtgtgttgggcactcgtgggtccatgcgccaccactgagccacgtagctggaaaggctgcagtctcgaggcctcatgccaggggaagtgacgcttgatccggaagtcctgaccgacttcttagaattgttcttattacatgcctttttggggacacagaacatacaaaagtaaacgtggccgcccagtatgttcgaattctctatttgtggattccggtgttaaacttaactaagaccagcagggttttgccaactccctctcagtttctcgtcctcatatgtttctaccacattaacaatgagctaattgctttctatcatgatttttagtctgttgtttaatctttctgtgtgtgtttatagaaactccctttctccatcttgtcaaattatttctaatttttactccatgcacttagttgccacctttcccaactggctattatccccaaaacaaatgagcacgcctgcattgatacaatttatatcaaaacggaaaataatgtttgtttcgagcacaaggctgaatggtggacaatgccatattgcatttccccagatttcaccgaatccttactaagagcgttcatgagcctcctggtatgcagctgggtgcccactctacacaccctgggctaggccagtagttcccaactgcaggctggagaaaactgctggagtcaccagcaggtattcaggaagcacctacttggtcctgcccctcctccagcctgcatgctttccccgggggctgaaaagacagctccgcaatgtgctgatcagtattttcatcaaatgtcagtaattttccttccagatagaaaggtgaattctatgggctacttcttctgaatcacactttatgattagatatatttaattcttcatgataataggcaaaattaaactataagtatgaaatgccaaagtttttgttactacatttaaaaaactgagtactcttttgtaatgaaaaatattgtcacttttgttagcattggttaaatgtctaagcgacagaattatttccttttttaatttttttttcttaggtggtacctccggaaatttgaagagtatccaaagttcagaaaaattataattccatttttgttttaagtgcgtttttcatgaaattatcttcaacttgaagctttccaatggcgcttctctatggactttgtaaataagttatatctttgtaattttcctgctactttatcattttcaagatgtcctctaggaattttttttctagtaattttgcaatctacctaataagtacctaaatacgctgaaatggaggttgaatatcctactgtgtaacaggtcagaatttcaagctctgggtaataactgctgatattttttctaatttcaaatttacctcttttggctatgtcttgccaagtgtgtatgagactagactttacaactgtctttgatggcattttcagaacaataaatgtcacaatcccttctatagccccctacagtgatctcttcaaggtcaactgcagtgttgcttccctccccctatagggctggaatctgtctaggagccctctctcggaggccacagaggctgggggtagccattgtgcagtcatggcccgggggaaacttgccaaccttcgtgtcaggtgctgtgtgtaagtggagaacttggggatagaggaggaagctcctcgtggcccttccaaggtgaggcaaaggcatctggacttgttccagcccagcccaccgggtgacatcaccgggcagggaggggtgctggtggtggttcatacggagtaagctgctctgcctgtgtgagtggctcctgggccctaaacaggcacctttaggccatgggtcactcaccgtgagccatcaatgtgctctggtctgacatggtttctctctgtcttctagtctagacctagtttttttgttctgttccccacgtatggatatagtagagattgttgtctgtgaaatttctcttttgtagattttgagttttcccttgtagtgtaaagaatgatcactttctgtaacaataacaagaccactttttaagatttatcctgtttgttctttgttgattgaaacataataattgttaaaattctctacagccttctttttcttccatagctaatcttccttctaatagtttttgctttctgttttgctgttgttgctttgcaaagctttcccctcatagcctgtacctgttatcaatataaaataatcttcctgttgaatgcttcatgacttgaattctactttgataaaaacattgccatactgctttttatcttgatgaattcatctggcattgctttgccttatcatctcatctggagtttttaaatgccatttgtttcagttgtctttaacaacataataaatagactttgccatttaacaaggtagctcaaattcttttactaattgttacatcgaaacattctttcatcatatttcctgtttttatttggttttttcaacttcttctgtttactatctacagtgatttggaaaggagatttcctttaaaacaaacaagcttattgggaatggcttttatgatttttaaagtagccttgagagcttccagttaaatctgatgagctgaacatacacctttccttctcccctctctattctgaccccagttgaaatcacctcaaaggaatttaggtgggggagtggccccataaagagagtgagagagagtcaccactgcagatggaccacagcacgggtggagatgggcctgatgtggcagagcagagaggccatgacagtgcacaccctgcggagaccctgggtcctcacatctgggctgacagaaggcagagggaaatgagcatctcaaagtgagaccaactaaacatggcgcctgcagcagaaagcagtgtcctctgcacccccactctccagggagagcacagagagcccagaaatgagccatgtgcccattgccggggaagagaaggtaggctgaggaggtggcctttcctaacacaaaaattaactaagtggggaaaaccagagaactaggtgttggcatcccaggaaaaaaataaagtctccacattttggcctatagggatcctgccccataatggctggttacctcctgcctcaagctgcagggaagccagggggtggcatggccatggcttctccctcagagaggcctctgtgcacgacttcagtcacccaacactgacagaacttggaacccaaaagcccatttctctccttccgtccagaccctgtctgctgttatctgtaggaagaccacagccaactgctatcatgaccaaagctaaaatccaatgaggcagagaacaatagttgtacccatctcctccttagtctccaaggccagcggtgcatgcatttgtgcattcaacaacatttgccaagcacttactgtatatcaagcacagcagtgggtgctgaggacggatgggtagaaaaaacagtcctggcccaggtggagtgacaggtaagaaacaagtaagtagctaaaataatgttaggtagaaaaaaataacaagaataaaagcaaggaaaagggaagggaccctcacttgtgtctgatacagccataatcttctctatcggccattgctgtaaccaaagcttaaccacctttcttaagatattgatcaaccagatcattgcaaatactgctaattgattcctttttatggctgagtagtattccattgtatatatatatataccacttgttgactgatgggcatttgggttggttccacgattttgcagttgtgaattgtgctgctataaacatgtgcgtgcaagtatctttttttgaataatgacttcttttcctctgggtagatacccagtaatgggattgctggatcaaatggtagttctacttttagttctaaggaatttccacactgttttccatggtggctctaatagtttacattcccaccagcagtgtggaagtgttccatgattgccgcatgcatgccaacatctactgttttttgatttttttggttatggccattcttgcaggagtaagggggtatcgcactgtagtttttatttgcatttccctgatcattagtgatgttgagcattttttcatactttgttggccatttgtatatcttcttttgagaattgtctattcatgtccttaacccactttttgatgggattgtttgtttttttcttactgatttgtttgagtttgttgtagattctggatattagtcctttgtctgatgtatagattgtgaagattttctcccactctgtgcgttgtctgtttactctgctgactgttgcttttaccatgcaaaagctctttagtttaattaagtcccatctatttatctttgtttttattgttggaaactattattctaagtt

SEQ ID NO: 17276 - DNA, 34049 bp, Human
aaatctcttcagttaaccacatttaagtcccttcagtccaaagaggaaatggccactggagtctgctttagttcccacaagctttgggttgctccttcctcctgttcacatgttaatgtctttagaggttcagaggggcatggaagctactgagagactgacttcctggggaaaggaagataacttgtaaccttaagttggtgttttctttttttttttgagacaaagtctcgctctgcagcccaggctggagtgcagtggtgcgatcttggctcactgtaacctctgcttctgggttcaagtgattctcctgccttagcctcctgagtagctgggattacaggcacgcaccactatgtctggctaattattgtatttttactagaaacagggttttgccatgttggccaggctggtcttgaactcttagcctcaagtgatctgccctccttggcctcttaaagtgctgggattataggtgtgagccaccatgcccagccggtgttttttctctcgaccaccagccttttattatgttgataatgtgtatttggagatgataattattatcaagaactatactaaagagagctgaaagcagtgtgggctttggaaagtatatgagatttgaacttggaaagcctgtttttttggtttttgtttttttgtttgtttgtttgtttttgagacagggtcttgctctgtcatccaggctggagtgcagtggcatgatcatagctcattgtagctggaagacctgtttcaagcctcagatctaccaattatgggccaggcaggctgggccaatcactaaccttgttgggcctctgttttcctacttgtaaagcgaaaaataataatacctgactttacaaggttgttgtgagcatcagttgtaataatttactatgtgaagtactttttaaactgtgaagcactctacagatagaagggattattatcattgttattattattatttttttaatcttccacctattcagccatcagttttaatgtcagtaatcttcagactttccgggaggcaccaactgagtttcagtgaatagggcaatctctccatttcccatttccttgctatgatgagtggagattcttcaggccctctgggaagggttgcgggggcagttgaagaggagtgctagatttatttattcatctggtgagtgggcttcattgtgtattggtgctaagtgttttggtaagctctaggacaaaatgaaaagtctgccatcctcaagaatctgagagcctaactgggaaaatggccttgatgacaatgtcatggtaacaatactaaccacagggtgtccttaggagccccagaaaagtgtggttgttggttctcaaagtctatttcctagggggggaaaaatatatatatatatatatatatatagtgttagctccagccaccagtgagtcaggagaggctttctaggcaaagacatctaagttcagaatccttgtgatccagatgcctgtaccctttgagttcagaggtgggccagggtatctcaggtatttctttcctttagcatcttgcaattcaaaatatggtccttgaatcaacatcacctgagagcttgttaaacagagaaggctacttcaaattctatttctgtcttttatgttagtcatttgggttcttaagtcatttcactgtaacctctgggggagctaggggattctttaaggaagtttccattctctgagttgttttcagaaactgttagttggcaaaggatgtaccatctcctattaaacgggcaaggacaagttcccttttctgaggtcccttaagatctcttcctggggtgatctaggcttgctgttttatgagggagggacatatttacacaggggcaagaactagtcttttaatccattgttgcataggggaggcgtgggcacttggagttgtcttaggactgatgtctgaattaactaaatgaacttgtctggtttgcagagtgctgatggcagagattggtgaggatttggataaatctgatgtgtcctcattaattttcctcatgaaggattacatgggccgaggcaagataagcaaggagaaggtgagttttcttcttttggttcatggccccaggagcctatcagaagtgggagctactcttgttgatacagagagagggaagcaggcagtctgccgccactatagtgggagtcagacatctcaggtggcttttaaacaacatgaatgggaagagaattggtttatgaattgaagaaataggattataacatcttctggtgtggtcttggatgtttctttcatccttggattttatccttgtttctgtaaaattcataggtctggctcatatgtgtttccctccctggtttgatggggttgtggggaagacatcccatctgcttgtgctgggggaaaacaggaaggaggtgctagtccactatagtatcactctcctactgccatctatttctcctcagctgactcaaggtcattgtggggtctaggctgcatgtaggagtggggtggggggaggttcttgtgactggtgtatctgggaaatggtaaaagtagagatttagagttgaaaaccaggaggccgggcgcagtggctcatgcctgtaatcccagcactttggggggccaaggtgggtggatcacgaggtcaggagatcgagaccaacctggctaacacggtgaaaccctatctctactaaaaatacaaaaaaagtagccgggtgtggtggcgggcgcctgtagtcccagttactcgggaggctgaggcaagagaatggtgtgaagctgggaggcagagcttgcggtgagctgagatggcgccactgcactccagcctgggtgacagcaagactccatctcaaaaaaaaaaaaaaaaaaaaaaaatgaagaaaagaagaccaggtagtggtgaagatctcggggatgtcatgattgctagaaaaatatttaaaatccatggccaggcacggtggctcacgcctgtaatcctagcactttgggagactgaggtgggcagatcacctgaggtcaagagtttgagaccaacctggccaacctggtgaaactccgtctctactaaaaatacaaaaaattagccgggcgtggtggtaggcacctataatcccagctacaggaggtgaaggcaggagaatcacttgaacccaggaggcggaggttgcagtgagtcgagattgcaccattgcactccagcctgggcgacggagcaagactctgtctcaaaaaaaaaaattttttttaactccagttggcctagcacaatggctcatgggcacagtggctcatgcttgtaatcccagcactttgggaggctgagccgggcagatcacttgaggtcaggagttcaagaccagcctggccaacatggcaaaaccccatctctactaaaagtacaaaaattagctgggcgtagtggtgggcgcctgtaatcccagctacttgggaggctgaggcaggagaattgctagaacccaggaggcagaggttgcagtaagccaagattgtgctattgcactccagcctgggctatagagccagactccatctcaaaaattaaaataaaataaaataaaataaaataaaataaaataaaataaaaaaatataaaataaaataacattctagttggccctacatggtactgttgacctaaggataggccaggaaatgtttgagaacctattgtttctaaaatatgacaataggtcctcaaaataggcaggccagtgcctgcctgtaacgattcagataagtcattgcttgagaatttcctcatgttcctaatgattatagttttgtttcttaagtcccatcaaatgcaaaatgggaaggaaaatgaaactagaactccctttttggtttctcctagtaattgtctctcccagccatttatatatatctaaattatgattattattttcaaaaataaagatagcacttcagtaactaaatgttaaatgcaaaggaaatagatcccaaagcaatgcctgtttctgaaatatcgttcgttcataatcactgtggcccaaggtaaacgaatagcagaatactcaaaccttgttgtaatttcacttttttataatcccctgagtcagaacgtcagaatgagttggaaggcccaatattgattcaaatattttggaaactttaaaactataacatgtgatttttctcataaagtctttccccagctacctttcttctcctttttcagagaagcccttagagtttttcactatgacaccagcctggccttttggaaaataataaacttaggaggattgtcttttcagccctgctctttcacggtccttctcaatgacacaacatggcacacgtgtctctctgcaaccaaggagcagattgatgaccaaaagacttaccaccacctctgttctgagtaaaaatcaggagtctaagttgctcatgacagagatgtctggtttaagatcactgaaggtcactgaaagggctcatcttgtcacattttcttactgctataaatcacatggactgaggtttgcatttggggcttattagtcagctctattttttttttttgagacagggtctcgctctgctgcccaggctggagtgccgtggtgcaatcactgctcactgccttgacctctgagttcaagtgatcctccacctctgcctcctgagtagctgggaccacaggtgtgtgccaacacactcagcttattttttttattttttgtagagatgggggtctcactattttgctcaggctggtctcaaactcttgggctcaagcagtcttcctgcctcagcctcccaaagtgctgggattacaggtatgaacttctgcacctggcctagctagctctattgacatttgttttttgttggtggttctcttagagtttcttggaccttgtggttgagttggagaaactaaatctggttgccccagatcaactggatttattagaaaaatgcctaaagaacatccacagaatagacctgaagacaaaaatccagaagtacaagcagtctggtaagaattttggcctctcagtggtctaggggaagtactctgtgcatgggggtgggcatcatgactgataaatattcatttgttggataggtggatggaatggaacctggatgaccaaagcctcctttagcttgtggctagaaatcgcgtccctttatattcttcatatcccagatctgccaactccattgccctgtatattcatgatctctgcaaaatgctgccaagcagttcttaacatttcagtcttcaagaaagaatctgggatctgcacaggctggcagagctatggacattcaggggttttgcatgtatgctgaaccctactgccttgctctggtatttggcctcacaaccactgtccaacttcgggtgatgtcacttgggtctcataccttccttgcatgtgtcccaagtttcacaaaacctccttatggaaaagagcacattcgatttcttccttgataaaagggaccagattcacattggccttctgctttacttgcattcctcattgtcttttagactcagcctcagcttgggctttgttagcaagttcactgccaccatagcatcacagcctaaagggcatggctgagactcattgatctatagagcactcttttaccccaacatactctaaatgactgatcaaagatcaaaaacagaagagcatttatactccattcttgttttttgagacctgcttgatttattccgattatttaacacacagggacgcaacagtgatcccaaagtgtgtaaagttaaagccttcaactgcagctgaggagagggcaggaatggggacggtggtgagtcaggaatgacaggcaggcagccatgaccagggcagcctcctccccagggccagggactggggagtggcctaaggagcaggacctaagggtagcccagagctggggaagggggcagagacctccccttggcctaggtctggagctcagaagtgccacatgcctgagggggcagcggcctgggaagggccagaggcagggtcaggagagcaccatttcctggggggctggggacagggaggtgccctataggagaagccaggaggggccgtctgcccctgaggtgggggctgggctggagcaggctgcagcaagaaagacctgaggcaggcacagggcctgagagcccagctgcctgggttcaggggggctcccagggcagcctggcccagggagcagtcctgactctgcaggggatgcccagcaaggggggctgcagacccctcagagcctcccctcctctctccctggaaaggagctggggaacccatagtgcaaatctgtggaccactcagttatggagggaggctgtgcctgaaggtggacactggggtgcactccctccaccatctcgccctgcaccgctgtcctcagtacagccacttctcgtaagagtgcaggccatggatgccaccgtcgatctgggctgacatggtctgcttctcaaacttgagctcccctgagtacatcatggaccgaaggacagacaggctgtgggccccgatatcctggcagccatgctggatgcccactatgaggtagggcacgaacttctgaatggaccctttgtcctggatggagcccaagacatcctgcgtgatcttcgccttatccccgtcgttgaagtattgtttctggctgctgctgctcttctccatggcatccagtgagcccatgccctggtacttcttgagctgcattccgtctgagaagaagcactcgccgggggcctccatggtggcggccagcagggagcccatcatcactgtggaggctcctagggccagggccttgaccacatgccccatggtctggatgccaccatcggctatgatgggcacaccaaagttctgggtatgcttggccaccttgtacacagcagtgccctggggctgactgcaggctatcacttcctggttgatgtagatggagccgcgcagtccatgcccctgcccagcccatccacaccagcgtcaatcaggttgttggcctgggctgctgtcaccacgttccccccaatcacctggaggtggggttacttttgtttgatgtaatgcaccatggcgatctgatacaccgagttcccttgggacgagtccaagcctatgacattgacgcctacctgggtgagcaggtccaggtggtatttgtcatcctcatgggtacccacagctgccccgcccagcagctgctcatgggaatccttggaggccacagggtagtctcggttcttcagcgcggtgcaggtgataatggccaccagctcatcgcgatcattgacgataggcagcttcctttcttactaagctgcaggatctcatttgcctctttcaacctcacactgctggagccaccactagcttgatccttggcatcatcacctcactgaggagggtggtgtggtccttctcagcaagaaagtcgatgtctcgggaggtgacgatgcccaccagcttgctgcccatggtacccgtctcagtgatggggatgccagagaagccatgacgcatcttggcctccaacacatcacccacagtgtgcaaggggctcagcaccacggggtgtgtgataaagcccggttcaaacttcttgaccttctgcacctcactggcctggaactctggggtgcagttgtggtgaatgaaaccagtacctcccatcagagccatcacgatggccaggtcggcctctgtcacagtgtccatgggggaggagatcagcggcgtcttcagagtgaccattgggtcagggctgaggtcaggtccacctcatcagctatgaagtctatgaatcctgggagaatcaagaagtcgttgtaggtgagtccctggtcactggcgaagagctgctgcacggtgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctctatactttgcgtctgtgtctttcttttccaagtctctcgttccacctaacgagaaaaacccacaggtgtggaggggcaacccaccccttcagcgcagtgaacccgtcctcgaccacgtagccggtgctgctgctgataggtagtccctcatgctgccgcgagaccccgcgacccgacataaacgctgcagctgctgcgacgcggaggccgcgccgctgccacgctgcagccaggcgccgggtgggctgggtgggctgggggcgggggctgcggcagcggcggggcgggccagggcgccctatactccattcttcatgatgtttggtcgaagagtcatctgaaattttgaattcagtaaggtggctagaaagtttagggtattttgaaagatggtgattgaccttggactgaaccactattgaagatttatttgataataatttgtaagttttaactcagtacctcccttctgcttttatagttcaaggagcagggacaagttacaggaatgttctccaagcagcaatccaaaagagtctcaaggatccttcaaataacttcagggtgagtctggagaaaacatatggaatcccagcatgaaaccgtttcagagttctaataaaaatatgcatattctcacagcatgtactttatttaatatctgaaaaaattgtgatagaaatgtgtatttgttttaaaaacgtgtaacttcttatatttcaaagctaatacatgttcattgagatatttggagactatagagaaagataaaagaaaataaatcacctatattccactatccaaagacaaccactgttagtattttggtatatttccttctagactcttttttatgtgggtttgcatctgtatctgtatgtatgtatatatatatatatatacatacatacatacatacagttggacaattggacatttttttcactgttcatttattcacttgaaattgtaacttaaaaaaagaaaatgtaactttaaaaataaaaatagatgcaccatgcctatggaaaaaaatttaaatgtactacaagaggttttaaaagtatttttttgcccgggtgcggtggctcatgcgtgtaatcccagcactttgggaggccgagccggaaggatcacctgaggtcaggagttcgagactggcctggccaacatggtgaaactccatctctactaaaaaatacaaaaattagccaggtatggtggcaggtgcctataatcccagctacttgggaggctgaggcaggagaatcatatgaacccaggaagtggaggttgcagtagccaaatcgcgccattgtactccagcctgggtgacaagagcaaaactctgtctcaaaaaaaatgttttcttcctacccctataatactgacctccaattatttttcctaaaggcagctgttgtgaactagttcattctgtaactatccagagatagtctacacatatatttcatttttgcttttttctcttctacagatgataacaccctatgcccattgtcctgatctgaaaattcttggaaattgttccatgtgattaacatggaactgcctctacttaatcattctgaatgattaaatcgtttcattttctaaatgtgttataatgtgtttagccctttcttgttgctgtatgtttagatgctttccaatcttttgttactactaataatgctataaaataaatatccttgtacttctttgtgcatttgtttttttactgagctaattttaatgatttcagcaaaagttattttgttattgagtgatgaaacaaaagatttttgagggtgttcatgagcataagtatcatatagtcacttatggttgttgtgttcctagtacttagtacaaggtatcggaattgttctttagttaatcttttatcttgagaagttaaatcttggtgtaatcttatcctcatgttcatataaagatatgtggagtttgtagtgaggacttagagccgggtacaatttcatggttaaattagaaatgcttttggcagtgttaacagctcttttagaatttgtctagcaggcttttcagtttttgccagaaagccctaaaaaaaaagaaggaaaaaaatgcttttggctgagtgtggtggctcacgcctgtaatcccagcactttgggaggccgaggcaagcggatcgcttgagcccaggagttcgagacaaacctggtcaatatgtcaaaaccccatttctacaaaaaatacaaaaattagctgggcatgatggtgtgcctttagtctcagctacttgggaggctgaggtgggagaaattgcttgagcctgggaggttgaggctgcagtgaggtgtgagtgtgccactgcactccagccctggtgacagagtgagaccttgtctctaaaagaaaaaaaaatattatatatatatatataaatgctttccttaaaatatgtaatgaaaacccactcttgtaatataaatggtttcttggagaatatgtctgtaagagacactactgagcaatgcaatttcagagctaaaatggatttacggattatattatccaactcccttaatgaacaaaataaggaaacttagccctaaagaacattaactgattgtctacttctaactactagcagagctgggcccagcccatactcctttcactgcactgtgatgtatataataaactatatacttgtcataccatatcttagagcatactttttgtttttttgagacagagtttcgttcttgttgcccaggctggagtgcaatggcgcgatcttggctcaccgcaacctccgcctcccgggttcaagcgattctcccacctcagcctcccaagtagctgggattacaggaatgtgccaccacgcccgggtaattttatatttttagtagagatggggtttctccatgttggtcaggctggtcttgaactcccgacctcaggtgatctgcccgcctcagcctcgcaaagtgctgagattacagacatgagccactgcacttggcctagcatatattttttaaaagaatgaaatgtgctttgttttgtccttctgagtctctgtaataccaaataatgagaaaaagcagatttaggattcagatccaggttttctgagctttctctgctattgtctgtctaatataaattatattgtcattcttagttaaaaaacctgccatatttttactattgtgtttctattttgtaaatgaagcatattcattgctatgtagcctgttgtgagcccatatgctttgcatattagtttctccttaaactttctatatttaatatgtgaccctaaggccgggtgcagtggctcacacctgtaatctcagcacgttgggaggccgaggcaggtggatcacctgaggtcgagagtttgagaccaacatggagaaaccctgtctctactaaaaatacaaaattttccaggtgtggtggtgcatgcctgtaatcccagctacttgcgaggctgaggcaggagaatcacttgaacctgagaggcggaggttgtcgtgagccgagattgtgccattgcactccagtttgggcaacaagagtggaactccgtctcaaaaaaagaaaaaaaaaagtgaccctgattattcattcattcatttagtaagcaggcactatggcatatgaatgcagtgactttcttaaaaggtttaggagccgaatacctagaagttaattcatatgaggctgcagaagtgcttcaaaaattactgtatgattaaatgccacaggataccacaagatattatagaattaaaaaattatggctgggcatggtggctcacacctgtaatcccagcactttgggaggccgaggcaggtggatcatgaggtcaggagttcaagaccagcctggccaagatggtgaaaccctgtctctactaaaactacaaaaattaaccaggcgcagtggcaggcgcctataatcccagctactctggaggccgaggcaggagaatcacttgaacccaggcggcagaggttgcaggcgccactgcaccccaccctgggtgacagagtgagactctgtctcaaaaaaaaaaaagaatttaaaaattatttggctacaatacaatgcttttaaaatccatctttgatttgatatgttacctctctctaataatatgtaaaagcgaatacacatgcatgcggccaatttctatctgatatgatcagcctctggctaagttactaattattagtgaaaaaggcaacttacatgtttttaatttagacacacagacttagctactgacacagcttaacagatagtgtatttcactcttttggctaggttagcttcagagaagaactgtcatttgaaagctgagtgtctcagatgggttgacagcatgtggtatgtgtatcttacataggacctgtcatctgagaagagaaagggtcggtttaatctttcattctctgattactcttactctagccctcagaagtggtttatcaagaatatttgattatcaagaatcaggaccatatgttgcttatgtgtagctaggcaatgatagaaaagcaataactggacatttattatgtacttccatgtgcttggcactgtgctgagtgctttgtgtgcatttaatcttcatacaaaatctgtaaggtatctattattatcctcatttagcatatgaagaaacacacatacagaagttaaataacttgctcgaggttacatagctaataagtggcagaattaggattcctagccaggtctgtctggcctagaaatccgactcttaaccatgctgtactttgcccctgtgttgaaggaacaggtggaatgtcaatctcatgttccaacagcttatcctaacctggagctatgctagcaactatactatactgtaacatcagattttattgggctgttttgaaacattctaatatgctagcttagcatatttttcttttctttttttttaatttttgtgacagagtttcacttttcactcttgtcgcccaggctggagtgcaatggcaccatctcagctcactgcaacctctgcctctcaggttcaagcaattctcctgcctcagcctcctgagaagctgggattacaggggcacgccaccatgcccagcaaatttttgtatttttagtagagatggggttttaccatgttggccaggccggtctggaactcctggcctcagatgatccacccaccttggcatcccaaggtgttgggattacaggtgtcagccatcgctcccggcctattttcatcttttaaaagcagaatttccctgttctttggtaatatgatacgggatttatggagttaacagctcttgctattctttagataatttaactgttgggacgatatttttatttttttcctgagttaagaatcctattgagacatttaaagaggtgtaatgtatagtgtacctctgaaataactaacaggaagtatgaccttattctttgtatttgaagctccataatgggagaagtaaagaacaaagacttaaggaacagcttggcgctcaacgtaagaccacctttttttaatattcattatttataaatgcttgataattctagtacaaatattgcatttttagagttggtcatttcctttatctacataatctaagtaagctctcaaaataaaaactggttaaactcttacgatagactcattggcatttctagttgtctattgaattagcttatctaagtttgaacaccatcgtactccatcagcttcatcatcttggccgtatgttaagagatgtgatgtttataactgaaatggaatggagctctaatcaggccatgttaaacattgatccaaccatgataatgaaccatgttaaaccaaatatctagcagcaggaagaggaatggtaaataagttcttgtcttacagcctatttaataaatctggatactctacagatgatatcccccctttcctaagaaagaaaacgtgcaatttaaagatgggtcatttcaacccgcatgagctgttttctctcttaaaacattagcacttgatcccatagatcattttttaaaagattactcttttttttttttggagacggggtctcactctgtcacccaggccggagtgcagtggtacacttttggctcactacagcctccacctcctgaattcaagtaattctcatgcctcagcctcctgagtagctgggattaaaggcacgcaccaccacacccagctaatttttttcttatcttttcttttcttttttttgagacagagtcttgctctgtcacccaggctggcgtgcagtggtgcaatctcggctcactgcaacctccgcctcctgggttcaggtgattcttatgcctcagcctcctgagtagctgggattacaggcttgtgccaccacacccagtttatttttgtatttttagtagagatggggtttcattctgttgcccaggctggtctcaaacttctgacctcaggtgatccacccacctcggtctcccaaagtgctgggattacagggatgagccatggcgcccagcctaatttttgtatttttagtacagataacgtttcatcatgttggtcaggctggtctcaaactgctgacctcaagtaatccaccaccttggcctcccaaagtgccgggattacaggcgtgagccactgcacccagcaaaagtttacttcttttgcttgtcttgagtcctccttgaagtgagagctgagactcagtcttacactgatgaggcacatggctgtggttccgaactccaggaaacggattgatgggctgtgatggagggcttcagtcttatccaagaggcttggaatctgtcctgtgtgtggtgggacatcatgaatgttttgagtagggcagtggcctaatagaagccctctttgtgtggcagtccccttacagatatcttacgactcagtctttgtgctatctgcacctggaaacttattttgcccggattagtcagctggtgtagctcatgtctgtcattctctacctaatattgtgctctccagcaaaaactactgagaagcgaattaattcctgaaatgatagcatgtttcttaaaacactggtgaggtgatgagaattagtattccgaagcctgtttaaagggaaaataggagacctagtagatttgcataggaattaaaaacaattggtgttctttccatttgctccctgatggcaattttatccttggtcataattgtacagatgaggtaagtgagaatccaaatatccctatgatcctgttaggagagctgcttacttgctcttgcttggacttggtttatttgctaataaaagaaaaaggtttctgggctgggcatggtagctcatgcctgtagtcccagcactttgggaggtcgaggtgggtgcatcacctgaggtcaggagttcaagaccaacctgggcaacatggtgaaaccccgtctctactaaaaatacaaaaattacctggtcatggtggtgcatgcctgtagtcccagatactcgggaggctgaggcaggagaattgcttgaacctgggaggtggaggttgcagtgagccgagatcttgccactgcattctagcctgggcaacagagcaagaccctgccccccaccccagaaaagctttctaataacttgggcttaatttaatagaagtttaaaatactcggccaggcatggtggctaacgcctgtaatcccagcactttgggaggccgagacaggcggatcacgaggtcaggagttggagaccagcctgaccaacacggtgaaaccctgtctctactgaaaatataaaaattagccaggtgtggtggcacacacctgtaatcccagctactcaggaggctgaggcaggagaatcgcttcaacctgggaggcggaggttgcagtgagctgagatcgtgccattgcactccagcctgggtgacagagcgagactccatctaaataaataaataaataataataatcaaaccaaatatttatattaatttggacttccaaatagatttgaactgttcagccatcattgaatttgatgaggatggtgataacttcaatttagtaatttcttgctaaatgccttaaactgagatagatatatcacatagattattttgtggcttttctttgtttgtttgtttgttctgttaatatataattgctaaaatacaaaaaatataaaatgaaatttcctctttcaagtatcagagatagctgctattaatgtttgatttttatgcctccagattcttttatatttaagcatatattaatacatgtgtaagtatatgtacacaaatatacatttttaagttcacagaatcaatattatacatatttttaataatccatttttcacttaatatatcctgtgtatctttttttaatttttttctttttttttggagacagagtctcgctctgttgcccactttggagtgcagtggcacaatctctgctcaaaactggttgttcttccacctccctgacctaatcaagtcatttttttctagcaaattagctttaggctcatctccatttgccaggctcactgcccccattgtcactgtcttgccattgacattttattttatgatctcccagtatcactggactatgaaaacagtgccatctgttttataactagcaaacacatataaactttccctgctctgcactctctaaggctgttccctttaggtattgtcaacagtttcagcacatataggaaagctatcagtattgttgggtggtgaggttattagattctcctatcaagttaaaaactcaccagccacctgttcctcacctagaacggggtaggggagagccttctttcacttgctgtttaagcagcttttccagatagcccctgatagcactgggacttgtgttttcttatgtcactttcttcagtgtgaggttgaaaccttggggccaagtatagctggggaaagaagagataattgaagaaaataggaagggagaacagttgttatacaaagaaactcagccagtgtaggggtggacttagctctccttcagctttgtaaatggtttctctctctcatcccccagaagaaccagtgaagaaatccattcaggaatcagaagcttttttgcctcaggtacagaataaatgatctgatttggtattatatgtacatagctgtggataaccctgacttctttaaaaatacctgtccattaagaattctttgagacagtgggactctgagagtgttgttctcctgagaacttccatacaagggaaccctgaataacaaagagaaagatgttaaagtggattgcattagtgaactttggaatgcagggaagttccaaagtagcactcctcatctcaactcagtgactgctgaacatattagtcagcagtgatacttccctgaactttggcttgttctggctttttcttaggttgacacctctttgtaagcagaagcaatagaagggctccctttgtacttgggaacatgccacttatataacttcaggttactgtggagacaaatcactcatgttttctctctttttcaaattatctttattccacaaagccaataaagagagtgggattttcattaaaattaaataaaaatgaaaataatttgtcttaagcacattaccctaatagaggaaaaatttgatattaatgggaaacatttgccgtaatgggaaacttcaggctgtgtctgttgagtgactcacctgccaaaggaaatccaaaagaagagatggtatatgggtgggaccttatagaaacagagcaatatccagagtctttagcatttcttgtcttcctttccagagcatacctgaagagagatacaagatgaagagcaagcccctaggaatctgcctgataatcgattgcattggcaatgagacaggtaggtgtggaagctgcagattaactggtgcccccagattgagatcatggcacaggcaagctgtattcattggagtgatcagcaccaactgccgtgacaaaccagttcaagaatctgtgcttcatcctgggtgcggtggctcatgcctggaattccagcactttgtgaggctgagatgggaggatcacttgagcccagttaaaaattagctggtgtgggctcgggcacggtggcttacacctgtaatcccagcactttgggaggcggaggcgggcggatcatgaggtcaggagttcaagaccagcctggccaatatggtgaaaccccgtctctactaaaaatacaaaaattagctgggcatggtggtgggttcctgtagtcccagctacttgggaggctgaggcagaagaattgcttgaacctgggaggcagagcttgcagtgagccgagatcgcaccaccgcactgtagcctgggtgacagagcaagattctgtctcaaaaaaaaaaaaaattagctggtgtggtggtgcacacctgtagtcccagctacatggtaggctgaagcaggaggatcacttgagcccaaggaggtcaaggctgcagtgagccaagatggtggcattgcactccagtgtgggtgacagagcaagaccctgtctcaaaaaaagaaaaaaaaaatgaatatgtgttacaacacaatagagacttgtttctcattcatgtcacaggctagtgtggatcgggctgggggagctttgttcatgtggctattcagtggctccattatcttctgaggtcttggagttttctacagagtcccttgcatctggctagcagataagggaagagagaatgtgtgaaggatctcacaagagattttagggaccaggcctaaaagtgataatgtgcatcatttccaccccattagattggtcagaactcagtcatgtggctccatctaactgtagtggacatggagaaattagtctcgctgtgtgtcaggaggaaatgaaatggatttgggggacacataacagtgtctctggcacaaagacatcatttacggtagttggtgagccttagtcttgccttttcttttggatgctgaagcagggaggagtcctggaacccagaggggcattaatattaatggaaggcattctggcttcacatattatcacatgccccatcatttcacctagatagacgacaaaagctttcctgggaacattaaagacataataaatgtgtgttcacttacagagctttggatattttctgagctgtgtcagtcagttctgctgtcctttgctttggtcgttggcctcagtctcttctatctgcgcgtcaccattgcttggatctgagatgattcttttgctcagttgttgttggatgtctgactcaaactgaatcactggtgctgcatcaaaagagaatgagaagagcctagataagtggaatgacattctgtttaattatttagctcttccttaagaggatcgatcattgtatttccagttttagagcttctcaacattctcttaaaatgagtcagaactatctttcaggctcacttaaaatgttaccatggggagttttatgggaagaaaggctaagagaaggtcaaattagcaaatataatactaaattttccaggatttcagatacgatcctgcttggtcgtgtcctatttttggttagatgtgagaaagataagtgtcttcttttcagccattagtacccatataagaatgagaaaatattttcttaatgagtcacttcctgttttaagagattatgtaattgtcctgtacttctggttttggtcagttttgtttcattcatcagtagatgttgtacgtatatctgttgtatgagagaatcataaaaaaaaaaaagccatgacctgctgtgaattgaaaaactaagttttttggctaaaactcaatgtctgtgcttgcttctgttgctgggttatgggcctcttgggggcgggggctgaatgtatatttgaatttttctgcattataggagcatgatcagagttgagaaatggaatatgacagtgtgggtttgaatcatggctatgccatgttctagcttgtgaccttgggcaatgtccctggcctctttattttttttaatgtttttttttttctttcttgagagagaatctcactcttgttgcccatgctggagggccatggtgcgatcttggctcactgcaacctcttcctcctgggttcaagcaattctcctgcctcagcctcccgagtacatccctgccgggaatacaggcgcccgccaccatgcctggctaattttttgtatttttagtagagacggggtttcaccatgttggccaggctggtctcgaacttgctgacctcaagtgatccacccacctcggcctcccaaagtgctgggattacaggcatgagccaccacgctcggcttctaattttttttaatttaaattttatttttatttttcctgtagtgctgagttctcggccttcttaagtcccagtttctcttctgtaaagtgggttaataacaggacctacctcatagggaggttgggcagaatgagagttcatacttggaaagggcttagaataatgcctggcacagtgtgagcatgtactagatgccaactagcattatttcctcatttgcttgttcaattctagccataaaccacctaagcaagagctcaccatggctttgcacttggtacatagagtctgatctcagacaagtgagagaccagggcactgaggcctgccctaggcccaagggtgagtggaatgcatccccatagactgaggcgcactggaatggaggccataacttgagagggttatccaacttcttggataaacactcaagtggaaagctgagcacagcactcctaccagtcacagtctgaatgggcttggcagaggagaatctaagtacaaagtacaggagggcagagacctgataaaagagaaagatggaagaagatggtagaattggaggcagagcctggggcatcatgcttttggccacaggtatgagcaggtattggtcttgactgcactggtacatctgtttcctgccccatggttgcggatgtatctgtatacgagctccaagaatcagaatggcagctctagacagcaggtccttcctggtcagacatagtcctttaaagttcaacatcttggtggtacattgctggacaagagtaggcctgggccattagagggtaccctggatgctcggtgctgcctttcccctgagaatcagggtgatttgactcaagccttctctgcctctgggaacaaaatcagtaattgggcttgaggccacttataaacccccctgggctcaggtggctaattagcaagtaagaaacaaggcagcacacttttactcttcttgtgctatggttttcatcagctgagaggtcacaaatccacttacatgcagactcagagcagcaggagaacattaattattaagaagtggaaaggcacagtctcctctcctcacaccatctccctaggcctccagctcttcatttccctcctcctctcctggtaatttgtcactgaagattctaggcccagaatcctgccttggttgaaaatggttgttattattagtgcagcacccttcatctcttttccttctaatccgcagttagggggcttcatctagagtaattatgtggatttcctctgtctggttaactttgccatctggttaacattgaacacttgggaggagtgcaggagtcagataatgaacaagcgggtaaggtaattgccagccgaaataaggtctctgaaagaaagaaacaagaacatgataggactaacctaggcatagctgtgctcagagtatataatttattaaaaatctactacgtgccaggtactttgctaattgctttacacggattcttgcttaatcctcatgaataataccataatataggtactattctctccattaaattttttttgttctacttagaactaatttgctaggaatattctattttcttttctttcttttttttttttttttttttttgacagagtcttgctctgtcgccaggctggagtgcagtggtgcaatcttggctcactgcaacctctccctcccaagttcaagcgattcttctgcctcagcctcctgagtagctgggattacaggcatgcgccaccacgcccagctaatttttcttttttctttttatatttttaatttatttttaagacggagtttcccttttgttgcccaggttggagtgcaatggcgcaatctcagctcaccgcaatctccacctcccaggttcaagcgattctcctgcctcagcctcctgagtaactgggattacaggcatgtgccaccatgcccagctaattttgtatttttagtagagacaaggtttcaccatgtcggccaggctggtctcgatctcctgaccttgtgatctgcccacctcagcctcccaaagtgctacgattacaggcgtcagccatcatgcctggcttattctctccattttcaaggtgaggaagctgagcagtgaactacactcctaccttctctagtactgattgagctgggattcaaaagctggactccaaaacctatgcttttaactactttgcctcaatataatttccatgaaggtgagggagtttatctatctcctactatgggtctccagtacctggaagaatacctgctatgtaggtgttcaataaataattgttgggtgaatgaatgaaggaataagctctcccagtgtcagtgtgtttctaaaagccattcctttttatctttagagtttagcagactctcttctacctatcttcccttctctcctcaaaaaaccagacttttatccaaaaagcatgcaagtcccccaagtatttaaagctttatttctttgtttgtccagtaaatgttcgttgagggcctactatgtgcaaagcaccatgcttggccctgtgtgaagcaaatattaaggcaatgaggtggagtctgatctcagagctgtgttgtgcatgaaataaggttattctttggtagttctttcttgagaagaattcttatggagttcagtaacctcttcttgaggcagaagtaaatgctcagggatttgggaactaattatctcagtttggtagaattgaaaaataagtctttggtgttgtgtcatctgtgtcagtgacagcaaagctggacctgtgctaggccctggtgggtcatctttaagcactggacttttatcttgttaggaatatagaagcaagcgtctcacatctctgacagatgggctttacggcttggcctaaagctctggttgtttttaaggcccttgaataaaaataaaagacgatgtttgcagattttaagaggaagttttttttttttttgagacagagtctcgctctgtcacccaggctactggagtgcaatggcgttatcttggctcactgcaacctctgtctcccgggttcaagcgattctccgcctcagcctcctgagtagctgggattacaggcacccgccatcatgcccggctaatttttgtatttttgtagagatggggtttcaccatgttggccaggctagtcttgaactcctgacctcaggtgatccgcccgcctcggcctcccaaagtgctgggatcacggggatgagccatcgcacctggccaagaggaagtattttttttttctatcctgctctttctgaaaagcttgaacatttttctgtactttccttttcttttttgagacagggtcttgctctatcacccagaatggagcacaggggtacaatcatggctcactgcagccttcacctcccgggctcaagcaatcctctcacctcaccctcccaagtagctggaactacacacaggcgccaccacatccatctaatttttaaaatattctgtagagacagggtctcactatgttgcccaggctggtctcaaacttctgggctgaagcaatcctcccacttcagcctcctgagtggctgggactacaggcacatgctatcatgtctggctaactttgttttttatagagacagggtcttttgctgtatttcccagggcggtcttgaactcctggcttcaagtgatcttcctgccttggcctcccaaagcactgggattatggccatgagccaccacgtaatctttgttttatgcgtatttataagctttgcttccccaacaagattataagctctttgattgaagtacatcatatatttgatatgtattctcttgtccaagtgtttctgtaggcaataaggggaactttgtaaaacaagagttttccggtcaagtaaatttgagaagcgctgcctaatctcttccccctcagagatttgcaatgcatattgacctattaaaggctctgagaattcttcctgcgaagaaacctattttagccttgtccaccttgcatttcccaaacacgtttgacctcagaactccctttttcactaagaatgttttgcccatcttatgttttacccatgtgctctatagcagttaacactgggcttattaaaggtactcaatatgtgattgtaaattaactggtgaagcattccctcattcttgtttattttatacatttatttaatgaagcccttttcatagaaattgtcaagataaatgtatcctcatttagatcaaaacaaattctaaattaatgaagtcatgacattttactgtattttggtttttttggtttatctgtgaagtcctcaaacctgtgagtagtgctgaccctagccttgaatgaacagccctgtactaactgcaaggccagaagaacccctgcccttcccctccccacccccccacatcatttccagaagttctaaagaacagttgaaatttacggagatcagactgggttgagtgtgggatttccagggtgggttctagaaggagaagtgggtcttctgtagtttgttgaaattttattttccaaacccagcccccaagtttttcttcctctatttatgtgcaaggacaaaacagttactgtcctacctacataggatatggactctgtctgctctgagcccattttagtttagaatatagagacctccctccaggtcctaagagagagattccatgagagatgtgcaacaccataaggttggtgatttgtactttgaaatggctgcctttatttcctttaaagtcaatatcttatatttgaataaacacagtttgcaaagcatctttacagaaatctcattggatcctcacggtcaccttttttctgagacagagtctcactctttcacccaggctggagtgcagtggagcgatcttggctcctccacttcctgggctcgagtgatcctccttccttagcctcccaagtagctgggaccacagatgcgtgccaccatgcccagccaatttttgtatttttggtagagatggggtttcgccatgttgcccaggctggtctcaaactctgcagctcaagcaatccacccgccttggcctcccaaagtgctgggattacaggtatgagccactgtaccctgccctcacagtcaccttttgaagaacctcctgctcaagagatcctcctgcctcagcctcctgagtagctgtgatgactacaggcttgtactaccatgcctggctagtttttttattttttgtagagacggggttccctgtgatgcccagggtggtctcaaactcctgagctcaagccatcctcccacctcagcctcccaaagtgctgggattgtaggtgtgagccactgcacctggccaagcattagttttaatcttgttttatagatgaataaactggggctgactcaaactgactcaaagtcacactgtcattacctttttgatcctgtacgttagactgggctgtatgcatgttcttgctggcccaataaagttgcaagtgccagctaacagcccttcccactccacctcaccacctcatagaggaaaattgtgacgttaatgggaaatgtcagcggtaatgtcttcaggctgggcctgtggagtgactcccttgccacaggatatttaagcaatgctgtgtcttgtctgaggctcagacctgctattcttattggcacttgggacctgcatggtttttggcttcacctccagctttagccatttttcttctgttcttttaggtaaggattttctgccccagacctcagattcccatttccttcctagcttctctgctgttatagctcagtctcttccaagaccatgcaagattcagaccctagtaggaggagatggaggaactaggacttaaacccacatcttgtgattccaaggctggttcctcttttgccctgcaccacacagctgtctgctcacagtcatgtgacaggggcttccccagccagaacctccagggagcacaaataaaggaaagagctggaaggcacagtacagcatttgttctgtccaagccttacatatcagcatgggcagggagaatgtggtgaagttttctttcaaggactttgtttgataaggaaggacatttatcagtaaagagaggttttgagggaagtgaaccaatcttgagataagtacacaaaagagctttgagtctggtgtttccctgtttgcttctgccccctggaggagcaaatactccatgattagagacgtgtgagtcctttggaatagaatagcagtgatggaactggagtcctagtccaggttctctccttgttcagcctggattcagcactgggtatcgaaacaagcctgcaccctcagaggagatggctaggggacagtgcgtccaggcctcttctaccacacagagttttcttttttttataaagggtatacacatttaaaatttaatgatactcccaaattgctcttcaaaaaggctgtgcaaaattacagtcctgataacagctacccagagatcctgtaacggcatttgccctcattattattattattattattattattattattattattattatttgaatttgagacggagttctgctctgttgcccaggctggagtgcagtggcgcaatcttggctcactgcaacctctgcctcccgggttcaagcaattctcctgtctcaccctccctagtagctgggattacaggtgagcaccaccacgcctggctaatttttgtatttttagtagagacggggtttcaccatattggccagactggtctcgaactcctgacctcaggtgatccgcccgtctcggcctcccaaagtgctaggattacagatgtgagccactggggctggttgccctcactatttaatgggttatttgcaacctgtgaatcatgtctcctatttccttgttaatgatgcttattgattatagacttaggaatatcagcacctcctttgtagctcttcattcttacatgatataataattaatttttttttttgagacagagtctcactctgttgcccaggctggagtgcagtgtcacaatgttggctcactgcaacctccacctcctgggttcaagcgattctcctgcctcagcctcctgagtagctgggactacaggtgcgtgccactacacctgactaatttttgtatttttagtagagacagggtttcgccatgttggctaggctggtcttgaactcctgacctcaggtaatctgcccgcctcagcctcccaaagtgctgggattacaggtgagccactgcgcccagccaataattcattgtttaatccttagttgtgggccaagcaaaggagaaaagtaagaagccttttccttttaccgataggaaaggtcaaaggacttacctggtgaattatttacctaaaaatgtatacaaatcactccaaaatttagtggctaaaaacaacagtactaatttaattatatcttcacagttactaatttaattatatcctcacctgtgggtgaggaatttaggagcagcttagctgggctgttctggcccagagtctagtgaagttgtggtcagttgtcagctgggtcatctgaatgcttgattgggattggaggctccacttctatggtggtcactcacatgactgagaagttggtgctagctgttggcaggaagcctgttcttcatgtgggcctctctgagggactgcttgagtactttcatgatgtggtggtgggcttctcccagagtgagccactcagaagagagaaagattgtgaggtctggacttcaataagaagattgttgaagaaaaaaaggttttgtccccccttggtttgattggactagagtgggctcagtctgtgcctgtggctggcatcaggcaggaacagtggtatagcagggtatagaccatatttagggacctaaaatcacatctttcatgattcatgtggttcttgttccaactgcccaggactcaggcacatcaaaatatgacacaaaagcagaagcttttcataatggagattagaccatgtctaggattcctacccagtcctcttgagctctcctcactccagtgttgttttccatgtttgttttttgttttccccagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccgtccctgtacctgcagtgcctctcccagaaactgagacaagaaaggtgagcccccaggaggtggtcagttccggaccacctgcttattttcgtgccaccaggatgggaattaccactgtgccacatttgctgcccatctcttccgggaggaaaagagattttccctcctgcattgggcttgccctaggactacagtatagacccggcatgatttataaatactttgtagttagttagtttgtagtttgaatacttttctttaaaattaagaaattttcagcctgggcaacaaagtgagaacttgctctataaacatttttaaaattagttgggtgtggtggtgtgcgcttatagtcccaactgcttgggaggctaaggtaggaggattgcttgagcccaggagtttgaggctgcagtgagtcgtgattgcactactgcactgcagcctgagcaacagagggagaccttgtctccaataaacaaataaataaatacaaataacaaatttatttatttttatttatttttttttttgagatggagtcttgctctgttgcccaggctggagtgcattggcgcaatcttggctcactgcaacctccacctcccaggttcaagcagttgtcctgcctcaccctcccaagtagctgggattacaggcatgtgccaccacgccctggctaatttttgtatttttagtagagactgggtttcaccatgttgaccaggccagtcttgaactcctgacctcaggtgatctgcctgcctcagcctcccaaagtgctaggattacaagcgtgagccactgcgcctggccacaaatttttatttttaatttttctttttttttttttttttttttttgagacagagtttcactcttgttgcccaggctggagtacagtggcatgatcttggctcgctgcaacctccgcctgctgggttccagtgattctcctgcctcagcttcccgagtagctgggattacaggcgtccgccatcacacctggctaatttttgtatttttagtggagacagggtttccaccatgttggccaggctggtctggaactcctggcctcaagtgatccacgtacctcggcctgccaaagtgctgggattacaggcatgagccaccatgctcagccaccttccagatctttttttatttgatacccacacagtcatgtagaagtatatcttttttgtttgtttgttttttgagatgacatctcactctgttgtccaggctggagtgcagtggcacacctcggcttactgcaacatccacctcccgggttcaggcaattctcctgcctcagtctcctgagtagctgggactacaggcgcacaccactacggctttgctaatttttgtatttttagtagagatggggtttcaccatgttggccaggctggtcccgaactcctgacctcaagtgatcctcctgccttggcctcccaaaagtgagccactgcgcccagcctggaagtatgtttgtaagcccagatggaatcatcatctattgtttcttttttttaattaaaaaaattttaatacagttcaaatccccatgtctggctcatttcagctcctttactgccaaagcaggggacaaggactgcttcagtttctctgccttctctttctctgaaggtatctgctgcattgaacttgaaagttcacattatccttatttttcttgatcttgacagatttggcatcctttcacctggctgtgagcagaaagtccttgatttcctcaattttgcaaggcatggcgatgaggcacacagggagaggacaaggacaggcacccctctatcccatgtatcacccaaaagacactcacagcctgccatcactttataacctgcttttagtttgtttaacagtagatcacaaacatttttgcatgtcagtagtcacatttctacagcatcagtttaatgtatgcacaatagcccataatatggccatagcttaatttacttgatcaatcttcagttgttgcacagtgtttgctttcatacgaagtaagtattaaacatccttgtaacttagtatttgttcttatccttaattgttttctagggggacaattcccggaagtggaattacagagtcaaaggacatgcatttttcaagcctcggatgcatcttactagatgtcctataggatggtcatatcagctttataggagagtagctgtgtccctgaattctccctgacactgcatgctcttatatttcctcaagttttgacaatttgataggtgaaaagtggtatctgactgttcagatctggaaggctttgttatataaacatttttttaatgtttattggcaagaatacttttctaagagaaacatcagtgagctggtttccatttaagctgaatgaagccacaatgtacctcaagtataagattaactggcctttttcagttgcactctaattacaatttagaatgatgtttctgagccacctgtcaaatgcattctgggctgtacctctgcgtaccccaggaataaatctcatggccttctttacctggcctccttagtggtggcccagcaggaagcgggggttagagcaggagccactcagccttccaagatagatactccatgggccggtggtattactggccttttgagcccatccccatttgcatagatgatccacgtgggttatcatctggctggtatgttcccagagtgaaactcagcagccccttgagggaggggatggtggccatcaggccagagtattgcaagttagtttggatcatttgctaagcagcttgtggtgccttcagaaaggaacagtttcaaagaactttcacatctgttggctcatttcgccctaatgacagtcttctctttgatatttgcatggcattaaattttgcctttcttgttttctccagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgaggactctaccctcatcacctaattacctcccaaaggccccaccttctgatactgtcactttggggatactgtctcccctttgaattctggggggga

SEQ ID NO: 17277 - DNA, 57331 bp, Human
gttgccactgcactccagcctgggcggcagagggagactgcatctcaaaaaaaaaaaattatatatataaaaaacacacataagttgaacatatctattcaacattcctagatcttcatctttttttcaaatttcttttcttttttaagaaatggggtctcgatgtgttgcccaggctggagtgcagtggctattcacaagtgagatcactgctcactgcatcctggaactctgggatgcaaacaatcttccttttctcagcctcacaagtagctgggattacaggtgtgtgtgctgggctagtcatcttcacatttttaaacactcttcaaacacatcattgttaactgttgagctatgttctctttatcttctgtctctagtcactccccaaattcttatttataatgcacaaaaaattgcctttctcttccattttcttaactccacctagccaaaatggaataatgaggtatcaaggctatgatcatttctttctcaactggatttcctaaacagctcccaaatcttgtgactctatatcttccctcccaatcctacctcctttatccaaagatctttcaatacaaatctgaccagtgccctaagggccaactaagcccttcataataacagacccaatgcttggcattttacacagctgttacacggatttggaccttctacctggaaaattttacccctcttggcctgttttaaatctattcaacacaggggtttcagtttaaacatctcttcctcctagaaaattgttcctgactccttctgggcttttaattagctactcctaccatgtgctccaatgcacttcccatatcatggtatttttctcaatattgtccgttcaatatcttcacgtgctaggtaactacagtgaatgcagagatcgtagttgtctcgctcgataatgaatacttatcttctgttcgcagagtactctgtagttttgttttgagtaagtgaatccaaatgaaacaataccctgttcttaatactgtatggatcccatccaggttcattccttttcttcctcattttctctgtcttgtcttttttatattttggatagttgaagtcaatcattttctctgtctattcattctatttccccagcctcttcatcccactagccgtccgatcccatctccatattcagtgcttctcctaacgtctcttcttctccctaccccaaaccctggagatgtacaagatcctacctttcacgccaaatgaagaaaatctttaaaaaagaaatgcgaatcaatttccattacctttttcttcaaaaggtagctgggaaaccaatgaacacttttttttttttttttttttttttttgagacggagtttcgctcttgttgcccaggctggaatgcaatggctcgatctcggctcactgcaacgtccgcctcccgggttcaagcgtttctcctgcctcagcctcccgagtagctagtattacaggcatgcgccaccacgcccggctaattttgtatttttaggagagacggggtttctccatgtcggtcagactggtctcgagctcccgacctcaggtgattcgcccgcctcggcctcccaaggtgctgggattagaggcgtgagacactgcgcccgaccccaaagaacactttttaaagattgctacaagacaaacagctaccactcagccagctactgtgcaaacttcctcagatccaaacaacacttccttttcccttccccggaaacggaaagaagaaaggaaaggtaaggcccacaactcagggcccaagaatccgttttcctcaggtttcctgatgggcggggccgaatggccggcgccgactggacggcagagccgtcgctcttggccgactcctcttcctattggcttcctcgggcaccgccccctgaacagggcgggagattcggtgtgccgcacgcaggcttcccatcccccagctggcctccggtgctccttacctccccggtggtcgggcgcgaattactggaaattggcttttcccgttggggccgaaggtaccttccctgcggcggcgactcagcggggtgtcgttcggccggcgtgacgcagccggatcggcgccagacggaaacctagcggtgagtagtggggtgtcggggcagcctgcctcccttttctgcttagctcgcggcgtgtgaggtgcgtccaggtgcacccagccccgcgtcggagcttggcccctagcgtcccaagtcgcgcatctcaggactttccctcggcacttggggcatggtctttgcgcctcgctgccccccgcaggctgcccgggggctcgagaacccttactggtggagcgcagccaactggccagaggctggaggcgcaggccaaagtcctttaagacttgaggtgagaggctcactctgggaggacctttcgttagtctgccccgcagttataggccttttgtgcaagggacgcctgatactaacctacctgattcccagcttacgaagccctctggttggaaaaggagaactgtgaagatgtgtaacgacagtggtaaagtgccctgtgaggtatgaagaggaagagatcgcgtcccagaaccactgtagctagaacctttgatgtcatcccagcctggaggcaccaatgtgtcctgccagctaactgatcggtcaccttggagccatgcttggctgtaaaatgttgataagccaggctcttttggtagagctttttaattaaaaagatgttgagacgttacttttcattttacaattgaaatcctaatagaatcattacactttcccgcagttaaattgcaatctgaagaaaaatagcacggccctacaccgttatataagggcactgcacgttaaacggacatcatcacttattgagcagtttttctgttagatgttgaatgagttagagatgtacaagagatctgcatggttaagttgaagtttaaagtaaaaatatctcagtgcactgcagtaaggagctaaaaaagaaaaaggttaaagtaaaaataccgataattgggagcattcagtgatgctcttttatatatcaggcacatcatttcatttaatcgtcaggactttggacaaagtcacacagttataaagtatggagtggagattggaactcaggtttctccaatattaaaattggtgtttaaccactaatctatccaaccttctttttcaaaggattatgtttttaaaaattacagcaaatcttttatttgttttcaaaggagagtgtgttgctaccacttggtgcaatgctaacacttggtgctgcagaattgccttgaagtaactccttgaaaggggttggcctataagcaccaaggcagtgccttgaggggtcataatggtcactaaatattgcattttattgtgtgattgttaggtttttttgttcgtttgtttttcaggaactgttggaaagcaaagaaggaaacgtttctcatgaggtctttgtagacattttctttaatttggtgattttgtactatttaataagatgctccaaaattagaaaaggaaatgtttgtataaatgcacttggctacaaacaagtctcaggctgcctctctccaggcaattcttgtgtagaataccatagggaaattgcctaggacaatactcagttgcctagaatatttgtttttaaattttcctagaaaatcttgtccccacatccccaagaacaactaaacttttgccaataagaattacgtaaccgacctttacttgctttttgctttgattgccaggaagctcagagccaaaaattcattgtgtgattttattttctgctttcctttatattttttctgatgcagactccctattagcatttataaattataatttgttttattgcatttgctcattgtcactgcttcaaatcctttgtagtacacagcagtgtataattaagtaaaataatgtagattatgctgactctggccatgctctttgaagtatgcttgatagaactagtgatgtttcacccaatgaactggaaagttagagaaactttccagtttggacattctatagttacctgctatagaataccctaaccctaattgacatgtagagaaataattagacctattatgaatggttttcagaggtcaaaacaagcatttagcgtccagcacagtggttcacacctgcagtcccagcacttggggaggctgaggtgggcagattgcttgagctcaggccagcctgggcaacatggggaaaccccgtctctacaaaaaaatacaaaaattagcaaggcttggcattgcacgcctgtagtcccacctgttcaggaggctgaggtgagatgttgcagtgagctgagatcgcaccactgcactccagcctgggtgacagagctgaatgaccctgtttcaaaaaacaaaccccacaaaaacaaaaaacccaaaacaacaaaaaaaccaagcatttatgataacatttttatttgatggcaggagaggtatgtggtgtaatagagtggtcaggaagttaggaatctgccaggtgcagtggcttacacctgtaatcccaacactttgggaggctgaggtgggccaatcacgagttcaagagatcgacaccatcctggccgacatggtgaaaccccatctctactaaaaatgcaaaaattagctgggtgtggtggtgcacacctgtagtcccagctactcgggaggctgaggcaggaggatctcttgaacccaggaggcggaggttgcagtgagctgaaactgagcctctgcactccagcctgggacacagccagactccatcttagaaaaaaaaaagaagaagttaggatcagtccgaagtgaatttcaaccctaatagatttataattgtgtgtatttgcattaataattcaatgagttattaatatttaatgagttgacctcagtttactcatttgtaagttggggacattatatatataaagagagagatgcaaaatacctaagtcagagaatctgaggatttaatgagctggtgtacataaatgtgcctaatacagtgcctcacaaacagccccttaaaaaacctgttgctttattttatacaaatattacataaatgggttaaactttttctctaatacacccagtttccccataataggaaacagtattatgactagaaaaatggcccaagaggacatgttttacaagcaatggtcataagttatagatgaagtatttattatctttattttttatttttatttttaaaatttttccttcatatcacagccaagtccacaattttttgttgtcgttgttgtttaaaaaaatttttttgacctggtgtggtggctcactcctgtaatcccagcagtttgggaggtagaggtgggtagatcgcttgagcccaaaggtttgagacaagcctaggcaacatggtgaaacctcatttctacaaaaaatacaaaagttagctggacgtggtggcagaagctagtagtcccagctgtatgggaggctgaggtgggcagatcacctgagcccaggaggttggagctgtggtgagccaagatcataccactgctctaggtgacagagcccagaccctgtctcaaaaaaaaagaaaaaaaaattagagacagagtctcactctgttgcccaatccgagtagactataggcacatgccactacgcccagctaattttttttttttttggtagaggcaggccttactgttgccaggcttgtcttcaactcctggcctcaagggatccccctgcctcagcctcccaaagcactgagattataggcatgagccactgcacccagcccactatttattatctttatacacaaagtatgaacctcatagagttgtgcagattaaatgagaatacatatggagtactcaaaactgtctagcacaatgtaagtgctcaaattttgtcctcctctcttcccactccatccagatgttctcagtatctagggcttcctagccaaatcagtaatggtctttttgtcctttactataccattacaacagctttggctttgtaaggtctacatgtatctattcatcatgcttgttaaaacttgtggaacttgtttttgccccattgctttcatttttctgctagctgaccctgactgagttatttttccaattacaggtgactgtatctgaattttgcagctgcagaatgtgtagtaccttaaaaggtaaatgaaaactgaaagaagtcatttaagcatgttgcttgtcaaaataaaacttggtaacattgaattagttttcttcctgcagttaatgaactcagaagagataaatgactgtggtggtggcccatgcctgtaaatcccagaggtttgggagggtgaggtgggaaaattgcttaattccaggagctcagaaccagcctgggcaacatagtgaggctccatctctacaaaaaaaggaaaacctgccaagcatggtggcatgtgcctgtaatcccaactacttcagaggttgagatgggaggattgcttgagcccaggtggttgaggctgcagcaacacagtgagaccctgtctcaataaaaaaagaaagaaaagagagacacagtcaatagtttctcctgccaaaagaaaaggtgaaaacaagattgtaagaaagagagaagagaaaagaaatcaccaagaacactgaatcttagtttacattttttgggtaaactgattagctggcagcagttaaaatcatcattagttattttcaggccagtagcatagtaagttctgaaagttcattttgtgagactagccagagttgatcaaacttttgcttgccaaactctggaggtttgttcagtgaggaactgagtgtaaagtgttcgaaagatttgtgtttactgtttagttaccaagatatctagaaagccatattcatatttgtaaagttgtttggtaagcattccataaaagtaaagggaggtgcttgagggttttttgatccaggcttaggacacaagtgaagtttaacagactccccacaattgactgtagctttctagtgaacagataataaaatccattaaagcattattctttgtttggctgtcacttttctaaacactcatgtattaaccaccccctttctgttaatgtgcttatctggattggttagagctttcattaaaacttaaaattgtttttctgagaatattttattttatttttctgagtatattttagctaccttgattggatttagctcttctcaaatctcagaatctctttgcctccccaattttttagataaagaattgagttacctacagttgaatatgtagtaatacagtaatgcataatgtattttttatacttaaaaagactttaaaaatattagataaagacatgtattcattatgtgaatgtttaatttggtggttgatatgaattcttcatcacttttgagtaacttactgtttttgtttaggttggcaacaatgagtaaaccagaattaaaggaagacaagatgctggaggttcactttgtgggagatgatgatgttcttaatcacattctagatagagaaggaggtattaagtgattgtacaatttgaagagatgcttattataatgtttatggattatttcacttttaaaacttttaacattttcttttgaaaatatagcgcaaaggattgatctggttagtaaaactaaataaaaactgctttaatttttagtttaattctttcaaactttaattgaaaatgttcagtaaagcctaatataaaacaaaatgcccaggagtggtagtcactaataactacccattgtaatttaaaatatgtggttattttgaaccctaaaaatatatactttcaagattgtgtgtgtttttttttttaactatataaactgtggaagagtggtcagagtggtcagttttaatcaaagagaaagcttttttcccagcttttaagtaatgacaatataaatattataatttcttatttaaatgtaatgtttagaaagaatttatacctgtcatgctctatttctttggatgttcttataggagctaaattgaagaaggagcgagcgcagcttttggtcaaccccaaaaaaataataaagaagccagaatatgatttggaggaagatgaccaggaggtcttaaaagatcagaactatgtggaaattatgggaagagatgttcaaggtatttgagggggtgaaatatacactcgtttctgctagtagcagaaattgctttataggatacacaaaagtagtctggtaggttaaacagtggtgttctatatgatcatgtttctcatctaaaaagcatttgcttcaatttctccatagttcttttttttaacaaccagtcctgcacatagttttcagtaagaaggaatctatagaccaaccactctaaagttattttatttttaaaatttttccaggatacatgtgtacaatgtgcaggcttgttacataggtatacatgtgccatggtggtttgctgcacctttcaacccatcatctaggttttaagccccacatgcattagctgtctgtccttatgctctccctccctccacccacccgcaggctgtggcatatgttgttcccctccctgtgtccatgtgttctcatttttcaactcccacctatgagtgagaatatgcagtgtgtggttttctgttcctgtgttagtttgctgaggatgatgacttctagcttcatacatgtccctgcaaaggacatgatctcattccttttatggctgcatagtactcctaaagttattttcaagattatttatttatttatttatttattttagagacagggtcttgctcagtcacccagattgggatgccatggcacaatcatagctcattgtagcctccaacttctgggttcaggagatcctcccaacttagccacctgagtagctagtactatttttaaggtatttatttatggccagacatggtggctcacgcctgtgatcccagtacattgggagactgaggcaggaggactgcttgagcccaggagtttgtaaccatcctaggcaacatagtaagatcccgtttctacaaaaaaaaaaagtttttaattagctggaagctgggtgtgtgatggctcatgcctgtaatctcagcatattgggagaccaaagcagattgatcgcttgagtccaggagtttgagactagcctggcatggtggcacacacctgtggtcccagctatgagtgaggctgaggtgggaggatcacttgagcctgggaggttgaggcagcagtgagccgtgatcataccactacactccagcctgggcaacagagtgagaccctgtctcaaaaaaaaaataaaactagctgagcatggtggcgtgtgcctgtagtcctagttacttgggaggctaacgcagaggattgcttgagcccaggaggttgaggctacagtgagctgtgattgcatcactatactcagcctgggtgacaaagcgagaccctaggtcaaaacagaacaaaaaaaagatatttatatttttaacttatttaaaatacctttctaaagcaagttactttattcttaccttgatctttacagaactaggaggagcatttcaagaagtagtgttctaacccagggatgctggtattatgtgtgtggttttaatttttacatctaagccagattcctgcaagattattcttaacataaaacatttttttaggttcgaattatattttagttaggtttttcctgggtacaaggaacacagatccccacaacctagcttaaaaaaataatgacaaaggaaagaaatcaatattgttgggtactaggagagttggaactgggacagtgttaaaaactgaggaactgtgctttcatgagtctccaggtctccctgtgtcatctctgtgcatctgttctgatttctctatgccacatattttcttcatgtacatgtgttttattctcacatacttataaatgtccatcaagttcccagtgttaagtgatttggtttttcagttctcccattctagattctcaagagtcaatttagctcaattcatttttaaaatctggacatagaaatagcatataattggaatatccacagatgaatcacagttgagttatctgtgcctattacttattatattaatgaacataattacatagttcattaactatgggggtagagtcatatactccatgtatagagttatacaaaaaatgaccactgctcctcaatagatttagtgggctgggtagggtctcctatgtgtccacagctagacagttgacattttttgagcatattctaaataaaacttggtgttcttgactccctattatgccaggcctaagaagagattgataacagtattccacaaaggaaacttttatcataaaaattgtctcttaaaaaagtagtatgtttgttgtagaaattcagtgcttccaacctttctcacataacagcactcacagcaaatgatatttggaggcacaatggaataaatagaagaggatgctgcagaccaaggacaaataccccagggccctaaccctacccctgctactggccttgattggcatcctcaaaggcctgagagaatcagtactcagcacatatgaaacccataccatttatttatttatttatttatttatttattcattcattcattcattcattcctcacactggggaactttgccttattttttggcatcatgccctatgtttttcaacctttttaaaattattgacccctaattagcctttttagacattttctcctaatcactttttcccaccctaaaaatttcagtactacatatatgctgtatatctgtttatgtactgtgacgctttggagggccacagactattatattaataatgtcaaagtcttttttccacactccctcctgtgccaagatccagttttacccaattgggagatgtattgtacctgtcaagaatgcctgctttagagaacgtggaaccgttaacatttcagtgtgtatcttctgtctgttcatacatgcatgggcacacataagcttgcaccattacgtttataaatagactttttgcaattaataatgtatcatatatacattactctgtcattagacattcttctacaataagagttttgacatgtattgccaaatatcctcctaaagtttatacagattacactatttaatcatagttacattttcctaaagacttagttttggccaggtgcagtggctcatgcctgtaatctcagcactttgggaggccaaggcgggtggatcgcctgaggacgggaattcaagaccagcctggccaacatggcgaaaccgtgtctctactaaaaatacaaaaaattagctgggcgtggtggtgggtgcctgtaatctcagctactcgggaggctgaggcaggaaaatcgcttgaacccgggagatggaggttgcaatgagccaaggtcacaccattgcacttcagcctgggcaacaagagtgaaaatccatctcaaaaaaaaaaaaagaaaaagaaagaaagaaatcccaaatcccatctctacaaaaaacatacaaaaattagctgggcgtggtggcatgcacctgtagtcctagctgctcagaaggctgaagtgggaggatcactggagcccaggaggttgaggctgcagtgagccacaatcacaccattgcacactagcatgggtgacagagcaagaatttatctcatacacacacaaaaaagcttagcatctgaaccatttttaaagtgtatgggttcagtggcattaggtacattcacaccatttgtaaccaatctcccaaacttttctcattgtacaaaactgaaatttattcatctgtagatggacacttgggttgcttcaaccttttgggtattgcgaatgatgctgctatgaacatgggtgtacaaatacctctttgtgaccctgcattcaattctttggggtttatacccataagtggaaatgctggatcatgtgctaattctatttttaattttttaaggaaccaccatactttttgcacagtggctgcaccattttacatatcaacctacagtgtacaagggttccaatttctccacgttcttaccaacacctatttccttttttaaaaaaaaaaaaaaacagtagcccttttaatggatatgaggcggtggttttattttcttttaaatttaacatatcgttaaattctcagaggtcagtcttcggacaaaaagaactgtaatagctagtagtattgcattctaatatataaataatgtgtggttttctatattatacttttggattgtttgtaactttttattagtgtaactaatgcagtagtgattgattttgatgtaggacttgagtctttgaatgtaagtttgttggagatcagctggttgaacagtattgcctttttttttttttttttttttgagacagggtctcactctgtcacctaggctggagtgcagtggcacaatcaaggctcactgcaaccttagcctccctgggctcaggtgatcctcccacctaagcctcctgagtagctgcaactacaggtgcggaccaccatgcctggctagtttttgtatattttgtagaggtggagtctcaccatgttgaccaggctggtctcaaacccctaggctcaagtgatctgccagcctcagcctatccaaagtgctgagattagaggtgtaagcaattatgcccagcctgctttttttttttttaatttttaagctatcatatccataatgcatcaactggaattttccagtttcattttcttccaataaactgataacttaatgatacttttgatgctatctgagtgtagtaggctttcatgtttctcaaattttctcttaaatcttttacagtttctcattctcaccttatttaaaaccagttgttttagttaataactttttcaagtttatattttgtctatatttgacattcagacaaaaataaattatataggccgggcgcggtggctcatgcctgtaatcccagcactttgggaggccaaggtgggtggatcatgaggtcaggagatcgagaccatcctggctaacacagtgaaaccctgtccctactaaaaatacaaaaaaaattagccgggtgtggtggcgggcgactgtagtcccagctactcgggaggtggaggcaggagaatggcatgaacccaggaggcagagcttgcagtgagcctagatcgtgccactgcactccagcctgggcgacagagtgagactccgtctcaaaaaataaataaataaataaattatataaatatatagttatacattctatattctaattatatattctagttgtagttctatcattgcagtaacaagttctccataaatagatttgtgcatatatgaaaactagatatactgtagaagtagcattgcagatcactgggctagtgatgaactggtcagtaaatggtgatgggacaattgtatattcccattttaaaaaaaaggccctctacctccctttataaacagattaattaccttaattatttaaacatgaaaagcaaattgtaaatgcttttagacaaaaatataagagaatatggttttggtcttgattacagaaagttttcttagaaaatatgtaatcaaaagaaaagattgacaaattcaactaattaaaattcattgtttctcaagaaagtgagaagactacagactagaagaaaatgttgcagaagacatgtctgataaaggacttttaatccaaaatatacaaagagcttttaaaattcagcaataagaaaacaatttaattaaaaaataggcaaataggtatttgaacagataccatatgcttatttgccatctatttttattctttattaccaaggaaaataaacagatggccaataagcatatgaaaatatgctcaatatcatatcattagggaattgcaaattaaaacaaaatgagataccactatacacctattagaatagccaaaatccaaaacacgaataccaccaaatactgattaggatgtggagcagcaagaactcatttatctctagttaatgcaaaatggtgcagccccatgaaaaacagctgtgctgctgcttatgaaactcaacatactctaactatataatccagtagttatgtttcttagtatttacccaaatgagttgaatacttatgtccacacaaaaacctgcaggtggacctttatagcaatttcattcacaatggccaaaacttggaagcaacaaagaggtcgttcagtagatgaatggatgaacaaactggcacatcctgaccatggagtattcagcacttaaataaaaaagagctatcaagccatgaacaagatatgaaaggaccttaaaagtatgttactaagtgaaataagccaatctgaaaaggctacatactgtatgattccaactatatgacattctggaaaatgcaaaactgtggagacagtaaaaagactagtgtaaagtctattttataagaaaccagcactttccttcaaatgacaccataaaaagagtgtaaagacaagccacagcgtaaagaagatattttttctgagaagaaacctgtaaaaaaatgttcagtgtcattaatgattaaggaaatacaaatttaagacgcctctcttcagtttatacccattgtttgacaaagattaaggagtttggataaaaccaagcgttggtggaaatacagatcactaggaaagcttaataaggaggatgagcacacactttggaaagtttgacaccattttctaataaatccattaagtattgacaaaaattacatatatttaaatgaaaacaactttcaataacttaatgaggagggcattgttttctatttttaatgtctggcttcattgaaggcaactggattttcttcttcacgcattccattagtcaatatggtaacttgttatcacatcatgtcgtctctggcatacctcactgtacactcttgtttgagagtcaaaagttaattaatgtcttagtattattacgaagtaattttgacctcagggatcctagcaaccctcaggccacatgttggaaattgctgtgatagaaagtaggatactagaaatgaatgttcactgtgttgtaggtagcagttgatatttaaagaggagattgaagaatgtcagttaagtcaggatctgtgaagaaagcttttttttttgatactttatcactttatcaccgaggctggagtgcagtggcacaatctctgctcaccgcaacctctgcctcccaggttcaagcaattcttctgcctcagcctcctgagtagctggaactacaggcatgtgcccccatgcccggctaattttttgtattttcagtagagacgaggtttcactgtgttagccaggatgctctcaatctcctgacctcgtgatcacctggctcagcctcccaaagtgctgggattacaggtgtgagccactgcgcccggccaagaaagcttctaccataaaacagctgtttaaatctcaacctcaacaattgtacttttcatctttgcttcagaaaataaatataaccaaaaaactccctttagtcctcccttcccagggacaactgttactaggaattgaatgcatatccctctaatctggggttttgctatggttttgtatttttacatagatgtctgtgtatctttgaatagcatgttaaaacttatataaacagtttcatagcctgttttctttactatgtatttccaaatattttatatataaatatagttaaatctttatgcaaggctatgaggggtacaaatcttaagtttttttgttaaaatttttttctgttaattttgttcttttttcctaaatgtatattgcatttttttctttcagaatcattgaaaaatggctctgctacaggtggtggaaataaagtttattcttttcagaatagaaaacactctgaaaagatggctaaattaggtatgttgcttttctgatttctataactattactcatctttcctaaggtagatttaaccacattccccatgattattataccactacatttcctaaaagaatgaagagagattccctatggtttagggaataatgagacgttccctaaaagaaggatgttatattaagcacaattaagttcatttgtttttttcatgctcagatgtcttctgttttcagctagattataagcttcttgtagtatgtgcacagtctttgtttttctttagtcctctccaaaatatgtagcttagtttctttttttttttttttaaaggtggagtctcactctgttgcccaagctggagtgcagtggtgcaatctcggctcactgcaacctccacctcctgggttcaagcaattctcctgcctcagcctcctgagtagctgagactacaggtgtgctccaccacacccggctaatttttttgtatttttagtagagaaggggtttcaccatgttggccaggttggtctcaaactccaaacctcaagtgatccacccacctcggcttcccaaagtgctgggattacaggcatgagtcaccatgcccggccatagcttagtttcttcacaaatttttttgaagtaacaagtgagaatcacatagagatattctgaattgattaataaataagagttttgctgggcatggttgctcacggctgtaatcccagcactttgggaagctgaggcaggaggcaggcagatcccttgaggtcaagagtttgagaccagcctggctaacatggtaaaaccccgtctctactaaaaatacgaaaaatgagccaggcgtggtggcacgtgcctgtagtcctagctatccaggaggctgaggcaggagaatcacttgaacctgggaggcagaggttgcagtgagccgagattgtgccattgcactccagcctgggtgacagaacaagactccatctcaaaaaacaaacaaacaaaaaaacccagagttttaccctgtatatggaaaaatgttgtttatattacagaaaaatgcttatataaagttattagtaatggtcttctaacatttttcttacttgagttaccacctataccaattaacacttcagttgctgattttcagagaactaagctgtaataaattacatataaccttaaaattaaactgtcaattatttttcaaaattcaggccaggcatggtagctcatgcctgtaatctcagcactttgggtggccaagacaggaggatcgcttgaggccagtagttcagtaccagcctgggcaacatagcgaaaccctgtctctacagaaaatttaaaaattaggctgggtgcagtggctcacgcctgtaatcccagcactttgggaggccgaggcaggtggatcacaaggtcagaagatcgagaccatcctggctaacacagtgaaaccccgtctctactaaaaatacaaaaaaaaaaattagccaggcgtggtggcgggcgactgtagtcccagctactcgggaggttgaggcaggagaatggcgtgaacccgggaggcggagcttgcagtgagccgagatcgcgccactgcactccagcctgggcgacagagcgagactcagtctcaaaaaaaaaaagaaaattaaaaaattagccaggcatggtggtacatgcctatagtcccagctacttgggaggctgaagcaggaggatgacttgagcctaggggttcaaggttgcagtgagccatgatcacaccactacactccagcctgggtgacagagtgaaaccctgtctcaaaaaaacaaaaacaaaaaaatcagatggcactgtatttcgatcttgtggtatgagggggtcatcatttttgaaagcagtaaggaagggaaataatatatgtgaaagcactttgaaaattataaaggtatataaatacaaagtttggaaataccaaaaagtcaggaacaaaagtataataattatccacctggtaaatgtaatagttgaaaaagagggcttataacgtataattataaaacacctatggatatttcttcagtggtttgtttttattcaatcactgtagccaatgacacatgtaaacattcaaggtcaagtaaaaataaaatatgttaaatgttgacactgatgaggaatatatgagaagtaattataaaacctgtatttctgaatataagttaatcagttgccaaaatcagtttagtttttctaaaatgtgtaacattaaatacattactgattttgaacataacatggtacatacaataatttacattaattgatgtgtttcttagtatttattatctacatcaagaaattaagtttttttggttggtcgcggtggctcgctcctgtaatcccagcactttgggaggccgaggtaggtggatcacttgaggtcaggagttcaagaccagcctggccaacatggtgaaacccagctctactaaaaatacaaaaattagctgggtgtggtggcacacacctgtaattctggctacctgggaggctgaggcaggagaatcacttgaacccagaacgtggaggttgcagtgagccaagattgcaccactgcactccagcctgggtgacagaaagagactccatctgaaaaaacaagaaattaagtttttaaatctataaaaatgactgaatcctgtataggagcactgagaaaccagagaagaaatgctgatgtaataattagaaagataaagtagacagcaagaccaaaatgaaaccctaggacaatggtgcaggacaaagaaataccactggagaaagaggagaattattattgtaaagtgaaatagaactcacaggagtaatcaagtagtagttctccatttggagaattagcatgctcataacttaaagatgataatgtgttgtatttgtaagcactgcataaaactggaatattatcctcattctgcgcatttctgtcatcatatctgaaagaaatacacattttaaagtcatgagaagatagttttatagatatttcgtctttattattatgaccatgaaatttcaggaacgcagtttaacagactgatcagactttctataatctttgtttagttatgatgctctttaatgaatttcattgactcattaagtattgttgctaattgtgtttacatctaaatatatcagtaaaatagaatgccttaatatttaataaataacatgatctgccagaaaatcatatgttattctgagtataaatgatgattttgtccaggcatggtagctcacacctataatcccaacactttgagaggaaaaggtaagaggatcacttaagcccaggagtttgagaccagcccgtgcaacctagtgagaccttgtctctataaaaaaaaattaaaaaaaaaaatagattttcatataattgggctaaccaagatatagggctagaaatagactataagttagataggaaggctttgtaaaatacagagaatgtatctagagtaagaaaataaatgtaaacaaaagagcaaaagtagaagtaccaggtagagaagaaagtgaggagttcagtcaggctggagaaataaatgggtaaattaaaaatagattgagatccagcaatcccactactagatatatacccaaagggtatgaaatgagtatgtcgaagagatatctgcactcccgtgttcattgcagtattattttgcaatatccaggatatggaatcaagctaaatgttcatcaacagaggagcagataaatataaatgaggtaaaagaaaataagtatctttttaaaaaaattagaaaatagattggttagataggaccagataatagactaatctaaagctatcattagacagagaccagtttattgtgtaaaatacaatacagatgaattaatagaataatgaatataaagatacaaaatttatgccctatttttttttgcaagcccacaaataatatcataattttttttaagggtctcactgtattgccccggctggaacgtgtggtgtaatcttggcttgctgcaacttccatgtcctaggctcaagcaattttcctgcctcagcttcctttcctcagtgtccctttagctcgggctaaagtcacacgccaccacacctggctaatttttctattcttttgtagagacagggtttcttcatgttgcccagtctggtctcgaactcctagactcaagtgatccacccacctcggtctcccaaagtgctgggattataggcttgagccaccatgtccaggtctaattttctattaatagagtcaacagccatgccattacatttcatttaatatcatcaaaaacaaatatgacataggagcaagaaaagaataaaaactgtacacatgcattgaaagtgtgcatgtagatgattaatacagagcaaaggtcagccagctttttctgtaaagggccagacagtaaatattttcagctctgtgagctagacagtctctgttgtgactactgaacttggctgttgtagctgaaaagcagccacagacaatacgtatggatggtgtggctacataaagctgtacttaaaacaagtggaaaggctgggtttggccccatagacttatagcttgctgacccctgacataaagaaacactgtaactttttgccattcatagtcataactaaacacaaagttatgtgttaaatagtgattcaccgctgggcgtggtgactcatgcttgtaatcttagcactttgagaggccgaggcgggaggagaacttgaggccaggagtttgaaaccagcctgagcaacataggaagacccagtctctacaaaaatttaaaaattagctaggcatagtggcgcacgcctgtggtctcagctatttgggagtttgaggtgggaggattgcttgggcccaggaggtcaaggctgcagtgagccatgatcacgccagtgtactcctgggcgacaggtacttgtactaggcattgtgcctggtgcttattagacatgttgagtcatccaagaggtgttggaatgtctgcctatctctgtgtgctcacaaaaatgactatcttagccgggcgcggtggctcacacctgtaatcccagcactttgggaggccaaggcaggcagatcacgaggtcaggagtttgagactagcctggccagcatggtgaaacccccgctctactaaaaatacaaaaaattaggtgggcatgatggcacacatgtgtaatcccagctactcaggaggctgaggctggataactgcttgaacctgggaggcagagggtgcagtgagctgagatcgcaccactgcactccagcctgggcgacagagcaagactctatctcaaaaaaaaagagactatcttgttcttaatcctcttcaattcttcctttttattcttttctccctggctcctttgtagtttaatagttatttaaaatcaggtggagcatttttatgtttcagtataacaccaaaatgatctcagctaagttgcttttgttgcttcttttcatatgaagttttttccctatcctgtgaatcagcctttaatccaaaaatgacataaagagaagagcaaggactgagccttaagtatgcctagaatgttgaggaggctgaggacagtgaagaagagatgaaataaccacaaccagtagcttgggaaccaggataatgtcataagactcaaatggaggaattaatatcaagggaagattaaaaaaaaaaaaaaaacttagtgaatcatatagaagaccgaagggattaaggaagaagaagcagccaattcatttgtagagattgttatgagtattttgggtcagtttcaagactggaggataaaaatgggggcaggttagaaaggtttaggagccagtaaaatggctttcacttgtacaaatttaactacaccttctccatttagagaaaaaaagcaaaaaagcagttaatttggtatgtgccctttttctcagtgaacagtgtcccagtgtgagagttaacttggaaaaggtaaatctgtttcttcatttgggttcattttccacatgcctctcatggtgtgagtgtgagagcatcattaaagataacacttatatttttttatttaaaatggcctctattataagtgatttggtctttggtctttagaaaaaaaaagcgagagaaagaaaattgttaaagtaaaaataaaatggcccctaaacaaaagaccactattccatttattctcggttgaagaaatggccatctgttcaacactctattttatgtattatttatatgtattatagactttttggcacaaaataaactgttcacactttatggaagatttaaaagattttaaagtataattttaactctgcacagttttcacttgattttagatctcactttctggcccttctttctcaccccccatcaaagatgtgcctcaactatatatggtaagaaatgaaaggaacataagtggttgatggagaggagagtatggtaattagagaaagcagcaaggtcaaagttagttatttgtattttcttttaaagaaatctgtgggtaatatgaaggaaaatttgaagattctgggaagacagctaataaaggtgaaagcagtattactcctaatatgggtaggattatttttctgataaaagtaacagaggtttttaaagaatttttgtaagcgtaataaggttatttccctctttatctactgttgtcctttaaaaggtttttatatatttctttgtttacagcttcagaactagcaaaaacaccacaaaaaagtgtttcattcagtttgaagaatgatcctgagattacgataaacgttcctcaaagtagcaagggtaagacattacattagttctttgaaaagaattttcatagttgcttcaagatagagcatgttacttttttccttgtttgtgaatttttatatatattttcttcttttctgaaaattcattcaacaaaatgcaattaatatttcaactcatgtaccttagtatacccgtgtttagcagtcagtaagagggaaaaatatctgtgctaactgaagttgtgcaaattgacagggttaaccagaaatagtctttaagtcctgttgtcatgtgcttgagttagccaattatttatagaagatttggctttgggaaatactatatgaaataaggcgtttggagtttggaagtcttacagattgtggagcagctgtttttgaatgatccattctaactagattaaaaagtgtacatttcgttgctctttatttatatttttgtttttgtttttgaacaccaatgtcacttgccgacatttctgtttttttcattttttagagacagggtctcgctatgttgcccaggctgaagtgcattggctattcacaggcacaattacagcacactattaaagccttgaattcctgggctcaagtgatcctctagcctcagcctctcgtgtaacagggcctataagcacaccgcattgtgtctggctccattgtacttttttttttttctttttttttgagaaggagtctcgcttttcacccaggctggagtgctggagtgctggagtgcagtggtgtgatcttggctcattgcaacctctgccttctgggttcaagcaattctcctgcctcagactcctgaataactgggattacaggtacctgccaacatgcccagctaatttttgcatttttagtagaaatggggtttcaccctgttggtcaggctgttttctaactcctgacctcaagcgatcctcctgccttggcctcccaaagtgctgggattacgggcgtgagccaccgctcctggacagttgtacttttcaataatcaaaatttaaaagggctccgtttttcttgttagaatgctacagaaatgcaggaagtagctgttaaaaatgtgagtaatcatgaaactaatagtgataatcctccggtggagatggaattaatttataattcagtaataatgtggtggcttctatgtagaagctgcaactttgctttttttttttttttttaatttttaattttttgaatagacacaggatcacgctatgatgctcaggttggtcttgaactcctggcctcaagcaatcttcctgccttgcctcccaaagtgctgggattacagatgtgagccaccatgcctggcaaactttacttttaatgaaactagaccacaatgaaaagtgaagtgtccgtagtaagtcatggctttttgtttcattctttaggccattctgcttcagacaaggttcaaccgaaggtaagcaattgactaaaaagcaaaagccttagtgttacaaagtaagacatgatgaaaaattgccagaaattcaatgaaaaaattgatctcttaatttatatagtgctttgtaatttacagatatttggcagttaaatacctaacttataggtggagaatttgaggttcagagaggtaaagtgacttgtgtgagttcacttgactaggaaggagaacagctagaaaatgaagccaggcctcccagacccaactgttgtgctttttctgctgtgtgtagctggcctgaaaatgtttggggttttgcttttatgtatcatgttctgtttcttttgcagggggaagagggcagtgttgtgcagtttgatcccaagatgcattagatccattactctatatttttatctcctcctttgtggggttttttctttgtttgtttgtttgtttttgagacggagtcttactctgtcgcccaggctggagtgcagtggcgtggtctcggctcactgcaacctccaccttccaggttcaagtgattcttacacctcagcctcctgagtagctgggattacaggtgtgcaccaccacgcctggctaatttttgtatttttagtagaggcaaggcttcaccatgttggccaggccggtcttgaactcctgacctcaagtgatccatccacctgggcctctcaaagtactgggatttcaggtgtgagccaccacgcctggcctcctttgtgtttttgtggtataattttctcattatgccttttcaagtggtgagtgttccatgaaagggccatatatgcaaagcatcccccaaatgccaaaggagccaagaaaccaaaggacaaggcagacaagtttagtttgtctgtaaagggtattttattagagacagaagcatggtcttgggcagccacaagacaggtagctctctgcagtgttactccccagacccacggcttacctaccataaggaaagggtatacatgttccagcaagataattaaaggcaaccctctttaattgtcaagagggcaagaatgctatatgcattgtagccagtaatttgtgtgataatatcaaggttgacatgttctttcacagaaggcagtacataaagtaggaatcaggaggcattcatgagactggggctaatcagaagttaacgtgatggattagcatccaagatggagtaacttttgtctccacagtcagtatagacatttaaggccatggttatggcctgtgcaggaatgtcctatttagacaagtctaggtatgggattagacatgccagactttcatttgtctttaataatgcttttttcttatgtcttgtgtgttctatcactataaaaggaaaaaaactcattgccataatctaatcaagaatttagattattctttctcaagttatagattataacccattagaagatattgtcaactctcccaaaaaaccagaaaaacctgttgatgaaacaaagctacctatcacaataagagacaacatcgttgtgacagaatcttagtgtactgtcttagaaaagcaagttcaagagaaaatatgtatcgggcttggggatcctgggctcaagtggcttaaagcaggtttttcaaaatggtaaactgattgggattgggcaaagttagggacatgatattttaggattggtagacacagtgaagatcgtgtcttaaagtgtatcttgataactaaactgttgataagataagctgtttgccctaggagtaatctgttgtcctgatagggagaacagtttgcccaaatgagcaaactgtcaagagagattagtttgcagaaatgttctatagcaagtaggaaaaaattatttattagtcttgtctttttgagcaggaattttctgcagtggttattttgacacaggtgttgtgaattctcagacttaagctgtgtagatatatataagttatctcaatactcaatcttgaaatcagtttaataggacataaactgcatttttaacaaatgaagtagaacagaattttaaatttctgttttataattttttttagttatatatacacgtgtactgggtcaagatgacaaaatgtaaaaatttttgaggatcttgatcaaaaaatttgagacatactgtaattccattggtaagggattagctcagttattagagtactattctttttttttttttttccccctgaggaagagtttcattgtgttgtccaggctggagtccaataacgtgatctcggctcaccgcaacctccacctcccaggttcaagcagttgtcctgcctcaacctctcgagtagctgggattacaggcatgcaccagcacgcccggctaattttgtatttttagtagagacgggatttctccatgttggtcaggctggtctcaaactcccgacctcaggtgatctgcccgccttggcctcccaaaatgctgggattacacaggcatgagccactgtgcccggcctagagtactattcttaaaatcaaatcagattttaatgacaccagcaatctatcacaagacaataaacttaaatttttttgtcatattgtcatgttgacaaaatcacagggtactttaacttttttatcagtactattagaaatttacaggtatataacagtggatgttttaatgtgctaacaatttatggtattaaagtattctataaaaaaacagactttgtactcctacaaaaagttacaattttttaaatacagaaagtaagaaagtgtaaatctctccttctctcctcaaagaatgtaatactttaacaccagtaaatttctagcacattaaaaggcccattgccatatacataggggtgcccgttccctttcatacttatgattgctacataatactatcttttaaaaaaatactccattgggccgggcgctgtggctcacacccataatcccagtactttgggaggttaaggtgggcggttcacttgaggtcaggagttttgagaccagcctggccaacatggtgagaccctgtctctgctaaaaatacaaaaattagctgggtgtggtggcacgtgcctataatcacagctacttgggagtctgaggcaggagaatggtttgaacccatttgtcataatcttctagttctaggaactaagctcatctagttctaatgcagtctattgaaagcaaaatatttttctttttttctagcctctttcactcagatcagtcattaatttccatgttattatttaatgctttttctatttctaaacagaacaatgacaaaagtgaatttctgtcaacagcacctcgtagtctaagaaaaagattaataggtacgtatttgtttttacatgactttttataaaaagtagcatctaaacaagaggcaataatagttaagtatataggttctagacttagactgcttggtgttttgaatctttggcttttagttgcaacacttagcaccatgtctttcacattgtagtcagtgtatattgaagtcagctaaaaggtctttccaatgaaataacatgccttttaattgttttgagacagtttggaaattattctattgatttatttggaaattttataatgaaataatattaaatattcatagttgtactgaatgctaaacaaagtcaagtaaacagacatggcttctgccttctaggaaattaaaaatcgtttcagatttttgaatattgaactttgaggcaaatgactggacctttatatatcaggaagatgtcaacacctttcataatgttgacccttgacaataatagtattagtcaacattgttaaattcagcctaacatcagggcttcatacttcatagccctttcttttcaaggtatggatttcatagagttgttaaaactgtatttttaatcaccataaaattggtaatgctaaatgatttggtatattaaagcagtaaaagatctgtatagttgtgattgttatttcatgtcaactatatcccatgtcttatgttttctcctcatcccaaatatgggttgttttttagagagaaggtgaacttccctcttccttcttaatcaccacaaaacatatatacctacatggaggaagcatacatgtaaagaaggtagagatactttctggtacctgccaccacttctaactgtgcatgtaccacgagcagcagtcaatgcacacctgaatctgctgagctatatatgcccacaaaatcaagcctttttttttctttttttttttaatatctacatttgttacatgctgacttgggataatcctctgcagtatatctgttgttcagaataaatatgctgatttgtttaagttttttcactcatattttggaagttagcttttaaaaacagttttatgcctgtttagtgtgaaactggctttattcttatttgataaatgtaaaactagctatattatttctggggagttgtagggatgaggttgtggtttgtttaaaaagacaattcttgaatcaactctgggatggtgtatgtgtatgtattagtaataattataatcataagtaccatttattgagtgctatattagttagtatgacgttttcagtaggcagcaacagaaaattctataatggtagtttaagccatagacatttaagtatctcacatcaaaacaagtatggagatgcaagttccatggttgatgtgacttaacagtatcattaaggacccagattcttcctatcttttactctgccaccagcatttttcatctttaggtttgatacttcatattgcaaaatggctttcatagctttaaacgatgggtataaataggggcttttcttccgtaattgaggaaaatccttctcagaagctgccagctattttccctcaattcactggtcaaggggtcacatagtcaaccatagttggagcagaggctgggaaagcaggtaccttgaagaggaaaaaggcagttaccatgattcatcccctaggatggggcatattgccatattttgcaaaattggagttctgttagcaaggaagagggaaggagaacggtgttaggtatgattaacaatttctatcacagttcctgtgtgtcaggaattattagtggctttatatacatttcaatgtaatcttcctaatggtttattaaactatgtactattaatttgataaataaactggtgctgagagaatttgttaattagctctggtgaaatcatgagcaggtaatgacaaaaccagaattcagactcttactacagagcccccactctttgctttaccccacaatgcctctcttgtcaaaccatgaaattgtccaaattgctatttttccccccacagttccaaggtctcattctgacagtgaaagcgaatattctgcttccaactcagaggatgatgaaggggttgcacaggaacatgaagaggacactaatgcagtcatattcagccaaaagattcaagctcagaatagagtagtttcagctcctgttggcaaagaaacaccttctaagagaatgaaaagagataaaacagtaagtgaagagagagactttaaccttaaagaaaaattgtgtaatatttcaaagataggctaccctaagagatccacatctctcaaaataatattttttcttcacttttctatattttctcagccttccacataaattcccacatatatttgtttctacttctgggctttcttttctggcctgtctacatattcatgaattaataccatagtatatgctaaatagtatatgctaaaagtgacatctcaattccactgtataaaaatgaactttttaggctgggcacagtggctcatgcctgtaatcccagcactttgggaggccaaggcgggtggatcacctgaggtcaggagttcgagaccagcctggccaacatggtgaaaccctgtctctactaaaaacacaaaaattagccaggtgtggtgatgtgtgcctgtaatcccagctacgcgggaggctgaagcaggagaattgctggaacccaggaggcagaggctgtagtgagccgagatcatgccattgtactagcctgggcaataagaacgaaactccgtctcaaaaataaataaataaatttttaaataagctatgggattagaataaaaaataacaaaaataaaaaatgaacttttaagtaaatattgattggacaattggaggcatgagttctcagtgtatcttgtttttgtaccattgtcaatgtattcaagtcagtgtaatgaatgatgtggctagggacccatgttgagtcatttggaagaacattgcaggcaccttggttttagaaaaggctaattatcctggtgctctgtctaaaggttcagagcaattgaggagcctactgcttaaatagctttctgtcccttccttaccaccctagagtttagtcctgcccaaaatcagaagaacaaatagtgtgagaagaaaattccgcttgactggaatagtaggccagtttttttatttgtttgtgggtttcttttttttcttttgttaccttgcagttgatttcctcattttcacagtacttcagctatactaatattaaaggatttgctaagactatttgaagccaggcatggtggctcatgcctgttatcccaacactttgggagggcaaggtgggaggattgcttgaggccaggagtttgaaaccagcctggataacataataagaccctgtctctgcaaaaaaaaaaaaaaaacaatttaaaaaattagtcaggtgtagtggtgcatgcctgtagtcccagctacttggaaggctgaggtaggaggatcccttgtgcccaggaggttgggggtacagtgagctgtatttgcaccactacactgcagcctgggtgacagagtgagacccttcctcaataaagaaaggaaaaaaaaaagacttacttgaggagaaacaaagatcttgatatataaaaccatctctctttttttagtctaaatggaaattacatattgtaacttaggaatcatttttaggaacagactactacttcacctagtcatttctttaacttatatgatcctagtaattactcagttttattactgaaattaaatatgcttggtccttaactggtactgttgctttaaaaagaaaatactaccaagtaaagaatttcacgtgtcctattttacattaatattactgtctaattttgatatgagacagatatttgaagctactaaggactgactactctgttcactttcagagtgacttagtagaagaatattttgaagctcacagcagttcaaaagttttaacctctgatagaacactgcagaagctaaagagagctaaactggatcaggtatgttacaaggaatgttacttctaaattttttttactctgtcctgaaaaatatgctacgtaagcaacagatttgaaaagtatacacaagtagaattattgtcctgatcaaatgaaacacaagttaatgtgattattacttcttttattatataaatagtaaataggccgggcacacctggctcatacctgtaatctcagcaccttgggaggccaagggaggaggattatgtgaacacaggagtttgagaccagcctgggcaatatagggagacctcgttgttactaaaaatttaaataaataaataaataatttactggattagacagactgtaattatgcatttttcccctcttactcgtttattatttcttcaggatctatgataatcatcagggtcatagttccttgatatccatttaccatttatctctgttattcatttaacctatatgtattcactaaatctcacactggtcataaaacagcaactgcaacctgactttctctcagttaaaaactttgcacaaagtagaggatattctgcttgaggatattatggaaaacctgcccagtgtggtaaggtaacaagattactatgtaccatggttccagtagctcattttacaaaaaaaaaaaaaaaaaaaataccatacagttatacttgctggggttttacatctctgtgagaggagacagaaccatctgagtgagaaaatctttgtcagtaataattgcaattgataatctaagtcctggctcattggtattgagactcggatcagagaatataagcaatatgggagaaggacacatgagtctagactcacaataggacttcatcagacttagaggcaaaaagatctctaggaggatgaaagaaacacctgtcagtgagggagacgaaagcctttcattgggcgtaaacatagcatagctaaccaatacaatcttcagtagcatgtgacaataagcatttttcatgtctgcaagtcagtcagaagttggctgatctaggatttgctccatgtttcttttcctcgttggaccagcaggctagctgaggcatgttatcctcatgacagtggcagaggcataagaggaaaagtgggaaaacacacaatctcttacagcccaggctcaaaactagattgccagttctgcttcattctagtacagctggatattggggtcgaaagtgcagttttccatgaatattaattaaagtttgaaatgaggctgggcatggaggctcacacctgtaataccagcactttgggaggccaaggcgggaggatcacgaggtcaggagtttgagagcggcctgcccaacatggtgaaaccccatctctactaaaactacaaaaattagccaggcgtggtggcacgcgcctgtactcccagctactcaggaggctgaggcaggagaatcgcttgaacctgggaggtggagtttgcagtgagctgagattgtgccaccacactccaggctgggtgacagagcaagactctgtctcaaaaaaaaaaaaaaaaaaaaaaagtttgaaatgaaagtacatacatgagataacattctagtgttcacactcaagtgtgaatatgctcagataatctagtgtaaatgactgctggaaaagatattagtgctttctctgctttttcagggctctgaactcagaagagataagagttgtttttttttaactacctacttaacaattttacttaaaggtagttctgtttgctttaactgtgactaaataaacacagtacaagccagagtacctggaatatttatcgcaactctaatcttcagtatttaaataatattttacttgaaaggtggtggaatcatgaaaacatggtagtgccaaagtgaagacccatgtgtagctttttgctagagttttcatttcaaaaaatgatctctgattcatcagcatgaatttccaagtttggggtacagggcaatgcactttcctcagtttatttatattattgtttttaaaaatttgcaatacttaccaaagataaaggatttgttagaaacagcttttggaagaggagcagtgatataggtttattttactaatgataatagtaagtaaattataaagaacctttaatgttttctgagaaagtaaagcctattcttggagtttataatcatttaagtggttctggacaaaacttaccaaattctttactgttattactaaaaagaatgttaacaattttaagaaaacaaaaaaattattttttaagaattttgtttatcggttgatatactcattgccaaaccagattaaagtaatattccaattggattggcttcttctaagctctacttctaaggaaattgtttggattgatttgctgtctgtgctttgagaatgacttttttcccctcctccttttttttaaagcaaactttgcgtaacttattgagcaaggtttccccttccttttctgccgaacttaaacaactaaatcaacagtatgaaaaattatttcataaatggatgctgcaattacagtaagtattatcattacaaacccttgtaaaataaagaataatatttacatgaatctttatgttaaagtaagttaacatttttctttttacagtgagtttcagatatttagtcatatataaaaataaatgtaaaaatagacattatgactcagatatagaaatgtcactttattgtatgactcttcccagaaattctacagtttttaagaaatttgtgtttatcagacttgacagccattgataagataaatagcatttcttagaattatgttattggtttaaaaaacttgaatatttcctttgtcaagattaataaatataacaattagaaaaaaaaattataaagttttccacagcatagttctttaaatgaaaggataatatttactttaatcttatgtatgtgtactacagactttcagaattttatgaacagatttgttctataagcattattttactattttaacattatttcctagaatattttttcactgttattattttcacacacctcagattaaattttaaatttccattaaaacacctagaagaatgattgaaatcaaaacataatactttctttttatgataattacttttatccttgcagttaaaaagacttgaacataaggaagtgcttaaaatgtacactaatgtgaatatacatgcacactcacagttacattgtcactgaggtaaataagaaggtagagccatggaccaggcacttggcctcccataatcccagtgctttgggaggccaaggcaggaggattgcttgagcccaggggtttgagagactctgtcttaaaaaaaaaaaaaaaaaaaagttatgctaggaagggaatgattaacttgcctgcaagaacctcagcttctctcaataactatttatggatctatgcattataaatttgtaagctcttcattctaatcccatccccagcccatcatttttttctcccagcgtgtcaacttagataacttaatttgctttgcttctcagattagaccttatagtcagcaagtttgttggaattgctagctctctgaattccttgcctctttatttctgctgctttgaccttggtaatctctacctttggaggttacctcttttctgttcttccatttctaggttatcctgcattgccagagagcatcacataaatactgtttctgcttgacctttgtaaacaatcacggagttggactttagcttgacctctagtgcttggtgttctgggtggtctcattcacccttctggcttcagttgttttctgtatatgaatgactcatgtaactgttaacctccaacccatacctcactctcagtagcagacctggatatctgaatgtatattagaagtttatacttgggtgtcctgtaaataattcaacatacataaaattaaactcatctgaaatccactgttcccacctgcccctgctatccagcagagtgaatgactgaatgttagtcactccatttgtgtagttgcctatggcagaaaactgagtcattcttttttttttttcttttctttttaagagacagtctcactctgtcacccagaatggtgtgaatacagctcaaggagccccaacctcctgggttcaagcaatcctcccacctcagcttcccaaatagctgggtccatagatgtgtgccaccatgcctgggctaattttttttattttttattgtgtagagatgaggtctcaccatcttgcctaggctggtctcaaacccctgggcacaagcaattctctgccttggcttccaaaactgctgggattacaggtgtgagccacagcgcccagccctgagtcattcttaagtattcttttcctcactctccacatctaatcagtctccaactcttactggtttgactttctataaagttcttgacattttaacatttttctccatgacagctaagttaatcttccacagttttgttccttcctgtccattccccaaatataatcaatgtgatctttctgaaaagaacatgttactttcctacttaaaacctttctgttaacccctcattagttacttttaaatgctcattcttggctgggcacggtggctcacgtctgtaattccagcactttgggaggccaaggtgggtggatcacctgaggtcaggagttccagaccagcctgaccaacatagtgaaatcctgtctctactaaaaatacaaagttagccgggcttagtggtgcatgcctgtaatcccagctacttgggagggtgaggcaggagaattgcttgaacgcgggaggcagtgagccaaaatcgcaccactgcactccagcctgggtgacagagcaggactccatctcaaaataaataaataaatgctcattctccttggaatgagtgaattaatggtttagtatgacttaacaaggcctttgttacttgacctcttttcaatttgtatcagtttcaactctgcttcagcctataaaagtttttaggactttttttttgttgtttttttttttgagacagagtcttgctctgttgcccaggctgaagtgcagtggtgcaatctcggctcactgcaagctctgcctcccgtgttcacgccattctcctgcctcagcctcctgagtagctgggactacaggtgcctgccaccacgcccagctaatttttttgtatttttagtagagacaggatttcaccgtgttagccaagatggtctcgatctcctgacctcgtgatccgcccgcctcggcctcccaaagtgctgggattacaggcgtgagccactgcgcctggcctttttagggcttttattggcaatggtctcccttgcctccagtcatctgtcatctgaaaagtaatagaagctacagtgaagctactgaacaaattagaactagaagcttggtatacagataataaaattgtgcctttaccttgtatgggtttggaataaatatttatttatttatttaagatggaatcttactctgttgcccaggctggaatgtagtgatgtgatctcagctctctgcaacctccacctcccaggttcaagcaattctcctgcctcagcctcccaagtagctgggattacaggcacctgccaccatgcccagccaatttttgtatttttagtagagacaggatttcaccatgttggccaggctggtctcgaattcctggcctcatgtgatccacctgcctcgacctcccaaagtgctgggattacaggcgtgagccatcatgcccggccaataataatttttaaaaagaatactttttttttttaggaaggaagaggaagaactgggatggctgaatcactaaacattgattcctggccttgcacggtggctcatgcctgtaatcccagcactttgagaggctaaggcaggcacatcacctgaggtcaagagttcaagaccaacatggtgaaaccccgtctctactaaaaatataaaaattagctgggcatggtggcgggcgcctgtaatccagctgctcaggaggctgaggcaggagaatcgcttgaacccgggaggcggaggttgcagtgagctatgatggtgccactacactccagcctgggcgacagagcgaaaaaaaaaattattattaattagttaatttttttttacagacactgtcttgctctgttgccctggttggagtgcagtggcgggatctcggctcactgcaagctccgccttccgtgttcacgccattctcctgcctcagcctcccaagtagctgggactacaggcacccgccactgcacccagctaattttttttttttttgtatttttagtagagatggggtttcactgtggtctcgatctcctgacctcgtgatccgcccacctcggcctcccaaagtgctgggattacaggcgtgagccaccgcacctgacctaattttttttttaaataaaaatatttttggctagacatggtggctcacacctgtagtcccagcaattttgggggccaaggtgggtggattacttgagcccagttgttcaagaccagcctgggcaacatggcaaaagctcatctctagtaaaaatataaaaattagccaggtatggtggtgcacagctgtagccccagcttcttgggagactgacgctgaagagttgcttgaacctgggaggctgaggttgcagtgagccaagagtgccactggactccagtctgggtgacagagtgactctgtctcaaaaaaaaaaagatacatatatatacatacatgaaaaacttttttgcgtttgccttcccaaaattcggggattacaggcttgagccagtgcgcctacccctttcctgtattttttataaactgaatttaaggaaactggttgataataaaattggcaataagaggtattgaagtttaatttcatgaatactgtctttcctaacagccttgggttcaacattgtgctttatggtttgggttctaagagagatttactagaaaggtttcgaaccactatgctgcaagattccattcacgttgtcatcaatggcttctttcctggaatcagtgtgaaatcagtaagtttcaaaaatgttaaagggaaaaacattatatcctctgccaattcaagcccccacataaatgaggatggagtattaaagaatttttgttttagccttcacggtagtaggattgtatagtgcttaataccatgtgtttggactcaagaatctagctttgaaaccatcttcgaatgtcctacattgtaactgacatgtattaaaacttaggaaaatgttagctttgtttactatactgagtatcagtggtacttctgaaggagggaattatggggtcttcagttttgttataaactatgaaaatgctttattaggcaaaaactacatgctgtgaaaatgctttaaaatgcaacaggatgtgatgtgaagactgtagtttaacaatacatttatcatagatcatttttatttcaaatgcttaatatctcttcatcatttgaacatgaaatcttttgggtgctggatattgagccatatagtattccttttttaaagtgtctgtagtgtttgtgtcctgtttcctttgatagaactgtagttttctaatgtttctcatgttcttgggagctttttcatttgtttttgctgccctcttatattacctattacctgtacatctttgctattcttttctgttttcttttagccacaacttaggcaaaaaacaatgaattagatatactcaagtaccagtagaatttttaaaagttattttttaaacttttgggaaatccaaattcatttttaatttataaaaaaaggtttgattttctagttgtatatgacaataaattgtaattaatgtggtacctcttccacattcatgatataggtcctgaattctataacagaagaagtcctcgatcatatgggtactttccgcagtatactggatcagctagactggatagtaaacaaatttaaagaaggtaacatgaagtagatgctcggtagttttagagtaaagttaagcatatacttctacttattcatgtatttatatacatacaatattattattattatttttgagacagtctctctgttgcccagcctggagtgcagtggtgcgatcatggctcactgcagccttgaccttctgggctcaagcaattctcccacttcagcctcccaggtagctcagatcacaggcgtgtgccattatgcctggctaattttttattatttgtagagatgaggtctcgctatgttgcccaggatagtcttgaacttctgggctcaagcagtcctcctgccttggcctcccaaagggctgagattataggtgtgagccaccacacctggcccaaaaagattattttaataatggcatttatcttggtgctctaaaaaagtttgtcctttttctatgaactttttccgtgaacttaacaggaaagaaaaatgttagtcccactttcttaagtttgtatatccaaaagcctgtttctgtttataaaacactccaaaagtgcagtggcacgattttggctcactgcaacctccgcctcccgggttcaagcaattctcctgcctcagcctctcaagtagctgggattacaggcgtgcaccaccaagcccagcgaatttatttcagaataattttcaggttttgttttgcttgtgtaaagtgcctccacttgagtggtacaagtttgtctgatatttttatattgtttaatgtttttataaaacattatttcttggctgggcgcagtggctgacgcctgtaatcccagcactttgggaggccgagctcagtgggtcacctgaggtcaggagttcgagaccagcctggccaatatggtgaaaccccatctctacaaaaatacaaaaaaattagccaggcgtggtggcacatgcctgtagtcccagctacttgggagggtgaggcaggagaattgcttgagcccgggaggcagagattgcagtgagccaagatcataccactgcactccaccctgggtgatagagtgagactctatctaaaaataaataaataaataaaacattatttctttattctgtgtacatatcattacattgagataattttatatactaagatctcttgattcttttggtgtgaatgttttggttatgtgagtatgtcagaaaattggaaatagtattatatagtctctaacagttaattgccatttagtaatgactaaattaagaattaagagaagtaattgagaatgcctaactgctttgatggataatttttttgataatgacaataatcttagctctgttccgtagtacttttatcttgtcaatattctagcatgttctttagttttgtcttcattttgtttccaacctgaaaagctttctgtcccaaatttcctttcacactcctacacccattttatccacagttctttatagaaatggaccgtatactttttttttttaacacagtcttgctctctcacccaggctggagtccagtggcacaaacacagctcactacatcctaaatctcctgggcccaagtgatccacccaactcagcctccccattagctgggactacaggcacatatcacctgcctggctattgttaaaattttttgtagagatggagtctcactgtgttgcccaggctggtctcaaactcctaggcctcaagggatactcctgcctgggccttccaaagtgctgggattacaggcatgagcccagccagacaatatacatttttataccaactctacacatttgaaaacaggtagagttgattctcattattcacaaattctataatagcaaatttacctgcttgctaacatttatttataatcccaaaatcaatattcttggtacttttgcaaagtgaaacatggcacagagtggcaaaaagtttgcattgcccaatgtacatattctaagccgaggtcaaacaaggcaatgctttgccttcttgtttcaactctcatactataaacaagcatcgttttcacagtctgttcagtgctacgtttttcacatttttctgcttttttgttggtgatttggctgtttaaaatggcccgcaagcatagtgttaaaatgctatctagtgttcccaagcacaagaaggctgtgatgtgccttggggaaaaaatacctgtgtatataaacttccttcagttatgagttacagtgttcttgactgtgagttccgtgttaatagaccaacagtgtatattaaaaataaagttgcccttaagccggatgcggtggctcacacctgcaatcccttcactttgggaggccgaggcaggtggatcacttgaggttaggagtttgagaccagcctgggcaacatggtgaaaccctgtctcgacaaaaaatacaaaaaactagccggtcctggtggtgcgcacctgtaatcccagctagtcgggaggctgagacaggagaatcgcttgaacctgggagttggaggttgcagtgagccaagatcacatcactgcactccagcctgggcaacagagcgagactccgtctccaaaaagagtaaataaataaaaataaaattgcctttaaacagaaacacacataaaacaaagttatatattgaacctaaccctgtatttcctctgggaacagtggttcagtattcaataattcaggatttgcagcagcatagaacttaatgtaatgagagtcaagtatatatttcccagaaccctaaaactactgcatatgtgaacatatcttattcattgattatgtgggcatatagtgaattactagcaggttattgtaagagaaacaaatctgtttggtttgttttcagttctttcaaccttattatttaattaaaaatcaattgctgcaatatttattcctataataattttgccttgtttttctgaattgtctttagttttcaacataagttctcctacttaaagaataacagaagcattgctttttattcccttaccacagatccttgtaagagcccagtattgttcgtatgctcattaaaatagatgcctaagtcactttatatttgtgtgcgtctgtgtgtatacatacgtttggttttgggtgtttttggttttgatactgttaaatatgatgacgtctagatttcagggaacctgggattttcacaatgtgtcatctcagaatctttgtcactgtattgtctctcttacccatctacccccgagtagaagagaaattaactcactctctgaaagacttatactctatcacgtatgccaagtctccagagagacttatcaatacctgtggcttttaaatatacattaaaaataaaagttacctgattctgctgccctttcacactattttatttttctgtttcatacggtttcagtattttggaagacatgtcctgccttcaattttttttttttttttttttacctatttcattctaatgtctttcctctgtgctatcagaactgtatgcttgatcacctgtaactttcttcttaccaagcccagtgaccttggctcatcctttatcttgatctctgctgtatttgatagtgtcaacagctccatcctctaaattcctccttcactgacttttataatttatctgaacttcctgatgccttgagcagtatcctaacccccaccccccacccactccttttttggtctcctttggcttttgtgataatccgggttttctatataatctctgagagcattatatataatgctttctgagaaatcctttggtttttttggtatccctccactcccacagtgtaataaaacatgcacagattcacctccaatctattgtatacatcttgcctatttcccatgccttattaaagctgctttctttaggctgagcacggcggctcacacatgtaatcccaccactttgggaggccgaggcgggcagatcacttgagctcacgagttctagaccagcctgggcaacatggtgaaaccccatctctacaaaaaatataaaaatcagctaggtgtggtggtacacgcctatagtcccagctactcgggaggctgaagtggaaggatggcttgagccctggatgtcagggttgcagtgagctgagatcaccccactgcactctagcctggacaacagagccagaacttgtcttaaaaaacaaaacaaaacaaaaagctgctttctgtagggcctgacttcagtgctaatcatgtctattttatgagtaaatgacatatcttctcaaataaattacatacccctaagcaatcattattttatcctatactactttattttttaatacctaggcattgtgtatggtagaggaaataatcactgaaatatcactaaaaataataattgcagctggacatggtggttcacgtctgtgatcctagcactttgggaggccaagttgagtccaggagttcaagaccaacctgggcaacttagtgagaccccgtctctaccaaaaaaacaattagccaggcatggtggtgtgcgcctagttccaggtaatcgagaggctgaggtgggaggattgcttgagtccaggagttggaggctgcagtgagctatgattgtaccactgcactctagcctaggcaacagagtgagaccctctaaaaataataataataataattggatttcttttctttttagattcttctttagaactcttccttctcatccacaatttggatagccagatgttgagaggagagaagagccagcaaatcattggtcagttgtcatctttgcataacatttaccttatagcatccattgaccacctcaatgctcctctcagtaagttaattgttactatttttccttctagagatatcagtcttacaagacaaattctattaatataaatcagaaaatttttactgtttttagtacgctttttccccttttacatgtttaaaaacacaggttgccaaaaagatgttctcaatctaatttagaacataatttttggaaataaaaattcagatactaaatgaggatgttttagtctaaagttaaatggagggaaaagacccaactattattttggtctctttctcttcttgtaatatcgcaacatttattttatgaacttaatttatagactttctgataatcctgtagaagaaaatgttaaaacattactaattttttaaaaagaatgcattggtagtgctaagattttaatttatgcttaattgaaaataaaggttcagatgttggttgaaaatgaaattagattgtgagttactgatttagatatggaagtggcaaaaatgaaaaacttggggattcatttttatttaatcctttctcattcttttgtaaagtggaatctagtaacatgacaatataaaaataatttgtaattcttgttttctttgatcatgtgctagtgtgggatcatgcaaagcagagtctttttaactggctctggtatgaaactactacatacagtccttatactgaagaaacctcctatgagaactctcttctggtaaagcagtctggatccctgccacttagctcccttactcatgtcttacgaagccttacccctaatgcaaggtaaggatgaaaaccatatttcttttttaaaaactatacattttaagatatgtactactaggttttaatggggatactgaagtccctagttagttgaaggattaagtgaaattatagtaataatagttaccagtactggattatggagtaggcagacaagtcaacagtagtctatcaaattgcccagtaataaagcgagaataccaactttttatttctttgatatttctgaatatgagcacctgactggtcataatggagaaaaagcagacttttcatgacttttacttaaattttatggttatttttcattacatattgaacattctgatccaaacagtgagtactttatatgcattacttcatttgatcctaactaaggtggatagtcagtggcacaaagactttgatccagatatgccagctccaaaactcatgctcttaaacatcactgtataatgtctccagtcaagcccttacagcagcctaacctagaggcatatctgaattaataaatgcaagctggttatagcataagccagcaaaaaataaattgcataattagccggacgcagtggcctacacctgtaataccagcactttgggaggccaaggcaggtgggtcacttgaggtcaggagttcgagaccagcctggccgacatggggaaaccccatctctaccaaaaatacaaaaattagccaggtgtggtggcacgcacctgtagtctcagctactcaagaggctgaggccggagaattgcttgaacccaggaggcagaggttgcagtgagctgagattgcaccactgcactccagcctgcgtgacagagcaatctctgtctcaaaaaaataataaagaaattgcataattagcctgttgaaagaagcttttagtaacaaactttaccccctgacaaaagcataaaattatagaattatatttaacaagatgaagtgttgaaaaataacaaaccttgctgagaatagataattaagagctggatagatgaaaagaaatattgtgttcttgggtgggtagattaaatattataagagtagcaattctttccaagttagaaatgtgttagacttgccaggcacagtggctcaagcctgtaatcccaacactatgcgaagctaaggcaggaggattgctccagctgggaccttgagaccagcctgggcaacatagggagactacatctctacaaaaaattttaaaaattaattgagtgtggtggtgtacacccatagtctcagctgaggaggctgaagggagccgagattgcgccactgcactccagcctgggtgatagagcaagaccctgtctccagaaaaacaggtattagatctataaattagtcaaaatgtaaatgaatttttttgttttaaatttgaaagaaaatttagtttcctaaagaataaacagtcagctgggtgtggtagctcacacctgtaatcccagcactttgggaggccgaagcgggtggatcacttgaagtcaggagttcgagactatcctggtcaacatgctgaaaccctgtctctactaaaaacacaaaaattagccggacttggtggcacacacctgtaatcccagctacttgggaggctgaagtgggagaatcgcttgaacccaggaggcggaggttgcagtaagccaagatcacgccactgcactccagcctgggtgacagagtgagcctctgtctcaaaaaaaaaaaaagaaagaagaaaaaagaaaaaaagagggaacaagcaagtctagcagagacaatttcttttttgtttttaaagagcaatgaagggacacttgtggtcaagatggcataatacttctcactctttcctttcatcccctcttgttccaaacacacagcataatagacagaatttaaaaataaataccctggctcaaaatacaaacatctcaatgcaacagaatgataaatcagtgagcagagttgaagccacagcacagctgcattcttggtttagaagcagcattggcagccaggatattgacttatatgggatgatagtagtgtgacgatatatattgtccaaaccagatattttcgtttaggacaaatgctgaactgaacagatgtttgttgtagaaataaaaccatataaaatatatagcattcaaatgtatatatcagtatgaataaaagtttaaaatgtgcatggaattaggtctttttaggtactaaaaataataaaaaaaaattaggtaccaaccctggagaagaataaaggggaatagatagaggagagtgtacacagggactttggggatatcttttttttttttaaccccccctagcaatttattttccatttatttttcttttacctgtgtgtttgtggtggagggattaactttttgttgtgagatgattatagattcagaagaagctacaaaaatacatgcagggaagtctcatgtaccctcctcccaaagcaccaacttccaccaaccaccaccatctcatataaacacagtacagtatcagaaccaagaaattgacattgttataatcccatccatatttggatttcactattatacatgctgcactcgtgtgtgtaagttctgtgcagttttgtcacttgtagccttgtatgactgccacctccatgtatacactcagctgtaccatcaccacaagactcaaatgttaaccctcaaatgctaattttaatgaatgttgttactctgtaaagctgatttgaacactgaagatgagattagcattcaactcggccaggcatagtggctcacccctataattctactactttgggagcctgaggagggaagattgcatgaggccaggagtttgagacgaacctgggcaacgtagaccccatctctacaaaaagtaaaaataaagccttgcattaatattggaatatgcaggctgggcgcggtggctcatgcttgtaatctcagcactttgagaggctgaagcaggcagatcgtttgaggtcaggagttcgagaccagcctggccaacatggtgaaaccgcatctctactaaaaattaaaaaatcagctgggcatggtggtgcatgcctgtaatcccaactacttgggaggctgaggagggagaatcgcttgaacccaggaggtaaaggttgcattgagctaagatcacaccactgcactccagcctgtgcaacagagtgagactctgtctcaaaaaaaaaaaaaaaaaaaggtggggcacagtggctcacacctgtaatcccagcactttgtgaggccaaggcgggcagatcacgaggtcaggagatcaagaccatcctggctaacatggtgaaatcccatctctactaaaaaattagccgggcgtggtggcgggcacctgaggtcccagctgctcaggaggcagaggcaggagaatggcgtgaacccaggaggcggagcttgcagtgagccgagatcgcaccactgcactccagcctgggcgacagagcgagactccgtctcaaataaaataaaataaaataaaaaaattgaaataggcattaaatggttatctaatgaaattttttgatggaattggggacaaagtcttcattctgttttgttattactaataataaaagtccttaactgctgaaggactgttggaagttgctgtgtgtaaagttgagggtccatgcagtgtgagaactcaaaacgttaaatatggcactggctacgctgatgcaagttttttttttgagatggagactcatggtgtcgccaaggctggagtgcagtggcaagatctcggctcactgcaacctccctctctggggtttaaggaattttcatgcctcagcatcccacaagtagcggggactagaggcatgcaccaccacacctggctaatttttgtatttttagtagagatggagtttcaccatgttgggcaggctggtcttgaactcttgacctcaagtgatccacccaccttgacctcccaaagtgctgggattacaggcatgagccaccatgcccagtctaatgcaagtattttttagtttggcatgcctaaatgtctgtgtgctagcctcagcattttcttatttaaactattttgaaattttgcttgattctgcaaactccagtatcatttagactttacttggtatgtgattgaataaaaattttaaccaaaattcagctctggagttagtagtagtacctagttaaaaagtagtcattgagggccggatgcggtggctcactcctataatcctagcactttgggaggctgaagtgggcggatcacttgacgccaggagttcaggaccagcctggccaacatggtaaaacgttgtgtctactaaaaatataaaaaattagctgggcgtggtggtgtccacctgtaatcgcaactactcaggagtctgaggcatgaaaatcgcttgaacctgggaggccaaggttgcagtgagccaagatcgcaccactgcactccaacctgggcaacagcgagattctgtctcaaaaaaaaaaaagtgttcattgagatgatccaaaatatgattatagtaattgttttctggacctgcataacaatgaaaattcatataagttttgaatttttggcatacccaaggactgatgggagtcttagtttgtgtaatactgcttctaaccccataattctacttggttcactcttccatggaataattcaaaatacaaagaaatacgtacagttttatttagtgctgagttattttttctgtatccagtcatccattaagagttatttttaatctaaacttagaaataatgtaaacatccaaaccaatagggaaatggtaagtttatggtacatggtagataagcagttgttaaaacttccttaagttcttcttacatgtggcaaaaaaaaagaaaagaaaaacttgtttaggagaagttttaaagacatgggaaaaatcaggccgaggcgggtggatcacctgaggtcgggagttcaagaccagcctgaccaacatggcgaaaccccgtctctactaaaaatacaaaattagctggggtggtggcacatgcctataatcccagctactcggaggctgaggcaggagaatcgcttgaacccgggagacagaggttgcggtgagccaagatcgcgccattgcactccagcctgggcaacaagagcgaaactctgtctcaaaaaaaaaaaaaaaaaaaaaaaaaaaaagacgtgggaagaatcaaaaagtgaagaagcaaggtataaagtggtatatgcagtatataaatgtgtgaatttctgttatttccacccgcctcattgcacaaagatttgagataacagcatacccagtatgatctcaacaccaagtgttaatggatatgggattgatatttttctctttagatgttattctgtattccagcttttctaccaacactaacctaaaaagtaagaaaaaaatactttcatattttatttttttgagacagggtgtctgtcactcaagtacagcctcaagctcccaggctcaagtgatctttgcacctcagcctcccgagtagctgagaccataggcgcataccagtatgcctggctaattttttaattttttatagagacagagtctcactatattgcccagggtggtctcaaactcctgggctcaagcagtcctcccacctcagtctcccaaaggggtgagattataggtgtgaggcaccacactcagcctatatttttctttagaagaaataaaaaagcgggccgggtacagtggctcacgcctgtaatcccagcactttgggaggccgaggcgggcggatcacgagatcaggagatcgagaccatcctggctaacacggtgaaaccccatctctactaaaaatacaaaaaatttagccaggcatggtggtgggcacctgtagtcccagctacttgggaggctgaggcaggagaatggcgtgaacccgggaggcagagcttgcagtgagccaagatcatgccactgcattccagcctgggcaacagagcaagactccgtctcaaaaaaaaaaaaaaaaaagaaattagaaagctttctgtttaagtaggcaaggatatgatattccttggaggaacagaagataatgcggataggccaactacttgacattttctttgtgtattttactattagttgttaccttttgatgttaacatttttggatttaaattcctgtttttttttttttttaggggaattttcaggctactaataaaataccagctggacaaccaggataacccttcttacattggtatccaatatttatgacattcaattgtgtaatttttgttttaccctgtacatttcctgtctctggaatttaatgacagcagtgcagtttttcacagcagtgagtaagtggtcactcatgatgggtatgtctgccacatagcaaattttcaagcagctctacagatccactgctgagcaaggtgtttgccaacacaaattgaaagacaaacccagcttacttttaaaattttctgtgctaactatggatgtgtatctgccaagtacatatttttcatattctaggcatcttaggagattttcttcccctttggcaaaaatgatttcaacaaacattttaataattgttctgctctcatgacttacttgttccttctttaaaagtcctatcaatacttgttcactgctctgggataacatgcaaatagcacttttattctgttcttttgtatgggtgtttgtatattgggtcatgtcttaagtgctgacttatgttcatatccttttgaacttgccaggcctttcttttcaagatttttaccagcagtgtcgggaggcattcctcgtcaatagtgatctgacactccgggcccagttaactgaatttagggaccacaagcttataagaacaaagaaggtaagactccactattgtagcattgtatgccaggaatagtccgtatcatttacttaaggacacatatatgtttgacttagacctgattttgaaactgatgttccctgttgagtcacagagattcatttaggggatgtgccatttgagtttgtagaaagagccatggtagaagtaccctgcttcagagcagagcagaaaactcacatgttctagtccagagtaataggcaattagaaacatggtgagtcaaataattctgttcttttgttttttccctcttgctcattcattaatttggtctgtatttattgagtactaactacatagatattgcactaagtattaggatacagtagtaagcaaaaatctgattgcttttcttatggagcttaaagtctaatgggggagatggacattagtcaagtaatcgcacacataacattttaactgtaaggaagtcctatgattagaaggtacatagttctgaaagagtttatttaaataggtggatttgacctaattatggatagatatcagaagagaccactgagctgagatctaaaggaagactaggaggccaggcgtggtggctcacgcctgtgatcccagcactttgggaggccgaggtgggtagatcatttgagcccaggagttcgagaccagcctggcaacacaggagaccctgtctatgaaagaaaaaaaaaaaagagctggttgtggtggcacgcagctgtacctgtagtcccagctgcccaggaggctgaggtgggaggatcacttgagcctgggaggtgaaggctgcagtaagccatgatcgtgccaccacactccagcctgggcaacagagtgaaaccctatttcaaaaagaacaaaacacacacactgaaagagtgacattttagggagacagatgatgagttcatgatcttaatcagtttagacaactctgtttgaggttcctttgagatttccaaatggaaatgtcaactatgcagttggatacctaggacaagaaaccagaggaaagatatgggttggagagagaagattatgattcttatatatttagattataactgaaaccaggcattggggtactacctaaagggaggacgtttagtgagaatagagagctaggagataaggccagaaatgtgacatttaacaaaagtaaaggataagcctgcagaggtgagagaaacagccagagaactaggaagaaaaccaggatgtgatgtcacagaagccaagagaagcatgttttaatgcagagaaaatagtcagcagtgtcagatgctgctgagaggccaaaaagattaagactgaaaatatctgtgagatttaggaatataaaattcctgatggtctaagcaaacgatgtgataatgggaacagtagctcagttaaactgtgctgaatgagaagtgtggaaatggagactgccatcatagccaacttgcttggagaagtgcagagataatgtgatagatggagaggaatgaaggtgtgtagtgagggttactgaaaaattggacacacttgaatgtattaaatatttaaaagccaacagggaaggttcttgttgaaaggaggaagaaaggacacagacatcaatagtgttagattctaaacagggcaggaaggtgaagaatgatctaaagcacaatgaaaaaaataaatacccacctacccaccctctagttagttgtcttttccactataaggatgtttaactataactccatatatttaagtatatatgactgtgtgcccttttgcctttttatacttatatatttaaaaattacatccaagaaataaattcattttttctttagcctctacaatagaagagttcatatacctcttatgaatgactaacgtacaggtattcttaaatctttcagggaactgatggagtagagtatttattaattcctgttgataatggaacattgactgatttcttggaaaaggaagaagaggaggcttgaagctttcctttattcttgaatctcccatggaagggttgtaccccagctgccactcctctagttgaaagtgttgtgtttacatctgacattaaattatttttccagcatacaagatttaaatttgggaagggggggatgtcctcaattagaactttttgatcagcctggctggtaccgtctagtactatgcagcggtcctcaagttggagaaaatgtgcctttcattcattacctctctggagacttcttgctggaatgaacagtgtgctcagggactatttggaactggatgtttttgaattattttatacttagagatattctgaattttttgagggccttttaacactccccgagctgattgtttgcaagtgtgtttgttccagagtgtggaagtataaagacatgggcatcacgtaaattggttttgtttgctattctgtgtgtcagaaccaacgagtgtaatggagagggcaggtcatctcttattgtttctaaaacaacttaaaaggtgtagattgggaagaggtgagtgatccagctttctccttttggattgaggctatgtacttggtgggggcaggggagggaatatattataatactattcagttgggataatgggaaaaacagagtatatagggtatctacccagcctagaaagcacaggaacaatacgtcatatatttggaacagttattgtctgtgccatgaccttcatgataccagtgagaagccaggctagagaaataaaatcctgaattacattttagtaattgttttcaagacaacaaaaaataaaacatttcattattcttgtatattgacatatttttcttttcttgaacaacatgcaggtgagtagcatattaatggctggctgtaaattaattttgattcctctgtcaagtagacctaaaactcactgtaagatatttcagttttttccttaaagtgatgatttcaaacctcctgaatatttgcgcgagacttttttcttaggaaagaaaaaaggctcaccttggctactgttgtcagcttacagtcatcacataccccctgaaatatttgacacttggaaatgaagttcttcctgaaaatatcactgcaataaaatacgtactacgtcagcatttctcactcatttcttatcttgtaaacctctttcatgaaaatatttccaaaaatccttggaatttttaaataatttttcttgtggcatataattaagtaattttggccaggcataatggcttatgcctgtaatcacaacactttgggaggccaaggcaggaggatctctggagcccaggagtttaagaacagcctgggcaacatagtgagaccttgtctctacaaaaaatttaaaaaatcatccgggcatggtggcccatgcctatagtcctagctgctgtggaggctgaggcaggaggatcgcttgagcccaggggttcaagattacagtgagctatgattgtgccactgcacttcagtctgggtgcagagcaagaccttgtctttttttttttttaaatcatttttttaaaaagtaattttatgttaagtccatgggcttagtctttttttttttttttttttttttagatggaattgcactgtcatccagtctagagtgcagtggcgtgatctaagcttacagcagcctccacctcctgggttcaagtgattcttgtgcctcagcctcctgagctgggactacaggcacacgccaccacgcctggctagtttttgaatttttagcagagatggggtttcaccatgttggccaggctggtctcgaattcctgacctcaagtgatcctgcctcggcctcccaaagtactgggatcaggggtgagccactatgcctggccaagggcttagtcttaaatataacctctagtcaaaatgtttaaacaaatttgtacataaatgtgatttaaaaaaatttttttaatagtaccaaaggatattcagtgaaagtgagtttcctgcccactccctgatccacccagttctttaggcaaccactgatagcattttcttaagtattcttccagatatcgtctatgcatatgtaaaagtatctgtctttctccttttaaaaacacaattggtaatatatcatacttgctggtttgcaccttgctttttttgcttaatatatctagtttataatgacctaatgtgcaaatttttgcatctgccctaaatatctactggtttatttttataatttttgtgtctatactatttgcaagcagtatgtgtcagtagactttattattaataaataaaaagccaatttggatagaatcactttataaattggtagtgctggttttttactaaaaatatttttaagttcttcaaaagaagttttatgagtgcatcttacagatctggtgaagatcttggcacattattgtatgctgtttgttgacttgtgtccgcatcggtgtccctgaggctctagcaattatgtcttgactgataaggctctaatttcttctactgtgttaacttgcttctggcaagattgaacagatctactgaaaccttgaaaggttttctgggtactcttaataaaattgcaaaaaaaaaaaaaaaaaaaggcacaggagatgtcaaacatttattgtttataaatttgccacagtgctgaatttattgtgcaaggactgctaaattagttctcacagtagtccagaaactggactttcttagcattgtttgttattttaatacatgatcacttcactcatataaaagatcagtggaggccgggcgtggtggctcacgcctgtaatcccagcactttgggaggccgaggcaggcggatcacgaggtcaggagatcgagaccatcctggctaaaacggtgaaaccccgtctctactaaaaatacaaaaaattagccgggcgtggtcgcgggcgcctgtagtcccagctacttgagagggtgaggcaggagaatggcgtgaacccaggagacggagcttgcagtgagccgagatcac

SEQ ID NO: 17278 - DNA, 61777 bp, Human
  misc_feature (1)...(61777): n = A,T,C or G
gagtgcagtggcatgatctgggctcactgcaatctctgcctcccaggttcaagcgatcctcctgcctcagcctcccgagtagctgggattacaggtgcgcaccaccatgcccagctaatttttgcatttttagtagagacggggtttcgccaagttggccaagctggtctggaattcctgacctcaggtgattcacctgcctcggcctcccaaagtactgggattacaggtgtgagccaccactcccagacttatctctgccattctcgctctttctccccctaccccaagctctaaagtaactttctaaaaggtttttgtcccataagcctttctccctaaatatgacatgaagagtatgcctctacctatatcttgggttttgaaaaaagcctaaaaatacatttgcaatagaacttattggaaaaaacatgaggctttgcatgagatagagtcaggtttgaatcctggtttcaaggcctgaactaattactgaatccttctgcgccttggattcctcatctgtaaaatgggaataatcaagcctgcctcagaggatgtattagtttgctagggctaccataacaaagaaccacacactgggtggcctcaacaacggagaatgattttctggagatgctgggggctgcatatctgatatcaatgtgatactcaacatacacataccgtccagcacgtaggtgatgctcaacacacacacactacctggtgtgtaggtgacactcaacacacacagactgcccggtgtgtaggtgatactcaagacacacagactgcccagtgcataggtgatgctcagtgtttctacatgtgccacttaactgtttctttcagtgggaatttgtgtcagccttccgacaagcccagcgacaggagaatgcgctagcgatagtcaattcaggaatgagagtcttttttggagaaggggatggcattattagagagttatgcatctcatatggaggcgttggtccagccaccatctgtgccaagaattcctgccagaaactcattggaaggtaaggcattagaagtaagggctcctctaatacttgtccttagactccaagtattagaggagccctttttgtggtgagatgtgattacaagaagaaaagtgttccatacctttctatttaatggctgggaattccaataagattttgttattatttccatatgtcttgatgttagtgaattctgaagtgggaattatatactctgtgtgcgtgtgtgtgtgtgtgtgtgtgtgtgtgtgtggagagagagagagagagagacagacagacagagaagccctccctcaacagtgcaaatttgtattctttattttgggagaataatttgccatgatgaaaaaccaattatgtgagtttgttctataataaattgttaaaggcatttgcttacctgacttcctatatctaaagatgacactaatagctaatatttcttgagcattacttggtatcagctgccataacaaagcatagtgattaaaagcatgagctttaaaacttgagaaaggcagactggccaaaatctcagtttaccctctgttaactcctccatgctctcagtcagcttacttaattatattggtactttggttccctagctgtcaaagatgggtgatcatacctacctcacagggcagttgagaggattaaatgagtgaatacatataaggtgctaaaagcagatcttggcatgcaataaatgtcctagtgaggacatttattagtgagtaaatgagggtcagttactcctggactatggattttatatgagttgtcacttatttctctagatcattctgtgagttgggttctaatattccccttttacaggtgaggacatggcgagacccaggctagccaccttgagaatggtgggccaatttgaactcgggctgcctgatccagagcttgtactcttatttcctgtattaaactatggctatttgtcttacccattagatgaagatatggggtaataaaccctgtcaggctaggagtcttctctttggactttccaggcactggaacgaacagatgctggatatagcctgcaggcttattctgaatgaagtctcccttttgggctcggcgccaggtgggaaagtggagttcaagaggactctcatcatcagcttcctcttcaagttctacctggaagtgtcacagattttgaaaaagatggtaaacaactgtttacacattaacttccccagtactgggagctatgatgacaccaaaagtagaggcaatgactccctaccaaatagctgtagaataaaaaagacaatccacattagaaacacacgtacttgctgaacatccctcagcctgtctgtgggtgggtatgagtttagggaagaattgaaagtagagccaagagttgatcaggcttttatttaacaccactcaattatttggtttctgactgttagtttttccagatcatgttcagaaaacttgctaatgatttgggtatgttttccctctgtatgtcatttctttctcttgagctattaccttcacgttgaggttgacttcatgtgtttggtgttcttttccagattcagcttcatttccctagcccgtaaggtggccatgatggcagccactgcacaagatgactgtgaaatgcgtcattgtaggaaaagggcttcatatggtccctagtgcttcagaggaaatctgtagtagtagtcataataatagtagtgacaatccatgcattcttttgcctggtctctcttagggcaaacaattaaagctacaagattcttggctggggaggacacaactaaaaaaaattctctgaataaatccattagacccaaaggagacttgagcctcattggcctcacaaaccccatgctataaccagctgaccaaaacagactggaagccaagaacagtcttcctgtggtatagaagttagtatggtcactttaaataggagacacaaagtcctctcttatccttgcttttgagggtatcttctcagtgtaggtgggagcaactaggaaccagaagggtagtatcacattattaagaatgaaaatttgaaatcatagataagtgacatattgtcaccaggtaaccaattatagactcctccaattagtagcaaactaatataatttctgggtgactcaagcgatgtaatttaaaacttttgccttgtagtcttatacccctcctctctttaaaaataatagcttttgttggttttatttaattttttttttgagacagggtctctgtcacccatgctggaatacagtggtgtgatatcatagctcagtgcagcctcaacttcctggactcaagcaattctcccacctcagcctcccaaatagctgagaccacaggcatgcaccaccatgcccagctaatttctttatttttttggagagacagagtcttaccatgttgctcaagctggtcttgaactcctggactcaagcaatcctgctgccttggcttcccaaaatgctggaattacaggcatgagccatgacacctagctggttttattttctattaaaattatgtaaattagaaaaaataaccaccatgtgtattgttgaaagcctttccccccatccggctctaggctgtgcaatgttcagtcttgtgtaaagaaccaaatgactcacttccctcagtcctgaggaatgttcttgctggggaccagaatccttcccctgtagggcagcgacagggatgcagcctgtgtccccctttctacacagctggcaggcaacatggaacctttatgcttatttgcaatggtgtactttgactctgatgttttcctggcttaagtattttcttcctttctattttatttacttagcttctatcttcttgttggatcagtttgtaagtcctcatatcatttaggagagtatatgagagaatcataagaaacatagagctggtggaagccagttacctaccgtattcatctggctattcataatatgaggaaatatgtatgcacctttcagagtatatgtccttgagtcagggagctgcttgtatttctggggttctgaatagggtgagtgcttaatatacgtgagacttcagagtagagatgcttgctaagactcatgctagcctcacttccaaaatcattctggtgcattcaaactatttaaaatatctgcaatggttctacttttcaggatccagttcactatcctagccttgcagacaagtatgaaagtgctttagaagatcttcattccaaacatcactgcagtacattaaagtaccaggtgagcggtatttcttgtttttaaaaattcacaatctgggctatagtgatttgacctggacattcccactgtctctccgtgaaactcaagctctgtaagtccaagctccacttctggtaaactcacagcctctttatgggtaactaaaattccaaaatcaatgaagaatttgattaaagacaaatctagcagtggtaatattaaagaagaatgttgatttgggtcttaaaggttacgtgctttgcactgtggccttgtaccacagacacgcatgagatggccaccttgtcacgtgttttctgccctgggcactgcaggcatcagagtccaataaagccacgctctgcggcaaggccatgggctgctttgctttcattttcagaggaaaagacacagcccctagaggttgatgaaaattcaataatgcttttaaaaagaactgctgatttgtttagcttgaatgttaagatattttactcccttagtctctattcttctagtgatttttctgtgagttacattttagagttgaatcaaacgtaagtactaagagctttttgtgctctcgtaatgaaggctattagaaaacaggattcctaactctcaaatggaattttctgccacatcataaaaatatgcctgaagtcaccctgttggtaaagtggatacagtttggtgggtttttccttgaaattattatcaggaaacttgacctcgagagttttagtaagtcaagaacatgaaaaggctttttaaagcatttgttcactgaaactattgttggatttggttgtgaaagcttatagtatgtcgtaatgaacattgacgttggtgtgtattccttgaggttttaggttcaatatgtttaaaaattaaaatgcaccaaactccattgaaaatgattgttttgaaagttaaaaacagctgccatctccccggtgttcttttcaaatatgatagttgaaccctttggcttataaataccctaatatttcttagacaatggaataaacttcagaaagaaacaacaacaaattaatggatattgaaatcatccaaagaaaaaggaaaatcttcacatagtgcatgatcttgaatgagagtttatcattgattgcaaaacaaagttttagatgcaatatgtctgccacatagatgagttttgtttttgttttgcccgtggtttttcacacacacatacaaacatccacattgctagagcaacgtcagcactcacgaagagcatttttcccctaaatcagttcatttgctttgaaaatattttgacacagcttcaaaagatcaccagtttgaggagacagcattcttccttccatagtatctttagccaaatactaagcagaagcaggtaattgaggacagcttctttcaccagtagatttatcacaactaactgcaaaaaaaaaaaaaaaaaaaaaaaaatgtatgatatctttgacggtaggacaaagacattttttggaatttttcctcagttttttggcaggcctcacacaacatggtttcaaaagactttttttcaatgtgatgaagtgttttgtttgttacagtgaaatgtgttatgtcagttaactcccagacccattacagatacctatgaatgtctttccttaatgtctgagcttatgaattatctggaattttgcttttcaggatgaaaaaacttcttagggttttaaaaagaagatgtgggtgattttttttcactcaaatgtggttcaggttgagagcccaagcagcatcacagctcagcactttgggggatattttgcagaggaagtcaattcctaccatctgcaacatatgaaaaaccacacctggtagaacctcattgttggtttttccttttcatcactatctcagctcctcgaagcagagggggaagaggagaactgaggggattcctttgccatggggacagggcagtgtgagctacgtcaatagagctggagtgttgggactgtctccaatctgtgctcatgcctgaaccccaataagtaaacttttctctcattttccctagtcccctacattcgtggcctaatatctacctttatttaatggagccctgggccaaggtctaaattatttttctcgatagtctcctgctttctagctgataaagtcaggatgactcaacaataactgaaaatgaaaaaacaaaaacttagtcaatactccgttttttgttcactgtattatactaactacaaaactgaagtttacatttaagtaaaagaaatatgaaattagaacaataaatgcttatcaacagtgtttattttgcagcaaaacagtaaattttatataaaataggaataaatgcatcctacacacatgtcttataccaagttaattgtagaaattacactactttctgtgcatagttgtcagccacaatttggttgacattttacttcttgtcatttatgttatgaaaataatatggtttttttattttcaaatcaatgttgaacatgttctgaaataacacatgccactctgccgttctctcctgatattccagccctgccacctgcctggagaatctctgatctctatctccagccagaggttttttgtttttttgaggcccttaagtagttgggtagtgagtggggagcactcttctcgagttcctggagcagcagagggcactggagaactgtacatttcacagctgtcttaagtaaagctctcattataaccagaggtctcctccatttgtgggattagatgaattaaatccaaatgttcagaaaggaaagcaaaacatctgcatgaaaaggaaatgtgttaatcggggggatccagacagcttgtcttcagttccatagagcaagagccttggagcactttcactggaccagggcggactttgaaacaggaaaccctgcagtgaagagtgagatgaaataccattttagatggattcaagtatctaacttattgttcatatgtgctgaataggctttctcaaactgcacattctggtaatcaaatacaaaagaatttagcttttctccccgctcagatgccttaaaggatgctatgttggaaataggcctgtttcttcttttttctcccagtaaagatttttaaccagtatgtgttggcgacttgttctctcttccctcctgccatatgatgtgtagcctggcattgtaaggctcatctaaaaggaagatccagggctcagggtgatcctgtgagctgcaggatgggaaggggaggtgtccatagcttttctctgacctcaacctggccaacatgactgcatgcccctcacccccaggtcttccagagaaagcctctgggagtctggcctcagtcccagtaccgagtgcaatgttgacacagtgagttacagatgggggtacccaccagggcttagcaggccactcctcagccacagccttcaccctggccttatgtctgtctcttcacctgctctccttctttcttcatatcttcagttcttttcacaatacacacccgactgggaaagccataaattcccatatttgaaacaccagggcagacattgtgctgattaatgtctgctttgattaatgaaacacatttaaggtatttacagagccaacagcaagatattctgctccatggggctctaagaaagagcaacattagtggatcattactccaattgcaggtccctttggcttcattctctatcaggattgtctaagttaagagttttgccaattatttcttatatttcctcactcaaaattgaaaaaaagaaggctattctggttgaagtaataccctcagtattttctacaaacatagtcacgatatcatcatactcttctgtaaaatattatatgtatcgtgcttatatagaaacagtaaagtcattttgataataaaatttaaagagatacataagcattagcaagaggacataattttgtattgtcaagaagaaagatttaaatttgtttacttacacaaatggaatttccatttgagatgtttggggtctacattcaaaaaaagtgaaaaataagaacaacatcatggattgacataccagttggcttattgaattactgtagtaggtttattgtcttggtgttattaatagtgacttttttttttttttttttgatggcgtcttgctctgtctcccaggccggggtgcagtgctgtgatcttggctcgctgcaacctctgcctcccaggttccagcgattctgtagcctcagcctcccgagtagctgggattacaggcatgtgccaccgtacctggctattttgttttgttttgtttttttttagtagagacggggttttactatgttggccaggctggtctcgaactcctgacctcaagtgatctgcccaccttagcctcccaaagtgctgggattataggcatgagccactgtgcccagcccaatagtgctttttcatatgcaaaagtattctggtttgagtctaaattatatagctaccttcttatgggaaatgtgcataataataattcctactttctctatagaaatgtaaaagtatattttggttatttattaaacagaatataggcccaaagcagcatcctgaagacccaattggccaccccatcatgcatctgtctggtgtgaagcatgccacgggggaggccatctactgtgatgacatgcctctggtggaccaggaacttttcttgacttttgtgactagttcaagagctcatgctaagattgtgtaagtggtaaaattcttactcaatgggcataaatgattgtcttttcatctaagtcacactagtgaaaagtaatggtgtgaagaaataggctatttgttggtgatatccaatgcagaccagaggtgaaacaggatcgaaatgtaggatttactacaacttcgttgtcccaagaattttttcccaattgtctggcagagactgttggacagttcttacctctctcatatcttattatccaattaaccatgttcttggcctctatggccactctaaggagctctgctgtgtatatcatctaggtctattgatctgtcagaagctctcagcatgcccggtgtggtggacatcatgacagcagaacatcttagtgacgtcaactccttctgcttttttactgaagctgagaaatttctggcgacagataaggtactgcatttttgctttctatttgaaaaataactttctcagttaacggtgcttcatattttcttaaagataccatctactttggcacaccatgaaagactccagtattcttagaatgcttattataaaagtatattctaatattgaatgaattcaaatatattcattttctgtacaagtaaagacattaactagttatataaaagattatttggtgttttacattttctaatagtgagatggcatactgctaatggtataaatgagtaaatgaagatggaataatggtaaattttatatggaaatcccttccctgagaagcccttattattgtcccagtctcagtatggtcaaagttcaactacaagttcaagtggtatctgcaccatgaagccttttttctcattcttcaatccagaagttcattcattctctctctctctctctctctctctctcaatttattctgatttatttatatttccatgtgttaaatgcgctttttattttttattttattttattttattttgaaatggagtttctgtttgtcacccaggctggagtgcagtggcatgatcttggctcactgcaacatccacctcctgggttcaagcgattctcctgcctcagcttcctgagtagctgggattacaggcacaaatcaccatgctcggctaatttttgtgtttttagtagacagcatttttgccatgttggccaggctggtctcgaactccttacctcaggtgatctgcctgcctgggcctcccaaagtgctgggattgcaggcatgagccaccacgcccggcttaaatgggatttttaaaagtgagcatctatgatgtctggtcaccatagctgaacaagatatgtatgatctctactctcatggagcttaaagtctagaggagaaaacaaagtgacctttatgtactttctaccttgtgttaagcttgtttattttgatgtcttatatatttcttccacctagtataaattccttgagtgaggacccatgtctgattcatctgtgtattccacacactgcttctcacattgcagggtgaatgagtagaggtatagtgataacattgttgccttgtgaaaattacaaatgattaaaactttggctacagcaagaacagcagtcaacaggttttctgcataattcggactgctcagttcagtgtttacccaaaagggcttcataatttgaaacagtcccttcctctggctctccttggaagatactcccttgaagatattatctgtagaaatgaaagcttgatgactgagagtttgaactcaaggttgaaactcccccaaagcagggctgtgtagcactggcagagacggtgagaatttaagccctttgcataaatgtttactaaacaagtgaaactgatcttggctgcatgatagtacctgctctttgaggtgtgcttatgaagatcataagcatctcaggggccacatctatgtgccaggtcacaggagcaaaatcaggagtctttggagtgccattgtgaatgattgcctttgttggtttaatgctttttaaaacattcatttatggcacttaatggcttttaaaagtcttttcattgtagaaattgtaagcatacacaaaaatgggaaagtattatacaatgaaccccatagatccatcacccagcttcaacagttatcaacacgttaccattcttgtttcatttttctctccttcactgcccctaccccaaacaaacacactttttttgtgttcatgctagattttatgtttttaatgcctttttttcgatgataaaactactttatgttcattgtggaaaagacataatagttcaaagtcaatttttaaaatgagtgattacattgaaattgtgaatcacagcataaagtaggagagagaactcagcaatgatggtgacttcttccagtccagactgtttttacctttctcaagtcttaaggtttcttttccccatctaaatttctgctgtggtccctgtgtgaactcctgagcctagctgccccacctgcaggcgaataatcctagctgtcaacccccccaggaaggggatgctgtctgcttggtcacgtcttggctaggacatcttttcatgaaaagacagtttgtgaggagagatgtgctcaccatcagggttctgttatcacaggggactccccttcccaggtcatcccctttttctctctggttgagatgatctgtgacttcctggtcctccctgtccgtgcaggcagaggctgcctctctcagaacagctctgattgtcgtgtgacagccaaacatcaagccatgggacaggctggccctcacacagcctcataggcttggcctggagcctgagcctgctgtcctcaagacagcatcactcctgctcctctgatacagcacaaggatctaaacttcccccagtgcctcgggtcaggaggccagctgtggttatagtcatggacagatgtggaggggtcacacctgtgtgtatctagccctagccctactgtaatcgagtactaggagggaggaagaaaatgaataaaagagaggacctgatgcctgccctccttgacaacaaaggtctttctgtgtcgtaggtgttctgtgtgggtcagcttgtctgtgctgtgcttgccgattctgaggttcaggcaaagcgagctgctaagcgagtgaagattgtctatcaagacttggagccgctgatactaacaattgaggtaatgagttctgtggaatggtggtgccagttgggagccagaacaaatatcagttaaaatgcttttggctactgtaacaggaaaatgtggctcaaagtggcctccaaagcacacggactttattaacctctaaccagtctcagtattaacaatttccccaaggacatggcttctttttgccactcttctctgctgcccacaatacaagctcaattcctgtggtcacacagatggccgccaggacaacctggacttccttgttcatgttcaaggagtaagaggaaccctattgccccagcattctaagcacaaatcctgagatccagcctaattaagccacttaggtcacatatccatctccaaattaatgactggcagaggaatggaggagctgttggttacttctaggggtaggagttggggtcaggtttctctgaagtaagtgggctatgtaggggagtgtaggaaactgaaacaaatctgagccctgtttggaaagggaaaggggaggggatgctagatgggaaacagtgatgtccaggaaagtggatccactctatgactttttacccaccttcacccaggcacatggtgaggaccaacaggatgttccatgaagtgagtgtcagagacacgatttttagatttttcaagagataagtcgtatgatgcctacaggtattttggcaacttaaactggagaattgcattttctatcctgatttttagaaaggagttgaaaatttataaaggctataagactcatctccatgaaatgataggatgttctcttgtgtgcattccattggttcttataatttcctggatgatgaaagaatgaacactggggaggcagtgtaaatagatgagactcagtccatacaggccgcatgtgctctgggacacaatattagcttcacagcataatgaacatgttgttctctgggtgaccggcatggcctgaggcagaattgaggaaacaacctgggcacgatcagtgtctccaggagaactgggtgttgggggtgcttcttgccatgctgcttgatgcttaggaacatggagtttgtctctgggaatttttcttacattttaaaataaaaataaaatcatgtcaaatagacaaaaacgtagaagtctaattggagtcgaagtgtgattaggcctcccaaattttcctggccagtttcaaattcaaacactctgttcccttctcaggcccttttcatttacatgttgcatgctgctcttgcttcatatattctgtcccctgaagtttgctggagagttagaattacttattagaaattatttacgtaacacttcatcaatattttgtttataaatctttgcccaatatcaggggctaaatatctactctccactccccctaccttccagccaaataaaagccccaataagcaaatataatagatgccactccccccaccctcaccacttcaaccagcagactcgtgattgtctgccagagaatcccagcatcagatacaagctctggctttgtggaaaagagttgcctcacattgtgttcagagattaagctctcaaagtctaaagatcatcaactggatcagagcaaatttaatcaaagtttagagcagggaaatatgcccctctccctatacattacagttcttttatcactttcctgactaagaaaaattcagaaaattggctcaaagttattcaaagagcaagcagccagtgaagttgaaaaagatgaaacttttaaaaataggatttataaaacctagcttttttttcaacctggaatctctttaatcttagattaataagaaaagcacatgaacagattccaataggaagtgtgttatcaatcaaaatagaacaaaaacaaatatatctctgtcactatcacaaagatttaatctggcacatgcttttcgagtttttagtagattgaatggggcaacgatcaaaactcttgaatcaaggggtaaggctgatgaccataatggaaaaaaatgtgttccctaccggaatctgtcctgaataataatcatcaacaacaacatgagcatagctaggacctatacagagctcactgtgtggtcaacatggttctaggtcagtttcacacattaacttactaaatgctcaccacaatcctatgaggcaaaaactatttttatccccattctgatggggaaactaaaagacagggttacccaaggttacatagctagtcagtaacaaaaacaatcaacaaacactctgtcaaagaacctgggccccaccggtgctataaacaaaccaacccagtttttgaatgggggaaatggcagaatcacaatagcccatccctctaaggggtgttgtctagacacctactggtggccagaaggaaacagagataagagaatccccaactaccaacagaatggaatttcatggatggacaataacccacagtagataatgccagcaggagctggcacaccacatttgccagtggacacatggattactgcaagataaattctcagggatagctaaaaaccaacctatgttattgtaactacatctctggttatgtgcaccactgtacccttttactgggcacccagggagagccaataggagctagtgtataaatggatttgtacacccagctcccagacagggcttgtctgaaatcttacttccagagctggaggtcccaggtgctctactgccctgtgcaaatgaaatgctcatccccgcaaagaaggaatatggggctggcaggcagagccaccatgatcccaatcactagagtcttttcaactagcaattattgagtgtttactatatgcaatataagctcttcacgtcttatttcattttatcttcaccaaccacgatcctattggagctatatgcacacctgttacttccattttacagacaatgataagagaggtgaagtgataggcccacagtcaaagctggtaagtgggaaaaatgtgtgcacaatgctgactgggtctagagcccaggctctgaagccctgtgctgtatggccttggctacatgaaatggattgtggtgtgcagacaataacctgcctggaaaatactagtttcattctgggatcacttagatgccagtttttttctgtgcatattatttcttcagactcagtaggcacatttacatttcctcactggggagtctctctgcagttggattcttagcttggctcaccagggtcatggtgaaagtgcacggaaccacaaggtgaagggagaaacaacccctgctcagaggatgtgcagtggggtgtgtctgctgccctagggcagggtctcttgcccaagctgcctcattcctctgttctctttctaggaaagtatacaacacaactcctccttcaagccagaaaggaaactggaatatggaaatgttgacgaagcatttaaagtggttgatcaaattcttgaaggtaaaaagtaatggaagagtaaacaaccctggaagtcttctaagcatgtcagtttaaggcttcctttgtcttctggaaatcatcgggcagcctaggggggtgttgctcctcaggaacaggcagaacaggcacctcattcacaaatgtgtttccctccgtctctggggtaggccaagagccaatggggaggcaaaagaggaggcaagaccctgcccctcttccctgaccccccttccctcatcaaggctccagttgttagagatgtcattttctttcctgttcacaaccaccctgcaagagggtattattatctcaatcttataggctggaaaatggaggctcagcgtaattatggagtgtgaccaaggtcacacaacaactactaaataacagagttggccattgaattgataggctttattaggatttccaaagcccatgtttcttcttcatcctttctctctctgattctccctctcttcctttcttccttctctgctttttcttcccttcctcttcccttccctttctcctttctctttcttccagacttctttgctgtatgtatgtatgtaattaaaattaaatttgcctcttagaaaatagttaattatagctttccagtacaattccttaacttttggctttgaaatattttaaaacttacataaaagttgcagaaacattaaagaaactcccaaatatttttcactcagattccccaattatacacacacacatacacacacacacacttctgagccatttgagagtaaattgtaaacatgatgtatgtctctttacccctaaatagtcagcatttgtttcctaaaaacaggatgttgtctaacataaacatagttatcaaaatcagaatattaacacatattctattaatctacacagtttattcaaatttcgctagttgtctcaataatgtcctttatagcagaaaaaagaggttcatcataagtcttaaataacccatgctttccccgccacactctgctgtcattgctgctgtgaaagctgtcctaatgcctgcctcacaagatctctgatttacagacatgctattgggtgggtatgggcagtctgtgccacatctcagagcagagaaatcatccggcattatctgtctttaagtgaatttccagggcattggcctctagtgcatgttaaaaactcccatcttctgggctgggcatggtgactcatgcctataatcccagcactttgggaggccgaggtgagtggatcacttgaggccaggaattcaagaccagcctggccaaaatggcaaaaacccctctctactaaaaatacaaaaattccaggcgtggtggtgggagcctgtaatcccagctactgaggaggctgaggcacaagaatcgcttgaaccctggaggcagaggttgcagtgagccgagattgcaccactgcactccagcctgggtgacagaaggagactccatctcaaacaaacaaacaaacaaacaaacaaaaaacacaactcccatcttcttaatttttctcaccaaccttgatcacaagaataggaagagtcctaagacacatcccatcctgagtgcacagccagagctgtgtaatatgtcaccagtcagcccagcttcttaagttccaagcccatcatgtctcaactctataggtgcattaaacttgaagcgtgtcaggggctgactggaaatgtcacctgaaagctgtaggaaagacacctggaactgtcacctaccagttttccttggcattgtgtcttattagctgtgtaacctggcagggcacttctcagggctcagtctccctgttttaatattacatggataaagtaaaaacaatttcaaatgtgaattataaagattataagagataatcatgtgttcttggcatatagtaacaaatcaataactgtgagcaatgattattagatttagatgtttttgttgttttcctgaaaatgttgtctattagtgagatacgttggcaggtgttcatttatcaaacccagtgtttccaagattttctccttataggaatcactgaggatatttatgagacctagagatccctgtgcccttttttagaattgtagaggatccaaaacagcccaggaactggtcttaacaagttttccaggtaattcttagggctagtaaaatgtggaaaatactggaaaagtgagtttgatttatgggaatgaagagaaaaagagggtacatttctatcatagagcgttcccggcatgagcatgttggaaatatcaatatttaggggggttccttgtctcatgtttgtttcctgacataatgagtatttgtgcaagaattccattgttgtatttttccttgacatcttctttaattatctaattcaattaggtgattgatttagtctgcctcttacttgaatttttgttattgctgcataccccattgataagtataaaaatgatacgggaatattaaaaaggacatttatactacttttcagtataaacgccagctgcagtagctcacgtctataatcccagcactttgggaggccaaggcaggacatttgaggccaggagtttgacaccaacctggtcaacgtagcaagataccttctattaaaaaagaaaaaggaagccgggcatggtggctcatgcctgtaatcccagcactttgtgaggctgaagcaggcagattgcttgaggccaggagtttgagaccagcccggtcaacgtagcaagactccttctatttaaaaaaaaaaaaaaaaaaaaaaaaaggaagctgggcacggtggctcttgcctgtaatcccagaattttgtgaggctgaagcaggcagatagcttcaggccaggagtttgagtccagcctgggcaatatggcaaaaccctgtctccaataaaaatacaaaaattagccaggtgtggtggcaaacacctgtaatcccagctactcggaaggctgaggcaccagaatggcttgaacccggtaggcggagattgcagtgagacaagatcaggccactgtactccagcctgagcaacagtgagactgtcaaaaaaaaaagatggatggatggaaggaagggaggaaggaaggaaggaaggaaggaaggaaggaggggaagaaaagaaaaggaaagacaagggaagggaaagacaagggaaggcaaaagaaaaccaattttcatcctcttgactcacaagtttgagtctagcttttccctttgtctgctatcgtcttttggattatgagtttctcctaatatctcatgatatttcaatgcgaggtaattgcaattaattatcatagcaacactttatctgtcttctaagaaaataagtgtcccacactggggcctgtaggagtgggggtaaggggagggagagcatcaggaagaatagctaatgcatgctaggtttaatacctaagtgatgggttcatctgtgcagtaaaccaccatggcacacgtttacctatgaagcaaacctgcacatcctgcacatgtaccccagaacttaaaagttgaaggaaaaaaagaaagaagataggtgttccaagaaaaaaaatatttaaaagataaaatatgtggagcattacatcaggtcttagaatgcgttcttggagggagaactattattgtttgcacttatctgctgcgaagatatatttcaactctatctaatcccggtgtcacagcaccagaggatgctaaagattaccattttcaaatgagccagctgaggctagagaggctacctgattgaccaggatgaaatctaagagttttcccaactccaaagttagtattctttcctctacattatcctgcttctcatttatctcattaaaattctgttagctgggatgtgctttatactggagagcacagagaacaatctgtatagaaggatttgcaagagacccagggagccctgaaactgagatgattttccccacaacctatcctgctgggcatggtacagatagacacattcacatcttagcagatttgggactttaagggcctcttattaaaatgtaaatatgcctggaggaatcactcctaaacccatactgggataacattttatctcagggattagttgatcaaattggtttccaacctagagagttgacagcaataccctaaggtgaagagggggcactacgggtgggggctgtcagggtaggcagtgcaatataacaggtttctaaaactttcccttctttacagatttaaacaggaacagctctgtctaatttttttagctctgaatattttaaataaagtgactacttaacaaaataaattctgagtggataggcagaatcaataatactgcaagcttgaatgtaagcctagtgacaatgacatgggtctttagactatttgataagagcttaaattgaagttaagatctgagcttgtgaaattttaatgtttatatattataagtgaagcagaatctattcatttttctgtgctctttttttaaactcagattttcgataagataggaagtccagattgcaatttaaaacatctcattttttatgcaaatagagggaatcctcaatttgcaaatcactattgctgagtaaatttttaatttttaaaagttctgccttccattaacatgatcgtcagtaataattgtattctgtttgttccctctgctttttattcttttccccaccttcctgtgggttgcctgaatatttgcttagaatttcattttgattaatctatagtattttttagtatacctccttgtacagattttttttagtggtagctctagatagtttacacatatacatatacacatcatatataaaataaaatttatatacatataaaatatttacatatataaaatatcacagtctggtttcaacattttacaagttcaagtcaagtgtagaagctttacctccctttacatccctctccctttttataatataattgataattctatttatttattctacatacattgataatcacatgaagcaatgttataattttgcttcaaacacaatttaggaaacccaagaggagaaagaaagtctattgtatatactggtatttttattatttctgttgttctttcttccttcctgatattttaagatttcttcatttaaaaaaaaaaatcattttctgtctgttttaaaaacttccctcagccattatttcagggtaaatccgtttaaaacaaactcttagttttccttcatctgaaaatgtcctcatttccctttcattgttgaaagatatttttgctggctatagaactctgagttgacaggtattttcacactagaaaaattttaccacttcttctggcctccatggttcctgaagagaaatctactgtctttaaaagtgcttttttttttctttctttctttcttttttttttttcagatggaatctcactctgtcgcccaggctggagtgcagtggtgtgatatcagctcactgcaacctctgactcccaggttcaagctactctcctgtctcagcctcctgagtagctgggattacaggcatccaccaccatgcctagctaatttttgtatttttagtagagacagggtttcaccacgaaagtacttttctcctatagatgaagtagtgtttctttctcatagctttcaacatggtgcttttgtccttagttttctgaagtttgactatgaggtatcttggagtgtatttctttgaatttattctatttgggatcactcagcttcttgaatctgtagattagtgtcgtttgtgaatttggggacatttttagccattatttttcaaataatggcttgacttcaatggcacaaatattagatcttttgttatagccaatgggttcctgaggtgctgttcattttttttccagtctatttttttctgcttttcagattggccaatttctattgttctatattcttgtacattaatcatttcctctgttctccctattctgttgctgagcccatcccttgaactttttaaatttttgctgtatttcttaattctaaaatttctatttcttttttctttttatattttctatttctttgctgaggtttctattttttcatttgtttcaagtgtttgtgtaattgcttattaaagcatttttattacagctgctttaaaatccttgtcagataattctaacatctgtgtcatctcagtgttggcatctgttgattgtcttttctcattgaagttgggattttcttggttcctggtatgaatgatatttgattgtatcctagacattttagatattatgtaatgagactttagatcttatttgaatcttctattttattagaatattctgtttcactagagtactttaaccttttactgatggagaagaagggggtgatgccttgttactgctaggtaggggttgtaagtccaggttccccatgtggcatccactgacagcaccccaatagagaggctgggacacctcattgcagcctgatgagggtggaactatagatttcctactcaaccttcacagtaggggtggggctgcagtttttttcatggtgtttgcctggagtagagtgcttattgtcttaatttttttgtctttctagtcttccacttttctggtcctttggctagggagagtgggcttttcttgaggatttttttttttttttttttttttttgtctttgcctgttggagtttttagattgctggcttctccggaactaagtctgggatatctgaggcaaacaacaacaacaacaaaaaaacccactgaactcactgctgtgtcttttcttaggtcctgaagtccctagctggtctgccttctctccacctttcagagtcttcttatgtttgttttataaataatgctcagggttgttatctgtacttaacaggagggacagggagcagtacatctactcctgctggtcctagagctggaagcctccgcattctcacattcctacgcctctgctaacagcgctggctccttatgacctactgaatcaagacccctctgcttttggctctagaaagtcatacacctttctctaggactctgtgacctagatattggcagacacaaaagattctcctatagaactttacttcaaatctgcaagtagactgaaagctaaacattgttgtttgttatacttcactgtgcccagcagaagtactattagtggaatttctgcataacgggataatacctgggggacgctacctgttgcttctgactgcttccttgacttttatgtattttcctgtaacaggtgaaatacatatgggaggtcaagaacatttttatatggaaacccaaagcatgcttgtcgttcccaagggagaggatcaagaaatggatgtctacgtgtccacacagtttcccaaatatatacaggtaacatggggccattgtggagaggacatggctaaatgatttctggccagtgaaatatatcaagagcaattagaggtaaaagtatatttgggaatttgaggtggggggattgcttgaacccaggagctcaaggcttcagtgatctatgatcacaccactgcactccagcctgggagatagagtgagaccctgtctctaacacaaaacaaacaaaacaaaaccaataatgttatttcttcagggactgaagaaatattgagtattaatagccatattgatttcagtattaatagccatataagttcagtgcttttaaaagagtgttattaaagtgggagccttttgtttgtggattgtagctttaaaaccagttatggaatcagcagatctcttgctcagctcttggcaccactgttaggaacacaagagaagaaagaggaagacctgctctccaaagcctatggtgcctaactcacaggaaacagttaagaaacaatattgaaaattatgcaaccaggtgctaaatcagcaaaggcaaaatttacgtgggtggagaaattaggaaagagtttgctgagggctagaatcatccaggaagtcccacaaagaagtcttaagtttggattcagaatgagagtgaggtttgtctagatggtaagacaagagaggtcacttccaggcaattccacagcaagatcaaatgacacccattcatttattttctcacctcttctgcaaacatttgttgcctgtgtcctgtaccctacgcagcatgcatggaaggaaggaggaatagcacaatgaccgccccagctggaatgaaggggtgcctttaggaaagctaggtttaagcatcagggtgagagtaagggaaatgaggcagggggtcttgattctggtcataaggagccagtgctcttagcagaggagtaggaatgtgagactatggagaatgaggcctcgtaaaaggcaggatcctaaagagggtcagatgaactccattccaggcctgcttttctcttcactctccgtgggatgttgggtccataacctcatccgtctcaggcttcccatctgtaagaatcaattgttaagactaaatgacccctaatcattaggatggcagaaaagagtgagatctgcatctaggaaaagaccaactggtcatctttagcagcaatccaagcaagaagtgagaagtgctttttttttttttttttttttttttttttgagacagagtctcgcttggtcacccaggctggagtgcagtggtgccgtctcagctcactgcaacctctgcctttcaggttcaagcgattctccggcctcagcctcctgagcagctgggattataggcacgcaccaccatgcccaactactttttgtatttttagtagagatggggtttcatcatgttggccaggctggtctcgaactcctgacctcaggtgatctgcctgacttggactcccaaagtgctgggattacaggcatgagccaccacatctggctgagaagtgcttattttccagtagagacagtagaatgcagggaaaagacccatgctgagtgaggcttagaagactgcaaaatcccacagctttgggaaacgtatgcctagggattagtgtgaatagaatactttaggagtggttcctggggaaaatacaaaaaagtatgagtacaaaaatatctcactggtaatgaaaacactactaattagttttggcaatgtcattatagccaagtattgctgagatcagttggggctgtgggccagggttgttggacattatcccattatttagcataaccacacagtatgggtatcatgtgcaacattaaagaatcaaaacatctagtgactgtcacagtccatttcaggggacaggttttttgttgttgttgttaaaatcatagatgtgacaatgacagtcacaattaagtccttgctgaagatggatcagattaatcagaactattattgttcacaggacattgttgcctcaaccttgaagctcccagctaacaaggtcatgtgccatgtaaggcgtgttggtggagcgtttggagggaaggtgttaaaaaccggaatcattgcagccgtcactgcatttgccgcaaacaagtaagtggagaaaatctgctaaaaataaagtgaagtcacactgaaagttctcactgtcagaatcaatgaggaagaacctgggccaagattatttaatatcacatatacgatacaaacacacaaacaagctgccagcttattacacttacttgtcttatattgtcctatagcaaccaaaataagagtcaattactgaaaataataaaagccacagaaaaaatataatacctagaaagtgggcagaaacaggtcctgaatgggtgggagttacttgtcctcagcacctgctggactgagctatatatgtagaggtcatatatatggctttttgaacaatgtacctatatatacatacacacatatatatttatatacatataaaccatgtacctatatatacatacacacatatatgtttataaacgtatatgtatgtttgtgtgtatatatgtacattcttcaatatatcaaagatatttttgtaaaatggggtcccatatacacacatacatatatacatatatgtacatatacatacacatatatacatatacgtgtatgtatatatgtgtatatatgtatatgtgtgtatatgtatattttcttgatttaaatatagactttgcttttgttatgcttacattcatttgtatcgccattttcctttgaggatctcaaaaaattctcatgtaaaattgtctctggagcaggcacacctagaaggcttaatttgtttgctgagtaatatgggtcagttcctccatcccaggaagcaaaaataccttgattccagatctctcctatcagggagcacttggtagttagatctgcattcttccatttgtggccagtctaaagaccttgggacgatttgcctataataaaggttgttattacaatgggaaatgcccccaaagcaatgtcctggagcccctggcacccaagagcctctgtcccacaagttgcaaatgcctggcattattccctgacctaacgggaggaaagcccacggtgtatgcctgagatcagcagaggataggcatgcgaaatagttgtgttgttctgtgaggcgtgtaggctccactcaggctcttgccaggagttatataaaccccagagaatgcctgctaagtaaaagaggttacctcacttactttttttctgttttagacatggccgtgcagttcgctgtgttctggaacgaggagaagacatgttaataactggaggccgccatccttaccttggaaagtacaaagtgagtacaagagggcatggaggaaggatttatgttgtagatacaacatcctatcagtgcgcagggcagtctttggctactctctagtggggagtaacaatgagcaaatcaaaaacagagcatctatttaactttctattggttgcactgacttttaattactagctggttcaatggaggcttttctgcttagctcaaagatgtcagtttcagaaataaaacactaagtgctagctggtattggctgtacagagcaaataactagaaaacgtgagtgtgtacgccattaaagtagatctgattaccatacttcttcccacatataaaagaggtaaaagtagaataattctcataacagtagtgttatgtgaaattgcaattatttgtaaatgggttcctcattcttcaatatatcaaggatatttttgtaaaatgaggttccagaaattcatagaaaaaaatttgtagtagaaaatagtgattcttttgctttataagaaaaattttacttctcagagtgggctaacttctctaagaaacaacttaaaagctcttaaactttcattacgtcatttcttgctcaagtaacagctcaatataatgctcaatataatcattgaggggggaaaggggaggattctgctttataaaatcattcagggactggagctgtttccatttattggtgccactgtgccctcagactgcatcatccaatatagtggtcactaggagcatatggctatttaaatttaaattacccaaattaaatacaattagaaatttagctccatagtcgtattagctatattccaagtgctcagtaggcacatgtggttagtgtctgccatattggacagtgcagacgcagaacattgccatcatcacagaaagttttattgggtatcactgccctacaaactctgagtcttccaggggatcttttgctgagggcagcagacagggaagcgagagagaagagagcatggagtgtcacctggtaggtgttttaggttttaggcaccggacctgtaagttgtggatctcacttgtatccagatgtcattggcgagacctctgtcacctaactgtaagggaggctgggaaatgtcatcttcctgtgtgcccagaatgaaatacaataggatttgttaaatgcatagcactgtctccatcgcaaaactgcataactaatacatgttttttaggagataatgaatgtttccatttcaaaccacactcactctaaactgtattttgaatttgatttagctcagaaagatttgttacagtaaacttcatcctgaaggagattttttttaataagacatatatgaagtcattatgaaaatataacaatctcaggttaaaagatggagagatgaatatgaattggaatatatataggcactttgttaaagaaggtaaaagataggtcttcaagaatggaggccaggcacggtggctcaggcctgtaatcctagcactttgggaggctgaggcgggtgaattgcctgagctcaggagttagagaccagcctgggcaacacggtgaaaccctgtctctaataaaaatacaaaaaaattagccgggcatggtggcaggcacctgtaatcccagctacttgggaggctgaggcaggagaatcgcttgaacctgggaggcagaggttgcagtgagccaaaatcgcgccactgcactccagcccgggtgacagagcgagactccatctcaaaaaaaaaaaaaaaaaagaatggataggcagaaggaaggcatgccaggtgtgggaatagtaagagcaaaactacagaggtgtaataaacatggcatgtttgatagaggcaagagtaaggggagagggagaattagaacacagagcacttcctggaaggtagtaaaaaataggattgatgggtttaggtgatgcctgactgagaggggcctacagtcccagagtgggaagtttaaacttgatcttaaaagaaacagtgagactgagtggatccttgaatggctcagtgccgtaattaaacacagatgctttggggagggtaacaggatagtctggggaggagagaggatggaagctggtagacagcgggaggcagctgatgcattcagacatgaagcacatggggtctgagatatgacagtaagttgtagaagagatgggtccaagagccattatagtgtaaaataaaagagaattggtgaaaatcttggcaaaatgctatgaagaatacaaccgcaaacatgacttggagggttttagaagaaagcgacaagttggaaggaggaaccgatctggaagaacgatgaagagcttgtttgtgtaaatgctgggggtagaagtgacaacaggaccctgaagcagaaatgtcctttaccaccatgggactttgctgaaaggactggattatagtgacagaagccattgtcataatggtgactaaaactatgagaaaataatgttttctgatggagagtagtgtgaggaaaggtgatatgaatactacttacgatactattattaattatatttagagtacttgctatgtttcaggcacttgcctataattttctatgtgttgccttatttacttccatttcacagatagtctgagtggttacacagcttgcctaagatcacagagctagttatatactatccgagaaatcactgccaaatccaatgtcatgacgcttttcccctatgtgtggagggtttgcaaatgacaaaatttggagagacttggcccctgttccagcattcgatatcggttctcttccccaggctggattcatgaacgatggcagaatcttggccctggacatggagcattacagcaatgcaggcgcctccttggatgaatcattattcgtaagtgttttaaggagcaagttcacattcctgaaaagagtgttatataaaataatttaacttagaaaatgcccaatagttaagtaatatttgattataaaggtataatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaccccaaacaaaaatgtttcaaccaggccagacgcagtggctcacacctgtaatcccagcactttgggaggctgaggtgggtggatcacttgaggccaggagttcaagaccagcctgaccacatggtgaaatcctgtttctactaaagccgggtatggtggcacacacctgtaatcccagctatttgggaggctgaggcaggagaatcacttgaaccccggaggcagaggttgcagtgagccgagatttcaccattacactccagcctgggcaacaaaagtgaaactctgtctaaaaaaaaaagagtttcaaccaaaatgttaacaatgaaaaatgtctccagacattgccagacgtccccaggagcagggaaaggattgctccccattgagaaccaatacattagacccaatgccaaaacatttttttctgttttcactgtcttccaggatattatattcattacattctatagacccagtgctcagggcctgtgaacatatcaaaggcctttgtatatatttgaaatcttaaaaaatgcattaactccaaaatacaaaaataaaaaataatgctctcaaaggaaaaattattctaatacttaaaaattattttacagcaaaaaatgtgtttaattgggggcatgggaatattttagcatgttagatgagatgaaaagagagctgccattttcggcctggttttggtctgaggtcgtaggatggtgaaacaggttcagaagatcttaatcacatcaactctggatttctccaggtgatagaaatgggacttctgaaaatggacaatgcttacaagtttcccaatctccgctgccggggttgggcatgcagaaccaaccttccatccaacacagcttttcgtgggtttggctttcctcaggcagcgctgatcaccgaatcttgtatcacggaagttgcagccaaatgtggactatcccctgagaaggtaatactaaatcagcttcacagacaaaacatgtggaatgtcagagacggtagggcctttgggggccattcaggttgaggaatttgagacccagaggggcaaatgatttgtgccaagtcccccagctaactggttaatgcggagcccagactccaaagttcagcaatactcaccttactcagactcctgctccaaaatcctgaagcagaagatcctgaggactgagcactgcattctcccctggctggtgagaagcttccattggctgggggtataactgctacccacaattccatcaaggccctcattccccgcttcctgaacatctcagccagctgtcaaaaagttggtcatttcagttgctaaactgatctccttttggttcttttttttttttttgtaacattaataggttggtttttatttttatttatttatttccataagttattggggtacaggtagtatttggttacatgagtaagttctttagtggtgaattgtgagattttggtgcacccatcacccgatgggtgtatgtatatacatatacacacgcacacatatatatgtgtatatatatatacacacacacacatatatatatatatacatacatacatacacacaccacagtttctttatccactcattgattggtgggcatttgggttggttccaagattttgttattgtgaattgtgctactataaacatgcaggtgcaagtatctttttcgaataacaacttgttttcctctgggtagacacccagtagtgggattgctgggtcaaatggtacttctacttttagttctttaaggaatctccacactgtcttccatagtggctgtactagtttacattcccaccagcagtgtagatgtgttccctgttcaccacatccacaccaacatgtactgttttttgattgtttgattatggccattcttgcaagagtaaggtggtgtagcattgtggtttcagtttgcatttccctgatcattagtgatgttgaacattttttcatatttttgttggccatttctatatcttgttttgtgaattgtctattcatgtccttagcccactttttgatggggtcgtttgtttttttcttactgatttgtttgagtttcttgtaggttatggatattagtcctttgtcagatgtatagattgtgaggattttctcccactctgtgggatgtctgtttactctgctggctgactgttccttttgccatgcaaaagctctttagtttaattagctcccagctatttatctttgtttttatcgcatttgcttttgagttcttggtcatgaaatccttgcctaagccaatatctagaagggattttccaatgttatcttctagaattttaatagtttcaggtcttaggtttaagtccttaatccatcttgagttaatttttgtataaggtcagagatgaggatccagtttcattctcattacatgtggctagccatcctagcaccatttgttgaaaaggatgtcctttccccactttacgtttttgttcgctttgtcaaagatcagttgggtgtaagtatttgggttctctattctgttccactggtttctatgtgcctatttttatacactactacaccattttgttgactatggccttatagtatagtttgaaatcaggtagtgtgatgcctccagatttgttctctttgcttactcttgctttggctatgcgggctcttttttggtatcatgtgaactttagaattgttttttctaattctgtgaagaacaatggtggtattttgatggggattgcactgaatttgtagattgcttttggcagtatagccattttcacaatgttgattctacccatccatgagcatgggatgtgtttccatttgtttgtgtcatccagtgttttgtagttttccttgtagaggtctttcaactccttgattaggtatattcctaagtgttttattattatcattattatttgcaactattgtaaaaggggttgagttcttgatttgattctctgcttggtcgccattggtgtatagaagaactactgatttgtgtacattagtcttgtatccggaaactttgctgaattcttttatcagttctaggagctttgtgaaggagtccttagggttttcaaggtaaatgattatatcgtcagcaaacagtgacggtttgacttctctttaccgatttggatgccctttatttctttctgttgtctgattgctctagctaggatttccagtaccatattgaagaagagtggtgagagtgggcctccttgtcttgttcccgttgaatgccttcaactttttcccattcaatattatgttgaatgtctttaacttttccccattcagtattatgttggctgtgtgtttgtcatagatggcttttattacattaaggtatgtcctttgtatgctgattttgctgagagttttaatcataaagagatgctggattttgtcaaatgctttttctgcattgagatgatcatgtgatatttgtttttaactctgtttatgtagtgtatcaaatttattgacttgtgtgtgttaaaccatccctgtatccctggtatgaatccctcttgataatggtggattatgtttttcatatgttgttggagttggttagctagtattttgttaaagattttagcatcaatgttcatcaaggatattggtctgtagttttcttttttggttatgtcctttcctggttttgttattagggtgatgctggcttcattaaatgaatttacttaaggttccttctttctctatcttgtggaatagtatcaaaaggattggtaccaattcttctttgaatgtctggtggaattctgctgtgaatccttctggtcctggactttttattgttggtaatttttaaattaccatttcaatctcgctcttgttattggtctgttaagggtatctaattcttcctgatttaatctgggagggtgtatttttccaggaatttatccatctcttctaggttttctagtttatgtgcacaaagttgctcatagtagctgtgaatgatcttttgtatttcagtgttgtcagttgtaatatctcctgtttcgtttcttagtgaggttatttggatttttactcttcttttcttaatcttcctaacggtctatcaattttatttatcttttcaaagaaccagctttttgtttcatttatcttttgtactttttttccagtttcatttagttctgctctgatcttggtaatttcctttcttctgctaggtttgggtttggtttgctcttatttctttagttccttgaggtgtgaccttagaatgtcagtctgtgcactgtcagtctttttgatgtaggcacttagggctatgaactttcctcttagcaccgcgtttgctgtatcccagagattttgacaggttgtgtcattattgtcattcagttcaaagaatattttaatttccatttgatttcatttttgacccaatgctcattcaggagcaggttatttaatttccatgtatttgcatggttctgaaggttccttttggaactgatttccagttttattccactgtggtctgagagagtgcttgatataatttcaattttcttaaatgtattgagcttgttttatggcctatcatatgatctatcttggagaaagttccatgtgccgttgaatagaatgtgtattttgcagttgttagataaaatgttctgtatatatctgtttagtccatttgttccaaggtatagtttaaatccattgtttctttgttgactttctgtcttgatgacctatctagtcctgtcagtggagtactgaagttccctactattgtgttgctgtctatctcatttcttaggtctattagtaattgttttataaatttgggagctccagtgttaggtgtgtatatgtttaagattgtgatattttccagttgtacaaggccttttaccattatataatgcacctctttgtctcttttaactctgttgctttaaaattggttttgtctgatttatatcagacagaatagctactcctgctcgcttttggtgtccatgtgcacgaattgcctttttccacttctttactttaagtttatatgagtccttatgtgttaggtgagtcttctgaagggaacagatagttggttggtgagttcttatctattctgtggttctgtatcttttaagtggagaatttagaccatttatattcaatgttagtattgaaatgtgaggtaccattgcatttgccatgctttttgttgcctgtgtactttgttttttatttttttgtttttgctttttaacatgtatttatgttttataggtcctatgtgacttatgctttaaagaagttctgttttgatgtgtttccaggatttgtttcaagatttagagctgcttttagcagttcttgtagtggtggcttggtaatggtgaattctctcagcatttgtttatctgaaagcaactgtatctttccttcatatgtgatgcttagtttcactggatacaaaattcttggctgataattgttttgtttgaggagcctgaagatagggaacaatcctttctagcttgtagggtttctgctgagaaatctgctgttaatcatgtaagttttcctttataagttacctggtgcttctgtctcacagctcttaagattctttccttcatcttaactttggataacctgatgacaatgtgcctacgtgaagatctttttgcaatgaattttccaggtgttctttgtgcttcttgtatttgatgtctaggtctctagcaaggctggggaagttttccttgattatccccctgaatatgttttccaagcttttagaattatcttcttcctcagcaacactgattattcttaagtttggttgtttaacataatcccagacttcttggagattttgttcctattttctattcttttctccttgtctttgttggattgggttaattcaaagaccttgtcttcgagctctgaatttctttcttctacttgtttaattctactactgagactttccagagcattttgcatttctaaaagtgtatccaaagtttcctgaatttttttattgttttttctttaagctatccatttccttgaatatttctccctaacttcttgtaacttttttaaaatttctttgaattgggctttgcctttctcttgttcctccctgattagtttaataactaacctcctgaattctttttcaggtaaatcagagatttcttcttggtttggatccattgctggtgaactagtgtgattttttgggggtgttgaagagccttgttttgtcatgttaccagggttgcttttctggttccgtctcatttgggtaggctctgtcagaaggaaagtttggggctgaaggctgttgttcagtttcttttgtcccatggaatgttcccttgatgtagtactctccccctttccctatggatgtggcttcctgtgagctgaactgcagtgattgttgtctttcttctgggtctagccacccagcaagtctacccagctcccggctggtactgagggttgtctgcacagagtcctgtgatgtgaaccgtctatgggtctctcagctatggataccagtgcctgttccggtggaggtgatggagggtgcagtggactccatgagggtccttagctttggtggtttatgctctatttttgtgctggttggcctcctaccaggaggtggcactttccagaaagcatcagctgtagtaatgtggagagggattggcggtgggcagggccctagaactcccaagattaaatgtcctttgtcttccactaccagagtgaatagggaaggaccatcaggtgggggcagggctaggcatgtctgagctcagactgtccttgggtgggtcttgctgtggctgctgtgggggatgggtgtgagattcccaggtcactggagttgtgtacctaggaggattatggctgcctctgctgagtcatgcaggttgttagggaagtaggggaaagccagcagtcacaggcctcacccagctcccatacaagcagaagggttggtctcactcccaatgtgtaccccccaacagccctgagtttgtttgcaggcagacagtgtgatgggcttgaaaacttgccctgtgctgcacccctagctgagagagaaaagggcttggtttctccccctgcctgtggagtctgcacaccagatttgtgccctcccactgagctctgaccaggaggcttcttgccccattcaaattgttacaaagttcagctagagatttctttctccctgtggagtttcaccccctacttctctggtcccccgccccctccgcccccaccatggatccctgtgttgttaggcaggaatggcctggcctgctaggggacacagcaagctcctagggcctttctgctgcttcctctacccctgcattttgcttggctctctaaattgtctcagcttcaggtaaagtcggaatcttctcctgcaaacagaatttcagcttctcccgtgggggtgtgtgtctgggagaggaggatctcccttccccctcacagctggggcactcacggtatttggggtatctcctgggtcctgcaggagtagtccacttccttcagagggtttgtgggtcctctcaggattattgctttgttcttgcagtcgatctagagctaaaattcggcgaacttccacaggctgctctgtccagagctgcaatctagtcctgcctcccgtccgccatgatgatccaatttctccttttggttctttcagtctcagccccaactttgtttattgacaacgaccttccccttcctggctcctcctcccagatcctggaatggaattagtgtggggagatggggtgagctctctctcagccccttctcctcccctgtgccttctgctgtgatgctggtgcaaggaggaagagaagaaggaccaggaaaacagtcagtttctccctgtgtgacttctcccggcaagctcacagtcctctctttggacagatgtcacttttcaagtacattgtctatggctccatttctgccagctcttccagaaattggcagtccttggaccttcagcgggcagctggcacagcattccactggtgaccacacctctctgctcatgccccagcagtctttagaaggccccaggtcccaattcatctaccagctttcacccaacagtagccactttctttgcttctcttgaacgtgtgggaggccttgcccctcccttcctggccatcccactaaactctctcctgatgtcctgccacatttggtagcactaaggaggagaattacatccttcccttcattcccagggaagttagagcagggaacagcctcttaaaaacaccactttcccccaaatgagatggcttactaatttccagtgtttctcttacaatgatctgataatttgcttcggagggtggggagagtgtgtctgtgatggctctgtcagcttagggagggggctggccacaagtgctatgagttttctcagctgagaatgtgacatacttggcaccttttattctcagcttagggtcttagtcaccaattctgggaatacaggaagaattctactcagtgcttcagacatcctgggatagaatcttttaatttgttcttcatcctagatattggttatatttaaacgaactttcatgcttgcctgttttggaggtgagtagtcttatcttgcaacatagcatgggagtaatccaaatcatgtggcctagatgatctttcagcagatacccaaatgcaactagaattaagagtctacagtgtacatggactgtgttgagttatattggaacataaggtaaaggttccatcctttaaagttgcacaagagtagcatagaaagcacataagtaattgctagcacgtttgatagaagctctgagtagaggaagaggacaatgttgtgcattaggaaaggcttccacaaggactcagtagaacttggcttggaccttacaggatgggcagaatttgaccaggaggatggtgaatggatgagcctatgtctgctgggtttcccctcccagctttaatctccttttctttcataggtgcgaatcataaacatgtacaaggaaattgatcaaacaccctacaaacaagagatcaatgccaagaacctaatccagtgttggagagaatgtatggccatgtcttcctactccttgaggaaagttgctgtggaaaagttcaatgcagagaattattggaagaagaaaggactggccatggtccccctgaagtttcctgttggccttggctcacgtgctgctggtcaggtgagttctccaaatgcacatgaggatgctgcctggaagcagccctgacaaagcaagaggtgttgaggaaacttctccttaagtcatattagccatatggttgcaatgcccaattgttaaatttcacaaaagccaccaaagtcaaagtaattaagctagctttactccagaggagaccagagctcctctgctcacatgcccatggttggtcaaaaacattcttgctggaaattgggagactgaggtttactcctggccctggcaacaggagttggcaaatggcagctgagtccatttgctctgggctcagactgctcatgtggaaagcaggagggtgggactgatgacctccaagactcctcttccagtgtccgcaattcggtgtcgctggaccatgaaatagaaatgaggagctgcaaggttttgggtgctccactccttctgggtgggttggaataaattaaattcagaaaaataaatcactttttaaatagaatttttgaagtttattcaccttgtaccttttaaaactgtgaaaggggggactgggaatctgctcttgcagtttaatttctttcattgattaaagaaatccccttgcttggttgcagtttccacctcttcattcttgacttcattcattcttaagaatgaataaaacttacccctaacggctggtgaaggactgcaacattctagctcattgtatggcagccgggaacccctattatctattttattacatacacacatccatgtacatacagataagctgggaggaccctcacaattgtcactcctctttgcagaattcactccttggttggagtcatgaagaaggcatggcagctgtgctgagcgatcacaaaataggaacaaatggcagggtaggggagcttcgagaggggcgttagtgtggatgttgtgtgttaagggatcagaagaggccaggaaaagtgggtaggaaggtcctttcctccatcccatatccatccattcacctaactgtcctagttgagctttggtgccatcctgagaacatttgcatgcagctttgattgtaggcaggtggtaggtcagagaagtgttataacaaatgatgatcttattgcagtcttctcattccttgcctgtttgtgatggcaaaaaataacacagagccatgtagtcatctgcatgcagtttactcaaatgtgggagacagtcaagatactgtggttgagaaataaaagcaaaaacgaggttattacaaaagaagagagaaagaaactaccactgggaaaagggtttgtaagcattgagtcttggtatagaattttggggtaaactgattagctggcagctaccaaagaggtcagctggggctgtctgtccttgtgcagactagtcaggatcatcaggaaaaacagcctccattgttcatggatcctctggaaatcctctcacgtttggccgtgggtaaacatggcgcactgcctctatttgatggctgccattactttatatctggcctccaccatagaccaggtctcacccattttcctcatcagaattttctcaaaaagtagatttgaaaaatatggtgaggtgcagtggctcacgcctgtaatcccaacactttgggaggccaagacaggagaattgcttgaggccagaagtttgaaaccagcctgagcaacatagtgaggccccatctctacaaaaaagaaaaaataataatagtgacaattactgagcactacgatgttgtaagtacttttaggtatttcatttaatcttgggacaacctagaagatttgtatcctcattttaggtataaaaaaaatctaggcttagaaggtttaaataactggctcaaggtcctgcagctggtagaggtaaggctggggctagaactcaggcctgagtggctctgaaagctgggttttctagttacaccacgtggtctccccaaaacaccttttgataggaactgaagtgggattcagctcagctgagaacaaactaggcaacagccagcagtacaaattcattcttgaaggccacctgggaaactgaccaacttacgtgctgaaaatatttacttagggctgaatcaaggagtttgagaccaaactccgtggagggcacatgctaaaagcctccattctgaaacaaactaaatagaggaggaaactagacatgatatttgagtgccttctccatggaaggacctgggctggggaatttgtaatctccacttgattattctctatctcatctctatcaggtaggtatgaatctctctatttcacagaaggggaaactgaagctcatagggattctctctgttgcccaaggacatccagccaataaatggcagaacaaggattcaacttcagcaccgccttcatcgtcccacagggcctccctgagcagaggcagtccctgcccagcagctgagggggtcaaacgtgccccacctgtgttatgcaggcataccttgttttactgcactctgctttattgcacttcctagatgctgcattttttacaaattaaaagtttgtggcaaccttgcttcaagcaagtctattggtgccatttttccaacagtatgtgctcactctttgtcaccttttggtaattctcacagtgtttcaacctttttcataattatggtgatctgtgatcagttatctttgattttactgttgtaattgttttggagcaccatgaaccacatccatataagacagcaaacttaataaatgttttgtgtgttctgactgctccacaaatagaggagcattcttcccccatttctctccctctcctcaggcctccctattccctgagacacaatgatattgaaattaggtcatttaataaccctgcagtggcctctaagtgttcaagtgaaaaaaagagtcacaagtctcacttgaaatcaaatgctagaaatgattaagcttagtaaggaaggcactgcactccagcctgggtgacagaagagaccctgtctcaaaaaaaaaaaaaaaaaaaaaaaaacagaaaagaaattgttacaactacctcctcaatcgtcagcaaccaccaccctggttagtcagcagccatcaacattgagaaaagaccctccaccagcaaaaagattctgactctctgaaggctcagatggttgttagcattttttaacaaagtattttaaaactaaaatatgtacaatctttttagacataatgctagtgtacacttaatagagtacagtgtagcataaacacttgtatgcactgggaaacaacgaaaattgtgtgatttgctttattgctgtggtttggagctgaacctgcaatatcagtgtacttacttcctgcagtctgaacactgaatggcacagacaggacctaaccaacctctgtgtgtccaatgccttactatggcacttggcacagagtaggaactcaaatgtctgaatggctgaaacatttggggaatctgcgggtttgaagctaacttctcatcgataccagtagtatttgtttgaagatttaaatttccccgactaggtcctctacttatgttggaggaccatctactccagctctccagttgtgcttgttttatagatgaagctttgcagaattatcttttgtggcactaacaatgagctgtacagtggtgccacttaactaaaccaaatttgacattttaaatggcccaaggagattgcagcaccacatggaacaaatggctgagtgatatctgatagacatgctgtcttggacatacaggctgaatgctataaccagcagggtcacacaatgttggaaaagtataatccactataattgtagcttaatcacatgggccaagtccaactatgaattacatgcacactttgcgagccaaggaggccaaatatggagtctacaagattaagaaacagattgcatggctatgctactgcaaatttacttaccaaacatttactgagcacctaccgcatgtgtgttgctatgttgcattccgagagattccttaggacgtgatccttcctttcagggggctcatattctagcaaagcacaatgaagtgccatggaatggggcccaggagctattgttgcagctggcatcacctgacatctgatgcatggcccccaggcagccagccctgggctctctgtagaggaaaactcttccttacctttattattttgaggatgaatgtccaggagcaaaagatggtgtttccaggagtcatgagtcaataaacagtaaaaaacactctattacatcttcccaaggtccttgggtgtcattatcatggctactatgccttcctcaagagtctaagtttctcctttggactgtggacatatgtgcctggtcctcagagaaagggtatcctgatgtccccatttgcccagtacatccctagtttacacctgccgaccaaataaatggagtgcattttcactgtcaaacttgccttatttggaatgatagaggtttctggttgtcattcacgggggtaatgtgaacctttggatacaaataaagagacagttctccaagcatggtccacggtccccaggcagcttggaaggcccttctgatgggcagagaattgatctggaaatgcagtctttttcttgggtttatctggtgattaacatgcagttccatcgaccttcacttaatgaccagggttgcttacaaataatctaagtgagcaactaaggcttaggaaaatttttggtttattaagttgacattggcttattaccagaattttctgaagaccttgacattacaaatcctagattattatgtcactctgcctaaaaaattagatgtgaagaaacctagctgacccagaccacacccatgcggtcagcacttccctgctgcaaaactgtaaaggttgccttgcaggctttcccggaccacagtggaaccactgagagatatctgttctaggaggaccattgctgctgatgttgctcttacattgcagagccaaagggaagaagccatccttctttcctgctgtgattttctgggatatccccatattctagtttagcacaggcagatacgcaagaaggcacattcttgttaattataaaaaacatgtttagcttagagactggatgtttctgattataagagtctttaatgctgttagcagtctggttccttctggatccttgtggggagctatacagttagataagattacttccaagttcttgtctaactccaaagctctgtagttctgtgccaagatgatttagggtgagcttagtcattttgcagcaaaacaattttagtgtctatctatctcatcttatatgggattataagaaaatggatttccattttcatttttctgggacatgcctacaactatgagaatatgtgtgcacacaattattcaccctctccctctacctgtctatactttactttgtattttaaaatagagtccccgccctggtttcccccaccccaaaaagaaacctaaaatgttgctccaccctggggggtgcgggattcttggagggaaatatttccaaggaaaatgttttaattgacacgatatgtgataatatcaaaaagatcacagaaacagttttcgtcttttctgctcaggctgctgccttggttcacatttatcttgatggctctgtgctggtcactcacggtggaattgaaatggggcagggggtccacactaaaatgattcaggtaagaatgcaaataactcgattgagttgggtgtgtgcttatagatctgttcatgagagaaaaactatgaatggatattttctgttacaaaatacaggataggaagctgggtgaggtggctcatgcctgtaatcccagcattttgggaggctggggtgagaggatttcttaagtgaaggagttcgagaccagcccagggaacatagggagattccatctctaccaaaaatatatatatatatatatatatatatttttttttttttttaattagcagggcatggtggcatgagcctgttttcccacctacttgggaggctgaggtgggaggattgcttgagcctgggaggtcgaagcctcagtgagccaattgcaccaatgtactccagcctcggtggcagagcaagaccctgtctcaaaaagtaaaaataaataaaaaacaaaggataggagatttgagctttgacagtttactctgttaaatgattagcagaaactgggtaaacaaaccaattttgcaactaaacccctaaaagaatgtggcagaagaatctcgagttgttttattgctaaagaaaattatatgcttatttgctgctttcctttggatatagtgacagttgagttgtcctttctgagtttttcttgggcaataagataatgtgtaaattctgatgtatttggattatttcttgccctttttgtattacaggctccgaacaattgctaatataaatcacctttgatatttacagtcaaactttatctgtttgcttttggctgtcttattttagattaattttaagctactgtttctcttttgttaatcataatagtaacattatagattataaaatatttggaagcagcagaacattttaaaaaacaaagaccctacacagtttcaccacatagaataatcattatttgggagtctttacatcttgtcttttttgcttttgcaaaaaagtcaccaacatgcttttgtttaattttgtattctgtttttccacccactttatatagcgtgaacactttctcctgtcattaagcagtctttacaatcatgaattgtatgtggctgcatgtggatacatatatgatttatttaaccatcccccagttgtttgaatacttcagtgaatatttttgtacactaacctgtgatcaaatcattgattgtttcttaaaatagacttctgggaatagaattactgggtcacaggtgtgaccattttaaattgtttgacacacattatcaaattgttttccagaaagtatccctctcatgacacccctaaccaacagtgaatgttatggattgttgaaaatttgtagataatttgataagtgaatgaaagtatctcattattgctttcatttacatttttctgagtataaagatgttaaatacatattttctctcagtcacttgagaattgactttccccattggagggtaagatttcagtgttttccttattggatcaccagagactttgatattctaagcctattgcactctgtgtggatgatctgagagccagacctcatggaagggctctgtatgcctgtgtccttgtagaagctgtgggcaagcactttcaagccatgctgctagcaggagagaggcaagtttgggatcaactaaagttagcaatatgattttgctctctagcgctaaaaataaagaataaagcagccagctaagtccttgtgttggcacatggcactggcgccatctcctgtgacccacatgttcatgccgttgcttttccaaggccatcgtcctttctcataggaagcactctttccctggggcaactccagaaatgtggataggagatagacatctcctatcattgataaggttctgctagaattttgcagagtgtggtcgtaggagaagcctcaaagatgtcaatatcatgattataaaaacaagaatgaagcatttcttcctgccttggcctggggcctcacctcctctttctgacactatcaccagaaagtcaaagaaaaagaaagtgtgttcaggacttggggtccagactagctataggatttttagaaacaagaaacttttcatggctggaggaatttgtggttctgctcccttgtccctgtcatgggtatgagggtatcacacatgtgttaccacgtgggcatgtgcacaggtctgtgactaatcaaagtgtttaaaaggaaactctctcttaaaattcaggtggtcagccgtgaattaagaatgccaatgtcgaatgtccacctgcgtggaacaagcacagaaactgtccctaatgcaaatatctctggaggttctgtggtggcagatctcaacggtttggcagtaaaggtaacagtcactgcagtggcgtccaaatcattaactccctcagggccaaatacgtgggtgggtggagctccaaagatgctgagagttaatccaactcatatctccttccccatcttgccctcagtcagtggtacagcacccagtggttctcctgtgctggaaatgccacctctttttctccctcactcctgacatttttctaatcagcaagtcctttcaagtctactcaaaaatgtctctgtctttctgcttccatattatgttagtatcactttaagacaggctcgcgcctctccccagggccgatgcaggacttctgtctctccaccacaacttcattgccttttgctctagctttctgctgccggagtgaattttctcacaaaataaatgtggccatgccatgtctgaaagcaatggctggtggttttccaagaggttttttattaagtcttgactttttagcatggcttacaaggccagttctctctctcacacacacacacacacacacacacacacacacacacacgtgcacacactcatatgaaacctttcatatcaccttcatacagggttggtgtcttatttttccatgttccctcttagataagcctatggaatggtacatattatgttgttttgaatttggtgtttgcatgaaattaggagcataattttaatttaaaaataatctctaggatgcctgtcaaactcttctaaaacgcctcgaacccatcatcagcaagaatcctaaaggaacttggaaagactgggtgagaatcaatggttctctgtattttattttagaagaaaaaggagtgggaggagagcaagagcaatgtgcattaattgaaatctgtagaaagggcatttgcaaaggtaccaccattgtgtaatgataaataaaaggccctttggctcttagcatgtggaaatcctatcacagtgtggtggaggaactcttgtatctgggaaaattttctgttagagaaaaagatggttcttctgccagaactcctgttttaatccagaattaattaatgtttcatcctatgtagcctaggggttgtctagataataactgtacatctgttttttctctttctttgggttctgctgttcctaaaatagaaaaacaatagtagaaccactctgtaaaagtaaaaatcatataagcactcgtttagaaataggaaaccaagccagtgggtatatgttcatccagtaataggtactcaatggaatggaaatactcaactgcttcctttgatctgcttataatctagttggaaaagaagacacattctaaagtcagctaacaaacttttcaaagtaatagtttatcaactaccagatgttgtggaacaaatatccataaaagctgggagcatgtgtcacgctggctattctagaatgtcagtttttgcaaccttacaaatacaggtctgggggaaataacatttgaggatcccacttagaaatggtttctgctattccatggagtaaggactcattttataattcatatttatgggatctgtctatacttcctgggcatatttgtttctgtcctctgtcccatgctgcctgagcccagaaagcctgagtcagtgtggctggagaaagctggagagaggtgcagcatggagagtagtactccaccaccatgagatgcagccattcagcccactttcttcgctaatgattgatgtgcttctgaccttcattcctagacttagggacttggacctgaccctgatttttgtgcatagtagtcagctctgtgtactgcagagttttggtgtaaatggtacaatttagcaaaattattcccctcacctgaaacaaatgtgtccagaaaggattgacagttcccataaatatgaattataaaatgaacccttactctatagactagcagaaacctgatattaaaattaagcagccaaccaagcattgttttctaaaatgtcccatcttaattgaaaattttctgcagatgactgagtgaatttcttcctaagtggaacatatgttgatgactttagtccagcctgtatcataccacagcgggcatttagtacaatcataggtgctgaacaaacagctacaagccgtgaaccacagaggagaaagccaaaaggaatggattaatctgggtccttcctggttactattgctgatagttttatttaacacacagggtaaaattaaaattgaagtcttgagtgattctttctttgggcatccttgttgcatcatgctatgctcttccttcacaggcacagactgcttttgatgaaagcattaacctttcagctgttggatacttcaggtaaatactccctctgatcacatgctatggagaagaacagtggtatcttgaggaagagtttcagttcccttgcaattttggcaaacgttgactttctaccttctatttacccatggttataaagaacatttaactgctagttaatccatggttgtggttataaagaacatttaactgctagtatccagaaagacttctgttaggaaaaataggcacacaaaattcagcttaactgatgattctaatcatagtgggtggtattataaggctctctgtggttagtacttggaatactcggcagtggttgactttttgttgaaaacacgatctatctcttaagaaacaaaggtaggggaaagcaaattaaacccataagatgggtaccattttacaccttcaggattggcaaaaaagaaattggaccataaccatgttacattaagatgtgaaacaacaggaactcagtgaatctggaaaacagtttattaaattattttaatggaaagtgaaagctgtctgagagcagggtgatgtagagccttacctggtttgatcactttgccattggtgcgggacctgggcactgactgcctgtcaggaacaggcattggaagcatttttaatggccacctccaggttgcagggcagcagaggagagagggtagagagttctgcaagctgctgacccatgcttctgttttaccattatttatttgatgttcttaaagattagttaggaacagagcaggccatggagcttgatggtgagagaccagagtagagacaaagaatgggagccatgggacctgatccttcacacagaggggcaaattctggagccagaaagatagacaaagcaggcaagcatgcacctttgaaatagcgtttggtgtaaaatgaaggttgagttccccaaatctgatgatccaatattagccaaaagcagtaagatggacattcaggaagtaagaagctaacctccaggagtaaggaggcaccagtcaggagtagttagatgtttttatcagacaaagcaagttttaaaagaaaaaactaaatacttatttattcaacacatttatcgcacatacattaggtgctggcacatacattaggtacaggtatattcctgtggcttgcataaatcctcatgggtctgtttagtcatcatggtctgcaattaggggacgtgatcacttaacaacactcactgtttcttccagaggttatgagtcagacatgaactgggagaaaggcgaaggccagcccttcgaatactttgtttatggagctgcctgttccgaggttgaaatagactgcctgacgggggatcataaggtcagtaccggttggaaaggtcttcaagttgcacttaggatgcacctaaattccacagatgccatctatctgaggagagcttagtgagtggcagcatcgtgcatttggcctaagggtgatttccctggattaccagaagaaaatagaatccccacaattgccttggtgatctggttgctgccatggaaaacaactggtggcctgtctttatttccctggcccttttaaatggaatcaggaaagaaactacatgaagaaagaaacatgctctaaagggggctttcatgtagactattggcacaaccagcaattctgactttttatgagaaatgccaagatatgacattcttgaaggatttcatagacatctgtaatctgctaacaagcaccaagccagcccagggcaggtagtggccacttttttatatcttttactcagctaggtcttgccttttagaagtccagtgtgctatccattgtgccacagagctggcttggtcttgctttttagatagtttaagagcatccttatgctttcaagggatgctctgaagagatacacacacatacacacaaacacacacacacacacacacacacacactctctctctctctctctctctctccccctctttctgtctctgttgcttcaaagactcatagaatttctcctcttgtaccagagccttcgggagtaaaagaagccacttactggtcactgtcaatactaataaatgatcactgatacattaaatgggactgtgataccctaacaactgtcatgtgaccaagctaccagtttagtgataatctcttccaaaatgtacctagaagcaagctctagttcttgatatttacaaatatcctctatgcctgtgttcttggattgtgatcagatttaaattttcatttaataagtctccagcatgtattttttaaaactatagtcaacctaatctctgaaactatggtcacttttattgaacctgccttttcaagtatctaacctgtctggttctaattcagactggatctctatagggtaacctcgcactagggcaaaacagtgatcactttgagcatggtttttgtgttagactagcagccctacactactagggagcgggttcttgcatagaactgatttctgtttgtttgtttgtttgtttttgagacagaatttcactctgtcacccaggctggagtacagtggcttgatcttggcttactgcaatctctgcctcctgggtttaagtgattcttgtgcctcagcctcccaagtagctgggattacaggctgcgccaccacacccagctaatttttgtatttttagtacagacatggcttcaccatgttgcccaggctggtctcaaactcctggccttcaagtgatccacccaccttggccttccaaagtgctgggattataggcctgagccactgtgccctgcccatataactgatttctaagtcccttctccctcaaagcaaaagttggtgaaaacttagtcatgtggattttcttatattcctatatatgcattgtccttgttaagatccaagaacaaggtaataattagcctagtatgaaattttaaggcatgttcctataacttatttgaatgatcttaggggatgtgtcatatagcctcatcagatgccttcataaaagctaaatctcagctcaggttagtgtcactgctaggcaaagggccagaatgtgacattctaccaggggccctccccaaaggcctgtttctcagccattctcctgttgatagacttgcccttattccggcaaaattttcctcactttgaacctacatctaaatatcagttacctgttctgtacaacaaattacccccaaacttagtgctgaaaacagtggatgctcattagctcacaccacttctgaggggctggcctccgggagtggcttatctgggtgattctgcatgaggcttgtcaagctgtggctggggcaacagtcatctcaaggctcaacggggacaggagaatcctgttccatctccctccatcatagcgttgttgacaggaggctcagcttctcactggctgttggccagaggcctccattctttgtcatgtggatacctctttgtaggctgcctgagtgtcctcaggacaagacaactggcttcctccagagagaccagcccaagagaaaaagagagagcatgtgcaagcgagagagtacccgagacagaagcccagctttataacctaatctcagagtgactactgtcacctctgccatagcctactggtcaaacaggctggcctggtagagtataggaggagactacatatggatgtgaataccaggaggtgaggattatccagagccatcttttaggcagcctaccacaacctagatccactctctccagtcctaacaaaagacacgacagacagcactaagcctacagctttgtgggttgtttttttctgttttgaggtggattcttgctctgttgcccaggctggagtgcagtggcatgatctcagttcactgcagcctctgcctcctgggttcaagtgattctcgtgcctcagcctcctgagtagctgggactacaggcacgtgccatcacccctggctaatttttgtatttttagtagagacggcatttcaccatgttggccaagctggtctcaaactcctggcctcaagtgatctgcccccctcggcctcccaaagtgctgggattacaggcataagccagccccaccagcctaagcacacagctttgaaagcacaaccttcactaacactgaagactttagagctcctcctctaaccttcagctgaggccacttatctcctggaaggccagtcttgctgactgatgtcaaagaggactttacattttactgtgtgtttaaataagaaatgtgagttcctgaagttttattattgtcaaacattccagatcattatctaattttcaaatgttacatgaaagtcccagatcaaataaggaaactcttggatttcttttgttcaattagtaattataagaacaatctgttagtcatggcagagaccattatatcacattaaaaaaaatgtacagacttgctggaaagcaaaggtgttactaacactctggctgggcctgctgtacttctcctcatttgtaggttatcagtagcaagttgtagtgtcaactttattctcttctctgctacaaaaatgaaaagtctagaacagcagatgacaatttgaagacttttttgttggtgcaccctgaactctgtggttcagtaaacattcctcagccagttgtacctggatgtttggttgtatgctagccattaagctttgcaactaggatcgtgagggccatagatgttttcttttgttgtgtcatatgttatatctgttgtagtgaattaaactcaatctgttgcatcatacagcttgaatcaaaatgaagtaaatatttttttctcctattatttccaagaaaaaaagacagtgcttcagctggctaagagtatttgtataattttgaaagttttacataataaactttgtcatataataaaatctttgttgcttctttcgaaatgacatggctgaaagaaaggctttataccaaagtcagcctggcaggaagtgttcctcagcttcttctccctaagttattctcattaaaataaacattttaacttttttttaatactagaacatcagaacagacattgtcatggatgttggctgcagtataaatccagccattgacataggccaggtacgtgtaactgatgtgtctcactttctatttgtaaaagccaaaagtgcggtggggtctgcaggagagcattccatcagtcttattcatcatcttatttttctaaccctttagtcaactctattcagaccaactgcagagctcaaatgttttactgtttaaaagggggaaggaaataaaggtgttttaggtagtttttgaagaaacataaaatctgtgactagggagcttgaatgaggcaagaccaagcctacaggtgactgatgagctccaaacttctgggacataagtagagttagtgcccagtgctgagccttagccacacgatgggcttcagcttcgaggagtttgaagtcgtgttgggataataagcctcaagtcatcagagcagtagctgttggtaggcagcctgtagtgctggattccacccacagacattttcaaatttaaatttgaaatagttgaaaagattggaaagtcataaatatctagtttctcttgaaaacagaaagtttgcccacactggatcctcatttccatgagtgaagtcggtgggctgtacctttagagtcccacactctccaatgacacaggacccacctggaatcttcatatactgggtttacgtgtctcgaacctggaggcaattcagctcattacctctgatttagggcaccatcttgtgtcccctcccccccaccccccgcccccaccatcatgacattgcattattggcgaatgggaagaatctgtggtgtggagaagtcaaaggaggcttagggaggaagtgggtgtgaaccaggttgtcaaggaaagaatgagaaacgacattaggggtgaaagaagagtggaggaagtcaccctacagaaacacatggaatttagcatgcctgttcatggctgctaatcaggccagggcagatgactatggggaaggcctgtgtgggaggggtgggccatgaggagggagtcagagagcagaagagggctggggactgccaggggtgggtggagggcttttagagacaagacttcacttagtggggatggactgaagtgtttggaagactgatctaaaatcagagtccagagatgtgaggctagccactttgtgggcaaggaggtgggatgagacaatgggattgtagcattcactagcaccctggggtctctggacacatcagtcaggggggtttgtctgcctcatgggcaaaaaacaaaagaagagggtgcttgggctccagactctgtgaagactcttcctgagcactcatttcaatggccaaaccaaaattagaaccctagtcctttgtctttgaccttctttttttcatgatttttatttattattattattattttttttttttgagactaagttttgctcttgttgcccgggctggagtgcaatggtgcaatctcagctcaccgcaacctccgcctcccaggttcaagcgattctcctgcctcagcctcccgagtagctggaattataggcatgcaccatcacacccagctaattttttttgtatttttagtagagacgggatttctctatgttagtcaggctggtctcaaactcccaacctcaggtgatccgcctgcctcggcctcccaaagtgctgggattacaggtgtgagccaccacgcccggctgactttgaacttcttttaacttaatgctgaacaaacatgtttaaaatggcttttagataaactttcagcaacatgctccaagacaccctgaaaatgctcttaaactgtaattttaaaattcaagcaaacagcatgaagttgaaatgctacttagtgttgactgtgttttctcatacgtggaaattctttttttgttcttgcctcagattgaaggtgcatttattcaaggcatgggactttatacaatagaggaactgaattattctccccagggcattctgcacactcgtggtccagaccaatataaaatccctgccatctgtgacatgcccacggagttgcacattgctttgttgcctccttctcaaaactcaaatactctttattcatctaaggtaagtaatgttctatgggtaaatatgcatgtttatatgatacctgttgggtgacaggaaggctacattcctctcttggctgtttgggatttttaccaggattgcagaagaaaaattcttattaaacattttaattctaatctaacattatgataaaaatttttagtattccaaatcttagaacttaacatcaactactattgccatcaggttctatctaatttttcaccttgcaataatcatcttcatgcctaataatcatcttctgtatgtaggtcatttcctgaggctagaattctaagaatgggaatattggatcaaaagattaaattactttttgaaacaaaaaatttatataggccgggcgcagtggctcatgcctataatccaagcactttgggaggccaaggcgggcagatcacctgagtccaagagttcgagaccagcctggccaacctagtgaaaccccatctctgctaaaaatacaaaaaaatagccaggtgtggcggtgcatgtctataatcccagctacttggaggctgaggcaggagaatggctcaaacctgggaggcggaggttgcagtgagctgagattgtgtcactacactccagtgtcatgcttgggcaacagagccagactctgtctcaaaaaaaaaaaaatgtacatatgtagtacgtaatatttttatatatgcacatatgctataaatatgcacatatatacagagtgagagagagaggtataatctagttggcatgcttcctttcaagggtctgggagagtcgggggtgttcctggggtgttccgtgtttttcgctatccatgacgcagtgagtgcagcacgacaggagagaggcctgcatggacccttgacccttaatagtccactgaccccggagaagattaggatggcctgtgaagacaagttcacaaaaatggtacgtttgcatggtagaaaaaaaatagtgatcataaaattctgaatttttggcctctgttcttgtggtaagttttcgtgaacgcactgctgtggcttttcttgccagaaaaggtgacgggaaacctgggggcatttgagcagatgtgcagaggggtccttgaacttgtacccctcgggttgcattttttcatcagcctgcccctgcttggctccattctatactatttgacaaaagaaagttcattcccattagttttatgttcctctcctgttttgctcccttcctaggacaccttggtcaggaatagaagttcaggaactatgccctgaacctaggacacccagtccaggaatataggcccctctgacagtctgcctccaccccaaccccaaacgggcacccggaaagtatgctagcaggaacccctcccctctggcaacagcgcccatgccgagcagacatctctaccctccttggatattttcagggacagggtttttaattgtggaagaaagtcatactgttcacagttaccaccctgactttgactgaagggaaagcccctcccatcctccactcacactggctctttgtggtatccttcatggttttccctaagcccctgacacgttgctttttctactctggagaaacagagacccactccacttttcactgggtggtcttcaagcgtgagatgataaccccaggacctctccagtcctcccctggcttcctctatacttcacaggctgttgttccctgacctgtcatggccctggttgccctctgctggtgtttaacctactttatgttcttctatttttcacctaagtcacaaacatttcccaggtttgaacatccagatttgtttttattttagattccgagagatgaacctggatcctacgttccttggaatgtacccatctgaatcaaatgcaaacttctggagaaaacagagtgcctcttcccagatggcaatctgtcctatctctgtgctggaagatgctagatctgaaagacagagtttccacagttcagaaatcatcccacagtgttgcttttctatggagctgatttaaagtattccatttagatttgatagatatgcttaagcaatctataaatcattttcaatgttataaacactaattggtttcctctagggtgatattcgtcattactctgtctcttcaatccatccagctaaatggaataggtgatgacttgcatgtgactcctacttggcttctatccaccaacagaaattataccatatagtgaaaggcaattttctaaataatttcattactaatatgaactgtgaagttgtcattttttcatttgtccttttctgctatcaccttcctcttgtcagaatgaatatagacactgtatctaagtgggaccaaagaaaaaatagcgaactttcaccaaagttttcatgaaaacccaaaagctttaaaagttactatcaagaaattgaaaggaaacccacagaataggataaaatatttgtaaatcatatattgataaaagtcttgtaaccagatacataaagagctcttacaactcaataaaaggcaagtaatttaaaaataggcaaaagaattgctggatggtatggtagttctatttttagtttttaccctaactactctgacttgatcatttaacattctgtgtatgtaacaaaatatcacatgcataaatattatgtatcaataaaattttttaatgggcaaaggatttgagtagatgtatctccaaagaagatatataaatggctagtaagcattaaaaatatgctcaaactcattagtcattaaggaaatgcaaatcaaaaccacaatgagccaccattttatatgcagtaggatgattgtaatcaaaatgatggacagcagtaagtattggctaggatagggaaaaatgggaacacttatccattgcagggggcagtgtagaatggtgtagatactgtggaaaatagtttagcatttcctcaaggagttaaacatagttaacatagaagttaaacatagaattaccataatcttaggtatatacccaagagaatttaaaacatatattcacccaaaaatgtatacataactgttcatagcattattcatagtatcccagaagtggaaacaactcaaatttccatcaactaataaaatgtggtatatccacacaagagagttttatttggccatataaaaaaaaagcactattacatgtgacaacatggatgaaccttgaaaacattgtctaaatgaaagaagccaggcacaaaaggctgcatattatatgattccatctatacaaaatgtccagaacaggcaaattcacagacacaaagtagattaatggctaccagaggctgctgggaccacagactgctaatggatatgggattccttttcggggtgagaaaaatgttctagaatgagtggtgataattttacaacgtgtgaatatactaaaaaccactgaattgtaattttataaaggtgagttttatggtatgtgaattatacctcaatttttaaaaaagtatctgtggagagaaacagaaaatgtgggaaagattgagaagttgtgagaatcaagaagcctgtcccaatcaatggctttccaaaaacatggaagcctcaaagggaggctaaatagcaaggcatagtcaaggaaaaacgccatttccgttaagagcagagagaagtcacatggatctctgcctttaagagcagattttctcatttataccacaagtatttatagagcattttactctgtgccaggcactgtactaggcacttgagatttatcagcaaacaaaatagacagagatccctgtccttgggaagatcctattttggtaagggcaggcagaaaaattttaaaaataataagtaaattacaggagtatggttgatgcttgagtgctaagggaagaagtagaagtggagcaggttaaggccaatggagagtgatggagcaggtggcaggttgtggttagaataggtcagagaaagccctcctgaggaaatgagaatggaggctgtgagctaagcaggtatctggaggaagagcattactggggagacaaggcattagagcagagtctcttgcaagcaagtgtgcctggcccgtttgtggagcagcagtggggcccatgtggctagcacagagccagggacgggggcagccatgtagaacctggaggccgctataaggacttgagcttttaatctaagtggctgcagagcagaaaagtgacatggacttgcttctgttgcaaaggattatcctggatgctgtgctgatgcaggtcgtgggagggcaaaagtcgagggtagatgcctcctttctgtccctttgccaactcctccccctccagcccacctctgtaaatgttggaattctcgagacagccatgggccctctttcccagtctctctgcctggtgggtggctgcctttactcccatggctggaggtaactctcttgcttaagctctggctctgtaaacccaactcttgcttttcattgccacttggatgtctcaaaggcacttcaaacgtcccaagcagatctccttttctgtacagccatccacaggttgctaggccggaaacgggaaatgatctgaggtgctctgttctctttgcgcacacatctattcaggcacgaaatcctgtcaatcccacatcaaagacagttcctgaatctgcctctcc

SEQ ID NO: 17279 - DNA, 18466 bp, Human
aaaagaattattccatattaagtgcttctatattatacaatttctccatcttgccactgcaatttccatgaacttttattgcccttgactgaatttctaaaaattacttataatgaaagacattagataaaaattgctcaaaacttaccatttttcctcttagtggtttcaggaaggactacgtgatttctcagtcttacagcgagctcaaaaataagtctctagtcccaaaagaaaaaaagaattaggctcattttcctgtcttaactcacacacgctcatctttactgaacattttaaataaaaacctcgccgggcgtggtggctcacgcctataatcctaacactttgggaggccgaggcgggtggatcacttgaggtcaggagttcgagaccagcctggccaacatggcgaaaccccgtctctactaaaaacacaaaaattagccgggtgtggtggcaggcgcctgtagtcctagctactcagcaggctgcggcaggagaatcacttgaacccaggaggcggaggctgcagtgagctgagatcgcgccactgcactccagcctgggtgacagcgcgagactccgtcaaaaaaaaaaaaaaaaaaaatcctctaatggcatcccctaggtaataaaaacccggctatagaagatatcctacccgattcaagcctcccaatctcctacttgcccggcttgctcttcttcaagagcctccttgcaagtcccccaataacccagataccttcccttagggtccaggcattgggtgtcccttttgcctggaattcttatactcagacatctctacggctaatttcctcacctccaaatttctgcttaaatgtcaagtttaactgacctgacaatcctacacagaactgctttagcccttcagccctaggacattcctatttccttctcccacagcacttatcactaatatactatgaaattcgctttttttttttttcaccacagcacttatactaatatactatgaacttttttttttccaccacagcacttatcactaatatactatgaacttctctttttttttcattttgagacggagtctcgctatgtcgccaggctggagtgcagtgcggcaggatctcggctcactgcaacctccgcctccgcctcccgggttcaagtgattgtcgtgtctcagcctcccgagtaggtgggactacaggcgcgcgctaccatgcacgactaatttttgtatttttagtagagacggggtttcgccgtgttggccaggctggtctcgaactcctgacttcaggtgatccgcccgcctcggcctcccgaagtgctgggaggccgccgtgcagggtccttcttttactctgacgttgcaacaacagcctcgccgcccactgttcactcgcagtatcccaagaactaaaccagtagcaacacagaactcagcaagcattcgaataagtgaatgaaagaattaatgacgttactccatacttgggcttcaccacttcgtctagcacagccgttgttaaaacaggaaaaatgcaatcgcagatgccagcagaggtctgttggttcaaaattatagtttctttgggccagcggaagttgggcgcgggacccaagagagagaacgccccttaccgcctcacctccttcctcccctcatcttcctatctcaaaccaaaacgacaatgcaatttatccccaaccggaaatttgacagtgaaagggagctctactaataattgcactgggacaagaagtgtaaggcgaaactacctgggcaacctcaagcaatgctttacactcggctgccaaacggaaaggaccacttccgcccagctctcccgctacggggagccaagtgccacagcatccggagcgccgacgcgggaccggaagtgacgcagagaagtttccgggactggtgagtagtgggcgatttaaaaacccgcgagtgtagttgtgaccttcgcggtaggtgccggttggggccggctgtgattgttatcttggtgctgcagaggacagcagaagaggagattgggtcagaaaactgccctgccgcaccagagcacagcgcactagtgggacaggggtcctgactcagacttaactggctgtgtctcgtggtttttcactgtcctggaaaaggcctgaagtggcactgaaatgaggcatagatgaggtaacgtcgagggagcggtttgcaggttgcaaaggggccctactgatgctgcttaatagtaaacagtgcttactctaggacgggagttgtttccagctttacgtgtaaatctcgcgatattgtggcctgggcactatttccattaaggaggaaactgcacaggataagtcatttacctgctgttgcacagctctggctctaggattcaggctggcttcagagtcggtgctcttaaccgccatactatgttgccttctgttgtcgttgttgactgtggccatgtagcttcgcagtttcctcatctgtaacagtaaataactcaaaacctgcatgatggcccactagggtttcactttcgagcttgccagatgtagaaaatgctggagaatggagtactatgaggaccattagaagatctttcaaggccggacgcagtggctcacccctgtaatcccggtactcttggaggccgaggcaggtggatcacttgagcgcaggagtttgagaccagcctgggcaacatggcgaatccccatctctactaaaaatacaaaaattagccaggtgtggtgtttagcgcctgtagtcccagctgctcaggaggctgaggtgggaggatctgcttgagctcaggaagtcgaggctgcagtgagctgagatcacgccactgcactccagcctaggcgcctagtgaaaccctgtgtcaaaaagaaaaaaacaaaaacaaacttccaagacctcgagtggtttttggagaccctgtatcacttcaaataatgtgttaaacaagcatcttcatctcattaaatagaaatgttgaaaaattgcttttggaataattgacttatggatatttcatcaaatttacagttggctatgctttcttattgtgcatactatgaaatgtttttcttcaaaaagtgtttataagtggtaagtttaagaatggggttgacagcattatcttttgtggttatttgattaaacatttactaattgtgcatattttggagccagcagtttttttctacctttccattgccctcccaccttccctctgttgccaaccttttcagttccttgttggatgtagatacttagaaggcttacaggctgtctgggaaaagtaccctataccttatcccctcccacctcttgagcctggcctttgtgtagcaaatgttgcttaaggggcagtggcttctcccttcttctgccttgaccctgcccatttatagagtgacctgcctatgtattccttgatttttgattctgataaagcacttgacattttaaacattctttttttttttttttttctttttgagacggagtgttgctctctcgccaggctggagtgctgtggcatgatcttggctcactgcaacctccgcctcccaggttcaagtgattctcctgcgtcagcctcccgagtagctgggactacaggtgcacaccaccatgcccagctaatttttgtatttttagtagagacggtttcaccacgttggccaggatagtctttatctcttgactttgtgatcctcccgcctcggcctcccaaagtgctgggattacaggcgccccgccacattattctgttttttggtaaagcacattgtaatgccagtatataccaccccaactccaaattctgttgcaatcaggggaggcgggcagtgtcattctatgcagtaagcatttagtgctggcttatattagtgatactgagatttattgaagttagttcctattacatagtagctttagcataatgggcacacacagaattatgagaatactgaggggtggggagccttgggaaggatgctgaaaagggaggtcaagaaaagttttatttaagaagttggagggggcttgggaaaaggaaaggtaatatttagagaaatggattagggaggaggttggttgaagcaagggtagggagaataagaacaagggtgtgcaaggcaggagatgggatggacgtttgtgtattatgtaccaggctttgctaggttacataattcattagctcctctggatggcctgtgaagtgggttatagtatctctgtttcgtaggtgagaaaacaagattggagaggttaaatggcttacctaagttacagtgtgctggtaagtggcagagccactatttgaacccagatctctatgacgacagctcttttgcccatatgttttgatgcctcaaagatccaggcctaaagtatacctgtgtaccattttctttgttttgacatcagaaacttgaactttacctgatttctgtatgttgtcatcttgcgtacgcccagtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggtgagaagcctctttcatatttgatattttccctgcaaatactttgaaactttaggatgtctttccagtaaagttttaactgctttagggttggggagggcatgattccatttttatataataattttaaaataatgttgctgaaatttggcagttaaattgcatttgaaaaaggaaacattttttattcttatggagtaaggagagcagaagtcttccttactggactgagcttcatgattcctcacttttgtggcacaatgcctgtcacccaggcacttggaaaatgcttgttgaattgaaagctcaggcctctccagaatacacttgattgataagtcaagtaaatagacatcagggttttaatgaatgtttttagtgaatgtttacttatgcctagcacaatgagggaatgatggatggattttagctttattttagtaagtctttagtttactcattttgggctaaagcttttatgatgatatctggattaatgtggtcaaataaagtatgagcatttgcaacctgaatgatggtttacatggctagatttaccaagcagtagaccattctgtgtattatctgaaaatgtatgaatcagtctttcttgtccaagtttttcagagatttaagaatcttttggaaaataattctgaaaataatttgattttgtatgtccatgccaaagccctagattatggggactggtgatgtatatctaagggatgtgtgtatgttatgtaagcatgagaatgaatctttttaaaaagtcatttcttagaaattttgcctataatagtttacttttaaatcttaatctctcaccccccaaaactcccattttcccacaatattttctctaggagcttgtacctccaggcccatacatccttccaaagctcccaactaccctacagagggaaaccaccgagtagaattcaacgttaactacacccaagacctggacaaagtcatgtctgcagtgaaaggaattgacggtgtttctgtcacttctttttctgctaggtacaatttatttttctcttttttttgtgtgtatttattggtaagcatcttccttacaaagtctataaccctggtatttaggcttgaaacaaatagttttctctggagttgatttacaaagtagcatactcctcatttgtttgtgggtcctggagaactatggaattttttcaaaacaataaaaacggtaagtaacactaagtattttctatgtcaggggactatactatgcattttacctacagtatttctaatcctggtaatgttcaaagatagttgtttttactttagagaatacagatagatcctagtgatgtggtgataaggcttttattggttcccagcaaatcagtgattcccaagtgcttttttatatttatctttacattttaaatatatattttcataaatcagtctttttatttaacatcatgggaaatatttttctgaatagtctttttttgtttgttttaagagactcccaggctgggcacggtggctcacacctgtaatcccagcactttgggaggccaaggctggtggatcacctgaggtcaggagtttgagaccagcctgactaacatggagaaacctcgtctctactaaaaatacaaaattagctgggcgtagtggcgcatgcctgtaatcccagctactcaggaggctgaggcaggagaatcacttgaacccgagaggcggaggttgcagtgagccgagatcgcgccactgcactccagcctgggagacagagagagactctgtctcaaaaaaaaaaaaaaaaaatgcagatttttgtattcacctcagaccttataattagaatggagtttgcctgagaatctgtccaggacattctcaaattcaatgatgttttaaaattatcatctctaaggctttaaaaaaattcattttgccccagccccatttgtagatgttctgttcactggttctgtggaaggatccagcagctgttattttaagaagctagaaggaattttttttatttttttgagacagagtctcactctgttgcccaggttggagtgcagtggtgtgatcttggctcactgtaacctccgcctcccaggtccaagtgattctcctgcctcagcctccccagtagctgggactacaggcacccgccccccaccacgcccggctaattttttttgtatttttggtggagatggggtttcatcatgttggacaggctggtcttgaactcctgatctcaggtaatccacctaccttggcctcccaaaatgctgggattacaggtgtgagccactgtgcctggccttctttttttttttttttttaactttaattttttaataattaaaaaaataataagatagggtcctgctatgttgcccaggctggtgttgaactcctgggctcaagtgacccgcccaccttggcctcccagaatgctgagattacagatgtgagccactgcacctggccaagaaatttctgatgcacaatcgggattgagaacagttcttgaacagtggtttcaaagtgaggtccttggaccagcaacatcagcatcacctggaacttgttagaaaggtaacctctcagacccccacctagatataatgaatcagaaactccaggggtggggcccagcactctgtgttttaataatcctccaggtgattctgatgcccagtagagttagagaaatgctattctagaaaatggattagtttcagattaaatgggttctgttggttaaatccttggttccacataaatctaatctattatagtaggtttgtaaactgtggattatctaaaatacattttggctatatttgtcctaaatggagtgatttttcccccctaggactggtaatgaggaacaaacacggattaatctgaattgtactcagaaggctttgatgcaggtggtagattttctttcccggaacaaacaactttatcagaagacggaaattctgtcactggagaaggtaataagaatattttgtatttgatcttaaaatactgtgcacacattttctaacagtataattgaggtataattgatatacttaggtatattgaggtataccttattgaggtataattgatatactaagaattgtacatatttgatgtgtacaatttgatgaatatcattactttgcatttttcttcagcaaattcatttgtaaattattagatcaacaggccattcactgttatctaaagtacaaaatggcaatgagagcataatattctctaggaagtaattgagaaagggagacattccaggaacaggaaaatattggtacgtcttcagggttacagatttggttacaggtttgctgtctccttattttacacgctctgcctggaccatgtcattcacttctttaacttgatagccatttgtatgatgatttctatctttactttttggcttagaatgctttcttaagggaaaaaatgacaagaacccatattttcatctactttctggatgttttgcacttacagagcccacaagtatttcaaattcagtatatccaaatactttatccgtttgccacccccgcttttttttttttccatatttcatatttcagtatcattatctactttagtttccaagttttcacattcctccttgactccaggccctgctgagtctggcctcatatctatacagtgtttctcctctgtattggctctgccaccacagtagttgaaactctcattttctgcgatgagagtagtctcaccgagcacctaggaggcagtccaggctctttagcatggtgttggaagcccttaatgatctgctacagcctgggcctccagcctcctctccttccacagcatgtactctgcacagtagccatactgtcttcttttggatctgcccccatagtgtgttctctcaagtttttggcacctttgtccatgtcctctgtgtttagaatgcctttctccatctcatcgtacctctgtcctgccacactgcacttgacatcacccctttttaaactctttatttccccctttttaactcttttagggttttctctaagacctaagtccttcctccaagtactccccaagcctcctaagtcacagctcatttagtttgtcattctttgtgctgctgcaactgtagcacctaccttgtatttaaacagttttattattttgtttatttgagacagggtctggctctgtccccaggctagagtgcagtggtacaatctcagctcaccacaacctctgtctcctgggtagctcaagcccacctcccattcagcctcccaagtagctgggactgcaggcgcacgccactgcctggctaatttttggatttttttgtggagatgaggtctcactatgttgcccaggctggtctcaaactcccgagctcaaacaatccacccaccacagcctcccaaagtgctaggattataggcatgagccatcgcgcctggcctgattattgatttaaacatctgccttcctagaaaactgtgaactcctagaagaatgattttgtcaggtttgtatccccacatttagcctggagcttgctatagtaatctcacagtgtgcatgttgatgattttagcatttgttgttttaggactaacaatgcacaccgtttctaacttctgtttctcctcagcctttgcttctacatactggaatgggacggttatgcacactggatgaatctgtctccctggcaaccatgattgatcgaataaaaagacacctaaaactatctcatattcgcttagcccttggggtggggagaaccttaggtaaatatagctccttcatctatccagtatgcctactgttaacattggacaaagatcgaaactcttggttgtattaatatgtgatagagaatgtgttagcagctcataggagataattggtttacgttattgattagggtgggccaggttctgatgtggaatacatctcattgacttaatcaatgagatttatttctctgtcatgctatgtgttcatttcaagttggtcattgtaggaagtctgaccattgtagactggttgctgttgcagagggagggagttttgcagggtcttaaaccatcagtttaaaattccaggaaacatgttaatttctgctcaactcattttccagaattagtcatgttgcccaatacaagcaagggaggcataaagtgcagtcttaccatgtgtcaggaagagagctggaatcatgattgctacaattacaacataaactttgcacttataagactggtaatattttctagtgaggtgctactgagtgatctgatccattgtagtttctaagtcttgtagttttttcttctggcctttcctggtacttttgagaacaaaaagagtgaacagacatttgttcaacaccttcagtgagcctagcactgtactgattgtctgtcctaagtacgtgagctcctgctggcaaaagcagtggggtacagcggttataggtgtggattctgagcttagacaacctggcttcagatttgtctgtcctgtttgctgcatgtctttgacaagtttatgccctctgtgtcacagtagcctcatctgtaaaaactgcattaataaaacctaactcagaaggtggtagtataatccatgtgacatggcacagtgattggctcacattaagtataaagtgctagctgttgttagttttgtggttggtactatttctcccattttataggtgaacaattgtggttcagagagataagtaactttattagttcgttctcacgctgctatgaagaaatacctgagactaggtaatttataaagaaaagaggtttaattgactcacagttctgcatggctggggaggccacaggaaacttacaatcatgttggaaggcacctcttctcagggtggcaggagagagaatgagtgcaagcaagagaaatgccagatgcttatgaaaccatcagatctcgtgagactcacgcattatcacaagaacagcatgggggaactgcccccatgatccaattacctccacctggtcccgcccttgacccgtgggaattatggggattatattcaaggtgagatttggatggggacacagagccaaaccatatcagtaacttatctaaaagtccagttagatcaaacaacccaagggagttagtgtccaaagaaaatggatagcagaggtgggatttgacttccaaaataactccaaagccccctctttgagataccctgctgctgaactggagtgtccactaaagtgttcattttagaaacccaagtgctaaatacttggattttggctcgaaagttgctgttatttcactttccagaggatgctttttgagaataaatagtatatttaaaaatagtgccaaatccatttgtagcattcctctttttatagtccttttagttccttagcttcctcacctgagaatagagatagtacttgcttacctctcactgttgtctgaagacccaggtgagattattttacctagcactgttgcaatacagcctagagctgcaccattagtactattcagtggtttgtgagtttgtgcagccatgtccaaaggaataacggtgcccccttcagcagcacatatactaaaaattggatgatatagattagcatggcccctatgcaaagattacacgcaaatttgtgcattgttccgtattttgcgcaatttacaaaggttgttgaaaaaaaaaaacacaacaaaggaataataaccatgccttgggttagctatgcaatatcaaagaatgacctgtttgcttatattaaaacatgttttttttaaaatgcagtaagaacaattcatatactggtgatgagaccaggagtgaaatctgtattatgtttaggattcttggtacaaattataatagtaaaatgaaagggaattgtaaagtattggtctcttgtttcctctgttttgaagagtctcaagtcaaagtcgtggccctgtgtgctggttctgggagcagcgttctgcagggtgttgaggctgacctttacctcacaggtaggacagactttggatctctcttggtttattttttgcaaaatcaaaaatggcaaattttaggacagtacctggcacatagatgatacctaattaatgttttctgaacctgaactaaacagaaactacaacagaactggggacttactgcattctttgtggagggatgaaatcattgaacagtttattacattatctcaaaagttaatggtcagcatttattttacctacattcttcctaaactgtcccaaacctctcagatttcacatcagtgggatactttctaccctgtcaccttagctaggaaatggttccttttactcagcctaaagccaatcatcaattcctatcaattcaagctcccaaatctttctagaatcttcccccttatctctatccaggcaccatctcctacttgaagtacagcatcaaccctctaatggtatcttccatatactctcctgaaattaacttttcaaagtgcaaatttgatggtcttgattaaaaagacttcagtgatttccttcatctgtctggtggagcctgaacattgcatcccctttcctgtaccctttgcttatgctgttttctctggctagaatgccttttccttgtactcctagtgataagtgaacaccccctctgagaagccttctctgacactgtcctgctcctgcctcttgtgggtccctatcactttgtccttgacctccaatgtgcacttctgttggatagtaattgtctggctgctgggccttatactttctcatttaggatactacctaataggtcctggctaatttttattgaaagaattactttatgtagttactactcaggaatatggccaaacatggccccttacacctccaaaggatttggaggcattttaaggggttgccactttgtttacctcctccttcttagggttaggagagaatgagttaaagaattacttttcccactttgaggaccaggctctaggctcttagccctctggccattcctttggctacttccatgcttcccttgcctcccacacccacactttgttatatagcacactctcttacaaaggctgctgcactcaaagcattgtcacatcctgaagtaccgaggagcagcatctgagcaagcctgatggaattgctctaaaccaataaattgatttaaaaaaacaaaacatgtatgtgactattacttattttatattttctgaagataaaagatttttgtaagcccttaaatttctaccagattaaagtgaaatttcaatatgaatatcttacagtattgtgtctggctattttaaaattcattttagcattttacttaggaatttcagacctatgcaaaagttgcaagaatagtatactgaactcctatatgctcttcaccttggttactatggttatattctgccatatttgtacattccctatgtgcatattatatatgtgtctatacacatttgtgtttgcatgtatagatacataatatatacaagttaaaatatgttctatatatatattgatgtatttcccctaggaccattttgtaatcaattgcagacatgacaatttctttacctctcaatacttcagtgtatagtctaagaacaaagacattctaagtccatggaacaattatcaaacatgggaatttaatattgttaaaacacttacttgatatacagtccatattcacattttcccaattgataaaagcttatagcatttctttttctgatccatatccagccaatgatctcacattgcatttagttgttgttagtctccttcagtctggaatagtttctcagctttgtctccatagcattgacatttttaaagagtataggctctttgttttgtgcttctctctcaatttggggtatctgtttccttatacttttttaaaaactagttttttaaaacaatgataaagtataatgatacgtgcataagataaattcaagcagttccaaaatgttaaaatgtccttcctatctggctgtggggagaaatagaaaatatattatccggctagcattagctgtctctggtctgtgaggcatcacttttgagtataacttcagagatgtgaagccccacctaaaggacctctgctgaacttcatcacgcttcctgtgagcctgaggccgtgttctcattgtattaggttgttaagggtaataccccgtaagaccagcagatggggagcctgctccttgtaaattaagttctcccatttgtcttttcattctccatttgcttattctttcccaagctgccatcctgggccaagcttttctttccattggcttcagctattattgcagggtcttcactgatttcccccctttcatgccttctccagccaatgaatttgtcacagtacaggcagccagacttacctttcctaaaacaaggcttccaactgggccatcttagtgtctttttcttgctttttacttctactattatagattaagatgttttaaaaggtgcttgaataaaaactgttccttataatgagatgacacttattaggaggagattgtggggaactaaaaaattctggaattaagaaaactcatttttttacttataggtgttttcttatgggaaaattaaaagagaactcatttttttccaagaacccttttttcttaaatttatatgcccttctgtctctaaatacagttcaaaattgtactttttaaagaacaaacctaattgtacacagtacagttttgctcttaaattagaagtcatcaaattcacaaactgcattttaagaaattcagaatattaggctggacatggtggctcacgcctgtaatcccagcactttgggaggctgaggcgggcagatcacttgagcccagcagttcgagaccagcctggccaacgtggtgaaaccccatctctactaaaaatacaaaaattagccaggcatggtggtgggtgcctgtcattccagctactcgagaggctgaggcaggagaatcacttgaacccaggaggcagaggttgcagtgagctgagatcgtgctactgtactccagcctgggtgacagagcaaaactccatctaaaaaaaaattaacaatataaattaaaaattcagaatatgaattttccccaaatcttttcacaacagatgagattccctccagagtttctagggattttgcttaagtcaaagaaaaatactttgtttttaacctggaagtaatcttaaattcatttcatccttatatattagactaagttgacgacagaaatactggtgcttacaaagcataagtctgctgggcagtatacatataatttcctccagaggtatttattacttacataagaggcaaattttctgaaggcctcattttacttggcagtgatcattcattttaccgtggaaacactttgaatgggtgtttacagatctggttctggccagatatgttggattggataattgccttggggtctgctaaggaaaaagaagttggaattctcagtgggatggattttatttttatattttcaagatagtcttactctgtcacccaggctgaagtgcagtggtgcagtctcggctcactgcaacctccaggccctggactgaagctattcacctgtctcagcctcctgagtagctgggattacaggcacgcaccaccacgcccagctaatttttgtgtttttagtagagatggaagtttcaccatgttggccaggctagtctagcactccttagctcaggtgatctgcctgcctaggcctcccaaagtgctgggattacaggcgtgagccaccgcgcccagacttttctctctttttaagttggaggacataaaagaaaactgtacactactttctagatttatatgtaaaacagttctgctctattacattcacttcatatagactacaaacttggtatttctgcttttgtgtttcctcattccacagattccatatttagcatttaagaatttgctcttccctttttggtaggtgagatgtcccatcatgatactttggatgctgcttcccaaggaataaatgtcatcctctgtgaacacagcaacactgaacgaggctttctttctgaccttcgagatatgctggattctcacttggagaataagataaatattatcctatcagagactgacagggaccctcttcaggtggtataattgcagaaacatcaggataacacattctacaaatcagctggatgccaacttaaatttgtaacatgagtcagtgggactggtgtgcttccagagagtgtcttcgagggtatcatcatttccggtttgttaatcttattcaccaaatgttctatcgctcgtaaggtaaaactgtaatataactaccatattaaataacaaatgttcattataaactctaggaaagattgaataaaatctgtttacttaacattctttggaaggagctcaagtgattctgtccttagtttaattgtagatgggatggatccatttgggtatctctgcccttggttagttaacattatgcttgaaaaacttgggcttgaacacttctaggtagtagcctttttgcagtgataagaagttctgtttgtccttgttcctagttctgcctacattccagtctctcacctaaatttcagaatcagaatgagatttatcaggatgttgttttgaaaatatgtatacacaatcattattcatattactgttactttattgctttttagatgacttacctgtaatttttttttcttccacagtcctttgttcccgatttctgctctgtcacttccctctcctggcaatgaacttggctgccgcaggcagggggcagggccagggaatgaaattccagagcagaaagaacaaagtcagatatctcaaaatatcatcctgccccatttaatctgggccttttatccatgtggatgcccctttctaaacagcacctgcgctgggctgcgaggcccctgcctgcctgctgctggttgggcagggcagatacacctttctccacctgaggactgcgttctcaggtaatctggctaaagcaatattccctccattttaggcattcttagattgcttttatgatttgtgctattttaccataccacatgtaatttttacttcatgcttttgtgtaaagcaactttttctctttttgtttattttttattgtggtaaaattcacataacataaaattcgccattttattttcctgccccccccttccaaaattcaccattttaaagtatacaattccgtagcttttagtacatttacagtgttgtggtactgttaccactacagttccaaagcatttttcatcaccacagagggaagcccccattaagtaataattccctcctcccatcccctggatcctatttctatggatttgtctattttggatattttctataagtggaatcataaacatgtggtcctttgtgtccggcatctttcacttatgttttctccattactgccgccttttgtgtttgattttttttctagtattttgactcccttatttccttttaagtatctattttatcttcttacctatctttaaaggaaattttatgtgacatccattataacttaaatatttacttaatctatattaaatacaggattattaaaatacaaaggaacactgctcaaaagaaatgtcatttttttttaatgtcattttttttttttttttggagacggagtctcactctgttgcccaggctagagagcagtggcatgattacagctccctgcaacctctgcctcccgggttcaagcgattctcctgcctcagcattccaagtagctgggattacaggcacacgtcaccattcccagctaatttttgtatttttagtagagacgaggtttcaccatgttggtcaggctggtctccaactcctaggctcaggggatccgcccacctcatcctcccaaagtgctgggttacaggttgagccaccgtgcctggcctgaaatgtcatttttaagcttagtgtctaatgacatgttttgtgttgttttgctgatttaataaataaggccagatactgacatgaaacagtggtttagtaatcccttatctactccagaaagctgaaggctgaggaaggacatgcacattccctcacaggtgtcacatgaaaaatcttccctatcctgtaggacttaaaaggtcgccttggatgcccacatggacaatacattccaggtggaaggttgcagattgtagggaatagtgtcaccacctttgttgtgcatccatgacaccttatataatctcttgtgcacatgtattagagggtgctccataccaatctagatcaggatccaaatcagacactagtgcaggaaagaagtgaagctggccaggaggtggcagcaacagttcagcccaaggcaagtgctg

SEQ ID NO: 17280 - DNA, 7496 bp, Human
gtttttttgagatggagtctcgctctgtcacccaggctggagtgcagtggcgtgatcttggctcacggcaacctctgactcccaggttcacgccattctcctgacttagcctcctgagtagctgggactacaggcacctgccacaacgcttggctaattttttgtatttttagtaaaaagacggggtttcaccgtgttagccaggatggtctccatctcctggccttgtgatccgcccgccttggcctcccaagtgccggaattacaggcgtgaaccaccgtgcctggccttcattctcctctttctataacgcaatcttaggatgcaaaaccaagcaaagtctgaattaatctatctagaatagcaccgtggagtcacagccatggtcaggcccctccaaagaacagactggatttcggaacccatgtctctccctgccacaagcaactagtccatatgcaacttggaagcagccactgtggatcttggcttctttcttgcttcctcctcaatagttactgccactgatttagtgctaaagagataggaacatcacttaaaaccatctctacacataaatccacttagaataattttttcccctggaggatctattattgaagtacaaggctttactgtttattctactgtagacaccacaggacaccatgttcttggttagaattgagtacttgagaaactatatgaataattgcttgttgaacagtacacgtgaattatctctattttccagctaaagattgagcctaaaatgattagtatttttgtaattttgaatcatttgatccatttgaagttggattagtgacaaagtcttattcatttttcaagtgttagttctgagggcttctcccagaactagcagcaaccagcgttgctgctagataatattgcacctttaagctaacaagtaaaaagctgatcctctgggttgatgttgtctcatgctagggctctaggcagagtgggctggagttcagtccccagccatcttcttagcagggcattctagatgtttaatcttttatgttgacgtgttgatatcacttccattagccatttgttagaattactaaattaaatttacataattcaaggatctaaaaagaccagaagttcagtcagagccatttttctgagatatttctgcatccctctgaagaagataatttgtccaaacttaacaaaaacaggtgttaaaattgagtacgttctgagaatactcagactttttttaagactttttttagtctcaaaccctacatgaaatacaatcccttaaatcttccaatcttagagctagaagaaaagtcgagcaccctcactttacccagaggcaattttgtgccccagatgacaaagctcttagatctactcatttgcttatggctccaccagtacttctaggtcaggccctctttcacctgaaggattagccatacttctggaaccattttccaggttccttgaaataaatatcttcgctttgctggggaccctagtttcctgttaagtagtgaatgacccttctttcctcccgccagccacagtcctatttcacagaggaagagaatgaccagcaagtcaacttctactacagagaagcagcaactgataaaaggccaaatcttacaaggtgccaacgtgaagaaaaaggcccactatcctgcagccaactcatatcaaaagtcaatctgtttagtcctctctgccggggtgaatctacagtttttctttttgtctccctcttgccccatcaccaggtggttgtcgttgtccttcccggctagttgccaataaagttgttacaaagtgaccttgagtgtcttccttggtgcacccgaaaccccgccttcttcatccgggtgctgcggcgcgaataagagccggaccgcgcttgcgcattgagtcccactccttcgacctctgctgcagcccgtgccgccgccgcctcctgggaaggtaagtggagggcacagggagcccggcctggccagggcggagcggcgcccagtagggacccattcattgtgccggcgcctcactgggcacggggcccaagctgacggcgtgcacgggagcctgcggagcctgggtgggaagaacaggcccctggagggcacttgaccttaagcctcttttcctccgcagagaggaagcgggagaggagcccacgtcgcctgtcacccaatatctccagccgcgcagtcccgaagagtgtaagatgttcgcctgcgccaagctcgcctgcaccccctctctggtgcgtagcccaggcagggtcggggggattgaggggtgggcgttttggcctagagcgtccacgttgttgaatggggcaaccttcgggcggggcacaccgccctctcgggaacggctttctccttacctattaacccattgccgttttcttcctaatcttagggcatctcagccctctccttgccactagggcgaggcagagcagccgaggcctagctgtcaggcctcactcggtgtaggtcaaactctcttgtccctagaccaggagtggccctttcccccaccttctctcagcctctctgttggattggggtcgacgcgaaggttggagtactgcagaggatgtagggggccgttgaggcctagttcacctcagcagcgctttccagtgcctgtctgtaggtcaaactcgttgctgcagagggagggactttgcctttccgtgtgggggcggaggaaggtggtgggggaacgagcccaaagtctttcttcctgcctctggagtattattttcataacaattttgcaggcttaaagtgaggtctagatctggaggatttgtcttagagaatcaggttttggttcggaagggtttttctgtgaccttaatttagtggacactcaagggcagagaagttggactggaatatgtccttatggtcagatatttcacagattattcttaaactgatgtagaattgcttaagttccttttttagaaatttttttttatgattaatggtcatatagaaatagctttgaaatggtcagggctattaactgctgggctattttgaatgataaatgtttattgtgacgctcctaatatacttgttggtccacttaaaattgccaaagaacgtgtggtatttattgcttttttctgacttgacttacggcactacaataatggaaatgtcaaaagcagttcttactctctttgtaactgttattagaaattttattcaaggtagcaagcgttacaatttcattagcatgaaactttattaaaattgcttatgtattaaaaatgaccaaacagcaaagagtcaattcagaagtttctgattcatttttactgcttgcttttttagaattcatggtaccagaaaagtcattgaagtcttacctgtattctttcttaatattgaaatctttatttttttttcattaatagatccgagctggatccagagttgcatacagaccaatttctgcatcagtgttatctcgaccagaggctagtaggactggagaggtaatagtagcaataattgaaattaggtaacactaccaaataagggtagggttttgattagagtgaaggaaaaaaactttattaataagagtttgagggcaagtctttcccacccttttatccaaaaaactagatgagccaaatagccaaaaatagccaaaaaactagatgagacgaatagagaaatttctctatccaaaacttggccaagtatttatattcaagtctattgatttaagttgcctatatttaaaattataatagctacagttattgaaaaatgtactctattggactggatgcggtggctcacacctgtgttcctagcactgtgggaggccaaggagggaggattgcttgaccccaggagttcaagatcagcctgggccacatagtaagatcctgtttctacaaaacatttaaaaattagcccagcctggtggtcacctgtagtgttagctactcaggaggctgaggtggggagctggcttgagcccaggagttcaaggctatagtgagctatgatcacaccacactgtactgcactccagcctgggtgacagaccaggtgagaccttgtctcttttaagaaaaaacaaaacaaaaaaccctactttatttaaaagcatatttatatatgttgtttcttaattttcaacacccttttaagatgtagatattgttatccctgttacacaagagtgagattattctaagctcttgatttgtctctttacactcagctacaaaataaaaaagtagttatcattttgacaatatggtatttaattaaaatagctacctgtggttactgatacgacctttacctttattttctgttttccagggctctacggtatttaatggggcccagaatggtgtgtctcagctaatccaaagggagtttcagaccagtgcaatcagcagagacattgatactgctgccaaatttattggtgcaggtgctgcaacagtaggagtggctggttctggtgctggtattggaacagtctttggcagccttatcattggttatgccaggtaatcatttctatccctaaataagttaagagcatgcttgcagtagttggaaacttagctactgaaataatagctactttgcattaagtgcttactctgtgtcttgcattatatttaaagggctttgtatgcattatctcacttaattctcataacaccatttgggatgttatgagaataacatctatgaaggactagagacacagaggccacattacttgcccaggtcatagctagtaaatgtcagaaaatgaattttaactaagtctgacttcagagtctgcattcctaattgttaagctattttgggaataaaattattagagcacattccttaaaaggatcaatttattttatttaagacctaaactgtcagatcttaaaaggtatagatcatattttcagatggataagaatgtcagaacccatcaaaatgaatgaaaactaaccatttatattgacagacagctccctacctttacaccatattatcaggattgaaggagaatagtgtaagagagatctaggcaaatactcttccagcagacttttcagtttacaaaaatccccacactagtaatctgattctttaacatttaccaaacatgttgaaattaatatttcaaagtaacagtcatatgtggtctcttttagaaacccttcgctgaagcagcagctgttctcatatgctatcctgggatttgccttgtctgaagctatgggtctcttttgtttgatggttgctttcttgattttgtttgccatgtaacaaattactgcttgacatgttggcattcatattaattacggatgtaattctgtgtatcttactgtgactccgaaaactgtagtattggtgtcatgggaatgtacgttatttccaaagtcatttcattaaagatgaaaactttaatttcttctgtgatttgtacttacactaagtttagattatcacaaagaagaacgtgcattcaggcagatgctgtcccattcagaggaagctacagcagttgctccactgatgaaaaatattccaatgtaatttttatgggaattcttttatatagtgttctgcatattgtaattcatagggcttttgtttattcatataaaggataaatatttgggtgttttgagcttctataaaatatgattaattaaaggtagttaatactcaagatggtcttgagtttttaaggtctaacatcagttagaatacttcaaatcagaatcaccttccaagactgacttgacaggtggttctaaaaataaatcacgtcagctttttaggaaatgaagccttaagctagggggtaatgtgacttttgtttttcagtaagtctcacattaagcaattgtgtgcctctaatgaatcttccatgtcttttcagaacagaaactagcagctagtttcttacttgaacaagactattaaaaaccaaatatcaaaaaactgaattggctagatttttacagccaaaaattgctgtaaggcagtgtgtatcactgttgctaacatgtttatagtgggagtcttggggatgatagctggttcaacagtattttgctgctaatactttatgttgcttcttggtcaaacttttcccattcaaaggaagaagatggtgctactatagacagtttttcccctagcaaatatattgtaccataatatctatcatccaagtttcagggttttttgaaagttgataattaggaaagtgacattttacttttcttagtgccctttgcctgtttgatttccattgagaaagagcagtcaccaaagttcctcaagtgtcggaagaccaccaccatcagaatcagtgcttgtttaaaaaataaaaatccctaggttccagacctactgaattggactctttggacatgagactcagcaatctacatctttaaaaaggcttcccaggtggtttttgtgcatactgtttgagagtcactaagttatatatatatcctaccttctgtaaagtgaaatgaggccccaaaaagctaaagaggtagagctgctacctcgtttttagttgattcatcatctagtctatatcacccaaaagaattggaaataggtattcaaacaaaaacctgtatacaagtattcatagaagcactacttacaatagccgaaaggtagaaacaaccaaatgtctatcagctgatgaatggataagtaaaatacatccatataatggaatattcagccatgaaaaggaatgaggcactgatacataatgaatagatgtgagtgaaccctaagaaagcatgctaagtggaagaagccagccacatgattccatttatatgaaatatccaaaataggcaaatccatggtgacaaagccaattagtagttatcaggaactagggagggggtgaaaagggagtgactgcgtaatgcgtatggggattccttttaggatgatgaaaattggatgaattacagctggtctgatggtagtgggttatcagaacttattaacattagtgtcattaaagttggtatatagcccctcactgctaaatctggctcaaaaattaaaagattattaaaatttgatgaattagtggtgatggttgcacaacattgtaaatataataaatgtcactgaattgtacactttaaggtggttaaaatggcaaattttacatgtcttactgaaactactgtactatttaatacaaagtacatagtataaaattttaaaagtgataggaaaatgcttagattaatattcacctattccaagtatattttaaataaaaacagtcttggtaaagacctgttcttggtgctggttttggtggttgaaaaggcttgaaacgttgatttgggaacaggtttcttgtaagagatgtcccagctgagggaatctcccagaatgaaaatggactaact

SEQ ID NO: 17281 - DNA, 28378 bp, Human
acccccatcccgtggcctcagttttctcctccacagcctggttccccaaaatcaccagggcactttgtggtgggaaatcacccacacaaggggacaaacaaggggactgaaagcaaaaagaaaccccaaatttgacatttctgggtagttgtgttatctggagccacgactacagtcacctcttcccaacccaactctgacacccttccctctactcccttgggtgccctttgcccatcctgggaaagttccatagctcctcctcctccccactgcatctcaaagggagaacaggcctgaagaaatggagagaaacccagacagaatcagagaaccagatggagacctaaggagacaagggagagacacagagagaataaaagccagagtgggggccgggcatggtagctgatgcctgtaattccagcactttgggaggccgaggcgggtggatcacctgaggtcgggagttcgagaccagcctgaccaacatggagaaacaccgcctctactaaaaatacaaaattagaaatacaaaattagccaggagtggtggcacatgcctgtaatcccagctactcgggaggctgaggtaggagaatcgcttgaaccttggaggtggaggttgctgtgagccaagatcgcgccattgcactccagtctgggcaacgagagcgaaactccatctcaaaaaaaaaaaaaaaaaaaaaacccagaaggggaaatgtgcaatgaaagacacagatattcggggccttacagtcagagaccaaatgagggatggtcaaccaagggcacagccactgggcacagggtcagggtgggaggcacgggagggctctgaaaacacagccacacacccttttaggcccatccttcccattctgtactctggcacctcaatgctagctttttaggacctaggactacccacactaaagccaagcccggcccaaccaagacagatgtttggtgggtggggctgcctgctggagcaacaggcctctgcaggccctggaggagaagtctagagaggtggctgcctggaagagagcaggcaggaccccctctcttaagcaggcacccccaccccatcaggtgcccagatgtcagtgcatggcaagggtggccctctgccctccagacctgggtgagaggacttgaaaacctgaggaatctgctcccatcaactgacttccacacctgcctgaagggaactgctggagggcacaggtgccaagtgggacccacccaaatgtggcaatgggtttgtatccagccaccgacaggctgcatgacggtggcaaagtcacttcccctctctggcctttgtttttccacttgtaaaatcatctttatggtcacttccagctgtggcacttggctttcattccagttgaccccctagctctgtgtctgaccctcccctgccaaatccattgctcagagtgggaaaggagaggagagggactatacttcctcctccctggggccccctgcagagcatctgggaagcaaggcttccctacatcctccatgcacccccttagagttttcaattcctttcctcgtgatcctgccaactaagacactgtgaccacacagagaaggtggggagaacgcagacattttggcttctgcagctttgaagttctttttttttttttcctctgaagttaaaagaatgaaactgggagaggtagtaaggggcaagaaaggagagtggaaatggagagaaaagggcagctctgagaagcagctggggagggaggcagatgagaatgcaccccccccaacagaacatgcagtcttggcccagctgtgctgtgagtgggcagctgggctggcccctcctctggtgctgccaacccgctgccaggcagaggggaggcccagaggagagggaagctgggcaaaggggatggaaggcgtccagcccgaccttaccaaaccccttgggcctcgtgggaaggggcctcttggagagggggactgaggctctagacaggatattcactgctgtggcaaggcctgtagagagtttcgaagttaggaggactcaagacggtccctccctggacttttctgaaggtagaaccagcctcataagtaactaggctgggtgaacgggggcgctggctagtttatggatcacagtcggctggtgaggccacgtgcctactgtgtggccctgggtggccccgggcaagcccctttccctctcaggacttccatttcttacctgcaaaattgtggagagggggagggctgaaacacatgactgccaagattctttccagttcctccgtcagggttgagtttagatggccggagtaaaagaaggagggaggtgctgcggtggtgggggtgatcttggcttcactagaatccccagttcttcccctctctacagttttgtctctgaggtcacaaaacctgtggcccccaagacacacatgcgcacacacgcgcgtgcacacacacaccccacacatttattttttaatctaggggctcaaaagatgacacgcgccagagctggaaggcgtcgccaattggtccacttttccctcctccctttttgcggatgagaaaactgaggcccaggtttgggatttccagagcccgggatttcccggcaacgcccgacaaccacattcccccggctattctgacccgccccggttccgggacgctccctgggagccgccgccgagggcctgctgggactcccgggggaccccgccgtcggggcagcccccacgcccggcgccgcccgccgggaacggccgccgctgttgcgcacttgcaggggagccggcgactgagggcgaggcagggagggagcaagcggggctgggagggctgctggcgcgggctcgcgcgctgtgtatggtctatcgcaggcagctgacctttgaggaggaaatcgctgctctccgctccttcctgtagtaacagccgccgctgccgccgccgccaggaaccccggccgggagcgagagccgcggggcgcagagccggcccggctgccggacggtgcggccccaccaggtgggtgacccggtggcgcgtcctcggcggcgcgccgagaggggacactctactgccgccccggcacctccggcacccggagctcgacggccgggcgcagcgcggggatcagtccccggcactgcgagggagttggcccagcgcagacgagggacggggggacgtggggacaggggtcggggatgaaaggcagaggccagggagggcgccgtcctggcacgcctcggagagggagcacctgtcgggctggacccggggaggcactagtgcacagatgggggagcagccgaagaggggagcgcccaagtcctcagccctgtctcctgaacagccccagccacgtgcccgaaaagccctagccgtcgagtgggagccgtcgtggcgctggcctaacttcgggttggaatatctccccttcccagaaaccgggcccgaggtgggctgggggatccttgcagccctctccagggggcctgtgggcctcccgccgtcaagtttctctttcagtttctggccgtccccctcactagggaagctccggtggggcgaggggagaggaagacggggagggcacctgcctctgcagagcaccttcccctccccttcagcgggttccttgttggaggggatgggcggccctccactcctcaccatctctgttcccgcacaggaaagctatctgtgggaggggaggggcctggcctggccgcggtccagggataggtaggcatggcaaggccaggggcaggcccggttccttggcctctgcagaggagagcgcttcagcgctcggctcgccctaggtgaacggccatggcgggctggatccaggcccagcagctgcagggagacgcgctgcgccagatgcaggtgctgtacggccagcacttccccatcgaggtccggcactacttggcccagtggattgagagccagccatggtaggcacgtcccgccctgcccctcctcagagggtccctaccatccaggccctttggcctctagttttactcatggtggtttggtgtgactctggtcctgcctgtccttctttgtgcggaaggggtggtgcccctgggaaaggggaagcctgggaggacagagaatgtttttagactcggatgtctgtggagctgctgggaacaagtcttgtgggccctggagtgccctcggtcatgagcctggggtttccactttattccagctccctgacctccttgcccaaggaggtgccacagtaggtttttctcttctgccctgccccaagggatgccattgacttggacaatccccaggacagagcccaagccacccagctcctggagggcctggtgcaggagctgcagaagaaggcggagcaccaggtgggggaagatgggtttttactgaagatcaagctggggcactacgccacgcagctccaggtgggtgtaggctctgggccacctacggggaggaagcatcatcttgttccagcatcagaacccctgggttttttcctggcctggccactgactcaccatgtgaccacgaacttattgggaacttttcttcgatttcccccaccccctctttctaaattcgacctgtcggatttctttagcatattgcaaagcaagggtgggaggtgtttgttgccaacagagagagatgggtgaactggccttatggaagcagcagaagggatggagggagactgagtcaggattcctatgttggagaagggaagaccagcagactctagaaatgaggccaccagacctccctcttggggtcttttaaaggtgagagaggagccatcccagagacaagagctggacacaagggctttgaattgagggtttagaaataagatgtagcttctttacttgaggggagtgggtatggaggaagagagggagtttttgtggaagcaggaaaggggtgtgggtagtgatgacagtcaagcacttattggaactcacgtatgtttcctagagagcccttcaatacagacagcagggtgccagggaaatacaagtccatcccagaagagggggaaaacaggagaagcctgaggggaagcaatataggaggccaggggcaggatggtgggaagtaccttgaccttggcatcagatgccctgagtctggagtcatctgctctctcacttggttgcgtctggacgagtacataatgtctgagcatcagttttctcatctgtgaaatggggatcatagtttctgcttatgtcctagagtttccatgctgttagtgccttgatcccccaccactttttggcaccagggaccggtttcatggaagacaatttttccatggaccgggattgggcagggaggtggtttctggatgattcaagagcatcacgtttattgtgcactttatttctattgttattacattgtgctatgcaatgaaataattatagaactcaccacaatgtaggatcagtgggagccctgagcttgttttcctgcaactagacagtcccatctgggggtgatgggagacagtgacagatcaccaggcattagattctcttaagaagtgcataacctagatccctcgcatgtgcagttcacaatagggttagcattcctatgggaatccagtgccattgctgatctgacaggaagcagagttcaggctgtaatgcgagcaataggcagcagctgtaaatacagatgaagcgtcactcacttgctcaccgccgctcacctcctgctgtgtggtccagttcctaacagaccaccgacctgtaccagtccatggcccaggggtttgggacccctgtgttacagtcaaaagatacggtagattggaagtgcttcataagactgggtatgatggctcacacctgtaatcacagcactttgggaggccgaggcgggtggatcacctgaggtcgggagttcgagaccagcctgaccaacgtggagaaaccccgcctctactaaaaatacaaaattagccgagcgtgatggcacatgcctgtaatcccaactactcaggaggctgaggaaggagaatcgcttgaacccgggaggtggaggttgcagtgagctgagatcacaccattgcacctttagcctaggcaacaagagcaaaactccatctcaaaaagaaaaaaaaaaaaaagagaaagtgcctcataaactgtgggtttttaattcgctccaaaccagatatgaagatcttggaggggaagatgaggatgaggaacagagatatagaggtgtctggggatagttcctgaggctccctgggaaaagctgaggcagaggctgaaggagaggaagggctgggcatagcatggggctggcatggctggagcagaggatggcgctggaggctactgttggattctttcagaaaacatatgaccgctgccccctggagctggtccgctgcatccggcacattctgtacaatgaacagaggctggtccgagaagccaacaatgtgagtgtcccttggggatggggaggagtgttgagaagtccctccatatgcctttctctccagaaacaactgtgtttatataaaacagcagcacgaggagagcaccaagaagatgagggacgtgggcaagtgtaagaggtggcagcattgcacgccggggtggagtgaccccctggatccagtccctggctctaccacttactagctgtgtgacttgagcaagttgcttaatctctctgagcctctgttcctgtttttttttcttttttcttttttcttttttttgagacggattcttgctctgtcacccaggctgcagtgcagtggcgtgatctcggctcactgcaagctctgccttccaggttcacaccattctcctgcctcagcctcccgagtagctggggctacaggcgcccaccaccatgcccggttaattttttgtatttttagcagagatggggtttcactgtgttagccaggatggtctcaacctgacctcgtgatccgcccacctcggcctcccaaagtactggggttacaggcgtgagccaccacgcttggcgcctactgttttttcccccccgagatgcagtcttgctctgttgcccaggctggagtgcagtgatgtgatctctgctcactgcaacctctgcctcccaggttcaagcaattctcttgcctcagcctcccgagtagctgggattacaggtgcccaccaccatgcccggctaattttttttgtatttttagtagagacgtggtttcactatgttggccaggctggtcttgaactcctgacctcatgatccacccgcctcggcctcccaaagtgttgggattacaggcgtgagccaccgtgcccggcctgttcctactcttgtaaaatggagatagcaatcatacctatctgtgtcagaagaactaacacaggcaggctcagagaagtgaggcccagggaggggtaacagggacacatctccccagttctgaaataataaaggcactgggcatctacatggacaatggcacagtgctgtactatctgcaatagagcaaaatgaatttcacaacatgacgtgacagaaatcttagaacagtgaccggagcacaggtcatatttattatttctttctttatttgtttgtttgtttatttatttttgagactgagtctcactctatcatctaggctggagtgcagtggcgtgatctcggctcactgcaacctccaccccttgggttcaagagattctcatgcctcagcctcccaagtagctaggattacaggggcccaccaccatgcccggctaatttttgtatttttagtagagacagggtttcaccctgttggccaggctggtctcgaattcctgacttcaagtgatccacctgcctcggcctcccgaagtgctgggattacaggcatgagccaccacgcccggcctattacgtatttattgttgtggacatggatttcaggatttactcagtagacatttattgaggtcttactgtgtgtccgatgctgggctatcatcagagaaacacataaaggcctggttcttgcctggaaggaattctggcagtgatggattctctagagatgagctgagtgctaagggggcctaggtggaaaaagcacccaactcagattggggcaggctggcaggggagcgtcctgtggacaggcatgtctgagctacagtggagaaaggcaggagaggagggatgaattttctaatgaaaagacagcagctgcgagagcaggagggcatgaatcttcttatcacattggaagacttgtaagtggtcagtgtaactggggagaaggaaccaagtggggagttgccatggataaaaatagatagagagggccaggcgtggtggctcacatctgtaatcccagcactttgggaggccaaggtgggcggatcacctgacgtcagaagttcgagaccagcctggccaacatggtgaaacccagtctctactaaaaaatacaaaaattagctaggcgtggtggcgggcgcctgtaatcctagctactcgggcggctgaggcaggagaattgcttgaacccaggagggggatgttgcagtgagctgagattgcaccacttcactccagcctgggcaacagagcgagactctgtataaaaaaaaaaaaaataggggttagaaaccaggtcacaaagggtcttccagcacagcccctgtgtccctgacttgttgccatcacagagctatctgcaaacctaaaaatgacttcagcctcattgacaaatccatgtccatggtgctggtgctgtcatggtctgggagctcattccttcctccaaccatacaactgttcctgaacacccctggcattctagggcttggggattctgtagttcacaggaaaggcaaggtcctagcccttgggaacctcacatccttgtgcagggagacagacagaaacatgtaagcaaatacaagaacaacacacttttagataggactactgtgaattggctcgtcagagatgacccctctgcaatggtaccagttaaagtgctttgcctcaggaggatctgatgccagaatgttccagactgttggaacaataagtgcaagggccccagggcaggaacatgcctgtgtgttcaaggaacagaaacagaaagcacacattcccagcgagctggggttggaggtaggcagggctatggccagcagacaccatgggaaggggtttggattttattctgagaacagttcattggaaagcctctgaggacttgttcctcttcatccatgtgctccctccctttgtgacctggtttctacccctctctctctattttttttttttttgaaacggagtctcgctgtgttgccaaggctagagtgcagtggcgcaatctcggctcactgcaacatccccctcctgggttcaagcgattctcctgaatgtgctgaaggaatggctggatccaaggggagcttgttgatgcctcccctctaacttcatttcggggtctccaggatgcctgtgagagtttcggcctcttccctcttccttcagtcacaagggggtcttaagtgagatggtgtgtgttcacacagccctgttcctccctatgtccctaggatctactgcagtccatggtattgagtcagcaaataaatgtagagcgaggggtcatcatcattagtgggaaaacccaggtgacacctgggacgtgttgagttctagtccctgggaggaaattagatggaccctgtttggaatactctagtggagggcagctctgacatagatatttggactttgaaggtgttactatctgccgttatctgccaggtcacctgtttctcctttctctttcccttttctatcccaattctggcaaatgactccttctgatgcaaatgatccttccttcttgccctagtttcccttcttaccctagtttggggtttggggtttggggtctgtagtattggtgtttcctaatgcctgtggtcttctcccatcctctcttccccgagttatttccattccatctgtctccagtgcagctctccggctgggatcctggttgacgccatgtcccagaagcaccttcagatcaaccagacatttgaggagctgcgactggtcacgcaggacacagagaatgagctgaagaaactgcagcagactcaggagtacttcatcatccagtaccaggagagcctgaggatccaaggtgaggcgcggtggaggcagtgtgcatccggagggtgggagtgaggaacattctatggactcctagagggtagagctgggtcagtgtccatctcctcagcactttgcccaaagcctggtagaagcaatggctcccggtgattgagcccctgccgtgggtcacacttggcacacattatttaattcaaccctctcaacaagcctatgaagtgaacagttgtgttatccccccttttgcagatggtaaaagtgaggttcaaagagaacaagtaacttggcctaggttgcctgtaaattacagaactggatctcaactagagatatatcataaaactcctgtactttattaaccagtattctctccttaatggtatgtattctgtaaatatcgacacaaataggtaaatatgaacagtgctccctaaccagagggaggacttggattggaagtcttctggttgaaccaggctgggagaggtggaacttccaaagtgggccttcttgagcctcacggataggatgtgggcctgggggaaggggtgacagtagaaaattctcctgtatcctaggtctgtagttcgccaatggctcccatgataaagatgtggggaaattaaaaaatcaaattagcttgaaaggaactatccccaggtacaatttgaggagtcatgggacatggcccatctattaatatgtcccattccagactgaccccagaaatgtaacacctcatcttagtgagaacaaggggtgtcaaactgctttttcctttactctttttaatctgatttcttaaggtagaccttaggtcattgattttagacctttcttcttttcttttctttctttttcttttcttttttttgagacaatcttgctctgtcgcccaggctggagcacagtggcatgatttcggctcactgcagcctctgcttcccagcttcaagaaattcttgtgcctcagtctcccgcatagctgggactacaggtgcaggccaccacgcccagctgatttttttagaattctattgtagctatttaagctctcttcctaaccctgcactgtcagtgctttgtgtacactgagaccagcacaatgcctgaatattgcagctattatgtaaatacttgcaggataattctaaatgtttgtttgtttgtttgtttatttattattgcccaggctggagtgcagtggcacgatctcatctcactgcgacctctgcctctcaggttcaaactattctcatgcctcagcctcctcagtagctgggactacagacatgcaccaccatgcctggctaattttttttttttgtagttttagtagatacagggttgtgccgtgttgtccaggctggttgcaacctctagcctcgagtgatctgcctgcctcggcctcccaaagtgctaggattataggcgtgagccacggtgcccagccaatactgacaggataattctaagagaatttcccctcatctgaatctatcccagactggccctagaagaagggcagctccttctgagaatggaaacggaagattttgggcggttattcctacccaagtccttagactgtcgacagtatttctgatcccgtgcctggcttttctgtttcctgtgcatggtggcggattaggtttggattcaggttgggtttggatctatcatgcagtgtcttctcagtcccatttgtcaagttcactcagcagaaacacagactattgatctgcttttgccagggaaggctcagctgcctccagtggagtagggaaattgcttcccgtctccctggcctccttcctaaaagcttctgcaaatttccaggagagccctaagtgggtcccttgcataggaaggctgggcccaggtgttgggatcaccaccaccctccctgtggctgggcaggatacccgaggtagccgtgcagacacctcggatctgtccgtgcctggatgatcctcttcctgctcgatacctgcagtgagattggagccatatttctgagttctagctctgggctgttcctggctacatagagttgcttttgtctgtcccagcttgtgcatcccatgggtcagggctggggtcagagtgacgtggccctcaggggccagccaggagctcgaccaagacatgctggtgcgcgcatcttctgactcagctcaagcaaggacgctgggctgttgagaaggtgatgggaagggattaatagtcccagtgtggtggagacgggctgtcgctgggagggtggggtgggcctgcggtggtggttgtaactgtggacatgtttactttcttagcctgggttattgatacacaggcgcccttgtgttccacatcccctgtgtcttacgtatttcataatggatacttttttttttttgagatggagtcttgctctgttgccttggctggagtgcagtggtgctctcggctcactgcaacctttaaccccgggttcaagcaattctcctgcctcagcctcctaagtagctgggattacaggcatgcgccaccatgcccagctaatttttgtatttttagtagagacagggtcttgccatgttggccaggctggtctcgaactcttgacctcaagtgatctgcctgtctcagcctcccaaagtgctgggattacaggcgtaagccaccgagcctggcacatgatggatacttttttttttttttttttagacagagtctagctctgtcgcccaggctggagtgcagtggcccaatctcggctcactgcaagctccaccttctgggttcacgccattctcctgcctcagcctccctagtagctggaactacaggcacccgccaccatgcccggctaattttttgtgtttttagtagagatggggtttcactgtgttagccaggatggtctctagccaggatggtctcgatcacctgacctcgtgatctgcccgcctcagtctcccaaagtgctgggattacaggcgtgagccactgcgcccagccccatgatggatactttttaaaagctagtgaggcctgacttattccctgtcccgccatcaatgagactcctcacagatggtgtggagggaagccgcctcccttcggcctccctttcctgagagaatcttggtggctctgcatccccagtggccctggacacgctctccctctgcggtctgtctatctgtctgtctcccctggttggtcggctgggctcacagtgagcccacctggacaaacatgctgggccccttccagcccctcaagaatctcatcctcccctgaggagggactgctgtgctcagggacgagacagagccgccggggctggggttccctgaagaggccttgctgcgggagggatggggccgagcagctgcttgtctctgtcacctcttctctctgtcctgttccccgttaaccaagaagcacgaacctcacacagagctcacccatgtcaggcagctttctggcatcttccatgtcctcatgtatttaatcttcaagcaccccactgaggcaggtgctgagaatctcccgttttacacgtggggaagccgaggcacaggaaaggaaagcgatttgcccaggttcacctgcagtcaagggcatgggcacacttacaccccagacagcctggacccatgctgggccgcgagaagagggctggcagccctgtgaggcaggcgggcaggaggcaggcaggcctcctccccagctgccccagcacccgtgtgcccccagaggggacggctcagagtcaggaggctggtgagcagggcccagaggcgcctcctgaggcgccattcatcttggcccccctggctgtcaggaaccccgacttgctcttgatgcagtgtctgagcctgggagggtctcgctccagaacaggtgagtgggcttctctaggcctcctgttggacactaggaggtgatggtcatggtttcctcttctctcctctagctcagtttgcccagctggcccagctgagcccccaggagcgtctgagccgggagacggccctccagcagaagcaggtgtctctggaggcctggttgcagcgtgaggcacagacactgcagcagtaccgcgtggtgagtggggtcctgggcctctcctgggcgtgggtgccatgaagtcagtctctggggacccgagggagggctgggaccagcatgagagcagaacctgggagggcaggaggccttttttcctgggggccttgcgaggcagagcagcttggggagagggaacggcctgggccctgccctgccatttcccagcgaggccctgcggtgttctctgggagcccagaaggggctgctctcctcccttccctcaggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtaatggtgtggggcggccagcgggcagggcaggaggggctggtggggatcccggctgcttctgcgtcctgtgctggctcctgcagcaggccccctccatcctgggacagctcttgtttctccagggagcctggttcctcaatcagactttggtccccatcctgtgcacctcccccaggaagggggctgctgtcctgggggtgggatggggctcgggtgtgtggggtgatgcttgggctgtttgggcctagtcagggtcgcccctcctgtgtacgtctctaattctgggaggcagggagctctgctcttcccatgggtgggaagtgtggcgaaagcacagagccttcctgggggaacgggagctgtgtcttggggcctggcgtctgtgaggagaagccattgtcctcctgttggccttggggctctcgtgcaggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccaggtgactgctgcctgtttgccatgcccaggagcttggggcagctcctgcctgcgtggggggagctgcaggtgccttccagaccagcagatccacttcctgcctctcatccctcccaactccatctccagttgctgtggctgctaggtgccgcccttgcccagtttctcctgtggacactgcaagagataccctgggccgcagcccatgccagctgctgtgttatctcactcccctctccatcctctccctggactctcacagcttccccgggaacagaggttgtgcccgagctcatcacctcctgagccccatgggaggcagccccacccccaccacagagggactgagagccctttcccctgcgccaacccctcatcgtgtgtctgtccctgtgtcccatgcagcacattcatcattgagaagcagcctcctcaggtcctgaagacccagaccaagtttgcagccaccgtacgcctgctggtgggcgggaagctgaacgtgcacatgaatcccccccaggtgaaggccaccatcatcagtgagcagcaggccaagtctctgcttaaaaatgagaacacccgcaagtaattgtgcctctcccttcccctgcccaagcttaggtgtgggggacctgcaccccccgctttgtccttgcatccagctatgtcttgtcccctagttcaccgtgttgcccaggctggtctcgaactcctggactcatgcagtcttcccacctcagcctcccaaagtgctgagttgataggcgtgagccaccacacccagccgagtatccgttctttaccctggggatggtgtggctgccggagagctgaggctcactgccactgcccagcattgtgagagactatcacaccactttctcctgaaagtgtattgcttcacaccattgtaaattcaaacaatcatgtcaaaccatcattaaatctgggacagatggtacactgccttcctcctactcagatgccttccctgtccctgcaacaagcttggtgctaggctagatgccgtggcttacccctgtaatcccagcactttgggaggccacggtcggaggatcacttgagcccaaaagtttgagttggacaatatagggagaccctcatcgctacaaaaagttttaaaattagctgggcatggtggtgcacgcacttgtagtcccagctactcgggaagctgaggtggtaggatcatttgagcctaggaatttgatactacagtgaggtatgattgtgccatggcactctaccctgggcaacagggtgagaccctgtctccaaaaaaatcacacaaagtatggtgttgtagctgtgttctagaacctgtgctacgcactgaggacaaaactgtgatcccaacagaactgggctgtcttctcgcccagccccttgagcagcagagcaggcagcagatgctgggaaatgcctgatggtgtagccatgtggcagggggatgtgtagggcaccgagaaagggggtcttcttgcaggattaaagaaatgacagtcttaggctcctggtggaattggaggtagctagtgatagggagggaagtagcagagagggaggactttcaggcagagcccatgtgccacatcctgagggaagagtacagagacattatgtgtagcagagagtggagaagtagtgtccagtgtcagggcaggccacccacagcgtatgcaggggatgaataaatgagtgaatgagtgatgtggaagacatggccccatcccttgtcatccaattaaaaatgtttactgaggctgggcgaggtggctcacgcctgtaatcccagcactttgggaggtagaggcaggcagatcacttgaggccaggagttcgagaccagcctggccaccatggtgaaaccctgtctctactaaaaatacaaaaattagccaggcttggtaacgtacacctgtagctccagctacttggacctctagtcctaactaccaactactctgaggcaagaaaatcacttgaacccggaggtggacgtggcagtgagccaagattgtgccactgcactccagcctatgacagagcaagactctgtttaaaaaaaaaaaaaaggccaggcacagtggctcacgcctgtaattccagcactttgggaggcccaagcgggcggatcatgaggtcaggagttcgagaccagcctggccaacatggtgaaaccccgtctctactaaaaatacaaaaattagctgggcatggtggtggaagcctgtaatcccagctactcaggaggctgaggcaggagaattcctcaaacccaggaggtggaggttgcagtgagccgagactgtgccattgcactccagcctgggcaacaaaagcaagactctgtttcaaaaaaaaaagtttactgatttcctaccatgtgatctggggtgaagatgaagacaaatgaccttctcactgcctttgagcttgcattgcagctggggagactgatgataatacactttaaaagatcaggcagggccaaccagtgatagacactggaaaagaagttaagacagagcaatctaggctgggcacagtggctcacgcctgtaatcccagcactttgagaggctgaggtggaaggatcgtttgagatcaggagttcgaaaccagcctgagtaacatggcaaaatccaatctctactaaaaatacaaaaattagccaggtatggttgtgtgcgcctgtagtcccagctacttgggaggctaaggcagtggaatcacttgaacctgggaggtggaggttgtggtgagctgagattgcaccatcgcactccagcctgggcaaaaagagcaaagctctgtctcaaaaaaaaaaagaaaaaagagcaatctgctagcgttggagatgtgtttaaggcgggggtgaggaaaggtcagcttggtaagcttctccagataagtggtccaggaaggcctttctggggagctatctgggctgagacctgaaggaggagaaggctaagagtgtttggggtgacaggaagagcaagggccaatgtccaagcctggcatgttcagcagacagccagggccaacggggcttgcatgtcctgagtgaggggagaggaattcagtgaggccaggggggtgggtaggtgttgaccatagggatcctcagagactgtggttgtgatttttatcttaagtgcattagaagctattggaagtccccaaagccctcacatcaatcttggtatcgaggaatttctaatgatagatccagacctcaccactggagaccttgccttgggtgctgggcaccaggttgatggagaagtcagtaacccagaaagacgccaagaaacactcttaggggatacggggcaggggctgctggcagggctgacctgagcgaagaccccagcccgaggtgtggacaggaccatgctcctggcctggggcccatgtggagctgggacccccctctcctttgcagcgagtgcagtggtgagatcctgaacaactgctgcgtgatggagtaccaccaagccacgggcaccctcagtgcccacttcaggaacatggtgaggacggggcccaccctcggagggcaggtctgcccagagctgagtccttgtaagcagccgccatctccctgttcccctgtcacctcccaccctgcagtcactgaagaggatcaagcgtgctgaccggcggggtgcagagtccgtgacagaggagaagttcacagtcctgtttgagtctcagttcagtgttggcagcaatgagcttgtgttccaggtgaaggtgagacccccagccctcctgcccccactgctccaggtcacccaagaggtggaggggcctgcctcaggactcctggcagcaatgccatcggacagcctgctttgactctgtgggtccctgtttgataggttataatctgggactaacccagacaatttaggcaatgggctaagaagaagtcggttgtagtttttgtttgtttgcttgtgcctacattttgctgggaggggcttgtgtttggaactgtgggtgaggaaagtgggttgggaccaggtgtggtggctctcacctgtaattccagcattttgggaggcagaagagggaggactgcttgagtccaggagttcaagactagcctgggcagcatagtgagaacccgtatctacaaaaaaaagaaaaaagttgggcatggtggcctgcacctgtagtcccagctattctggaggctgaggcaggaggatcacttgagcccaggaggtcaaggctgcagtgagctgtgattgcaccactgccctccagtctgggcgaccgagcgagaccctgtctcgaagaaaataaagcagattgcggccatgggtggtgggtcttgcctgtaatcccagcactttgggaggccaaggagggtggatcacctgaggtcaggggttcgagatcaacctgaccaacatggagaaaccccgtctctactaaaaatacaaaattagccaggtgtggtgacacatgcctgtaatcccagctacttgggaagctgaggcaggagaatcgcttgaacccgggaggcagaggttgtggtgagccgagattgcaccattgcactccagcctgggcaacaagagtgaaactccatatcaaaaaaaaaaatacataaaaaaaaataaagcagattgggcatgttgcctaagcagagggcacgtggtggtcacgccccatcaacttgggttcctttgactcctgtagactctgtccctacctgtggttgtcatcgtccacggcagccaggaccacaatgccacggctactgtgctgtgggacaatgcctttgctgagccggtgagtccccgtgggagccctaccccagcacccccaggccctaggactcacctggggtcagccccaccccttgggcccctgctgagtggtccttcctcaccccagggccagcccagaggtgaggtgaggccagaagggctggggtgctgggcgcctgccttccaccatggccttggcactctgggttccaggttcctggactggggtctgtgaggactgtgagcttggtctttggatcctggtctgggatcctcctttggcagatggcttgggtccttgctctctgttttctgtttcctggtctgcatctctgtccctgcatgcccccaccccctgcatcggttttcttccctgcaggctgggaaaaaaagtgcaagctagtatataaaagccgccgcatttcctgcccttgcatttgtgtcacctttctggatctgtctcagtctcctctgtctctaggtgtctgtgtatcttgtgtgtgtgtgaatatttccaactccctcaatctaccttttcccctctcttgtctccctctcagggcagggtgccatttgccgtgcctgacaaagtgctgtggccgcagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtccgtgtcctggtcccagttcaacagggtgaggggcccagctgccagccgcccaccagggcccaccggggtctgttgctcctccacctcacagacaggttactgcctggggctagcaccccactctccacccccaaccactctctcctacaaccaggagagatgggggcccctagcctcaagaaatgcaggcaggggctataggagttgtgcttagttgtgaagccaagagcgagatgacggagggcccagggctgggagtcaggatccttgggttctgggcctagatgtgtttgctaattttcttttttttttttagagacagaatctcattctgtcacccaggctggagtgcagtggcgtgatttcagcttactgtaacctctgcctcccgggttcaagtgattctcgtgcctcagcctcctgagtagctggaattataggtgcctgccaccatgctgggctaatttttgtatttttagtagagatggggtttcaccatgttggtcaggctggtctcgaactcctgacctcaggtgatccgcccacctcggcctcccaaagtgctgggattacaggcgtgagccaccacgcctgtggctctggctctccttctgcctctctccttgctaatttttgaagacccatccattctctgtgcctcagtttccccacctgtaaaatgaggggatgactttggaggaatgactttggaggccccatccagcctagattattctttacacctcttactcccacccttgggctggtcttggacccctgtgtcttagaagtgagtttcctctctgttttcctagggtacaagttgggggctgtgtcactttatggtctgctggagtgtggtggcaagcaggggtgaagaactgggagaagactgggtgggggcaggagggccctgactttcctgggccacctgtgacctggggcaccagccctgactcgggggttcctgggccctcaggagaacttgccgggctggaactacaccttctggcagtggtttgacggggtgatggaggtgttgaagaagcaccacaagccccactggaatgatgggtaaggaacgggggctgcagggtcaggggccagctgtgggcgcagagagactgtggctgtggcccagtggtgacgctcaatgctccgtgcacccagggccatcctaggttttgtgaataagcaacaggcccacgacctgctcatcaacaagcccgacgggaccttcttgttgcgctttagtgactcagaaatcgggggcatcaccatcgcctggaagtttgactcccgtgagtgcccgttttgcccacactccagccccaaggcccggtctcttgttcccttgccccgccaccccaccctccatcgggcctgtgtccttagaaggtacccagcgggaagcttagtatgagagggctgtggcttggaaatgtattctctttctattgttttccattttggagaacctgaagtccccagccccatagactccaggacggctgggcgagtcctcctgcagtttcacgctctcccctctctgccacgacccagccttgttggtatctgctcatctggtttgctgagtagaacatcccgcatcggctttcttccctacaggctggggctgcagcgcaagctactatataaaagcccagatttctcttgcaagcctgccctaaagccccacaaccttggtcctcctgctgctggtggattatgggaatgaggctgttcttttcacagcggaacgcaacctgtggaacctgaaaccattcaccacgcgggatttctccatcaggtccctggctgaccggctgggggacctgagctatctcatctatgtgtttcctgaccgccccaaggatgaggtcttctccaagtactacactcctgtgctgggtgggtactgccccaggaccctgccggctgactcccccgggctcttccccagcccatagacaaagccttgggctgcgccgtggggacttccccaggaggagcctaggggccatgtcccctgtgggttttggcccatggggtggtggagaggatttcagggctcacaaatgaggagagggaacgagaaacccgtcccagctctcttctctgcaaagtgaaagctgcatggattctcacttctgcaccctcggaggaaggggtggcagcactgtagggagtggccgggatcattcgagcccacagatagtgctccgctccccacctcaccagctgctctccacaccctgctcacaaaccttcccccgagtggagtgcaggcagcaaaagggagaagtctctcttcttccagctgccccaaatccattggttgggtttgcttgttgattctcattctttgacaggggtgggagcagggagagggaaatcagatggccagaaaaagaaccagaaggaatgggattcaagccaggggtctcagtgaccctcaggcaggattcatcagctggtgtttattgggggtccttgggaaatctcatcccagctgagaacacaaggtgatgtgagcaggagggagactacatggggcgtgggcttccaccccacttgggagttcccagagactttggttctcaccactgttcttcccttgacagctaaagctgttgatggatatgtgaaaccacagatcaagcaagtggtccctgagtaagtgtccaggtggctgtggctctccttctgcctctttcctcctcccccagaccctgcctcccatcctgatcctgggcccagctttccgctcccccagggaacctgtctcagccctggggagggagtcccctctcctgtagctggagccccagggccgagtggggcactttgtccgtctacaccccgagaaagacaaacatgcccctcggtcccctccccaagtcagctgccccggcctccctggtggctgaagctctgttctcttccttctgcaggtttgtgaatgcatctgcagatgctgggggcagcagcgccacgtacatggaccaggccccctccccagctgtgtgcccccaggctccctataacatgtacccacagaagtaggtggtgttctcatggggtccgcaggggaagaactggggacttggccccaggctggactcctggagggctggcgggcaaaggatccagagctctggttaggcccaagtccaggaggagtgagatcagccaggaaaacagagcattttgaagctagacatagcagggtcaagtcctcactctagtactaactgtgtgatcttgggaaaatgattgagcctctctgatgctcaagtttccttatgtgtaaaacggaggcaagaatgcttgcctcatgagaatgggatgagcattaaactgagacagtgtgggtgaagcatttccacagggaggggcttggaagggcttgatacagggtagctatgaatggggtggttgttcttgagtctggtgggaacaaggtagataattaattcccttcctcactgtggatagccagggctggatgtctgggaggtaccaccttccagtgggaccactgaagatcccaggttccaatccggactccaccacctcccagccaggtggcccagagcaagcttcctgatatggccttggttttctcgtctataaaacggggtcaatacccactctccagttggctgtaaaaattggagtcatgtgctcaataggctcagctgttctaggtgctcagtgaaaagattcagctgttctaagtgctcagtgaacggggcggtgcctaccattgcagctgagcatcattgcaggtgggcagagcccactgtgtcagccacctggttttaagatgaggacacggagaggggaaatgaattccctaagattattcagtgagttagcaagagatgcgaatagagtgggggtctgcagaagccagtgggctgactgctacccagcttggggtggggtgggggcatccagccagaactggtcctgttctcatgagacgggtttgagtggagagcaggctggaggctgtccccagggagcttgaggctgtgagacatgccagctccctctgacatccccctgtctttaccagccctgaccatgtactcgatcaggatggagaattcgacctggatgagaccatggatgtggccaggcacgtggaggaactcttacgccgaccaatggacagtcttgactcccgcctctcgccccctgccggtcttttcacctctgccagaggctccctctcatgaatgtttgaatcccacgcttctctttggaaacaatatgcaatgtgaagcggtcgtgttgtgagtttagtaaggctgtgtacactgacacctttgcaggcatgcatgtgcttgtgtgtgtgtgtgtgtgtgtgtccttgtgcatgagctacgcctgcctcccctgtgcagtcctgggatgtggctgcagcagcggtggcctcttttcagatcatggcatccaagagtgcgccgagtctgtctctgtcatggtagagaccgagcctctgtcactgcaggcactcaatgcagccagacctattcctcctgggcccctcatctgctcagcagctatttgaatgagatgattcagaaggggaggggagacaggtaacgtctgtaagctgaagtttcactccggagtgagaagctttgccctcctaagagagagagacagagagacagagagagagaaagagagagtgtgtgggtctatgtaaatgcatctgtcctcatgtgttgatgtaaccgattcatctctcagaagggaggctggggttcattttcgagtagtattttatactttagtgaacgtggactccagactctctgtgaaccctatgagagcgcgtctgggcccggccatgtccttagcacaggggggccgccggtttgagtgagggtttctgagctgctctgaattagtccttgcttggctgcttggccttgggcttcattcaagtctatgatgctgttgcccacgtttcccgggatatatattctctcccctccgttgggccccagccttctttgcttgcctctctgtttgtaaccttgtcgacaaagaggtagaaaagattgggtctaggatatggtgggtggacaggggccccgggacttggagggttggtcctcttgcctcctggaaaaaacaaaaacaaaaaactgcagtgaaagacaagctgcaaatcagccatgtgctgcgtgcctgtggaatctggagtgaggggtaaaagctgatctggtttgactccgctggaggtggggcctggagcaggccttgcgctgttgcgtaactggctgtgttctggtgaggccttgctcccaaccccacacgctcctccctctgaggctgtaggactcgcagtcaggggcagctgaccatggaagattgagagcccaaggtttaaacttctctgaagggaggtggggatgagaagaggggtttttttgtactttgtacaaagaccacacatttgtgtaaacagtgttttggaataaaatatttttttcataaatttgctgctatggctcctggttggggcgttggtggcctccctgggtgatgggaacccctggagctggttgttctgttccttcccgcgtgcatgcctgatgctgtcatttttagtcttaaattttaactctgcccgctttgctgtggttttcagggtgctggccacccctggaatactgtcaatgcttctcagaagggtaaggagccagtttagggggcacagattccttaaaaagcaggggactcgaggtttggggaaatgatggagatgggcgcgggtgggcagaactctgacccaggcttctccttagcagctgctgctcccagcagcctcgaagctggcggctgagggcccggcgccaagatgcttctcaaccctcggggccaggggcagtcccagagccgcaacaaccgtcccatcctcctccttcccagagaccagcaggtggcaccacgcggctgcgctgttttcagctggctgccggcgactgtgcgaggcggaggtgcagcaagcgggaccggctcgccccggctggacccccgcactgccggctgcagccagtccctgctgtcgctggggcccttgggctcagggacgcgcgctccctgggcggggctgggagccaggtttgcgggcaggttccttctgagctcagagctcaagcgagggagaggggcggcgcgtgggccccaagagggaggtgcagggggcccagagcagggggaaggcgggggtgggagaagagaggaggggaggggacgggcaggtgccaccgccccagggggctaatctgatccatctctgcgagggaaggtgctcgctcgtagctcccaggcgcggtctccagggcgctggggcacgtgtaggggtggggagaagccctgtgggcgcccgcgtagctgaggttggggcgcctttccctgcattatcaccgctggctgccgggggccctgcagccaccaccgggtgtctgcgtgttgtccccgctgggtgaactgaagggaaagtgataaaggagccaactgtggaaggggaggccttggtgcggtgggagtatctaccccccaccccgcttaggtggcttatctgaccccagacaggacgaggccgctctggggggtaggagggggccggggagggaggcctccactctgacacctttctgccgttggactattgacctcctgctcctccaggcaccccttacctccgggctggtggctaacataagggggttggcgggggggattaaggcaaccacctcctctcaagaccctttccggcccttatcccaggccccacctgtgtgtgaggccccctcagaacttatgcaggggaaaaggaagcctccaccagccaaacagagctgccatgctatcagacggttcctatataacgtttatttctggaagttaaagtagatacagcaatataccaaaaaaaaaaaaaaaaaaaaaagacaaaaaacctcacaataatataaatttttacactatgaagtacacattggaatttgaatgcagtggccaggacagcagcttataaaccaccttataggtaggtaagcaacccacgggattccctcggctgggctggggatggggagggggcagtggacaggaagcgggcagggcctgaggaccctgttctttaatgggccacaacagggctcagctcctctcagaacttttgctacaatcagagttaagaccagatacatgctacctaaggccatgaacttgacaatatctgctccagagaagccctgaaccctcgccctaggtccctatgatttaaacccaatggtaagcccaagtctcacctttctaaatattctgtttatcagttaagcttattatgtactgaagagtgttgctggagaagtaagagctctgcatgacacatcaactgtctccaggcaggaggactggggcgaaccctgttcatcttagagaaggtcgtctcccccttaattcaga

SEQ ID NO: 17282 - DNA, 9615 bp, Human
tctagcctgggcaacacagtgagaccttgtttctttaaaaaaaaaaattatttccttccatcagcactctttgagttcctagtatgcacataggcactgtgaggaaggcatctctaagaagcagaaagcacagaccttgtctcttcattgactgaggtgaaatgagaaagcgtcttaaactatgaaaaattgaaatgacataactttgaaatatttacatggtatttctggttgctaattgagacccaccaccccgtacttccttccttgtacttttggggaagaggtgggccccatttcaaacctcttttcctttggttctctccagaaaggaaactgttgtttctggctagtgaatcattcttcctgaagctcactttttaaatgagttgctgggagaacttggatgtggaaaacgatttgaggttgaacaaaacaagccctttgctgtcagcttcttgcatgaatgtggaccatttgcttcccacagatacctcctgttcatccacattgctgtcccttaaccatgagggaatgtacttcccttgctcaggggcagatcggggctctccctgggatcttagactccattatgcaaagggcagcctaataaaaaccttttctttccaacccaggttcaaatgctgaacagtgttcagtacttaatacctactcacaggacctgtttgtaaaacattctgtatatattctgatgtctgttgacatcagatgtatatgtctgatgagacatccacttatgtcttctagaggcttctagagataggctcctcatgtgtctgcaattccaaaacttaacaaaaacaaaaagttgagcctctgaagctgtcactaaccaagtgattcagatgtcgggactggaacaccagctgttggggatgcaggacttggtctctgccctcccacacctcctgcctcttctttctctccatcgccccatctctgccagtagagaatggaactgaggtctctattgaaaaagggaaagttggtagctgtgctgactgtggcagagctatgactttggtgtgtgtttctgtgtgtgtttgtttcggtgtgtgttttgttttggtgtctgttttggtgtgtatttctgtgtgtgtgttggcatgtgtttttgtgtgtgtgtgtgtgtgtttcagtgtgtatttgttccggtgtgtgtgtttctgtgtgtctttgtgtgtgtgtatcggtgtgtgttttactatgtgtttgtttctgtgtgtgttttgttttttaatgggtgcgagactttggcccatcaaaaatgagagaactagggaagaaggatcaggatgagagagtgaaacattgctttgattctggtgcacagaggcacacagtccagccctagactgaaagtcggtcagtccttctgaaggtggcaggagaaaaatggctatgttaataacaacttgtgctggccaggccctggtccctgaatggccatgaggttggccaagcaccttctctgaggagctttctaccaggacctcttgggcccctgtctgcctcaccactgtggtcctggctaccagactggaacttcattattgatctaaatcctagtgtcttcctgagcttttgttttgttttgttttgttttaattttgccccaaaagcctgttgacttaactgtcaccaggctgtcacacattcattcatcgcctgtgtgtgtttatttgtaggtgaatgtacatatttgggatccagaagtcaatgtgtttgctcagaaccatgagcctgaagttgggagaccattctcctctttacagctcagatggtggtagagccggtagacatctagtatagcccagtggggcctcctgacctctagtggggagggcagggaggtgaggtgaggggaagcagtcagctaggtcttcagtgaggccagagggaaagatctgtaatttaagaaggacacagcgggtgacggcctctgaactaactcagtacttctcatttctcccttacagttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggaggtgagtgggcatgagggagtcggggaggggcctgaaggttgccaaagaaatgctttgaccttgaggagatgggaagctgcctgcctgcattagggactaaatgcgtctgtggtggcagccccacttcctcacctgggccctggaattgagcccagcaactggtctccatgccagagtcccctcaagcatcgctagtaagcatttgctgggagtggaaagctagcttcccatcctgtttctgccccttcttgatctgtgtggccttggctgaggccctttcactgccctggcctcatggagggagagctgactctggatctttgaggccccttcttactataatgggtggtccatgtgccctggcctttcccacttccagaagaaggaacagcctggtgagtcggagctgggtgataggtgggtgtttctgaagctgactttaccctttctggagctcacagcctgttgttgattttccagtggtcagcatttaggatgtgagtgagggtctggcctcggcctcttgcctccgtggctaacacacacatcaagaggcaggggccaacgctggccttggccttgagtcatcctttctctactctcttggtaggaggtttctaggcagctggaaacaaaatgggccatgtcagcagtctccctgctgcctcctcagcatttgggtcaggagctggagaggggaagtgaggcagtgccccatgtccctcagtgagctgggggagggcagaccaggaaagcagccttctacacatggctgtcctgggttctctgctgggtccaggggcaaaggggccttttgctgtctgtcccagctctggactcctcctttgaagcatgtgtacaggcaccctgcattcccctaaggagtcacctcttagtgactgaaggtcaggtcacagggtggccatacaggaacaggtctgggtcagagctaggggcggtggctagctggagtgcctggaggtggtaggggtggttgggaagccggccacccagcctcagcctggtggtggaacagtgtgtacttccccagcatagctaagtgtgtgagaatgtccttaggaaacccaaggtcagtgacacccctgggctggagcaaactgaggggtggagcggtccctagctgctggtctgttctctgagtggcggaggaggaggtctgagggcgctcacccttctgtgcttggagtaggcttcccctaggctttccctctcttgcccctgctgtgttgctcttcagagagtggtcctgagatggctcagtgcatgcaggagtcccttctcctgccgttgcctgggctgggtctgcaaagcctgtgcagaccccgtcccccagacacatacataaaaatccaaactccaccccccactcaggcctgctttggctcctggcttgagggttctctgtgcccatctcagtggtgggcttctgagtgccagagcctagaagcaacagtgggattgtgtggggtggattccaactcgctcttgcccatggacgctccttctctcttacagcggccttcctcacacagactgtctgcctggatgacacaacagtcaagtttgagatctgggacacagctggacaggagcggtatcacagcctggcccccatgtactatcggggggcccaggctgccatcgtggtctatgacatcaccaacacagtaaagatttccccttgcttcttcctttgcccttcatcttctcaaagtcccagggattgggttatcagagccctgatttcaggccgcttaaccctctgttcctgggtggggggtgggcagatttcctgtttggggacattgcatcagaatctttaggtggcaatgtcttagataatttggctgtgccagcttgagagtctctaatgggtggccctgggcagaatgccttctctgtcccttcgacattctgtccctgtctcctcaggatacatttgcacgggccaagaactgggtgaaggagctacagaggcaggccagccccaacatcgtcattgcactcgcgggtaacaaggcagacctggccagcaagagagccgtggaattccaggtggggagatgacagacttgggggaaggagtggagtaagcagctccccccggcctcgcctgggatgctcaggggctttgggaagggccatgctaggaggcaacagggaagcttccatctgctgtcctctcgtgcctcaggcatgggcctaacatggctcctgtctgtaatcccagtgccttgggaggctggagtgggaggatcacttgaggccaggagttcgagaccagcctaggcgacacagtaagactctgtctctgcaaaagatttaaaaattagctgggcttggtggcacgcacctgtagtctcagctgctcaggaggctgaggcacgaggattgtttgagcccaggagtttaagattgcagtgattgcaacactgcactccagcctgagcaagagtgaggccccatctctttaaaaaaaaaaaaaaaacagccaggtgtggtggcacacacctgtaatcccaatactctgcaggctgaggcgggagatcacttgagcttaggagttcgagaccagcatgggcaatgtggcgaaaccccatgtctaaaaaaatacaaaagttagctgggcatggtggtgtgctactcaggaggccgaggtggggaggatcattagaggccaggagattgaggctgcagtgagcagtgatcgtgccactgcactccagcctgggcaacacagtgagatcctgtctcaaaaaaaaaaaaaagaaaagaataaaaaaagcatgggcctaaaaggaattgcccgtcacctgtctctccctggttctctttctttggtggtaggggtatgtgtatatatggatcactagccttctacttctcttttcttgtaagttgactttttaattaaacttattgagaaagaaatacttaagtctctgctaaccctagaaactcaacttctcttcttctaatttccccagtttcttgtccttccagaaatatgcacgtgttttttaatccctttctttacattgatggcagtgtgctatacatactgtatatgataattttttaccaatccctaataatagcaaaagactgaaaacagtgctgcagtagacatccacatacttttgtgcttttgtgcaaacatgtaagtgtatttgtaggttaactttctagaagtatttcctagcctagtgattttgaagagcaagaaggcagggtggacctggggaaacccgggtaagacatctgctagtgattgtgagctgagaggtgatatacatgagcggggaaacccagatcagggcagccttaggcctgaaaactcctgtgtgtgtccagctgatctctattatgataaggtgctcgaataaggaaggtttgtatcctgggccctgggccctggcccctgccaacatttccctctcacctcctctcacctccatccaaaccaggaagcacaagcctatgcagacgacaacagtttgctgttcatggagacatcagcaaagactgcaatgaacgtgaacgaaatcttcatggcaataggtcagttgcttctcctcccctcctctctccaccacagcaagggcatatcacctgtctgctggtctagagtgggcctgcggggtcccttcaccactctttttttttttttttttttttttttttgagatggagtctcgctctatcacccaggctggagttcagtggcacgatctcgactcactgcaagctccgccccccaggttcacgccattctcctgcctcagcctctcgagcagctgggactactggtacccaccaccactcccagctaattttttgtatttttggtagagacggggtttcacggtgttagccaggatggtctcgatctcctgacctcgtgatccacccgcctcggcctcccaaagtgctgggattacgagcgtaagccactgcgcccagcccccttcaccacttttaaccttctgataaaattgttttcatcatcacctgactcccagatgtagatgttggttgttcacccgagaagttcctgaagcctgggccagagtctcaacatttcactctctgagcctgtagcctgccacccatttcagagcctgccatcactacccctacccactgcctaggagtttttagctcatttggctctggaatcttccttcctgggttgcagatcctggctctaccactcattagctctgtagtcttgggcaagttatttaaccttactttgccgcagtttcctgaaaacaatcagaatgcacctgacacacagaagccctcaatatgtgagttaccactgattgggtataaaggccagaatctgctccagtggaactgggagagttattggggtacccccaacaaatgcacttttccccctcccaaacagctaagaagcttcccaagaacgagccccagaatgcaactggtgctccaggccgaaaccgaggtgtggacctccaggagaacaacccagccagccggagccagtgctgcagcaactgagccccccttgcctgcccgctgcccccgcctcctccgcctgaatgacccgactggaatccactctaaccaatcgcacttaacgactcgggccaccactgggggggcagggggaggggtccaccatgatttctccatataattttgatcataggccggagtgagtcattccacctgcacctttctgtacaaatactaattcaattttaagtcttaagtcacttttttaatatatatgatcttctgctcttcccacttcctcccctttctactgctctcccattttcccttgctgggagtagccacatgctcttgccccccaacccttgtatatggggacagtggggtcagtgcagctaccctttctttccctcctgcggaacagcggacccagcaagagcatccacatcctcactttgttcggagtggtctttggtttgggcggtggggcagaccttgggaaggggcttaggaagggagaggcagctcttccttcagctggctctcatcaggctgcagccccctccccgctcccacctccctgctgggaaaccacagcattatcacagcattattgtgacagccacgaacccattgcccacaacccctccaccctcggtcaccccaacctctggctctgagccctgttctgaccaaatcatgatgatgagtatttgggggtgggtgggtaagggggggagtgggaggggacggaaccaactttttctgtattttgtattgtatgttttcttcaacatgtaaccaatcagtatcttgtcaatatagtcagccgatcgatcgacctcacaattgtcttccttgtctttctctggcagtttatcagacagtgccctctgtagttgaagttgatttaaaatgaaccactgaatcttgttaaacaaaatcttcccctctaatgtgaggggatgctggtggtcatggtaaccaagagaaagaggctcttactgttagcagctccgatgaggtagctgacctgggctgaccaagtttgaagtttcagggcccgtgttcacttctccacctcccttcccctcccccacctaccagatcatactggggtgacatgcagtgtgtatttgatgatcattagtctctgaaacaccagaaacaacctctttgggtttttttggttggtctttaccagtgagagggtctggatcctttctcttcctgaagaggaaggaatcccaacagcccctggaacgctggactggtcttaaggccaagactgtagccactggctttcctcaccacctctgtccacgtcacccccccacaccacatccaagttgccccagtccagctctctactggttctggaatcaggtctgggcactcagctctctgctgctacctgttggagctgctgctcagctagggccacactctcctccaatttctcccagggccacagaggcctgattcccttttttttttttttttctttttttgagacggagtctctgttacccaggctggagtgcagtggtgctatctcaactcactgcagcctccacctcctgggttcaagcgattcttctgccttagcctcccaagtagctggaattacgggcacccgccaccacgccctgctaatttttgtatttttagtagagacagggtttcaccatgttggccaggcttgtctcaaactcctggcctcaagtgatccacccgcctcagcctcccaaagtgctgggattacaggcgtgagctaccacagtcggccttttttttttttttttttttttttttttgaaacggagtctcactctattgcccaggctggagtgcagtggcacgatctcggctcactgcaagctctgcctcccgggttcacgccattctcctgcctcagcctcccgagtagctgggactacgggcgcccaccaccacgcccggctaatttttttgtatttttagtagagacggggttttaccgtgttagccaggatggtctcgatctcctgaccttgtgattcgcccgcctcggcctcccaaagtgctgggattacaggcgtgagccaccgcgcccagcattttttttttttttttttttttttttttgagacagagtctcactctgtggcccaggctggagtgcagtggcaggatcttggctcactgcaacctccctccacctcccaggttcaaacgattctcttgctcagcctcccgagcagctgggattacaagcacacaccaccacgcctaatttttgtgtttttagtagagatggggtttcaccatgttggccaggctggtctcgaactcctggcctcaagtgatctgcccgcagaggcctgattcttggtggaccaccaccttgagggtgcctttcctgcctcctgtgcctccagtccctctacctctgacttccatccccagaaaagacaacggacaccaaggctgctgcacatcgcgtcgtttgtttaccgggtcaggttggaagccttagagccgaggctcccgagtctcggggacggtcctgtttgggcttcagggagggccagcgccacacactggcctctgacccacagctgcccggagggggtcaggcagcaggtcatggcggtaggactcaggttggacggtagcattttccggtgcaccttctgtgacatgcggtaactgaccctttccgggtccctgacgtccagttgctgctgtccggtcaccatcagccattggccatccacctgcaccaccagttcctccggggcgaagccgtgggcatccagcttcatttggaaaccgtctctggcatggtcattgtcctcctgagccgc

SEQ ID NO: 17283 - DNA, 78720 bp, Human; identical to SEQ ID NO: 12710
  misc_feature (1)...(78720): n = A,T,C or G

SEQ ID NO: 17284 - DNA, 12214 bp, Human
accgggtcaggttggaagccttagagccgaggctcccgagtctcggggacggtcctgtttgggcttcagggagggccagcgccacacactggcctctgacccacagctgcccggagggggtcaggcagcaggtcatggcggtaggactcaggttggacggtagcattttccggtgcaccttctgtgacatgcggtaactgaccctttccgggtccctgacgtccagttgctgctgtccggtcaccatcagccattggccatccacctgcaccaccagttcctccggggcgaagccgtgggcatccagcttcatttggaaaccgtctctggcatggtcattgtcctcctgagccgctggactgtccctgagcagccgcaccggcattgtggccacccggttccgttcagcaaggcccacgctgggacaccgggatgccacccggctctcgttggagaaggtgttaccgactctctgcatccgagtcagcaactaactgctgtcaaagggcgcgaggctcccagcgcagagctaggcgcacggacgcccggagaggagggacctcgcgcggcctacccgagctcagctccgctcgctcggttcccttcgcttctgcaaacgcaggcggagttcgggatcagccacgcccatcttacctccaagagccagactgtcagcgccctggcgcgcccgcagctgctctcctcccagactccgaccctttctccgcccttccccaccttcgttaatggacccggggaggccgcagctgtgaaggaactggatccacgaccaggccagacccgagggagccgcaccctggcgcagccaacagcagattgatcccccagctggaagggggctgtcttgccttctaaggaccaggcctggggcaaggattgttcctagacagagccaggggagggcggccttcctgggtcatccaccctacctctccctgaccacccacaaccccacgcggacacgcgacacgaggaggtggactggtctctccggctgcattaattcttcccggggcgtcctgtgctgcaggctgtggtctgggctctggggccacaaagatgaagacgcagttggggcttcaggagagtggctcccagtgcacagagaaagacctagccctcctccgcctcaccctccacgtcagtagccttcttggtgaccatcataaccacagctatgcctctggtgctgttatttgataattttttttttttaagagacagggtatcattatgttgcccaggttaatctcgaactcctgggctcaagcgatcctcccatctcggcctcccaaagtgctgagattacaggcgtgagccacctcgcccagcctataaactttattttttatttttttgtagagattggtggggggggtctcccaatgttgcccagcctggtctcgaactcctgcagggctcaagctctcctcccgcgtgagccagccacccggcctgataaactcctttttgttgagtgatactattaaatacatacatactgaaaagcgcagaaaaaggtgcaggtgaatgtcaggaggagaacacacccaagtcaccaccacactactgcagaactgttgctacatctcatctctaccgcagctgcaattccgtgtccggagccgcgtggggcagggcctgtgcgggagttgggggagggggttaagtgggagacaggcgcgtgaaagaggcagaccccacgattctccccaagactccttgtccccaagaggacagccatcgtgactctcccggactccattaaaagagattacaagtgaagaggggtcaatgtggggccttcactcaggcctcacttggctgtcaggggccaagagacaggacagaaaagtctggaagctggaggcagtgaggggaaggcgcgggaagactacaactcccgtcatgcgccgcgcagcaacgcctgcgcactgagcgctggttgcccatgcggccctagggctgggagcgcggcgccgctctccgctgcgggggaggccatggcggaaccttcccaggccccgaccccggccccggctgcgcagccccggccccttcagtccccagcccctgccccaactccgactcctgcacccagcccggcttcagccccgattccgactcccaccccggcaccagcccctgccccagctgcagccccagccggcagcacagggactggggggcccggggtaggaagtgggggggccgggagcgggggggatccggctcgacctggcctgagccagcagcagcgcgccagtcagaggaaggcgcaagtccgggggctgccgcgcgccaagaagcttgagaagctaggggtcttctcggcttgcaaggtgggggcggggcctggggtgaaggggcggggcttggggcatcccagggctctggtgggaatggggtcaaagctctggctgcggagcggctcttgccccagaggtataggtcattgactgatccttccacctccaggccaatgaaacctgtaagtgtaatggctggaaaaaccccaagccccccactgcaccccgcatggatctgcagcagccagctgccaacctgagtgagctgtgccgcagttgtgagcaccccttgggtaaggcaggcagcgcccttggagctgggggcaggtgctgggtcctgcttggacagggtgacaagtgccacaaagcttcatctctgaaaaaatcaaagatgcctcgaaggagggattgggttgggggggggtgtgcaccaaggggggagaaaggaaatctctcagcccagaacaggcccaggcaacccaacggttgatatcggagcagtcagtctcactgttggtcacactggttggaggaacagagtgtgtatcttgcttggctgtgaagagggtcaagaagccttgttgatttcttctatcaatttttcctaactctgccatctgtcttgcagctgaccacgtatcccacttggagaatgtgtcagaggatgagataaaccgactgctggggatggtggtggatgtggagaatctcttcatgtctgttcacaaggaagaggacacagacaccaagcaggtctatttctacctcttcaaggtgagcttccactaaaggagggtgtgagtgaaggaggtggggccttgaggggttgtctgcagctctgcccccctcccctctatgcccccttcctcttctctctagctactgcggaaatgcatcctgcagatgacccggcctgtggtggaggggtccctgggcagccctccatttgagaaacctaatattgagcaggtgagataggggaattggagatagcggataggagaattggggacagcttggaggagtggggagcctgtgttctccattctcctcaagctgagaacactggggaggttcagagaaggaagggtgttttgtgctaacctcagggtgggcatggtggtagggagggggcagagcttttctatagagagcacccgagagagagaggagaaggagaaccttgtccctggccagggagcatcttcctttgtctaagaaggccctgcgggctgctcacacctcattcctggttttatcccccacccaccccttctcagggtgtgctgaactttgtgcagtacaagtttagtcacctggctccccgggagcggcagacgatgttcgagctctcaaagatgttcttgctctgccttaactactggaagcttgagacacctgcccagtttcggcagaggtctcaggctgaggacgtggctacctacaaggtcaattacaccaggtaggcccagccaggggcagcttcgggggaggcttgcaggcccagcctgggttcagtggtttccgccctcacctgtctccccctcgaccccctactccagatggctctgttactgccacgtgccccagagctgtgatagcctcccccgctacgaaaccactcatgtctttgggcgaagccttctccggtccattttcaccgttacccgccggcagctgctggaaaagttccgagtggagaaggacaaattggtgcccgagaagaggaccctcatcctcactcacttccccaagtaaggctccttctggcctaccaggatttggccccaagttcacatcctccctgttgtccccttttttccaggaaggcttcctggattggtccctcctctccctccatgggccttttgggatctgggcgtctacctggcagacttgcccatggcccagaagcaacttgctagtactagtctggggatggcaggtacatagcccaagctaacgctgcccccacccgaccctacgccccagtagatgttactaattgtttcccatgggggcctggacacagcctcagactccttccctgcacaactctccaagaaaccagaccttaagcttgaagtgaaaccaatttctactcctgttctggtcttttctgtaccattttcttctgttcggccacaccttttaaaatctaggccataactcccctgttcaaaaaaccctgactgactaatcctggctctctagtgccccctgccatcaggtgggaacaagagatggcaaggtggggtggagtctgagcccattttgatactgagggcagtgagggggctcagggtgacaaggtgccctgcctggccacacagcacaggatgacatcagctcagacctgtctccctgtgccacacagcgtggtgaaactgagcctgtttgatctctgtcctggatgtgtcctgtcctcttaccttcaattggaggctcccagaagacaggggctgtcccctctctcaggtccccagttccctaagagcagggtctgtctctgaccagcctccagtccctctgctgcctggcccaggctgcaccctggagaacagagttgtgggacagactgtgtcctccctacagattcctgtccatgctggaggaggagatctatggggcaaactctccaatctgggagtcaggcttcaccatgccaccctcagaggggacacagctggttccccggccaggtatgtgccatggtacgctctgtagggtgtctggcctgcctggctgagctaagcctcctgggtggaagagagctcacctgggccggaggccctggatcccactgagggacctgccaccggcttcagcccccccagtccctgccttctctctctctctcctcagcttcagcacccccgtccctgactctctcctcagcttcagcccccgtccctgacttctctctctctcccctcagcttcagccccccatccctgacttctctctctctctcctcagcttcagtcagtgcagcggttgttcccagcacccccatcttcagccccagcatgggtgggggcagcaacagctccctgagtctggattctgcaggggccgagcctatgccaggtggatacttgacccctgacctctgaccctcattcactccttcccaaaccttttttactgatcctgagcaaccttgcctgcctccccaataggcgagaagaggacgctcccagagaacctgaccctggaggatgccaagcggctccgtgtgatgggtgacatccccatggagctggtcaatgaggtcatgctgaccatcactgaccctgctgccatgctggggcctgaggtgggcagcccgacctgctgaccagttgggggacccccaccaacctgagaccccggctcaccacccctcttctgtgcccagacgagcctgctttcggccaatgcggcccgggatgagacagcccgcctggaggagcgccgcggcatcatcgagttccatgtcatcggcaactcactgacgcccaaggccaaccggcgggtgttgctgtggctcgtggggctgcagaatgtcttttcccaccagctgccgcgcatgcctaaggagtatatcgcccgcctcgtctttgacccgtgcgtcccccagagagcccctcccccagggcagcacacccagttcccttcctcctcggcctcttcactcctcaaaattggggatcccctgctccccacttctgaggttcatcctttgagcattcttacttctcactgcccaaccctgactacagctcagacttccagggctctggggacctgaaggggacagtcaggggctatgacatgcccccctctctcttaggaagcacaagactctggccttgatcaaggatgggcgggtcatcggtggcatctgcttccgcatgtttcccacccagggcttcacggagattgtcttctgtgctgtcacctcgaatgagcaggtcaaggtgagcgcggctccccggccccagccccagtccacggcccactcctgagtttgggccagttcggagcagcaggatgtgtggcatgcagcagcccgttgctcttctcttagttagcggcccgttcctcacatccccacaaggtggcagccgtactttgataactgtggattaggaaaccacctgttgacagacggagcccaagcagcagccacactttggtggacctgtggacttgggttttctgcatcacaagaacatttacatacatgggggaattaattactttactttttattttttatttatttttttgaaagagggtctctctcacccaggccgcagtgcagaggcatgatcagggctcactgcagcctcaacctcccaggttcaagtgatactcctgcctcggcctcccaagtagctgggaccacaggcatgcaccactacgtctggctaacttttgtattttagtagagacagggtttcaccatgttgcagggtttcacccaggctggtctctaactcctgaccttaagtgattcacccacctcggcctcccaaagtgctgggattacaggcatgagccaccgcgcccagccaaactaatcattattacagtagccctatgctgatagttttggcttctgtcctttgttacaacagacccactcgtagggtctctggctctgtgtgtcgcatacctcagatctgtgtggtgcctcattggccctgacgtgtgggaggcattgctcctgctgctcagacctctggtgactccctctcccgcttctcccaactctgaggcccagggactgggaatcagtggcctgtgttgggtttggacccggccctgccacggctggcagcctgaccttgaacacatttcctaacgtagctgagtttcggttttctcttctgtaaaataaaggtggtaatactcgcctctggggttaatttgagaatcggtctgtaaaacaggaagcactgcacctagcccagagtgagcttagaaagcccgcacccttcactttctccccataagctccccttcctctgtcagctgcctttcttcctctttgcctggatgctctcgctctctctacctcctttccaatctacccgctcttctctggtctctgagacctctccagcaccaggcccatcctcagctcctggtgagtcctgcttccctcccccgcagggttatgggacccacctgatgaaccacctgaaggagtatcacatcaagcacaacattctctacttcctcacctacgccgacgagtacgccatcggctacttcaaaaagcaggtgacccgtagcctcgtcccacaccggtcctttgcctggaggctggggtaattctgtccagcccctctgtggatggagtaggagtccctttgcgtcccctacttcacctgacacctgccaggagagtctccatgcctatcttctttcctctgctgccattgccccaggggagaatgagggcctgtggggccagtagagcaggccggaggaactgggggtcagtagagcatcctggaggaactagggggccagtaaagcaggccggaggaactggggggggcactagagcaggctggaggaactggggggctagtagagcaggctggaggaactggggggccagtagagcaagctggaggaactgggggccaagagcaggctggaggaactggggggccagtagaggaggctggaggaactggggggccagtagaggaggctagaggaactggggggccagtagagcaggctggaggaactgggggactcttcgggatgagtcaggagtgggcagctgacctgggacctttccagggacagtttgaaccctcacagtgccccaggaggaggttcaggagcaggaggtggcaagtggcacgtgctactcctctggtgctcccaggtgagggacgacagaagttgggaaatacttatggatggactgggtcatgaccatccaccccccagggtttctccaaggacatcaaggtgcccaagagccgctacctgggctacatcaaggactacgagggagcgacgctgatggagtgtgagctgaatccccgcatcccctacacggagctgtcccacatcatcaagaagcagaaagaggtggtgtgcacacatgcgcatctgtgggatttttcatgaatgggcatgcagagggcgagcacacgtgtgtagacctgttctacgtctacatgcatatatgtgtgtgagtgaggaggggcaggccaggatcttggctcttgctctgctcccttggggaagttatgaggggaggtgctggattaggtggcgttgcagctgggtgggtgcagccagtggctccgactgtggccctgggaggggttgttgttggggctggagttggcccctcagtcccttccttccctcagatcatcaagaagctgattgagcgcaaacaggcccagatccgcaaggtctacccggggctcagctgcttcaaggagggcgtgaggcagatccctgtggagagcgttcctggcattcgtaagcaggggtctcagttgcagggtagtgggggcacgatgcttggggtgtggactggcattcttagagacattctcccacttcccactttgcaggagagacaggctggaagccattggggaaggagaaggggtgagtgtcaaaggagccgggttgggggtggggcagagggacttggagcctcagacttggtgtctctcgccccaggaaggagctgaaggaccccgaccagctctacacaaccctcaaaaacctgctggcccaaatcaaggtggggagaccaggtttcctttccagggcccctgcaccaatggctgtggcctcttgatgcagtgtggggtgggtagtggtctcgggctggcgtgggcgcagcagggctgtccccagcccggctcttctctccagtctcaccccagtgcctggcccttcatggagcctgtgaagaagtcggaggcccctgactactacgaggtcatccgcttccccattggtgaggaccttccattccatccccttccctcctcttctgtccccacacctgctcctgccctcactgcgccctgcagccccagggggcccaccctggtggacagccctgccgtggtcttcagcctcttaaagctgtgctccgtctcctgctgccccagacctgaagaccatgactgagcggctgcgaagccgctactacgtgacccggaagctctttgtggccgacctgcagcgggtcatcgccaactgtcgcgagtacaaccccccggacagcgagtactgccgctgtgccagcgccctggagaagttcttctacttcaagctcaaggagggaggcctcattgacaagtaggcccatctttgggccgcagccctgacctggaatgtctccacctcggattctgatctgatccttagggggtgccctggccccacggacccgactcagcttgagacactccagccaagggtcctccggacccgatcctgcagctctttctggaccttcaggcacccccaagcgtgcagctctgtcccagccttcactgtgtgtgagaggtctcctgggttggggcccagcccctctagagtagctggtggccagggatgaaccttgcccagccgtggtggcccccaggcctggtccccaagagctttggaggcttggattcctgggcctggcccaggtggctgtttccctgaggaccagaactgctcattttagcttgagtgatggcttcaggggttggaagttcagcccaaactgaagggggccatgccttgtccagcactgttctgtcagtctcccccaggggtggggggtatggggaccattcattccctggcattaatcccttagagggaataataaagctttttatttctctgtgtgattgtttctttggtgtagtcccagccttagcaggctcaccttggcccccagggacctcttgcaaactggaggctgctctccccagcaagcctcaggcctggtcctgtgctcctggggtgatgggtcctacctgcctgcagccccccacctctccctcctccaggctgctcctgatccagatgccagggcagcaggggtcagaacctcctgccttcaccttaacctgggtggatgtggttacaactgactgcagaagggccagagcgtagaggatcctgtagcactgaaagagtgcttccctgttagcacacgtggttctttttcttggggcagggataggagattcgtaagtcggctcagctggctcctcccctcagtttcagtttccatttctgatttctgctctctgcgctgagcacagcggcaccaggctgagctaagcagggccgccttgggcaggcctacgtggtggtgcaggcgagacccaggctgggcaaggcgcaggtgtagcctgtgttactcccaccccccccccacccccaccttttggccacagcaggcttctgatgagttttgagggtgtccccccccccacctccctcaagtggggtggagtcctgggcaaagggaggtctctgtaccgactgctctggccaggagttgggatgagtggagggcccagtgggtctgagtcccctgccattcccagaatggagctgtggccctaccaatgggaggtgatcatgcctgccagggcgctggcgcagcagcagtacttaaccggagtttgtactcacggcagttggcgatgactgttagcacaaacggttcttttctcttggttctttttcctggggcggggatgggagattcctaagtcggctcagctggctccttccctcagtttcagtttccatcttgggtctctgagctgagcagagtggcaccaggctgagttaagtgggactgccctgggcagacctacctactagagcaggtgagacctgggctgggcagggggcaggtgtagcctgtgttactcccgcctcccccttttgggcagagcagggtcctgatgggttctgagggagtcctgccccacctccctcaagtggggtggagtcctgggcaaagggaggtctctgtactgactggtctggccaggagttgggaggggtggaggagtcggtgggtctgagtcccctgccattcccagaatggagcttcggtcctaccaatgggaggtgatcatgcctgccctggagggcaagaatatcatcatctggctgcccacgggtgccgggaagacccgggcggctgcttatgtggccaagcggcacctagagactgtggatggagccaaggtggttgtattggtcaacagggtgagtggtctgtccctaccccgctctcccaccaccaagcagggtcttagctcttcaggcatctcccagtccccaccagaactccaaagctgctgtggccatcgctaagctcacctgtctttccaccctggctcagtacccagccatgtcctgcgggtcaccttaccgcctccctacccctggccccagattcagctctcttttcccagctcattctccacccccaggtgcacctggtgacccagcatggtgaagagttcaggcgcatgctggatggacgctggaccgtgacaaccctgagtggggacatgggaccacgtgctggctttggccacctggcccggtgccatgacctgctcatctgcacagcagagcttctgcagatggcactgaccagccccgaggaggaggagcacgtggagctcactggtgagggccatggccgggaggaaaaagatacgcatctggggtacctcctttcgccaaccccagggcacctcctggagtcaaggtgttgggagttttagtgggagtgaggggttgcctgttcacaaaacccctgcaggcactctagtagaaacaggccgggctatcgtgtaggatcttaggcc

SEQ ID NO: 17285 - DNA, 33353 bp, Human
aaaaaaaaaaaaaaaaaagagagagagaatctaggcaaagagaaataatgttgattctgttccatatgtcagaccttggaaggtcaactgcatgactgtggctgagactttgtacttgggagtgtgcagttttaaatcctgaccactatcttaggcaagtcccttctcttttctgagtgcctgtctgcttcttgccccatcagacagttctcacacaggttcatggcaacggtaaagaataagattagacagcacactgggtatggctttataatcacgggcactaagtgatgattttttccttattcattccacttggtcttaactcttacccttctattgtttggggatgttaactgcaaaacagggacagaatttgggctaaagggtctttttcccagtctggtaaattaagtatgtgataagacttctagaagagtagatctaaggtactttcttttgtgcacactaatgggaggtgtgaagggaaagcagaattgcaatttccagcctagggaggccaagccagtcggccttgccaaacacgttgtcttggataaaggaggattttcagtcctgctattggctgatggggcctccagtgccttcttcagcctgttggtggggatgatgccctcagagccgcagagtgagcagtctcctcccaagcatcgctgagcacttgggtgtggaagggttgcctgatactgagggtggggttcctggaagacaggcgatcaggttcagctcttgccttgccctttatggttaaatgttctttggaaagcttctatatctttcaaatcctgggggcattatgatctctcttctgcctatcccaaaccatcttcagccagtactgttgggagaatacaagctccagggcatggtccctggtccgtctggatgacccctccggatctggcatatagctggcgctctatggaaccagatatttatgtaaaagcagggacaatggaatgtgaaaacgtttcgcaaactccaaagcgattcataaccagacagaggtccaatcctagggtatacgagctctctcttttaagcacgtatcacagctgcttctcacgccaccgagacgcggtcaggacaggtgcatccatcttctctgggcttcccctcttgaaagtaggccagggcgcgcaggggttgagggtctctcattcccagagagaattaaacttggaggaaagcaaccaccggcgaggagcggggcgcgtggaagcgagccgcggtccgaggcccaaagaaaagcccaagcctcgcccccgccatcgcgcccgacgagacacctaggtccggggacgggtgtgtgccgcggaagtcaggtgcactgcgcagcactcccccggtaggtacacgctcctccacctacgagtgacctaattacaaggtgccagccgcgcccagaggtgggggtggttaatccaagcggccactcgctgcccgttcctgcccccaaagatgacggaaacccacacgattacagagccgcagcaccccagatgagccacggggtcgcaattctcgtttccgtgatcggactgccaggccccaggtgaggagctgagttcatcaccagagcggccttcccaggggaaccagttacaggctgccagtggccccggcttccatccggtctgcgcctgcgcgcggcccaagccctcgcctctcctggaatagtgctcagggattagtccggttcgccgctgtgcgcactgcgcatgctccagctccatccttcccttcccccaccaccccgccctccgggagccacgcccaaaaagtcaaggcgcttcagttaccagccggctacgtcgcgcctgcgctttgacccccagtttgcgccccaactccggtcgtgcggccgcccggggagggctctgcagttgcgcagcttgctccccggcccttttcccctccgctccccgccgcctcctgacgccgggcgtgacgtcaccacgcccggcggccgccattacagagagccgagctctggagcctcagcgagcggaggaggaggcgcagcggccgacggccgagtactgcggtgagagccagcgggccagcgccagcctcaacagccgccagaagtacacgaggaaccggcggcggcgtgtgcgtgtaggcccgtgtgcgggcggcggcgcgggaggagcgcggagcggcagccggctggggcgggtggcatcatggacgagaaggtgttcaccaaggagctggaccagtggatcgagcagctgaacgagtgcaagcagctgtccgagtcccaggtcaagagcctctgcgagaaggtgagctgtagtacggctgcggacagccgccgcggggccgagcccgccgaggaaaaggcggccgtgaggagggtgcaacatggcggaggccgccggtccgggccccccgagtctccgagaccggcgcccatcctggccggcggcggcttcctaacgacccggcgccccctgcctcccgcgcagggattggttgccgccgccgcctaaaatggcgccgttcactcgactcctgggcttttgagtcagccggccttggcgccagacgaggtggcagggggagcggagaccctgtgggtcatcgtcagggacggttttgagggtgagctggcttggattctgcggcttgggaatggagcctgggcctctccggtgggctgagtaagagtctttccgctggtacccaggcctagttaggtccagagctgcccagaggatcccccaaaggcagtcttgttaggccgtatcccagaacatacctaaaggtcacacagctttagtaccccttggtggtttgtattatactcaccaagcgatcttctccagaaatcaaggtaaggggtgtctttaagaatttttaaattattctcttaacctaatttttacgaaggtcatggtggtagctataagggaggagtgtaacttatttttcatagttggaagaaatcgggaatttggtgagtcatactacataaggagcttttggattggaaatcaagtgtcggttgaatatgatttatatgctgactcaaagccttctctaagcttaacacacttggcattttgccgtttatttttaaaatgaaccacataaaatggaagagcggtaaattttgtatctttgttgcaaaaattacttgatagtattttgtggctgcaagtagtagtagtgataataactgtcgactgagattgtattccagacattgtgcttagtgtttaaataatgtctcacatacactgaaaatagaatgttgtagtccacttagtaacactaaactttatattagctaattcccttttgttttcccctgggggttggggaaacaggtagttaatttagctattagctttgtgttgtatttttaaattcttgtaactcagttttctaaagtacacaaaatgctgatctctgctgtgaacattttaacttcccttttcaaaattaactttgcagcacgtcactttagtacagaatagtggagtatcatattagcattttgtatccgtgaaaagaattaatggagaactattatcctgatttgtttctggtttgatgtgaaaattaggttcatgagtttgacgtatatgtttccaagacaggcttttttagaaaccatgttgtgaacaattggaatttaagtaagtcagatttagatttgtttctcccaagcctgaacaaaactactactagtggatgaggtggcacatcatctgttggagatgccttttaatggtagcgatgtattgaatctcctgtttctttaccctctcacgtcaaatgaggttggtatttattttaaaggtttaaaattggcctttaaaaatgaatgtatattgccaggtcttaatttctaggtactgtacatgatgatcttaccgatttttggaattcagtgcattatatgaaagacttttaagtcagtagttggccagttgactagtcttttgaagaaaacgtggaaaggagggaggtgatgacgtaactggaagactggactgcgagttagatttggacatgagtccttctgctcttccttgagtaattgtgacagactttgggacagccacttcacttgtccttgttttcctgtctataaactaaaatgtgttctgagattatacagtcaattccgttttaaattagtagtgtgtttaatattgaacatctattgaatatctaagattgcatactcttttgagggaaatgaaaagcaatgaagaataagtatgcttattgtcgaggagctatgaatctagtttgaaagaaaagcatggtatgaaaaggtgtgggagatggagcatggaagtagagggtttgtgttggaaactgttgtagaagataagataatactggatgctagagtggggtgggtgaagctgatgcatctaatattgctttccacatctttgtaaaactaagatgtagtgaggtaaatctccattgcttgcgctgcttacgcaaattttagttctgagtgccaaaaaagatggaaataatatttgagagtaggtgttacataaaagtttctgtggaatggatccgttttggtggatatcattatacaaccttcatactgtttataactggtaagtaagtatttcaactttcaggatgatattaaacttccaaactaaattaatttgaagacagttttttgggtatgtagaatccatgaactgatgttttttgtacaagtctttctagtaaaacaaaagctgtctttcactgttaatatttgtgtgccaatggcatctctgggtgaaagctacatatgtgctttttggtgtgattgccttctaaagagtaattttgaaaatttgagggctaatttttttcattagtgtataataatagtattttttgagaaaaaagatacttgttaatagttgataatttcttcaatcataagaaggaatgataatgtaaaagccttccttctacccacctaaatgcctgatttgaaggggaaatatttaaatagtaaaaatagatgtataccataagaggtcattgttactaaaaaatcctgaggccatttttttgttatcccatcaacaattaacagtgttacatgttcagaactgagagaatctaagtatgcatttataaaagacaagagtgaacatggtttttatgttactgactagctaaaaagaattttaagatgtgattaagacttatacaaaagccaaggttgttagtgtatagtatactttgtcatcttgagaatcataatttgttgatagtttaataatttggtgtgcagctttgcctcaggctcagttctataatcagcattacatcagtataactggccgggtatgtttcaatctacagattgaaaggagtaaatagtatcaacttgcttttgcattgactacagtaaacaatcttttattatgtgacttcagctttgttttagcttgggtatgatttcttggctttgtgcttaccaaacatgtggagaacgttgtttgatagccagatttttttttttcaaagaagttctttacctaggtatgctgttttccattgctttgcaagcactataaataaagtgcagtcattagtcattaaaatgttagttttaacatttgttacgtgagtatggaaaaaacaaactgcttccttctaattagatgagctgaaaaatatttgaccaagatgacattcttgtatgaattgggtaatatgttgctgtgagtatgtgtgtacgtttcattttaaagggtgtttggctcatttctctagaagtgatttgaatattgaggacaagcaggtgggggaagcatgttacagaacattatttttatcatacttttataagatattgttctcagttacagatgcaacccaaagactcagaaaggtaaagtgacttgactaaaggggctaaaagtgagattgccaaggcttgtggattctaagcctaatgttctggtattgcttcacagatccccttctgttttcagaggtagtgttagtagtgaaagatgtaggtaaattggggccaagctaaattgggaagtcaacactttcataaaataaaacttttttttttttttttttttgagataaggtcttactcttttgcccagtctggagtgcagtggcgcaatctcggctcactgcaacctccacctcccaggttcaagcagttctcctgcatcagtctccctagtagctgggattacaggtacccaccaccatgcccagctgttttgtatttttagtagagatgggatttcaccatgttggccaggctagtctcgaactcctgaccttcagtgatccacccacctcagcctcccaaagtgctgggattacaggcttgagccagcgcgcctggccaaaacattatttttattttcattgcttgaaagcttcctattcatgttacatactgttgttccgctttgtcttggaaagagtaattattattcagttttggatgtagctgacaacatttgcccctcaaatgagattggtgagatgaaaaccctagataatttcccttgtattcttagtataaatcatgatccagagactgagctctaaagtattctaataaagtataactgactttttatattgtttattgcaacttataaaatgcctcttttcagcagggcaaggtggctcacacgcctgtaatcctagcactttggaaggccacggcaggcggatcaccaggtcaggagaccaagaccaatcctggctaacacggtgaagccccgtctctacttaaaaatacaaaaaattagccgggcgtggtggcacacacctgtagtctcagctactggggaggctgagacaggagaattgcttgaacctgggaggcggaggttgcagtgaaccaagattgtgccactgcactccagcctgggcgacagagggagaccccattccccccggccccaaaaaagcctcttttcatcctcttggcttccacagtcaaatgtcatgcatgtgtgtatttgtttcatggtctcctaggcaggaagctgtaatgcagttagtttggagttgacttcatgaggaaacagaaaaggtgaacattcccactattcagaaacacaggttccccaaccctccctacgttctccactgggaccagaattgtatgttttcagaaaattggctgtaaggctaagttgaagctcatgtactgtagaaagaatgaaggacccttcaggagtatgtgggataacatttgtattaccagtctggtgtggccctgttttatggcagcaaatatgttccctatctcatggtaagtcaggtttgtcagagttacctgtgagatagcctttgcttagtttggaaggggtaagttaggaaaactaagagactgggtttggtggggtcttttatcagggtactgaggagagaggcaaagctatatgtaacagggagacactatttattctttctgctttgacccatttctcttacttcattatcatccttgcctgagaaagctgtcaacctccactcatacacaggcagatctgaattggatgagaaccatgaaggaggaagatttttgtttttgtgggctttttttttttttttttttttttttttttgagatagagtctcacagtcgcccaggctggagtgcagtggtgtgatctcggctcactgcaccctctgcctcccaagttcaagcagttctcctgcctcagcctcccaaatagttgggattataggtgtgtgccaccacacccagctaatttttgtatttttagtagagacagggtttcaccatgttggccaggctggtcttgaactccttacgtcaagtgatccacccatctcagcctcccaaagtgctaggattacaggcatgagccactggcaccagacctgtttttgttttaaatagattttcttttggcttctggggcagaagtggtagaccaggctgaagaagggagaggtgtctattgtcagtaaatggctgagaggtggggtttgaaagaatggtaaagaacaacctgagattaactgctttttttttttttttttttgatacggagcctcgctctgttgcccaggccagagtacagttgcatgatctcggctcactgcaacctttgtctcccacgttcaagtgtttctcctgcctcagcctcctgagtagctgggattacaggcatgtgccaccatgcctagctaatttttttatttttagtagagacagggtttcatcatgttggccaggctggtcttgaactgctgacctcaagtgatccgcccgcctcagcctcccaaagtgctgggattacaggtgtgagccactgtgcccagctaactgcttaacttcttcacattgcagtattattgcctgtttattggtctgttgtggattgtggtttagaatggatgaacaaggcagtgacacagatgcgtgtatatctgaatctgggtattttttaaactaaatgtgaccagttggccagtccctcttgcaccctgtgttgccacttctgccttagtttagtcatttagttgctactacagatggggatttttaccctgctggtgttgaggctggaaggttgcaaacctttgtcctagatggggacgaggagtagaatgggagacaagcagtagcatgtgtttacctggccaaaggcctgcaaaatgtagttcacagaggttatggagtgtcattgatgctatcgtgtgacagtgtacatttgattttggaaccagtatttaataaaccttcattgtatgcattattgtcactattgagctttgtctaaaaagcactaccttattctcgtgtataaggatttcttagtttggttttgctctaattaatagcacagttttggattagtcaggagattgactttatagttaattctagatagggaatgttttagaatgcttgtgccggtggtgatcaagtaacttatttttctgccactaatctgtaaatgagcaataatgcccactatctatttcttttggctggctttacttaataaaataggcttaagacatgctttaggatggggtagaattctagtaatggaatcaaccttaaagaccatctaggctggcggggcacagtggctcacgcctggaatcccagcactttgggaggctgaggtgggtggatcacgaggtcaggagatggagcccatcctggctagcacggtgaaaccccgtctctactaaaaatacaaaaaatttagccaggcatggtggtgggcgcctgtagtcccagctgctcgggaggctgaggcaggagaattgcttgaacccagcaggcagaggttgcagtgagccgagatcgtgcccctgcactccagcctaagcgacagcaagactccatcttaaaagaaaaaaaaaaaaaaagaaagaaacaaccatctagactaattcatcttacacagatgagggaggaaactgagacccagagtggttgaatcttgttcatgatgtattattgtgacaattttttaataagtagatatatagcagcatttctcagttgtgtagtagattaaaacttctttttctatgcaggaatgattgggagtgtttaattcattcacatatgtaggttagttggtaaaggttgagtttagtctattgtgcatatgagacatagggctttaaggatctttccttttggtcagaggcaaaggtgatattgcagaaacagatgggaaaactcacaaattttatattttcttttattacacttttagaattatccctcattcccaacatttttcttttatttaggtcctaagccttagagccaaacagaaaatactagttactagaatattacctggagggttaaacttttaaaatataaccatactgattttaatcaaagaagattgaaatgtttcgtgaaatattagtggtatctgttcagtgtagttaatgaaagacaagtagtcatgcaccacataatgacattttggtcagtggtggactgcatgtgatggtggtcttatgaaattataatggagctgaaaaattcctatcacctggtgaccttgtaatgtcatagtgtaacactttatattgtttatgtttagttatacaaatacttaacattatgttaacagttgcctacagcattcagtacagtaaatgctgtacaagtttgtagcctaggagcaataggctatccaatagcttaggtttgtagtagtctatactatctagatttgtgtaagaccactctgtgatgttcacacaacaactaaataatttgatgtatccctgcgattaagcaacacatgattagtatgaagaatggtttgatagttgaaggaaattaactcaaaactcatttgcttccagggctagtaatatgttctacatcatgtatcaccccacgcctcaaactctagccctgtacactaacttatcacaaaccttggatttttttgcacaattatcaaaatgacatatcaaaccaaccgtacatcttgacataaaaacagtatgagacaaaatgaaattctcttgggatattgaaaaaattttttttgcctgtgaatttagtaattttacttattaagaattttcaaatgatttcagttcttaaactgaaaaataaaattcaaaaattaattgcattttttccagtgtttcttctatgtctttatattggtagaactgtccaactatatggtaaggatgtgaaatgttaaatttacttgaactagagttacaatgaacattagaattaataatcagacttcttttttttttctttttttgagaagggagtttcgctcttgttgcccaggctggagtgcagtggcacggtcttggctcaccgccacctccaccttccagattcaagcaattctcctgccccagcctcccgggtagctgggattacaggcatgcgccaccacacccagctaatttttgtattattagagatggggtttctctgtgttggtcaggctggtcctcaaactcccgatctcaggtgatctgcctgccttggcctcccaaagtgctgggattacaggcgtgagccacttcgcccggccaataatcagacttttagtagtaaaattactttcaaaaatggagattcctttgtcaaatagtactattattagtactaagattgtaaagaggttatttgtgtctgattttgagtttgatgctacagagaagacaggttaggcctgcattgacgtttttcatcaagggcagaattgatgatacagaaacttgatttctgtctaggcatggtggctcatacctacaatcctggtgctttgggaggcggaggctggaagctcactcgagactaggagtttgagaccagcttgggcaatgtagtgagaccaccgtttctacaaaacaaaaaacaggtttctttagttaagtataaatcattgatctgtgattaatccaaacactttttcctcagtatagaccttggggttcttcggtgtttgactaccttcttttgaaggaaaccaccttttttttttttttttttttttttgaggcagtctcactctgttgcccaggctggaatgcagtggcacaatctcagcccactgcaacctccgcctcatgggttcaagtgattctccagcttcagcctcctgagtagctggcattacaggcatgcaccaccatgcccagctaatttttgtatttttagtaggggagggggtgtttcgccatgttgcccaggctgttctcaaactcctgacctcaagcgatccacccaccctggcctcccgaagtgctgggattacaggcatgatccaccgtgcccacccgaaaccacttgtaatatacctttaggagaatgcttttagttacatcatgatccctttcatgtagctaacaacaaaaatgaatattaaccccaaatattggaactcgtattttgaagcaagttatttcttggtatactttagtgccagaattggtactgttatgtgattaactgtttttgagactaagaaaatattttgctggacatctgatgaaattatcttaaaaacagtgcttgggtgttttccctggagtgtagtggcaagagtactctgttgtccatcagagccacttgctgctctcagctggccttgctgttgaatggcataatctgatttcgttggagtacccaagtcctaagatttgaagaataagggttattatctcagtctcatcttttctctgagatagcatttgttcaggaaatgttatctgttttcaatggtgaagggagtgagagtctgcttaggagttactgtatacattaaacattggtgaccggcctttaaagaattagaggctaggcctggtgacttacacctataatcccagcagattgggaggccagggcaggaggatatcttgagcccgggagttcaagaccagcctaggcagcatagtgagaccctgtctctacaacaaaatttttacttttttatttttatttttattttttgagatggagttttgctctgtcacccaggctggagtgcagtggcatgatcttggctcactgcaacctccacctcctgggttcaagcgattctcctgcctcagcctcctgagtagctgggaccacaggcgagggctaccatgcccagaatatttttgtattttttttttggtagagatggggtttcaccactttggccaggctggtcttgaactcctgacctcaagtgatccacctgcctcggcctcccgaagtgctgggattacaggcgtgagccactgcacccagccctacgaataatttttaaaaataaattagttgggtgtggtggcacacctgtggttctagctactctgtgaggctgaggcaagaggattgcttgggtccaggagatctagactgcaatgagctgtgatcatgctacagcactcgaagcctggggaacagagcaagaacttgtctcaaaaaaaaaaaaaaaagtaaataaatattagacacttctcaagccctaggtcccaattgattgatttttttttttcttggatgcaggattccaaaatacttcaaggtcattattaaacatttaaagttaatgtcataatgttaacgatgcaagtttaagatgctgatataaaaagaagcttgagtagttgtcgtgtaatcttaggattaaagtatagattttaaaatgaaaaactcttagaaaatggcaagacgtgataacttttcttaataattgtaggagaaaaattacaaagcaaaaatgggcatagaaaatttctggctatatatttaaaaaataagagaaaatgccaaaaagttacttaaaataacagtttaaaatagtttatacaaatacttcagaacatcatctagctcttaatgatcagatgttcaaaaatattcatggacaacttgtataagaggagaaataactgatggtaaataaacatggaataaaaagtttgtactcagaaatgaaaaatgccaattaaattagtgataccacattgtatatctgaaatagctgagaatgagtatattctttcatttattattgtataacaaattggcataattgagttttatagtacatatgaaacaaaaaaagttaatgctattttgccctgtaatcccacaattaaagctttttgaaaggaaataattcaaatgagcaataatactgtacacgtataggtctatttagaagggcattatgtagttttaaaaaatcactataatgtagaaacgagttagtatgaaactttaggacacaaaatgagatgccagtcaattataagtaagaggtctgtgtgggtaaaaactgaaaggtaatagaaatgagaagaattctggttggtaagaataagatagttatatatcttaaagctttcagtgaaatcttaaccttttaattttttttttagcctttttttgttagttttgagagagagtcttactgtgttgcataggctggagtgcagtggcacgatctcagctcactgcaacctctgcctcctgggttccaataattctcatgccacagcctcccaagtagctgggattacaggcctgtgccatcttacctggctgatttttgtatttttagtagagatggggttttactgtgttggccaggctggtcccaaactcttgacctaaagtcatccacctgctttggctcccaaagtgatagaattacaggcgtgagccactgtgcctgggcttttcagcctttttttaatgcaaagaattgtgacatggttgtaatcattttgtgcttttatttatttattttgagatggtgttgttgcccaggctgaagtacagtgacatcatcatagttcactggaaccttgaactcctgggctcaagtgattcttctgcctcagcctccctagcagctgggaccacagagtgcaccaccatgcctagctaatttttatttttcgtagagacagggtctcgccacattgcccaggctgatcttgaactcctgagctcaagcaatcctcctgccacagccttccaagtagctggtactacaggtgtgtaccactatgcccagctaatattttaatttttttgtagagatggggttttggtgtgttgcccaggctgagcagtaatattttgaaaggaatctttttttttttttctgagcagtaggtctcaataatgcacttaaaatattcagtataccgtgctgtaagcagatgtgctgtcatccaggctttgttgttccatttctagagcacaggcgtagtagatttagcataattcttaagtgctaaagaatggcttaaatgctttcagaatggtgaatgagccttggcttcaactgaaagtcaccagctacattagcctctaacaagagtcagcctgtccgttgagggtttgagggcaggcattgacttctctagctagtaaagtcctaggtggcatcttcttccactagaaggctatttcgtctacattgaaaacctgttgtttagtgcaaccaccttcatcacttatcttaggtagatcgtctgggaaacttgttgtagtttttatattggtacttgatgccttatcttgcccttttatgttatggaaatgggttcttaaatctcatgaaccagtctgctagctttaagcttaacttctgcagcttcctcacctctattagcctttatagaattgaagaattaggacctacctctgaattaggctttggcttttaagcgaatgttgtggctgatttgatctatccagaccactaaaactttgtccgtatctgcaataagactgtttggcttacttactatttgtgtgttcactgaagtagcatttctaatttccttaaagaacttttcctttgcatttataccttagcagtttggtgcaagaagcctacctttaggcctgtctggagtttccatatgccctctcctaagtttaataatttctaacttttcatttaaagtgagagatatgcaactcttcctttcacttgagcatttggaggccattgtagggttattaattggcctaatttcaatattgtgtctcaggggatagggaggcccaaggagagggagagacagaatggccagtcagcagcagtaagaatatatacgacatttattaagttcattgtcttatgggcacggttggtagtgccccacagcaattacaatagtaacatcaaagatcactgatcacatatcaccataacagatacaatagtaatgaaaaagtttgaaataattttagaagtaccaagatgtgacaaagacaagaagtgagcacatgctggtgggaaaatggtgctgataaacttgctccacacagggttgccatgaagctttgattgattaaaaaaatgcaacatatgcaaagtgcaataaagagaagcacagtaaaatgaggcatgcctgtagttattgtgtgctcttaaggaaattactattactatttttgagatggagtctcactgtcacccaggctggagtgcagtggtgcggtctccgctcactgcaacctcgcctcccaggttcaagtgattctcctacctcagcctcccaagtagctgggattacaggcgcctgccaccacgcctggctaatttttttgtatttttagtacagatggggtttcaccatgttggccaggctggtttcgaactcccgacctcaagtgattcatccgccttggcatcccatagtgctaggattacaggcgtgagccactgcactcagccaaaaataataagtggttagtgaatctgttgttggttcatgtacttttaaaaattgtcttccactgggcgcagtggcttatgcctgtaatcccagcctttgggaggccaaggcgggtggatcacctgaggtcaggagtttgagaccagcctgggcaagatggtgaaatcctgtctgtactaaaaaaaaaaaaaaattagctgggagtggtttgcatctgtaatcccagctactcaagaggctgaggcaggagaatcacttgaacctaggaggcggaggttgcagcgaaccgagatcgcgccattgcactccagcccgcgcaacaagagcgaaactctgtctcaaaaaaaaaaaaaaaattgtcttccatgaaaaacagcatggatgatttatgagctttagtttaagcctgctttgtttgtaatttcatgttactacagtggttatgatggcctgtattcaagaatgttgagtctgtgggtcatttatcttatagctgattattttatagtgggttggaaataaggttgtgggatttctgaatccaaaccagaatgctgagaggacattggtaataagatagtgtcctcagtggtgcatgcctgcagtcccagctactcgggagactaaggtgggaggattacttgagcttgggagatcaaggctgcagtgagccgtgatggtgccgcactgcagcctggacaacagagcaagaccttgtctcaaaaaaaaaaaagattttaaaaagtatcctcaaagattgcttttcttcaagttaatctgcaaatttttggattctaggacagtatgagatgttaacttcccacagttacttgtgataaggtcttactaagagaatcgcctcattctagttttaaccttgttcttggaagtttataccaaatttttgtttgcttgaaattcattcatttcagtctataccatttgactgaatttcagaagggttctgataaatcaaaaccagtgtggtactaattacattcttttttttcttttttgggatggagtctcgctttgtcacctaggctgtagtgcagtgacatgatcttggcccattgggttcaagtggtgcccctgcctcagcctcctgagtagctaggattacaagtgtgtgccaccattcctggctttttagtagagctggggtttcactatgttggtcaggctggtctcaagctcttgacctcaaatgatccgcctgccttggcctcccaaagtgctgggattacaggcatgagccactgtgctcggccctaattacattcttttaaaaactttatcttaatttttttcccagatgttgaccatattagctaagaaatttgaggtcctggaaaaatgttttaggggaagcaaaaggtttggtatgcatgttttgcttttgcttgtctttcagttcttaattcaggtgatatgagactttacagaagtcaaaatgccagagtaaaaaggtggttattaaaaataaaaaacctcaaatgtcaaaattaagttacttaaaagtctggttctaccatttactttgagtattaaactagacagttgagattgtataaccatctttgaaaatgatggttgctaaaggtctggaggctctggaggtgatccataaagccgctcttattaggtgctttcaggatttataaggcctaagtccttgtgatagcacagcttatctttattttgtttttagtttttttttttgagatggctgtctaccaggctggagtgcagtggtatgatcacggctcactgcatccttgaccgtcctggggtcaagtgatcatggctgactgcatccttgaacttctgggctcaagcgattctcctagctcagccttttgggtacctaaaactgcaggtgtgtgccaccacagatggctaattttttattttattttctatagagaggggtctcaatatgttgttgcccaggctggtctctgaactcctgagcatcctcccgcttttaccttccaaagtgttgggattacaggcatgagccgctgcacttgccaaaatgatcttttttttttggacagagtcttgctctgtcactctggctgtagtgcagtggagcgatcttggctcactgcaacctccgcctcccaggttcaagctattctcatgcctcagcttcccaagtagctgagattacgggcctacaccacaacacccagctgttttgtgtttttagtagagacggggttttaccatgttggccaggctggtctggagctcctgacctcaagtgatccactcgcctcagcctcgcaaagtattgggatttgggattacaggcgtgagccactgcacccagcccaaaatgatcttttatatgaacatctgtagcttttattgttctactgttctggtgtagtctgttttattgttgtaactatctgagagctggtaagttgagaccaaaacaacaacaacaaaacaaccaaaatcatgcttaaaactggttctttccaaggttgcatttttgttaagatctacttaatagttgattggatgatttttttttcccccctccggtctgagggatggttgcttctactgtataccactgttatcgccagtatttaattatatttgttctggtctgtgaagtttggtaggaagggaagaaagagctctggttggcttttctagattgacaagttagaaatttcacttaagagttaactgttctttttattttaaaggacaatttgataatgtcaacatttaaaaaccaaactactagatacactagttaagttcacttcatagtatcttctctcaggaaatgtgcctgcatatgtatacagaggagaaaatacgaggatatatattgctgtagtttcacacccctctgcccttgtaattggtcaggggaatactctgcctccactatgagaaaataaccagctgtctcaataaatgttatgtattattatatattgttagaaaagcaggctgctgaacaatattgtttctagtttaaaaatgcaaaggaaaactattgtttctgtagacatacagtatgtgtgtaaactttgtaaacaaagttttaaaggatatacagacactccccaatttttcgacttaatgatggtgtgaaaatgatagctattcaatatacccctcagtttatgatgggactacatccagataaatatatcataacttgaaaacattgtaagctgaaaacacactgttgactcgattatatttacgataggattatctggatgcagctgtgttacaaattgagcatctgtacatcaaaattttattggtaactttgcccaaagggggtgggattgtgtagggtgctcaaagggaacatttcattttatctgtgccgaaattttttacaagaatgtattactaatttgtatagtttaaaaaatagataacactgtttatcggtgtgatttgcctaaattgaaataaaagcaacaaatagcatttagacttaattttccttcatgatttgaatagaaaatttgagtcagttgtagtaaggaacttcaggcagtcctgaaagtcaactttttattattaatacagagaatagctttgcagataaacagatattcacagaagtatattaacatttaacttctgatagctttaaatgtgaaaattacatcatggcaagatttacatggtatataaccatctgtttgcttatgtcatgcccttttaaaacttctgaataacttttgcaagtttcttctcagtgtaggacttatttcatttagttattttcattaatatatgataggtgttaaaaaaacactagatgtggtattaatgccagacagacttggtaatggaataagcctagtgaatttgtgttttttagtgatagtaaatgggaagttggaattaccctgcagagaaaaatttcaaaatgaagtaggatttgataataatgggttgtacatatttcttaataggtatctcaggccagtatagtggctaacgcctgtaattcagcactttgggaggcagaggtgggcaaatcatttaagctcaggagtttgaggccagcctggacaacatggtgaaacctcacctctacaaaaagtgcaaaataggcatagtggtgcacacctgtggtcgcaattgttcatggagactgaggcaggaggatcgtttgaacctgggaggtggaggttatagtgagccgagatcatgccactgtactccaggctggtctggaactcctggggtcaagccatccacccgccttagcgtcccaaagtgcagtggttcttaaacttggttgcacactgggaaaaggaggggtgggggtgcttaaaaattattgatggcttgattccagtctccaaaattctgactttattaggggaaggaatgggcattggtgtttttgtttttgttttgagacagagtcttggtctgtcacccaggctggagtgcagtgatgcgatcttggctcacggcaacctccacctcccaagtttaagcaattctcctgcctcagcctcccaagtagctggtactacagtcatgcaccaccatgcctagctagttttttttatttttagtggagatggggtttcaccatgatggccaggctggcctcaaactcctgacctcaagtgatcggcccaccttggcctcccaaagtgctgggattacaggtgtgagccaccgcgcctggctgggcattgggatttttaatgtgcagctaagattgcataccaatgctttgaacccagtccttgtcatctgtggttgtcatggctcattagcaacaattctctggtaatttgttttggtatcttatgtaaagtggtctctcccagttttcctctctctttcctttgtgacacttaacacagtgtacttttggcttggttacttgtttgtggtccttctcccctctacggtagtgggaatgagccatcttgttcaccactatatgtccagttgctagcatggggctggtacagatggttgagcaaatgattttctcacaggtatgagccacagtgcttggccaaaaacatgtttttaaaaagtcaaacagggctgaggtgaggtggcttatgcatgtaatcccagcccttgggaggatgagggtggaggatcacgtgagaccccgtctctacaaaaaagtttgtgaaaattagccagccatggtggcgtgtgcctgtggtccccactactgaggtgggaagattcctgagccaagaagatccaggctacagtgagctatgatcatactactgcactccagcctgggtgacaaaatgagaccctgtctcaaaaaaagaaaaaaaaagaatctttgagtgctgcattgtagttagaactctgaaggtaaggaagtagatacctgaatgtcctgttccattttcattggttttatgtgacagctaacaattagtatttaattagatggctatttgataggtttttaaaaaactcctggtattgatgataggaatgcatattttttccctaggtaacagggtgagatagctaatggattataatcatatctcacttattttaatgggttcataaatgcctgcaattttatcttagactgagtctgccccttaagctacattaagtgtaagtaaacaaatctttgttaatattgtttaatgccaaatgtattgccttatttttgtctcccatctgtaggctaaagaaatcctgacaaaagaatccaacgtgcaagaggttcgatgtccagttactgtctgtggagatgtgcatgggcaatttcatgatctcatggaactgtttagaattggtggcaaatcaccagatacaaattacttgtttatgggagattatgttgacagaggatattattcagttgaaacagttacactgcttgtagctcttaaggtaatttcaattttatgttggggcatgttgaaatgggtaagacagtcctcttgaaagtttttttccccccagttattttctctatctgaatgttaaaacaaaattccacatttaggaatgcatatgttcaggttttggacttaaaaatcataggcgtctgcgttctgagtaaggggatggtacagaatcaaaacaaaaggaggagaatgaatgcctcagtcagattgtttgaaaaaataggctgggcgtgatggcttatgcctgtaatcccagcactttgggacgctgaggtaggcagatcacctgaggtcaggagttcgagaccagcctggagaacatggtgaagccccatctctactaaaagtacaaaaaaactagccgggggtggtggcgggtgcctgtaatcccagctactctggagcctgaggcaggagaattgcttgaacctgggaggtggaggttgcagtgagctgagattgcgccactacacgccagcctggacaacagagcgagactgtctcaaaaaaaaaaaaggaaaagaaaaatgttagagggctggtcaaatagatattttagttcagtaaattggggtatggagaggtaatataattagatttgtgtttttagatacttttgaagtattataaatatataaacataccaaatgtcaaaatgttttaaatcagctggtcacggtggctcgtggctataatcccagcactttgggaggacaggacaaagtgagcatattgcttgagtccaagagtttgtgaccagcctgggcaacatagtgagaccttgtctacaaaaaaataataataattaaccgagtgtggtggcacaggcctgtagtcccagctactcaggctgaggtgggcagagttgcttgagcccaggaggtcgtggctgcaatgagacttgatcttgccaccctacactctaacttggggaacagtgagaccctgtctcaaaaaaaaaaaaaaaatatcgaggaagaagttcaagaaaaaaaagaatttttctgagaaattcaagaaaacatttgctgtaaatatttaacagagaatattatgtacattacatacattatgtatgtacatatggtttagctcagttgaatagtttccagccattaaccatgacagtaataatctagaataggctgggtgcagtggttcacgcctgttatctcaacactttgggaggctggggaaggcgggaaggatcacttgagtccaggagtttaagaacagcgtagtcaacataaaccccatctctacaaaaagtttaaaaaaatagccaggtgcagtggtgcatgcttgtagtctcagctactcaggaagctgaggtgggaagatcacttgaacctgggaggtcaaggctacagtgagccatgatgcaccactgcactccagccgtgtgacagagcaagacccctgtgtctttaaaaaacaaaaatctagaatggtagaaatgataaccgaaaaaagcaagttccaaaattacatgcattacatgccaattgtagctttgcaaagtgtaccgatgatgatctgaacatgaagcaaaagatggtaaagagctgttagggtggcaggcttccgcctttcccttgaaataaattgtttgactttacctttacccaaaaatcttggggagatttttttccccctaggcaacagactgatttttattattaaagaatattcaaaatgataaatggctgtcacagactttcctaatattagagaagcagtgagatgtggttttagcgtgagctgaattttcttgattaatatctgaattgtgtaaagtcctacgaaatatttttggagatcgttattttctgcatctgtaaaatgaaggagttggactagatggtggaaggtttctgcggtgactccaaatactatgaaaagagctaacctgtgctaaaaacccaggatgaatcccagtgctcagaggaatgaatgtgctacctttaagagtatgcaagcagcctgggcaacctagtgagaccccatctcttcagaaaacaattttagccagacatggtgacatgtgctgtagtcctagccactctggaggctgaggtgggaggattgcttgagcctaggaatttgaggctgcggtgagctactccactgcatttgagcctgggcgacagagtgagatcctatctggggggaaaaaaacttactcatggaggttaatgggctgaattgtagcccccaaaattcatttgtctaactcctaacccacagcacctcagaatgtgactgtatttggacaggtaattaaggtaaagtggggtcacatggttggaccctaatccagtgtaagtggtatccttattagagattaggacacagatggggagaagataagacagatggagaagatgagcatccataaatcaaggagagaggccatcagaagaaaccaactgtgctgacaccttgatcttggacttctgcctctggaacagtgaggaagtaaatttctgttgtttaagccacctattctctgatgctttgttgtggcagccttagcaaaagaataccgggggaaaggatgtttctttcagtaaatggtgctgaagcaaatggatcagaatgtatcatagaactaaatgtaagagctaaagctacaaaacttctagaataaatcagaaaatctttgtcaggttagttaaagattcttagatataacaaaagcacagtccataaaaaattgaaaaatcggactttatcaaaattaagattatgttttttcaaaagatgacaccagaaaaaaagtacttgtattcagatatttaaaaaaaaaaaacttttacagctcaataacaagacagataattgtaaaatgggcaaaatatttgaatagatattttacccaagaagatgatacatgagtggtcagtgagcacatgaaaagatgcttgatatcaattgtaatcagggaaatgcaaattaaagtaactgagttactacttcacatctattagaatggcagtaatcagtaaggttgataataccaagtgttggttaataccggagattaaactcttcatgcattgctggtgggaatataacatggtctagctactttgaaaaacagtttgactgtttctcaaaaagttaaacgttaccaggtgatccaacaattatattcttaggaatcttcctaaaagaaatgaaagcatatgtccacagaaaaacttccatgtgtatgattatagcaacattattcatagtagccaaaaacctcagtaacataattgccagttcatcttaactgtgaatagagaaacaaaaaatggtatagccatacagtgaaggactgtgcaactatgaaaaggaacaaaccactgatctatgccagaacatgggtgagcctcaaaaatattctaagtgatatttagccaaaagactacattttgtattccatttatatgacatttctagaaaagacaaactcaagacagaaagtaaatcagtggttgccaggagctggagtgggagtggagagtgactgcaggagggatctttttgggataatggaaaggttctaaaactggattgtggtgattgttgcataactataaatttgtgaaaaattactgaaccgtaaagtaatttatggggttttaatagcccattgatttatgtttggtataaagttggtggtagagggagtttgattttagttgagatgaggtgggcaaacaccccatgggcatttaaaaattctgtagagctgtggttttggttcactatgatatgaggatgtgtgctgttttttcaacaaaattgtaactgcatttttttctatagaaagtttcttgaattttcattggtttttgaaagagctagttgtttatgttttgcattttattgttttaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttggtggatgggcaggtatgtggatctaaaactcattgctgattatttcagagaatctgctttctttagtgttccggtgcttatgactctttccactcttaacacccctttggggttattttttaatagatattgatagcattcattcaaacttaaaaaaaatttaatttgacaaatgtgtccaacttttttaagtgcattattctttatatcaggcactgaactgtatggtgggatcacaggggtgggtgatgtagcccatttaccctctcagactgtttttggacaagtctgggagatgtaaggagctaattattggcctaggtagatgtgcacacaaaagaacttacaataaaattttatgagtatgaagatactagtctctggcaaagggcaggagtgatatccaagaagttttctcaaaggagctgtttgaagtggagtctggttgtgacagcgatggtctattaggaagaacaggagtgtactcaatagttcagagtgggctggagcaaagatgaaccctgcaaagtcaagtctcattaaggcagagcacagaaacaccagaggggccaagtgatgggggtgcccagctcattttttaaaatttttgtagagacacagggtcttgctgtgttgctcaggttggtctcaaactcctggcctcaagcagccctcctgcctcagcttcccaaagtgctggggttacaggcatgagccactgtgcccagccaagaatgtttacaaattttttaggtgaggttaaccttttaaaccactcttttcagatcttctgtctacatggtggtctctcgccatctatagatacactggatcatatcagagcacttgatcgcctacaagaagttccccatgaggtatgacttttatttgataaaattctttcagaaaacttattagggagtggagaagtttaattgtaagttcattagatgtattctctcatataattctcaaaaacaacttgaggtgtgagcactcttgtctgccctgttgttcaaaagaagctgacattaagaaacctgccaagatcacaacagctgtgaagctgggcttattaggacctgggttgtctgtcttagactctgaaatttgcataatataggcagattaattagggcatgttgctgctgggtcccatggatgtcagctgtgtctcataaagtctgctggaaaatacatcttatttgatgcagatgtttgacttcaactgcacagtctattagcattgtccacaaacatcactcaaaaagggtggcttagggtgctgcttctgatgaattactcaaataatgtgttaaccatgtttgtaaaaggcattttataacttgaagttattttttagggtccaatgtgtgacttgctgtggtcagatccagatgaccgtggtggttggggtatatctcctcgaggagctggttacacctttgggcaagatatttctgagacatttaatcatgccaatggcctcacgttggtgtctagagctcaccagctagtgatggaggtatgctgtgttctctgaaatatgacttgtttttttagtaaacttaaggaaagaagatattagggagttttaaattaatgacatttgtgagaaattccatctattccttctgatgagtttatcattatagcctgagccttttcagtagatgcacactactagaattaaaagctcaagcttttgattacaatgaatccattaacatgttttcagagaaatctgaatgactaggaagtacttgagatttaagagtgggaaagtaagatatagggagttggtgtgcatgtatgatattttatgatcccaatgttatttcgtatatttaatgtatgtatgtaggagagactggaaagaaatacacgaaaatgttttaagtggtcctttggatgctaggattacaggtgatttgaaagaagggaaagaggcaaaggttcttgacatggcacactgattagaatatttttaaaataaggtcctaattagattaatactagtacaactctgtggttatcaataaaatctgactttgctaaaggtaaagaaatttgtgaacaatactaaacaaaaagtaacaaaagtagctcatgcattcaggtggatggactttgaggaaatgaggctggagatcctagaggcatattgcatttgttcctgggcagtgaccaacttaacaggcctttacctgtgactgacaaaattggtaaggttctggtctccaggattaagtatctacttctctagggaatggccacttaaatacttattcttaaatcatgttttaaggccactgcaagagaagaggctaatgagacattgtcatttacagcaaggcagatacatgagaagtatttcattctttggtggttgctgctgtttgttaaagccttttttttttttaaagtactaaaaaaaaaacaagttttgtaattagggggaaaataaatacatgtgtaccttacaggttgtataaagtacaggagattattaagtcatccagaaaaaaagcattaacatttcttaagcccctttggcaggggtgggaatgagtagagatttttttctctcttgagtgaagtaacatttagttgaattgagggagtaaagtaagatttttgtctccttttccttgcagggatataactggtgccatgaccggaatgtagtaacgattttcagtgctccaaactattgttatcgttgtggtaaccaagctgcaatcatggaacttgacgatactctaaaatactctttgtaagtaattctacctgaacattttcttgcattactgaatatgtagggttttggtttatttattttgagagagagggtgtcactatattgcccagtcttgtctcgaactcctaggctgaagtgatcctttcaccttggcctcctagagtgttggggttacaagtataagatacagtgcccagcctgaatacatagtttaaatgtgaggtttaagagtttaagggggccaggcgcggtggctcacgcctgtaatcccagtactttggaaggctcgggtggatcacctgagatcaggagttcgagacaagcctgaccaacatggtgaaaccccttctctactaaaaatacaaaaattagcccagcgtggtggcgcctgcctgtaatcccagctactcaggaggctgaggcaggagaatggcatgaatccgggaggcagaggttgcagtgagccaagatcgcgccactgcgttccagcctgggcaacagagcgagacttcgtctcaaaaaagtgtttattaagggattatgctatgtcagattccaacttttatttttaagttttgttttttttttaatggatctacattgaaacacaccaacaggaacttattatatatagatcttcgtatgaattactaggtttttcacttttaaaaccatgttttgtgtttttttgttgtttgtttgtttgttttttgagacggagtctcactctgtcacccaggctggagtgcagtggtgcgatcttggctgactgcaagctctgcctcccgggttcacaccattctcctgcctcagcctcccgagtagctgggattacaggcgtctgccaccacgcccggctaatttttttgtatttttttagtagatatggggtttcaccgtggtagccaggatggtcttgatctcctgacctcgtgatccgcccgcctcagcctcccaaagtgctgggattacaggcgtgagccactgcgcccggccaaccatgttttgttttgttttgtttgaaatttcagtcaaggtaaaaaccatgtttttataaaagcatagtctctgtggctgaagttgccttgactctttcaaggggagtacagttaacagaccattatcattaaggttctgttacattaagacaagccaaaattgaataggaagtgtaaagtttggaagactcatgttcttgatcttgattgtcactacatggaggtcgtggaacataaaccatgaatcggtcttgtttttcagcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactgagaaggtcaaattttaattgtatcaatgggcaagactggtgctgtttattaaaaaagttaaatcaattgagtaaattttagaatttgtagacttgtaggtaaaataaaaatcaagggcactacataacctctctggtaactccttgacattcttcagattaacttcaggatttatttgtatttcacatattacaatttgtcacattgttggtgtgcactttgtgggttcttcctgcatattaacttgtttgtaagaaaggaaatctgtgctgcttcagtaagacttaattgtaaaaccatataacttgagatttaagtctttgggttttgttttaataaaacagcatgttttcaggtagagcttaaactaaatgatgtgtttacttagtgcagtttctggttatgaatattatattgctatgtgtatattatatggactctttaaaatgattgacagattggcaaattcttaaatctttgtacattgttgagtcatatgttcttagagttaaatttgtctcagataagaaagtgttaaagcattagcctgtgtcaagttctttgagtgatactagtgaaaccaaatagaaaactattgttggatcatgatttagtcttatgtacattcacccgaagacaaaaatggtacttaaagtggcagtgttcaacatttaatgagtttttccccttttatccttcgaataggattagatgtttaaaaaaaagttcttctgtgggaactaatatttgatattttaacctaccagagtaaacaggaacacttaatcatacttgtgagtgtagtaaataaaagttttcttgctttgtgctgtgttgaatctggaaccaacagggaagttatagcatatcccctttctaaaatgcttgaggaacacatacataccgaatgtcttttctgatctaattgatagtatttttagtggcttgtggagttaattttccaaagcaaaaggccattagggtttctacatttcatttcatttcattcttttctttcacaagaaatacattctctgtgtgtctttttgttgctctgtcactctatgccctttctctccgactgaacaaatagcttatccatgtgcagtggttttaatacccaaacaatctagacaccaagcagctattttttccggtcctgtgatatcagaattgaccaaggaatacgtatattgtaattgacacgtggtggtatcttccaggtacaaattctctaaattttgtggttagcagaatgggacttgtgataagaatagcttggttttagcataactagggtttaaaataattgtttaattatagagactgaccaggctttggccatctaaactggaaagtgttagtaccctaccttcttttgaaaatggctatggtaaggaaaatgtgttagtaaattatgtattttcttgaaaaatacataattatggttggatgggaatcactaagttgggtgttaactgatgtctcaattagtaacattaggattttcattaataaacctaaaaagctttccctaagaacaggcctggcacagtggctcatgcctgtaatcccaacactttgggagaccagggtgggtggatcccttgaggtcaggagttgaagagcagcctggccaacatggcaaaaccccatctctacaaaaaatatgaaaatcagccgggcttggtggcataccatagtcccagctacttgggaggctgaggtgagaggatcgcctgagcccaggagacggaggttgcagtgggctgagattgtgccactgtactccagtctgggtgacagagccagaccctgtctcaaaaataaagaggattctgagtttgtatagtgagggcttgcagaaattttgaaacttattttgtaagtttacaatgaatttgtacatgatgtgctcatgtcttgggttgagtatcctagacatgattttttcatttgctgcatattaaacatttgttggttgtagtcggtatttcttaaatagaagtttgtcaatattagattagtttcaagaaggacttagctcaggaaaaggatagttatttctgtggttctcagctttgatgcctacagagattctgatttaaattgctggaggagggcccaggcatacattttttaagtttcccaagtgattctaatttacatctagggttaaaaacagccaggcgcggtggctcatgcctgtaatcccagcacttggggaggccggggtgggtggatcacctgaggtcaggagatcgagaccagcctggccagcgtggtgaaaccccatctctattaaaaatacaaaactgaccggtgtggtggcaggagcctgtaatcccagctacttgggagg

SEQ ID NO: 17286 - DNA, 37414 bp, Human
acagttgggattacccacatgtgcctctgagcctggcccagttactgatgagtgcctactcttttttctttttttttttttttggcagagtttcgctcttgttgcccagactggagtgtgatggtgagatcttagctcaccgcaacctccgcctcctgggttcaagcaattctcctgccttagcttcacgagtagctgggattataggcatgtgccaccatgcccggctaatttttgtatttttagtagagacggggtttctccatgttggtaaggctggtctcgaactcccgacctcaggtgatccagccgcctcagcctcccaaagtgctgggattacaggagtgagccactgcacggggccgagtgcctactctttatgtgtcccattttaaacttacaccaacactctgaagctgaggctcttagaggccagccttcttgcctgggtcacgcagccactaagtgagtggttaatctgaaactagcacctaggggagctggcgaaggggcccagggtagcagaggccatgaagaactctttccaagttgttgtttttttttgttttttttttttgggggggggggacaatgtcactctgtcagtcaggctggagtacagcggctcaatctcagctgactccagcctcctccttccaagttcaagcgattctcgtgcctcagcctcctgagtagctgggactacaggcgcgcgccaccacgcccgtctagtttttgtatttttagtagagacagggttttgccatgttgcccaggctggtctcgaagtcctggcctcaagtgatctgcctgtctcggcctcccaaagtactaggattacaggcttgagccactgcacccggcccagattggttctttaaagcggagttgagaggtggcgctggaggggaggaagcccttcgacatttgctcccagcctcaaaactgggttgcaccggcatctgttcctagccctgtggggttcctggagccccgccttgtcccgcccggcctccctgagttcttgtcctccccctgcccaccagtctcagtgtgcggggtggggaccaccaggctgggaagcccagagttcccaggcaactcgtgcgcctgggagggtcatagaatccgtcctacactcctcaggatcttgaagggggctcttccttacattcccagtcacccctcccccagcccctacacagggcctaggtaacctgtctgcaccccactcccactctgtatcagctgccctcttcctcagcaccctatcccactggagcaccttttccaactccagtcgccacttttaatctgccgccttttcccagcagccagtcctgattgcctcctccgtagccccagttgcccactgctttagatagtgtcgcagctggctgtgaggagtgtcctgattctgtaacccggcacctcctccacagggccctagacgcctcaagccttccaggacgtttgttgatcaaaggcgaaggatgtgcagaatcttcgtccatctacgaattaattctcgaaacctgcttcgagtgggcctcgcgcgtaacacaggggacactcagtggtgaacgagaccactcgcttaggcctagcagcgaggtgaccgttcactcaacacacactaactgggtcccgcaggacacgccccggctggtcgcgggggttacccggggtgccctcagtcggccggccggccataaccggcgtgatctcctcgcgccgagagacccagcagggacctcgcaaaacccaatccacgttttgttttattttgtctttttgcctctcaaatgcatggaaattggctgctagtagctttgctacaggagaaaatcgctaatctgtagtgcaaaatcggcgcacaggggttttctctgagattgtctagacgccgcgcgggcgggtcggaggcgccagacacattgtatccggagcgcggagctcgggagcaacagtcgccgcctctactctgtatctgcgccgccccaggcgcccagtgtccgcgctgggcctgggactgccctcgggggatggggcccacgcgggctttgatggggggccgggggccactttgtccacccaggcgaggcttgggtccagcgccggccacatcaactcccgggggatctagcagcgcggaggccaagcaggaggcccaggagccccgcgcgtcttccattagcgcagggacctccgggccacagctcagagaatcggaaggcctcctcccccttcccgagcgctgccactggggccgaggtttccagcaagaacccgcgtgtccctgcgcacgcacacacggtgcacacgtcagtccggcgcctccccgtgccccgactcacgcaggtcctcccgcgcgcccgcaacacgcccgcaggctcctgtgtctgctgccggggcagcggggcccggaagggtaagaacgcggctcgctagcgggatggggaccctggcccggcctggacgctgtcccgggcggggcctgggggcggagcgcgccgggccgggcgcgcaggaggggaggcgggtccgcgccgccgccgtccgcgccgccccgcccttggcccagccgctcgctcggctccgctccctggctcggctccctgcctccgcgtcgcagcccccgccgtagccgcctccgagcccgccgccacatcctctgaggtaggcgcagcggaaaaggaccccggcttccttgcgccctggacggcgggggccaggcccctggggagctgagagggaggcgctgagggaggagcgggcgaggggccccggcagcccggccgcggggagggatcgcgagcggccggcgcgggcctggctggtgagcgggcgggcagagaaggccgcacaggcgggtgccgaacaggtctgggctggggagcgcgaggccgagggtccagagacgcctgcggctggcggcgagaggcggcccgggcttgcgggcggaagtgcaagggcggccgcgtggaggcccggcgggccgcgcgtctaggtgaccttccccggcggcgccctctggccctggatcccaccagcgtgcatccggcggggacccgttcgccgcccacgctcgccggaccaggccagcgggcgggtgccggccacgctgccgcctcggggatgagctcacgtgacgaccgtggccccgagtccccaggcccacgcgccctggccggcccacgcccgcagaagctggcgcccggcaccgcccgcctgtgccagagccttctagagcggaacgcgccggccgagagtcgacttaggcggtagaggccggagctcgggcctgggctgaaggtttggcctcggaaaaggaggccccacggggaaggatgtggccttcttggtcttaggagtgattactggttcggtcgttcattcattcgccaaatgcggcggtgcattctggaaactgtttcggagcctgactttggattagaggcccgcagtcttagtggtttgtacaaggtcacacagctgggaagtccccataccttcgttttctcatctataggacgggagcaattgtacctctccttcgatgagttttggggaataataaaatgaattaattagcatgaaacctttagaacagtgccggtgtggagaagggctaagtagaaaccctgacacccttggggctttttgggtgaatccagcccatcccccgcagaccattttgctacacgtggcgttgtggaaggggttcaataaatgtagctcctgtttttaaacattctttcactattattgacaagcatttgtataccaggtattgagtaactttcagcttaatttatgaaaaatcttgtaagtttacaaatggacattgtcaagctggagcagtaagtttgcatgtggagatcttgaatgcaggagcagaccctggtttagagcccgttccgcccggggtccctgtccccttgactagcctcccctctcctggggagataggggaaagggctcctctgttgcctaaacttctccactgaggcaggagaaggccagagcagactaccgagggccagccttcattctgcccaccccagctctggaccaactcagctcctaagggtcagactgaggcactgaggccctgtgctactttgtcttcagtgcctggggtggtgctgcctggcacacagtaggtgcttgagaagggtctgtgggggtaaatgcactcttgtgtcagaatccacccatctttactgacagagttttactattccagtacatggcccatagtaggtgcttattgagtatttgtggaattattgaatgggcatatgaagggctgcaggcccagaccatagtcctttgatcctggactttttttttttttgagacagggtcttgctctgttgccaggtctggagcgcggtggcaccataacggctcatggcagcttctgtttcctgggttcaggcaatcctcccacctcagcctcacagagtatctgggatcccaggcacacaccaccacgcctggctaatttttgtatttttagtagagtcggggtttcaccatgtttgccaggctgatctcaaactcctggcctcaagcaatccacccgcctccgcctcccaaagtgctgggattacacgcgtgagccaccatgcccggtcctggacatccttttgagggacacagacatctcacttgtggaaaacagcctcacctagcagagagtcacaaatatttaaagaactgtaacagtatgtatagtctcttgaaataagtgctttaaacacatcgtcttcattctctggttttccaagtcccgagggaaacttgttgaactggtgtttctgggcttgcagggagggtgacatgggtgactgggattctacagaaggtgttgggcctgttaccccttccctcatggtgggtggatggacagcttgtgctggggttgtcctgagtagggtgcctgcctgtgggtagtggggactactccttgttgattatttagttttatttttgctattctagagtggggctataggcaggggttattcgtagctcagaaagtgggggaccatacagggatgaggtgcctgtgggcccctggccttgctgaacactaggcaggtgtggacagtgaactccatgctggggaggtgaagggcatccaacctctacccttaccaggaagatgctcctgaagcactgaagtccacttcgcctttgatggaatttcccgtggtgtagtgtcttcggtggtagtgactggaagaggcgcatgtgtggttgaggaccagccgaagcttggaggcagcccctcctggtgctcagagattctgtagtctgcggctttgggttttccatggagtcctgtggtagccactgagaaaagttgaccagtgggctcctcagctgggtctgggcgcatttctccattttaccacgtactcagggggtttgggatgagtgggactttaagttctttactcagaactgtgctggaaagagcactggagagtagcttaggcccataacacaggtctggtgagccatagggtcggtctcatacaggtcaagtcactgtcttgtgcctcagtttctctctctcttttttttttttttttttttagatggagtctcactctgttgcccaggctggagtgcagtggtgcaatctcggctccctgcaatctctacctctcgggttcaagcaagtctctgcctcaccctctcgagtagccgggattacaggcgcctgccaccatgcctggctaatttttttgtattttttagtagagatggggtttcaccatcttggccaggttggtcttgaactcctgacctcctgatccacccgcctcggcctcctaaagtgcggggattgcaggtgtgagccactgagcccggccgagtttgtctgctataaaagtatgattgtcgtcattacagtgattgctgattgagggcttgctcagcacctttctgggggctcaacgaatgttctgtgatgttgagttcaccaccctataccctgggagagagatagtgtgtttccatttcacaggtcagcagactcgagcacagagaggtgaggtaacacagcctggcaggagtggagttgggattcaaggcctggtctgaatggtggtgctctcacattgcagttgcactccaagggacccttgcaaggtgctaacagatgtgaatgccttttggaaagtcaaaattggtgttcagatgggagacattatttttccacaccagtcagagtgaacttgtgcatggctgtgtgcgggccaactggcagtggacaatggagtcacctctatttcttgcaaggacagtggtgctgagtgtctattataagggtccgttttccctgggatctggtgggaggcattctttcaggacctgttcagctaaacaatgcctcattgtggacatgaaggactctggaccctgtggttcagggtgaccttttgaacatgcttagcagccattattataataaatatacaaaatgaaaacttgtgataaaatactgtgtgtattccctgcttaccaagcgccagccactgtaccaagtgttgtatattaacgagctaattcagtcctcacagtgacgccaatccaggctctctttctccatattagagctgaagaaaaaggagtagagaggttgcgacttgcccaaagtcacatacctagaaagtggtggggtgggttagaactcaggtctatttgattcccgaggcttcctgcccaagcactgtctgtctcaaccctacctggtcaagccaagcagtgaggctccagggaacttgaggtgccttaggtcaggtaggagccccaggtatgcctgggatccagaccatagtgtactggctgccagcgcaggccatctccccttgataggtgggtgggcaggctgccctgagtcagcaacctcctgagcccaggagctcagcatggaactcagctgtgctggtggtggcccagctgccagggtgtttcaaaatagaagctacccctggaaagctctactgcccactgcgagactgttgtggaagaatggagggagagaacagctgcattgggtacgcagacctgctaccagaacacagggccatcagcctttgccagcatcctggagcttgaaccaggaactgttcccctgggttgtttcttcctggcaagaaagagaaagtgctggagtgtgtgtgtgtgcatgcgtgcatgtgtgtgagcgagctgctgattgtgttcgcccccatgttggcttttagagctagggttgccttctgctggggaagttgcttttcctggtcctcagggctaggaagaggtgctgtttctgtgatcactggctggtctgatacccctcctataggctggcctagttctgccctgacaaaccacctagaatggtgttggtgaaacagcggggccagagacttttccatagtactctcttccttggcagaatcataagatgatggcaatgatgatgatgatggttgtgattgctctgttggttagcgtctttgcagggatctggtgcacacttacacttggtaatccaggagagtttaatgaagacatcatttgcaaagctgtggatggggtgtcaggtctggtctgttaacaccctgaggcctacaagagagggagcttcttggcaggagctgtggccttgggtagaggaaggtagtcattgcccatctgaagcctagcagggagggagactcggggtgagtaccccgacttcattcttccctaaactcccgtcttctgcaagtacctcacgttgaaaggctaagcccaatcataagcccatggacagcagtccataatgatcagttctgggggcacagagcagggtggaagggaggagaatggatctggaggggcagacagagtatccagtgtagtggattatggttattactgccatttgttgaacacttactccatgccagatacttctgctgttctgcctgtttcactcattccttgtaacaacttccttaggcctaaggcctttcctcccagctgtttttagctgagtcttggagacccatggccaccctgctccctgtatcaaccattgcagtagttgttggctctctaggggtgcaaagctcatctgcctgaatccttctattattactatttatttctttttattttttatttaaaagagacagggtctcactgtattgcccaggctggtctcgaactcctgcattcaggcgatcctcctgcctcagcctcccaaagtgctgggattagaggcgtgagccaccatgcctggcacatgcctgaatccttttgagggagcctctgcagagaagagagcatatttctaccaggcgggggcctggtaggtgcttagtgcaggaaccgccctgagctgctgcttctcagtggcacctgggggcagccctgcctgttaggcacaggctgagaggtagggcaggaggagttccatctcttctggcaggctcttcttgaacaagcgcctccggtgattcttgtgcaccctgaagttagggagctctttcctgctcatgatttctggcagggtggccaagccactagtggtcacctgggagtgaaatgtgccccgacggaccttgcctgataactcttccatctcagtgtagtttaaatctgttcttgcaatctgtatggacactctaggtagccttctggcattgctactgcagcagccttggaacgtgatttgggacacaacacagctcaatttcaggcacagtggttggcttttaaagtgctgtttttttggagagggagtctctcgctctgtcacccaggctggagtgcagtggcacgatcttggctcactgcagcctttgcctttgggttcaagtgattctcatgcctcagcctcccaagtagctgggattacaggcacttaccaccacgcccggctaatttttgtattgaaattctttatccttaaacaaattattagtatacacaaacagcttaaataatgaagcagaacaaaaaatgaaaattcgatttgaagtgcattccttccctaaacctccttctccagaagcgtatctaagccagccccaatttgcagattggcttgtatccttccacatgctttcccatccattcatgaacatagaaagatgtgtaaaaaggttttcctccaattacatggaattacaaattttctgacttttttcatttaactgtatcatagctagctagctttctttcttttttttttttttgtttcgagacggagttttactcttgttgcccaggctggattacaatggcgcgatctcagctcaccacaacctccacctcccaggttgaggcaattcttctgccccagcctcccgagtagctgggattacaggcatgcgccaccacgcctggctaatttattttgtatttttaatagagacagggtttctccatgttggtcagggtggtctcgaactcctgacctcaggtgacccgcccacctcggcctcccaaagtgctgggattacaggcatgagccactgcgcacggctatcgtagcttcatagctagctttctatgccaccacatacatccaccttattcttttttttttttttttttttttgtgagacagtctcgctctgtcatccaggctggagtgcagtggcatgatcttggctcactgcaacctctgcctcctggtttaagcttgtgcctcagcctctcaagtagctggcattacaggcgtgcaccatcacacctgggtgattttttttttttattttttttttatttttagtagagacggggttttgccatgttggccaggttgatctggaagtcctggcctgaagtgatccgcccacctcagcctcccaaagtgctgggattacaggcatgagccacccaccttattctttttgattaccatatggtactccttagtttgcaagtatagtaccttaatttttattcattcattttccttttgatggacttttaggttgcttctgggttttgtgttacaaatactgctgcagtgagcatcctcatatacacatctttgagtagtgccttggttgctacagtggggcaggttcctagaagtggaattgccactagggttaatgctgggttaattgctctccaaaaagagtgtacctgtagtactcccccttggcgtgaacaagagtgactgttttccacaccctcactgacactggatattatttacgtttttgccagactgctggttaagtgagcttctgaaacacagatgtggtagtcactcaacagtggctcttggtggcccttagaataaaatccatgcatggtattgaggtcagaagcaaccagtgcttctgatggcacttggtctcctcagcctgagatcagctctccttaggccgaggtgggagcaggcagggagtggaggtcattgctagttgagggtctccccaactcccccactcttggtgatgctgcaacagtgagcctgcagagggagctcttacttcctggttgcattgtaatgagttcctattgtcagattccaagtttctacttttttccccattgctaaataatactttgatgctcattgctcattcactcatcaaacacatttatattgaatgcctattatgtgccagggcttagcatctttatatacgtaactttttccatattttggataaatttatgcatgacaggctctggggtgctttgaattcaaagaggtgattttgggggtaggtgtatggggtagggtggggtgggggcacggtgagcacagcagctgtcattgccattcagctgatgagccaagaaggatgtgtacccccaagacagaggttacgtaagtattatgcagactgtgctgggtgatagatacactatccttcccctctgtgcttccagtatgggccggattttcattcctcagctggaatggggcttgcataatttgttcaaggtcagccaaggaaaggttgggtaggtagactggcaggctgtggaggggaaccagggactcctgtatcctggtgtgacttgctggtccttctcaaagtcttcagtgactgcaggcaggtctgctcagcctggccctgcccatccctctgtttcctaccaaccagtgggaacaaagcccccaggctctgccctgaagccatcactcaggcagagaggcctgtggttctgactcccccaggacgccctctgacttctgtctgtccagggctagctgctttgccgatgccagactgccctgcttcatgcgcagcctctagaggctcagcttgtgaaggcccctggggggtggatgctgcagagacagctgtgtatcagtagctaactgtacaggctccgatttggagcagatctgggtggaaggagtgactgggaggggtgggggccagggttcagccttcaagtcagcaccctggcagggtgttaagtgaaagcaggctttgttgccgacttttctttcctccagtcctcgccttagaaaattaatgcagattattatttctatcataaaattgtctctgaaatgggttcgagagctgtgtaaaaatgggcattttgggggtgctgtctgtagctgtaagaaagctgaacttctcggagcggcagagctgtctcgggccttccttagttccgtcagatcagtgcagcaggggatgggccgaagtgcacaaaaaggaggggaagctaccactacctggcagttgggggcctttagtgaaagggtgagtcatccttttgctgtcctcggtggtgtcacttcaggcccaggagtggacttgactccattcagccagtggtttctgtgagtcttccttgccaggtgctatgctggggagaatgcttacttgggggcccagaacgggggagattatgcttcattgtcggtgttcaaggagatggggaagagagcaagacacagatgagaaagccagcatccagtatgtttacagtgaggcattggatagggatatgttttagtgaaccagcaagttcacttgcgtgctgctggtaccaactacatggttgtgttgtggaaccccacagccccaaaagagcttggccgtgtcggagctcctagaggccccaggaggggtccggtctgctcttctgagctctgctctctgagtgccttgtccttgggtggtaatctctttagtggccttgtacttcaggctgatgtttgctgtgggtggggtgttttttgacaggtggctgtgcttgttggattttggggattagcgatgagagagggcatttggggaacatttaatggatgagtgctctgcctttatcctgagcggggaccagtccagatgtgaaggctgctgtgtctgggaggcgtctcttctgtggggtcaggggagagtcgtggggaaggctctggctcctaaggtccagggaggtcttaggtgacccacagatattaccactggactgcttctccttctgcttccccagcccccaccccggctgagtttgtggcccccctgggaggcatagcactgaagaggggtacttggttcactgatggtttgttaaccctgtcgggtggagaatgttctgggcccgttactgttatgttctgtgtctgcctggggttacattgcctcagctttcaatccagagttgttctcctaggaaggtgtcaggtaaagggtatttcttgaggttctggtgggtggtttcctggtctatcccggggggatgcacctacagggttagtttgggagggaggaacaagtggggagaggggagcccccagactggaaagagccagtggcgggcagtgtaaaatggatcttcccccctcatctctctaccctgatactaatgtgggctgacctgtccatggtttcagcctgatcatgtgcaagaaataacacagcagcgacaaaaataggacagagtaaacagctcgctgctcttctgtctgtgctctgacacaaaagtgagctgggataaaattaacaaagcatctggaaaaagtaaagtaggacctggatcacaacttcacaatttaaaattgtagaagtttatactgtttcttttacaacatactcaatgagtctgtggcctcctgcaatgcctttgaagttaaagctttggccaagaatgcaacttccattgatgatatggaagcatatcatgtcatatgacatgccaggagcatgtcatatatgtgtttatttgtgtgaatatatatacatgtaacttcagatggtatatatgcagatgaattttgataatttaggtatactgtattttaaaacgaatggaatggtccttctggttgagactaatgattctggggatggagaaggtgcaggagatgaggctttctcatgcatgaccccctctcctcctgggcagagcacaccatgtacagtcccagattaggatattaatcctgtgtacacagcatatacagcatgccaaagcaaagccttccaggaatgcagtgtggtccttagggcaaagactatttgagttactctccttccttgaacaccgaggtgcttaataaatgtttgttgattgacttagtgatatgcagcaatcccaagtagtcctttgatggttggttttaaaaataaagttacactggagctcaataaatatttgtttaatgtatttggaggatgtatttgggttttttccatgtgaagagctgccaaactggtttggttttactgtattctctatgagaaatatgaagtgggttcccataaagtccaaaagttttgtgaaaagttgggcccatcctggcatatagtaggtactccataaatatttgttgaatgaatgaaatcagagccacatggaaaatgatgttcccatgaaaagctctgatttctattcggtacatttaatgtcctagtagctgacattttgtaagatgatatgttttattggcaacagtcctacaattcagtaaagtcactggctcatgggaatgtgtctttgacagtttattcattaagcaaatatttcctgactcctactctgttctgggcctgggctcagtcctggggatgctgaggaggagaggtctaaattgttgatcatctgtcaacaaagactcattgagtgtctcaagctctggccacaaaatgaaggacaagacagcaagggcttcttggcccatctgggaggataagctacctggtagtcttagtgctaggtgatttttattggttgctaattacatctaataattgttattgatggaaagctaatttccctaattatcaatgcatttattctggtgattcttttatcatagcagaagatggctgtgccacccacgtatgccgatcttggcaaatctgccagggatgtcttcaccaagggctatggtgagtgttgcagagagggggtgcctttcagctcacagactgagttggcatgtttgagactttaccgataactgtttaggagacctgggtaggtcagctgttctgaactttcacgtgagggaaaaaagaagctttcatttgtgtggcaattgtagcaactttggttgtgcacccagttggacaggctcctgcattggtgctgtcaagtgggtattcttgttttcttttccaagtgtggagcagccctgtggaagctgctgcagtggagcgcggcttctatatttagcctgtgcttaggcacatgcccacgaggcccagtaactgtgtctttgccagctgtcaggtgtcttcttatcagaccctgctgggagtgcaggtgggacccaggtgggggtgcccattctgtctgctgctgttccatggcagctgagagctccccccacgagcagcagcagagactgggtgccctcagcccctgtggcaggagtgtgcttctttttaaaaaagcatcctgaagcaaccatgagggaggcagaggtgctgttctctagttatttaacctattgacagttgtcttcttctttctttaggatttggcttaataaagcttgatttgaaaacaaaatctgagaatggattggtaagttgtccaacccacatggaacatgagtatttatttatttttattttattttatttatttatttttgagatggagttttgctcttgtcgcccaggctggagtacaatggcgtgatctcagctcaccacaacctccacttcttgggttcaagcgattctcctacctcagcctaccgagtagctgggattacaggcacccgccaccatgctcggctaattttgtatttttaatagagacggggtttttccatgttggtcaggctggtcttgaactcccgacttcaggtgatccgcccaccttggcctcccaaagtgctggaattataggcatgagccactgcgcctggcttatttttatttttaaaaaagattttagattcagggtgtacatgtgcaggtttgttacatggatgtattgtgtaatggtgaggtttgggcttctagtgtacccattacccaaatagtgaccattgtatggaacgtgggaatttgttgtagatcaacaaataactgtcgtgacctggcccgcaaagccaaaagaaggtacttttttttttttattctggcagtttttgtggttttcacattcattccattttctgcatgatgggtggtccaggggaaccatgccagtaggcccccagttcagcagcgggtaatagaggagaatgggtcaggtctcagttttagttttccttgtgcttcttattttcaaattcacctgcattcaaccacataagtgtttttaaagtaatcttagtagtccctttgaaattatgtgtgcagtaattgttggaagaaagaagttttgggtttgaattaccgctgtgtcagctttagctcagtgctttttctctgtactgccctggagccaggatggaagggagatgctttcctgtccagactgaagagttacagggaggaaggaagctgtctgctgacaacaaattccccataagatttctttacatagcaggctcctttactcccatctgtactttaaatatctatttgaattgtagagttagccttggcccccccacattcagggtcttgcctcttgcagaaaggcaagtatagtgtttaggagtgaagtgaagccaagtgagtgctatggtgcaggctgtgactcttctctctcctttgaaggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcaggtaatggctgctgtgaaaagatgtggatttattaattcgcatctgccagcctgccttgtgactaaatctagtggcaaatttcttttctgttcagcttgcacgtggactgaagctgaccttcgattcatccttctcacctaacactgggtaagagtttcatctgttttctccacaaggatgttctctgatgttgcaggtggtggaagccctttgtgacaaaatgttttgggggctgacagcacctaaaatatggtctccgagacctggcgatttaagtcctctggttttgatttggtcccaggggtcgtatccacatctatgcactaacagactatgctataatgagcacttcctaattcaggactggtgtttacccaacaaacgatttctaagtgccacctgtgcttggccctgtgcccatctggagatctaagggtgcccaggccatgattgttacccgccaaggagctcactttctaatagaggattcagaccagtgtttagccgtgttttgtaataagattctgcattttgttagtgttctcctagtttctgccatggaggttgcaggatttctgttcagtaatagccatttcatgtgagttaggctgctggtgatgtaagtggctatgaccaaacgggagtgggtgacatttggaagcagggcctaactggtcactgttgccagcctcatttcttcaggcatggaagtccttctcccagcttcctgctgcttagggacactgagaccctgtgggtgtaactgcaaggtggctcctgaggctgcactttccccaggccttctggccacagatgtaataggcttgttagttcttgaccatcacttggcatgatagcatggtagtctgcctcaattcctgggtgcttttcaaagtgcctagaaggaattattcccttttagaatacacccttgtttttttccactcatattggtgggtcttccaaacctggggaagatgttttatatagtgatgttagggtcaagggcatgtactgaatttcagtttttaaaaattgtgggccgggcgtggtggctcacgcctgtaatcccaacactttgggaggctgaggcaggcaaatcacctgaggtcggaagtttgagaccagcctgaccaacgtggagaaaccctgtctctactaaacataaaaattagctgcgcctggtgggcgcatgcctgtaatcccagctacttgggaggctgaggcaggagaatcgcttgaacctgggaggcagaggttgtggtgagccaaggtggtgccattgcactgcaccctgggcaagaagagcgaaactccatctcaaaagaaaaaaaaaaaaaagagtcggatgcagtgactcatgcctgtgatcccagcactttgggaggctgaggtgggtggattgcttgaggtcaggagtttgagaccagcctgggcaacatggcaaaaccccatctctaataaaaatacaaaaattagccaggcatgatggtgcgtgcctgtagtcccagatacttgggatgctgaggcatgagaatcgcttgaacccaggagacagaggttgcagtgagctgagatcgcaccactgcactccagcctgggctacagagagagactctgtctccaaaaaaaaaaaaaaattgtggtaagatatacatataaaacttaacatctttaagtgtgtagttaaatggcactatgaatttttcagttttgccattcattttttttctttcttccttttttcctttccaacagatatttattagagggaggatctaccaagtgcagacctgtgctgggtgtgcagtgcacacaagtgactgggcacacagggttcctatcctctggagatgtcgtcttatagcttggctatagatgatctgaagagaccattgttacggggctgatttactctcattcctcttcgctgctgtagtttctcctgcaagagcactgcctttttgcagtgctgtgcactctccccccaggaactctgccatggtatcagggagcggttatctggaaagatcctgggataggatgagaggctggaggatgtgcccacatgcttgaatttgctgcctgggactttgcctgctgccctgggatagcacactttggaatttgtaggcgatttccttcccatgaccttagggagctttgcagaggtctccaggccatgcagtataaaacacaaaggaaagttttttggttttttttttttttgggttgagggggacggagtcttgctctgtcgcccaggctggagtgcagtggtgtgatctcagctcactgcaacctcctcctcccgggttcaagtgatccttttgcctcagcctcccaagtagctgggactacagacacgggccaccatgcctggctaatttttgtatttttagtggagacgggggtttcaccgtattggccaggctggtcttgaacttctgacctcgtgatccacctgcctcggcctcccaaagtgctgggcagattcatgtgtttctcctgcctcagcctcccgagtagccgggattacaggaatgcaccaccacacccagctaattttgtatttttaatagagacagggtctctccatgttggtcaggctggtcttgaactcctgaccttgggtgatctgcccacctcagcctcccaaagtgccgggtttacaggcgtgagccactgcacctgccccccttttttttttaatttactttttatttcaaaataattttatacttagaaaaaaatgtggcaaaaatagtatgcagagttctcctgtgttcttcacccagctcctaatgttaatggtttacgtaactataatgatcagaatcagcaagttaatgttgatatcatatagttaattaatctgttgtcacaatgacgtcttttttctgatctgtgatccagttcaggttcctaaattgcatctaattgttaagtcttctctaatctggaatattttctgactctgacacttttgaaaaagagtggccaattattttgttaagatgtccctcagtttggatttgtctgatgcttccttatgattaaatttaggttatgcatttttggcaactgtagttgttgtgttatattcttctctgcacctgatgttaggaagaatatatcagtaggcctcatttttggtgatcagttttgaagtggtgtctgccaactctcttcattgtaaagctactatttttctctttgtaattagtaagtatcttgtgggtagacactttgagattatgcagatattctatttctcatcatacttttgctcaaaaatagtaacatccattggtgattcttgcctgcaacagttacgcttggcaaatggtgactggagtgcagtggtgtgatcctggctcactgcaacctctgcctcctgggatccagcaatcctccttcctcagcctcccaagtagctgggaccacaggcgtgtgccaccaagcccagctaatttttgtatttttagtagagatgaggtttcaccaggttggccaggctggtctagaacttctcagctcaagcgatccacccgtctcagcctcccaaattgttgggattacaggtgtgagccaccacgcctggctacaaatggtgattttcttttcttttttgtttttatgagatggggtctcactctgtcacctaggctggagtgcagtggtatgatctcggctcattgcaacctctgcctccctggctcaagggatcctccctcctcggcctccccagtagctgggactacaggtgcctgctgccacccctggttgatttttatatttttggtagagacagtgtttcaccatgttgctcagtctggtctcaaactcctgactcaagtgatctgcctcccaccttggcctcccaaaattctgggattacaggtgtgagccaccacacctggcctcaaatggtaattttctattgccatccttccttcacttgttaattggtattctaccgtaaggaagagctattccttcttccccatgtatttatttaatcaattatttatttatattagtatagatgcatggacatttactctatgggctataatgcacagtgtcatttattttgtcgctcaagttgtcccagatatgggctttgggagaatacactctgtgtgctttttgacaaacctctgtcgtttttcagagcatgtctttatttctggttttagaaagtgtaccacgctcatctagtacttgtttttccccagtcctgctatctgccatttctccaaggagccttggttctttatgttggagaatgatatttagaaactaagattgtaggcctggcgcgggggctcatgcctgcaatcccagcactttggaatgctgaggcaggtggatcacgaggtcaggtgtttgagaccagcctggcaaaaccctgtctttactaaaaatacaaaaattagctgggtgtggtggcgcacacctgtaatcccagctactcaggaggctgaggcaggagaattgcttgaacccaggaggtggaggttgcagcgagccgagatggtaccactgcactccaatgtgggcgacagagcaagactccatctcaaaaaaaaaacaaaactaaaattctgggtgctagatgtacataatgctactgggtatttgaggaaagttctggtggtgcatcatggagattagaaacgaaagctggctttccaaagtgactgagggtacagcctgggaaaacacctggctcccaggaggagcggagtgtagaccacatctggatgaggccacagacctcaataaggaccagcacccacgctgagtatccatcacaaataaagcttgcttgttaaccacaaatcagtcaggcctctctcgggtgcttgtcaaattagcactactgttgaaatagcttaaaaataaatcccaataatatctgaaagaggaagactccacagacatggtgtgcagtgttagaaagagacctggagagaagcctgagccactccccagcactgccctttctcttggggattgtgggccctggccagaatccagtgagacagtgggtgggggtgccatgtcaactggtgcaggtggtgcacaccactggtcagaggccctgccataggcatcatagtttgtgatcatcagcagctttttattaaaaattgaaaaaggagatggttagaagatgcctgattttatatttccttttccctttgtaaatgtcagcctctcaacagctgtctaatcatcagtcatctcaaccagcctggtgccaatcacatacttggctgaaacccagacttctttccccaaagagcaggcagatgaagataggtttctttttcttttttcttgagacatcttgctctgtcgctcaggctggagtgcagtgatgtgatttcagctcactgcaacctccacctcccaggttcaagcaattctcgtgcctcagcctcctgaatagctgggattacaggcacatgccaccacgtcctgctaatttttgtatttttagtagagacagggtttttccgtgttggccaggctggtctccaactcctgacctcaagtgatctgccctccttggagtgctgggattacaggtgtgagccactacgcctgaccagttttggatttttcttattgagagataatttggttgttactcctttccttcaaaccttgccaaaatgtacagaagtaacttgaacaaaattgaggttccaaggcataagtttcattgtcacttgttctgttggtgagcaggtctgtgcacacctactcccaactgctgagggagctgagcagccaaagaaagagactgacaaatccagtttctcagaaagaaacatttaatagagacttacaaatagaagcgatgtctcaagcagccaagagacagtggatccctgcattcatcctccagaaagtattctttatatagcaagcttttagagtaaagacatgtgcatgtcttagaccatcttgcagaaaactcttgcaaaacttgtgaccaaagggaggttagataagcatctttactttttaaatttttatttatttatttttttgagacagtctcactctgtcacccgggctggactgcagaggcgtgatcttggctcattgcaacctctgcctcccgggttccagcgattcttctgcctcagcctcctgagtgtctgggactacaggtgtgcaccaccacacccagctaatttttgtatttttagtagagatggaattttgccatgttggccaggctggtcttgaactcctaagctcaagtgatctacctgccttggcctctaaaagtgttggaattacaggtgtgaggcactgtgcccggctggcattgtttcttttatgggattgtctatgatgcattccttggtcgtcatggctgtattaggctattcttgccaggcaaggtggctcacgcctgtaatcctagcatttttggaggctgaggcaggcagattgcttgagcccaggagttggagaccagcctaggtaacatggtgaaaccccatctacacacacacacacacacacacacacacacacacacacacacacacacacgctggtcattgtggtgagcgcctatagtcttgtccttgcattgctctaaagaaatacctggccaggcgaggtggctcacacctgtaatcccagcattttgggaggctaaggcaggcagattgcttgagcccaggagttggagaccagcctaggcaacatggttaaaccccgtctacccacatgcacacacacactagctgggcctggtggtgcgcacctatagtcagttctagctacctgggaggctgaggtgggaggatcacctgagctcaggaggtaggggctgtagtgagccatgatcgcaccactgcactcctgcctggacaacagagtgagaccttgtctgaaaaaaagaaaaaaatacctgaggatagctaatttatgaagaaaagaggttcaattggctcatggttctgcagtctgtacaagcagagcacaggcatctgctcggcttctgggaaggcgtcaggaagcttttagtcatggtgattgatgaagcaggagcaggcacatcacatggcaagagcaggagcaagagagagagagtggtggggaggtgccacacgcaaacaaccagatctcataactcattattgggaggacagcaccaatccatgagggatccacccccatggtctaaccaccacccagcaggtccaacactggggactgcatttcaacatgagattcagaagatacagcatcgaaactgtatcagtggtgattttgtttcaagacggtgtcactcttgccatggaacaggctattttcctacatcacttgggaggggtgctggctttattttcagctgtgacctctaaaattcttgtctcattgagaatttggaatttttaacctttatttttttttaatgagaaatctgaaacatacaaaaatatacagaaaaatatgtttaaccctcattctattcctatcacacagctttgatagttaccaacctgtggccaatcatgttttatttatacagccataaatataacactcctccacgcacatactattttaagtaaataacaacacttaatttcagctgtaaatattttattatgtatctttaaatggcaataatccattttaaaggagcataaccatgatattattattatattgaaaaaagttgatcatttctttttctttttttttttttttaaagatggagtttcactcttgttgcccaggctggagtgcaatggtgcgatctcagctcacgcagcctccgcctcccgggttcaagtgattgtcctgcctcagcctcctgagtagctgggattacaggcatgggccaccacacccggctaattttgtgtttttagtagagacgggatttctccgtgttggtcaggctgggctcgaactcccgacctcaggtgatccgcctgccccagcctcccaaagtgctgagattacaggcatgagccactgcgcccagtggatcatttcttaatattgtcaaatctctagtctgttcaaatttacatgattgtttcatgatttttttttttttttttgagactgagttttattcttgctacccaggctggagtgcagtggcgcggtcttggctcactgcaacctccacctcctgggttcaagtgattctcctgcctcagcctcccaagtagatgagattacaggcatgtgccaccacacccagctaatttttgcatttttagtagagatggggttttgccatgttggccaggctggccttgaactcctgacctcaggtgatccacccacctcggcctcccgaagtgttgggattataggcgtaagccaccgcacctggccttttgctgtttttaaaataacaggttggttctttagtctctaaagatgacagctatgtgatttgagcgttattataattcttttttttttttttttgagacggagtcttactctgtcgcccaggctggagtgcagtggcgcgatctcggctcactgcaacctctgcctcccgggttcaagcgtttctcctgcctcagcctcctgagtagctgggattacacacgcccaccaccgcgcccagctaatttttgtgtttttagtagagacggtgtttcaccatgttggccaggctggtctcgaacttctgaccttgtgatccacctgcctcagcctcccaaagtgctggaattactggcatgagccactgcgcctggccccgagtgtcattataatgcctagaataaacatactgtttaatatgtttcagcctattgctaatatttttcttattgaggctcacattgctccattgtcgaagcccttgggagcctcttcaggttaccttgtaagtccttttgcctccaccccagtagtcttcaatagctttgatagatgttttaggttactgtgtacatttcctgcctaagatctgtagttggccatttctccaaggagcactggttccatttaggaggaaatggtctaggtgctgaggatgaagcattaatctcaatgtgaataaagctagaagtgaacagtgctgtgtagtccttgaggctctgagtggatctggttcctcctgtggtctctgctgagaatgcagcttcctgtgggagatgtcgatcttgtaactgaatgatagagacaatcagataaaaatgatccatgttgtatttgttggatgtgatcttgttctccagtgtgtacttttggtaaaagacatggtaataataggtctgcaggtgacactattcacctgctcttcctaagggatgctgggtcttgaggaaccggcagtagagacactgaactgcttatagactcacatctggtatcatcaggttggacctgggatactgtctggctaactaacacttcctggcccccatgactgcagagttccaggttctacatcagtacccggttctctgaaatatgtactcattggggtctcatgaatatggaattgaaatccattttactgttgtactcacttagagggaacatagcctttgtttccttacttaaccatgtgagccacagagtaagaagaaaaccgtctctttaaaagctgctatttaggtagctgccttcatggcagataaatcttttccacaggtttggaaaatatcaaagatgcatctgtttcataattacatggtggctttctacctaatgaatgcctgtgtaggctgctacgttaagcatacaaagaggataggagaagaaagttacttcgtatttatttttcaggcttttcctgtctgtgttctcacttcgttattgtggggtttctgcagactgagtccctgtggaagagaggttgtgtcctgctcattgtggtacagcagtggcttaagggagaactggagccctgacttcacccccaccccactccctttatttgacctgggattaaaaaaaaaaaaaagacaacttgcatttcaaggtgagttagcttctgatcttaatataacttattttccttcaggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgtaagtgtacatgggggcagcagggtgggaggggtggggttggagcatgtgtggtaaggggattgcttttcactgtttttttttttttttttttaagaaagcccagtttttaaccactgtaaagtgagtttgttggcattagatgagccacatggcctgctgctatcttttgtttcccacctacccatttcctggagtgtcttagatcctttccactctgtgaacagtatatattgccacaggtacacaaagtggctgattaattacagcagggacatggtgtcagtccagagcgtgtccattccctgcagtttttgttttagttaacaaaacagctctctttctctgtctaatgcctgaggattagcctgctgggcttgatgacatgtagacatggtagacaaatttaggagctgattatctcagttacaaactatcttctctgtacagtgaagcatgtaaaagtaactattggacagtatggtgaagggaaacagtgattataggttaggagagagccccttgagaattgaagtagattgatgatttaagttaagggaaacacatttcattcatgaatcttgttttatccataaaccttgttttatttagtttcatgaggaattaacctgtgacaggcacaagctgggtgcagagttaccatgtttatttctttccactagaggtcactaaagaagtaacttcttaaacttaaggcaaatcagtgatattaatgtgtaaactaatatttccattaataaattttttgaggaatttttatcattaatttggaatctgttacagctaaaaagtcacaggaaaactatagagatggacaatctagtggttggcagggggcggggagggtatgactacaaagcagtgactgagggagtttcggggagggaactgttctatattctgactgtcgtcatggttacattaatctgtgtacgtgtgttaaaattcgtaaaaatgtataccaagaaaatatccattttggccgggcgtcgtggctcacgcctgtaatcccagcactttgggaggccgaggcgggtggatcacgaggtcagaagttcaagaccagcctggtcaagaaggtgaaaccccatctctactaaaaatacaaaaattagctgggcgtggtggcgggtgcctgtaatcccagctacttgggaggctgaagcaggagaatcgcttgaacctgggaggtggagtttgcaatgagccgagatcacgccactgcgctctagcctgagcaacagagcaagactccgtctcaaaaaaaaaaaaaaaaaaaaaaaaagcaaagaaaatatcaattttattatatgtttaattaagaagaggtgaaacatactaaaaagctataggaaacataccacatgcatagaaatgtttttgaacgtagaattctgattggcatgggaagtgttttccttggtttgaaattgggcattggcaccaattcttcagtaccaattctaggaggaacaatggctgttagccatttcccccacatatctgagcttcagcattttaaataagcaacaagtgggtatggtttatttttggaaccagcgtgaaggcagctgacacaactcatctgggttgccctggtgcttgcaggggcccaaatgcataacagaaattctttgtgcttcatatagatgaatttgaacagttccacctgtgtatttatttatttattattattattttttggtgacagggtctcactctctcacccaggctggagttcagtggcacgatctctgcagcctccacctcccgggattaagtgatactcccacctcagccttgcaagtagctgggactacaggtgcatgccaccacacctggctaatttttgtattttttgtggaggcaggatttcgccatgttgcccaggttgttcttgaacttgtgagctcaagcgatctgcccgccttggcctcccaaagtgctgggattacaggtgtgagccactgcatctgccttctgtttatggttttgaaagctctgtacaggaaggcagtattgtgttcctggttttaggatattctgaaaagtctggccttttttaaaaacatgtaagcccaagaaacttccccatttgaatatattactaaagtcattcaaaaatcttatttttgacaggctgctgttttattgtagcatacttgggctgtctacagaagacaggattctctgtgaatcaggcagtgcctgggtctccctgtactttctagaagcataatgtctgtctcgctgaatttcatggggaaacgaaaatttacaatgtgtggctcatacgtgtaatcctagctacttgggaggctgaggcgggaggatcacttgaggccaggagtttgggaccagcctggggaacatagaaatactctgtctctaagaaattttttaaaaattagctgggcatggtggcaacatgcctgtgatcacttgagcccaggagtttgaggttacagtgagctatgattttgccactgctctccagcctgggaaacagagcaagatcccatcttggggaaaaaaaaaaaagaaaatttagaatgtattctctgatttagggagagtgtcttgtgaagactagagtttttgttcttaggtcctgaagccctttgctggattccaaagtacgtgggctctgactcacagttaaccaatgccatttccactggaaatgcccacaatgatgaggcagaactcagacactgattttatgttaaagatgtttgagagggtctaggcaggcttgaagaccatctgatgcaaggaggatggtcattcctttttaaaaaattgcagcattaaaatttttcttaatttttttaatcaaaggagtctgaacccatggttgtaaaatcaaacagtacagatgggcctatgaaaagcagtgattccagcctgcctcagcctgctcatcccagctccgcagtggcagccactttaactgtttttgttttctgtggttccctccatggagaaggttgcttctgaccaggcaccagtatgcactgtgtgtataaacaacaatctgaaagcagtaatgagagacagtctatgatctgtgccgaccccagcccgacagaggacaaagtgtagactctgagctcttcgtatgcctttttaggggtggcagtgactgcagagtttgtataggctgttcagctgggtggggcagactttcaaattctgagagcttaagcagggccccaaaagaggaagaggagaatttgaatgactgaagaagggaaagggatattcccagcaactggagtcattcagtgtgtttgtaagagaggagggagcttggccagctggggtttcattctgaatgtttttgaaagagggagacattttatgatgtagcaaaaagctccctttcaaatcctgccaggcttagatgttgcagcatgggtgaggagtatgcacaggtggacgagatgaattgtggattaagctcttttgaagtgctgctcctccaagaggctgggtcagtgccaactgtatctccccagcagtggctgcagcaggttgtgccaagggctctaacttgccttctgaggcatatgtgcagccccacctttcttgccatttctggctgtgttctcttctcattttcttctctttccataacattttttatttttacttttattttttgagccagagtctcactctgtcacccagactggagtgcagtggtgagatctcagctcactgcaacctctgcctcctgggttcagacgattctcctgcctcacccccccaggttgctgggattacaggcacctgccaccatgcccagctaatttttatgtttttagtagagacagggtttcatcatgttagccaggctggtctcaaactcctgacctcaaatgatctgcccgccttggcctcccaaagtgctgggattataggcatgagccactgcacccggacttccatgccatttttctggtagaatcgtttataaaagtaataacatcagtagcagtaaaaataaatcactcagaatctcagtgctctacttgctgcttcttttttttttttttccttatagagacaggatctcgctctgttgcccaagctatatcctgggctcaagcagtcctgctgcctcggcctcccaaaatgctaggattacaggcgtgagtcaccacgtaccccctctcccctggctttttctttttttgtttgagacaatgtcttgctctgttgcccaggctggagtgcagtggcgcgatctcggcttactgcaacctctgcctcccaggttcaagcgattctcctgcctcagcctcttgagtagctgggattacaggcgtatggcaccagcccggtcaatttttgtatttttagtagaaacagggtttcaccatgttggccaggctggtctcaaacccctgacctcaagtgatctgcccatctcggcctcccaaagtgctgggattacaggtgtgagccactgtgcctggctaggtgcctgttccatacttatcagacttcctgtaatttagtacctgttttgtgaaatttggtgaacttctgacttcccttaataccagtattggttcagtccatttctgtcatccctgtcttctgggagacttgggtggatctgtctgggctgcagctcacctccctgggaagctcagcatctgtcctgtgcttgtttgcaggaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggtgggtatctgtggaatcacgcatctcacaggcaggcccatctgctctttatgttggaatccttcaggtttgctggagtgctgtgcttcagcttactcaaagtgagagatgctgctgggcgccgtgactcacgcctgtaatccctgcactttgggaggccaaggcaggcagatcacttgaggtcaggagtctgacaccagcctcgccaacacggtgaaaccctgtctactaaaagtacaaaaattagccgggcatggtggcgtgtgcctgtaatcccagctactcgagaggctgaggcaggagaattgcttgaaccggggaggcggaggttgcagtgagctgagatcgtgtcactgcactccagcctgggtgacagagtgagattctatctcaaaaaaaaaaaaaagactccgtctcaaaaaaacaaaaacaaagtgagagatgttctcactttgaaaagagtgccaaatgagtacagtgatcatactactagtacttcttatgggtaccaggcactgtgcagagccttttgtgtagattactgtgtttaatcccatttgaaataggtgctttggttttttaatcatctctgggttttttttattttttgtttttttgagacaaggcccaggttggatgcagtggtgtaattgcagctcactgcagcctcatcctcctgtgctcaagtaatcctgccacctcagcctcccaagtagctgggactataggcacaccagcatgcctggctaattaaaaaaaaatttttagtagagacaatgtctcactctgttgcctgggctggtctcaaactcctgggctcaagctgtcctcccacctcaacctcccaaatgttgggattacaaggcatgagccaccatgcctggccaatcatctctgtttgtttgtttttttttttgagacggagtctccctttgttgcccaggctggagtgcaatggcacgatctcagctcactgcgcaacctccgtcccccaggttcaagtgattctactgcctcaccctcccatgtagctgggaacacaggcacccaccaccacacctggataatttttgtgtttttagtatagacggggtttcaccatgttggtcaggctggtctcgaactcctgacctcaggtgatctgcctgcctcggcctcccaaaatgctggaattacaggcatgagccatggcccctggccaatcatctctgtttttacaaatgaggaactagaaacttaggtgagtaacttgctcaaaggtacacagcaggaaagtgctgggagctggatttgaaccagactggcttactgttaagcctcttccattaataccagttcctgttctatcatgcggactgttaaaaggggcactctgaaatctagggttctaattgataattccccccgccccgcctcacttttcattctccttttcagctcctgcattgcatattaagaaatcaatagtcagttggcatcttgcagagtctctggcattgctcacaggccctcgaactactacacagtttttgcagtaaatcctattgggctcatttctgttgtcacagggcactggcggctgtatctctttggggtgaaatgagggaatctcatgttgcagaatggtgtctgtactggtttgtgtaatttatggacagccctttttaagtctcctaaactagaaccgaatttggctcccttaacagcaagcacttaaaaacaagagaaaaggagcctcattatttatatgagcaaaaggacactggcccctaagaggccttccttctctctgctttgttcttatgaggggtgtcagatctcagcacaccctttgaacagaaaggtatgcacctaaaattgatgtattttgtattgaatttaatgaatctcatgaacaaggtggtcatgaaaaattttgattctaaagtccaaggttggttgactaaaaagctctaattttggagatggaagtgcaaagtattatacttaatgttttctctgttttgtcatttccttgattaggctaaagtgaacaactccagcctgataggtttaggatacactcagactctaaagccaggtatgtgttgcttgtgtgtgaaatcggttctttatcttaaaaaaattgtggtgctggtttgctgatttatgtcattgcttataaaatgtttatataatacagtgggtatatataaatggatatatgtaaagtataattaaatgtttataaaggagtatggggtcattataaaacatttggagaatatgagatgtagcaagcaggaggaaaaaggctgaggctaacacatattctttgctattttcttccatccttttttccagtgtggacataatgcttgatacttatttctggcagattctcaaaactaacttataaatcagccccactgtaaaaagacaaagaaataggaaaagtggtttgcaggtttcctctgcacagttggctaggccagtccacggcgtattatagttctagtgtataaccacttttgaaccctggaaatctaagactaccagctactccctgaatcaggttattccagggaatgtcagtttgttgtgtgcatctgtggatgtacatgcacactacacatgtgtgtacactatgaacatgaacatgtaagaccttaggttggattcaggattgaggtttcatttaaagggatgattgccaaagaagcttactgcatgctaccagtgctatagactaattgtaccaggggaacagtgagaggaaaaaggaaagtggggttccagaagtagatttgggtaggctctctgggcggtgggataattatagttgttttataagcccactgtagtatgcctgttggtcagatagtgctaagtaacaaggattgaagggccatgtagtttggaccctgctgataatacctggaacaggttctgaatttggtgttaatctttcttgtcatttctttcctccattcctcctcctttcctctccctcatttttctccctgcaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgttttttttttgcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaacctcatccttcttctgttgtctttattaataaaatataaataaacagggcatttgtttagatttattttgtcttcatgctctgtgtattatatattattcgttttcactcactgtacaacagattaccatatgtttagcagcttaaaacaacactcatttatttcacagttctgcaggtcaaagcgaggcaggtgtgcatgcctacctggactgtgcttagcttctcacaatgctggaattagggtgtcgaccaggctgtcttctcattttatctgggggcttggcgtcctcttccaggctttcagggttgtggtggaattcagttattttcagttgtaggacagaggtccctatttctttgttggctgagccactctcagtgctcagaggatgccagcattccttgccatggggtcccctccatcgccaaagccagaaacagaaaaactccctcatgtgaaatccctctcacacttccagtctcctccaggtagagccccaacccttttaaggactcacctgattaggttaggcccaatgagggtaatctcccttcaagttaactgccaggtaaagtaacctaatcactggtaatatcctttcatgtttgtaggtccctccatatgggtcatgggaaggggtgattttggaattctcccatatatttatatgtttttaataacttgatggtggatttttttttttttgaggcggagtttcattcttgttgcccaggctggaatgcaatggcgcacaatgtctgctcactgcaagctccgcctcctgggttcaagcaattctcctgcctcagcctccccgcctcctgggttcaagcaattctcctgcctcagcctcccgagtagctaggattacaaacatttgccaccacacccggctaattttgtatttttagtagagatggggtttctccatgttggtcaggctggtctcaaactcctgacctcaggtgatctgctcaccttggcctccaaaagtgctgggattacaggcgtgagccaccacatccagcctattgtggaaacacaaatagtaataaactctatgcatgatccagcttcaacaaatatgaacatttttttccattcatgatttttcagcagaattccttttttttctatgtttgaaagtgacattcaaaacaggaaccatctattttagcattttatgcaactgatcacccaaaaactgtgggcctcagtatttgtcatactgtcttcagggacttgcagctatttctaagtgaatgttcatagaatttatccagagattatggcacatagtggttgctgggtacatctagtcagatgtcaggtacagtattaagatattttacttttagagacagtcttactctgtcacccagactgaagtgcactgtcatcatcatagctcactgcagccttgaactcctgggctcctgtgatcctcccatctcagcctcccgagtacttgggattacaggcataagcctggccctaaaatatttaaaaatgtataaagggttctcttgagtatgagggaatatttccctcactagttacttattgtctgcttgttgcatgcagcatgttggaatatcattgtgcaaaatgctttgagttcataatatctcaccagttaagagaattgagacaatctggtatgaggacacaaatggacaaagtggacaatgagtcagggaagaggactgcagtgtgtttattatagattaactttaaagtcaacaagcagaaactaagattgagaagctcatttgttgaactgagtggttttacagaaaacttaagtaccgctcagagaagggaagctcctgggggactgggaggactttgcaccttggctaaagtggagagtttgcaataaggacaccattcagtctaatacgggcttctgggggatttcgggaaatgtgcagatgaatgacttcttagttttcttaacacagagtttgtgtgtttctgagctgtcaccagggtgagataa

SEQ ID NO: 17287 - DNA, 36611 bp, Human
tgcatcgcgatccaaaggaccggcgtcttttgtagatgcaggggctgagccaggccaagcgcgccgtggaggcccgcgtggacgcagacccgggtgccatacagatgcgctggaatccaggcactttcccgcgctccgcaaatctagatgtttcagcctggatcgagcgagggttagagggttagtcaggccagggtcaacttcagagtcatgggctccctaaatgcgacttctagggttgagttgctgtggacgagcgacccatgtcggaatcccgcgcccacgtggctgcccaaagttccgagtctccgggctgcaggttctagtcacggaaccgagttgggagagtcataggggctgggacttggaggatcggctgaggtccggtgctcttggctgtgttcgcggctcggagccgtcgcctgactgaggggcccgtcacagatgtgtgatgtataagctctgcacgcaacaggagctcaataaatgtgcgaaggggggtatacttatgatcgcactgtatgcaggcggcctagaaggaagtccctgattggcacagggatggaggatggggcaagagccgcaacagcgccgcggagttccaacgctgccggttccctggggtacgagcacagcctcaagcagcctcaagccctaggaagcccccagttcaaagcacagggcgcattggagcctgggcacgatacagttcacaccacggctgcgatggtaagccacgcccaagtcccaagggcctaggggacccccgccctccacagccggaggagaaacctgggcgcagaaagcagggggaatatctggttgtaggtgagtaagcggggtcaggagttcccgttagagtctctgcgtttcgggagaagggtgatcattcccaggcttgtccgacgtctctctcagggtgcgctccggaagagcgagccctttaaggctatgccgagtgggcgcgtcccggcctctcccgggagaggagaggcggggcggacctgtgtcccgcccccggcccggcccgcccccagtgcccgccccgcccccggcactcggccggcggcgcctttgatgttccgacccgccagctcgcggagccgctctgccccgcgccctagcccgcgcctgcagcccgcccaggcggagtcagcccgcgctccgcccgccgcgatccgggctcggaggttcggactccgggctcgccgccccccgggccggctccgcgccccgcactcccggcgcccagcgccccgcgccccggcgggcggagcgcaccatgccgcagctggactccggcgggggcggcgcgggcggcggcgacgacctcggcgcgccggacgagctgctggccttccaggatgaaggcgaggagcaggacgacaagagccgcgacagcgccgccggtcccgagcgcgacctggccgagctcaagtcgtcgctcgtgaacgagtccgagggcgcggccggcggcgcagggatcccgggggtcccgggggccggcgccggggcccgcggcgaggccgaggtgagcccccgccggcgccggctcctcccccgcggtcgccgcgccgcgccgccccagttgcgcgcggccctcggggtctccagcgcgcagagcgtccctgccccggcgtcggccccgacccccgcggtcccaccgcccctcactcccctccggttctccctccaggctctcgggcgggaacacgctgcgcagagactcttcccggacaaacttccagagcccctggaggacggtgagtttctgcccggcccggcttcccttcgtcgcgctcaggccctggcctcggtgggacggggacgccaaggaccgcggggagccgggtgcctcccccaccgcagctcaggaggcggcagaacccaggggtggagagtggggggcgggcttcccgggcgccgccgggtcgagtcacttccggtgccctgacctttataggagtaaacagacccccgccatccccgcctcccctcctgcccaggtgactgactaatccgccgccttcaggagacagaattggccaaggtttcttggttggagggcggggggtgggaggtcaagtaggggccacctcggggaggcctgccctccaggtccttcccctaaaacttggcactgccgatactcccagcccgttccttcccaagtcaggaacttgcaggggaccccttggcaattctttttctctcaagagcagacagccttcagtcccagccgctgccagggctggtgtgtctgacccagctgtggtttttccaggcctgaaggccccggagtgcaccagcggcatgtacaaagagaccgtctactccgccttcaatctgctcatgcattacccacccccctcgggagcagggcagcacccccagccgcagcccccgctggtaagtggaccccgcagccagtgccgccctgtgcttgcagcctccttgaccaggtaggtgaggcaccggcaagagacttctgcctggaacaaaatagacgagactcctgtgctggtcttttctcccatacacacccggtgggatctgaaccaaaaggagaactttgctgaaggaaggaggggccgccctggggcacccccctgccctctgcctcttggcttttgtcttcccagcttgctcataagcaggtgcaggctctgtcctggtgctgggtgatgccagggtggggtcttcttagagaacttttgagccgagaccacccttgctcctcgctgctctgatctgagctcagagctttgcaattaactttctaactagcccaggaaaccctgagcctccttggcgcttggaggaatgggcaggaaagctgatctgttcaggtcccctggttgtgcaggagaaacgtgctgtgttcggtcggctgtgtcctgacgggcgtgagtgtaccgttgccaaagaaggaccctgaacaccatgtgtggaaagtgggttcttaggaaactggcttggtctcagacataccaggaagggttggcaaaggtgctacaaatcagtgatgttgagaagggaccagtttaattaattcgtgaattaaatatttttaagtcccagtgctttgaaaagatttcatgatctttacaaaccatgcccattggtacagatgacctaaagtgtgaagagcctattctgagtgttttggagcagtacagttgcgcttttaaagaaattcctattcgtgtttcacactcttctcagttggtccaagttggggtgaaggtacgtggaaggtttggaggactgtggtaagtgagtgttgggtgtgaatgtaagcccagtgcaggtggggctggcaggctggaggctcgcatggctacagtggggtcaccagagggaggagagttaagtgctaggctatttcagaccaggagtgaagagggtggttctgagagctgctgcatgccaagccagtgggaatgagaagacatataggcttctttccagaagcctaggctggaaagcctattctatggctagctctagaaatgagctccttgccctttgggcccttatctgtaaaatgagtatgtttttcgagtagtctctgtatccgactttctgctctggggtggcttggtatatgaggtggttcacttccttccaagtctgtgagatggggggtgtgccccccagcattcccccgctgatgtagtgactacatccagagaactcaccctgtgtgagcccatgcttaacaaagatgcgttttggatccctacaagatgtaaataaacccttagatttgggactaggttgacataacccaccagtgccaaacttccaacaggtgtgccacttgcataggggctggggtcaccgtggaaccatgattagacaaaaggcctaggcccaaggctctactccagcctcccggggctccacagcagcacagggaaaaggcttcctttcggaggtcatctcatggtgtgggcaagtgctgggagagtatctggagcagggagggcttcgttctgctgtcagggtatgggtgatgggaccatttggtgtcctttgggccacatgggtcaagagtaggctctaacaggacagtggaggaggcacaccaccactggcctgggtcatttatttttcacctttcagtctttctcaagctacagcagatacatttctatgtatcgcacctgctcctataggtacaaatccccttgccctcctccccgcgcagccacagtctccactgtctggcttctggccacacaggaggaggaaaaggacgggctgtgacactggctctctgtgccctggcctcagctgctctgtggggctgcagaaaaggacagaggcagaggtgtaagttggagtgacactcagtgaggaagctgtatgtgaatgtaggagaacctcttttaagcaaacctgccagttataaacacatagcaagtcagagcatttgcttgcattacctgaagacgtgtgggcattgaaaatgtggttgggttttaccaagcaaagtgaatccacccccacattttagaagcatatttattattggattcaaggttcatgtgtctggaaccaggaatgatcttcttttcttgggtcaggagccccttgcaagggccctgaggaaaaactgcctttggaagatttttccaaagctggtcactttcccaagcccatctttaaaggacagacagcttgctgctcaggccctgccacaggccttagatccaggcccccttgccctttgcccggccctctctgagggcacctatgtggtcaacacttatgctgagaggcttgaggccagtcattgcacctccctcaagagcagggaaagcctataccagggacctgctctgcccatgtgtgggtaggatgcccatgtggctactgtgttagagacctcaaaacaggccagctcgaaccttgcccggagcaataggctgaatgaccaccccacagccaactgccacgggacacatttttttttttcttccaaaaaggttccttctttttggtagttggcttcttttaagcttgtttgaggaagaaaaaattaggtcaaagtttattccatgaacactgtcaggcacctgattgatgtaggcttgcaggcagttactggcctagaccagtaaccagggtttttttgttttgttttgtgtttgtgtttgtgtttttttagagacaaggtctcactctgttgcccaggctggagtgcagtggtgtgatcttggctcactgcagcctcaaactcctgggctcaagccatcctcccacctcagccttctgagtagctgggactacaggtatgcactacaatgcccggctaagtttgtttttgtttctgtagcaatgggtctcactgtgttgcctggactttggtttggttttctctgctctgctctgagacctgaaagtaggtggaggtggtgagtggggagatagtgagctgatcttaggctgtactttggggggattctgggatgggtaaggcatcattccttaggcaaactcaggctcaaactcagtgtagtcagtcttgtcatatccaaaattgatatgaggctgcattgagctgtggcttcttctatgagctctacttggagtctgtagcttagacagatgccgagccttttgccattttgatgaaatatccagaatagacacatccatagagacagaaagaggattagtgcttgccaggggctgacggaagaggggcccagggagcgactgctaatgggtatggagatactttctggggtgatgaataggttctggaattagatcgtggtggcagctgcacaatcttatgaatatactaaaagccactgaattacataccctttaaaacagtgtattttatgatatgtgaattacatctcaaattaaataaaaaggctgaggcctttggctgttgcagacttggggccatgtgtccctgtccctgatctccacagttgtccaggtgcctggggatgccccaagccagggggtcaggcatcaggtgtcaggtccagcagaaggagcctcactgaggcagtggactcatgttggggctcccggcaggtccagagcgtgcctgggggagcaggaggtgagggtatgagcaaggctccagcagaggaaggaagtgctgctgatgcacggccagcctgtccgaggagctttgcagagatgcataggtgcaggagcacccaccggcctccacacgccccagagcgagctgtgggccttgctgggaagcgtcagttattggtgttgagcaccagccctggttgcagtgaagcctgttaggagggaatttggcaccaagcttggtaccaggtactgggcccccagactggaaccaggctctaccccgggagtgcccagctgagccgaggagacagatagagacctgaagcagagctggcgagaggagcgctgtcactgaggtgtcccgggcagagccggccccagccctggctgtgaaggggggcccactgaggagcactctgaaggccacagggtgtccaacagatgaagacagaggagggactggcaggccccaggcttccctctgaacacatcccaaacctccccactactctgcagtcagcacccaaagccccagtcatcgccatctctcacccagacagcagcaacagcgtccaggggacccctccctcacccctaacccccatcctaaatcacagtccaggcttcacgtagcagccacagggggcctttaaaaacagagtcagatcacatctctcacctgatgagaccccgcatcagcttcccattgctcttgcagtgaagtcgaagccactcatcacagccgagtgcctgggtggcccccgccagccgcccctcatcacctgcaccagcctcttgctgtctccctgacagcagtcccctccctgtcctagggggtcttacagccagcaacttctttccaccccaggactcttgcactgcttccctccgctcggaagtctcttccccagccctgcacatagccgccaccttctcgttcctcactcagggctcaattcagatgtctctgcctcagggagcctcctctgaccattcccagtaggaccctcctcatcccttggctccagctgccttgccagccctggcaactcttcgggctcaaacggttggcactgctttacaatgcactcaccatgcttaaccctaagaaaggccggctgttcgtttcctcctctgcacaatgggagtggtgagccctcctcccagatttggagtgaggaccagcagcagtgccagggaggggcccagggaggtgccagtgcggcctggccagggggagtcagccatgactgaacccttgtcccttgctggcctggctcccctggggccagtggttgctcagttgtgggccccacgtggacttgggcacggaggggtctggaggtctgaaccctgggactggggactcaggtgtacaggccgcctacttactgccctgcctgacccaggattcttaggaggggaaagtgctatccctggggccaggcagggagccacagccactcactgcattctcagaattctatcctaccaccccaaagattgacctgaaagagactccccttcctcagtcatgtagaagtcctttacatgagatgttagaagcttaagctgttttgtttcaaaaaaaaaaaaaagattggctgggtgcggtggctcatgcctgtaatcccagcgctttgggaggccaaggtgggtggatcatttgaggttaggagttcaagaccagcctggccaacacggtaaaaccgggtctctactaaaaatacaaaaattagccgggcatggtggcacacgcctgtaatcccagctactctactcaggaggctgaggcaggagaatcgcttgaacccgggaggtggaggttgcagtgaaccaagattgcgccactgcactccagcctgggcaacagaaccagactcctcaaaaaaaaaaaaaaaaatgcaaaaaaccctcatggccatcagcctgggaagccgtggccaccctgtgcgtgcccctcattcttgccacgatgccacaggtgtgggcagcctccttgcttgcagcctcccctgtggctctggcttgctcccgggctgccttctttcccagtgtgaatgatgttctgtacacatcactctttcgtttccaccttgactattttcctgaagcataatacccaaacagaattatggggtcaagaggcaggaagagtcgaggcgttttgcttccctggtgccccagtgcgctgtaggttctgagctgtgagtgtcccatgcttacagtggctcagcacagctgatatggagttctgcctttgttgctctgcattgaataggtttgtggtgggcagtgcgactgtgagctattttgaattacctttctttccttggaaggctgcgtagtattggctatcacatttggaaaatctgcagcctcttttctgctgcttccaaggtgggactttgagggtggctccctcaaagccttgatgcctttcaaaaccaggagagcaccatgaagggggccgatcctgcagacccctggttagagccaggcttcctgccccaccctgtcctggggtcagggagggatggccgggaatttagggcggtttgcccctcctctggaaagtcggggtgagtactagctcagcagggtaggaaagaccttcccaaggcccagggctggcaaagagccctggattggttgctgagacctgggatccttccccccaggctctaccaggttccaccaagccagtttccacggcagcacacgggaatattcataccagcactgccacctcctcagctactctgagactcaagtgagtggggctgaagcagatgagggtggccccctttctgggtctctggagaccataccccatccccagcccctccaaggagggaggtttagctgagcttaagcagggctctgggggtgctggtttaaagtcgcataactgctgaggtcaggcaggtcaggggtgggcccagagcctcctggaggtgcaaggcaagccgcagcccccctgagcctctgcaggctgttgtggtcccaaagccatacagtcacacccctcacaccttgtgactggtgcttcctgctgctgtgtacaaacaaggctctggtggaggaaacaggtgttttatcaggtcacaggggcccccacccccaatggtacagtgcacagatcctcctgctgcaggtggggacagggaggccagatcagggaagggacttatccaaggccccttagaggagtggtcagagggaaggcgttgagtctgcacgatgcaccctctgacactgtatctgccattctttggctgggtggccctgggtgagttacttagccctctgggccttagttttcttatctaaaactgaggataacgagggttctcacctgtatgggtcagtgtggaatggaaagagacagtgtgtgaaacacccagcacacagtaggtgcctcctgagtggcagcggtggtagagggaaggcctctaccaggagtgtgagtgctccaaaagctgaggtgggactggggccttggctgcactttcctttcccagctcccctggggcagtgccctctggcctaccctacccttgggccctcagcctgtcgatagactacacattctctgctgtaatcttgggtccataccccgactgagccccttctctatacttcgcctggctcagcatgtggcgggctccctctgcccttccagagctcagtcctgggagacaaagagactttcactgggagcctctaagtcggctctgaggttctgctggagttgggaaaagggcacagaggagggagaggccagtgggggcagcaggggaggctcctgagagaggggcctgcacaggtgagagggggagaacactctgggtgggggccccactggaacaaaggaggagagaggcagaggctggcatgctccatcagcagaggggcagacagaggcccagggtctacgaaggatgtgcggtgagactggagaagaaggtcccagcctgtgaccttggtgctggggcagcgctggttccagagcctgggagaagctgatgggcgcatgcagcatgttggcatcatggtagggcaaggcggtacccacccacagatggtgtgaattggacatggcggacaaaggcggggagagccagctgctggggcagggtggatgctaggaggcatggggatcatgggaggaactcgaacagagccaagggagaggtaggctttgggtggagaagacccaagggtgttgggcagtgcaaggcaggggtacctcagaggtgagaactttccattttcccatccttccatttgaccctcatgctctctcggggttcgggatcctagggtctggccccctgattactgaggggaactctaccccagaggtcagtggctcgctcaggtcccaaggcccattggtgactcagccagggtgtggagagcatctctgaccagctctgtctctagcagagctccagggtcccaggggctttggcaggggtggagggtgggcatctctgagaaaccaggacattgtcagcttcttggttcaggcagtttgctgtcctgtttcgcagacctgtcatgcttggggtctggacctgggaaaccgccttcctcccttaaaaatgtgtggcctgcttctgctgctgcacacaagctgtctacagcctgggtgggcttgtcctcctcagagggttcccccttcccctgctttctgctggaacatggggctcctcttgcccagttccccagggagtagagggtctctgtcccttgctggatagggactctggcctggggtgagcctgagtctggccttctcctgggaggaggtcacctgcctgggctctgctagcagactactctagagccggagcaagcctggggacacaaagccctcaccccgcagccccaactccatagctagaactccctagagatcagaggagcagacactctgccaaataagcttcctcctaacccccccgccctgccccccattaaaaccactagcttgctcttcaagggcaggaaagctgtctgggccccacaccatgtgcttccaaatgatgagtgtgcggcagaggctccaggcatggatgggcaggacgtggccccagggaacagtgggtgtggactttgggggtttacacggttaggcctgcccccactccaccatgtctgagctggtttgggtgccagtggtggcaaatcacctcctcccaggaaacccagttttcccatgagggcagggagctgtgatgggaaggaagccatccctccccctgctgtgtgacctcacgcaaatctgtgaacctctctaggtctcagtttcttaaatggggtaggaatccctggccatggagaggcctgtgtgctgggtgggcctcagccggggtttgctgggcagctccttgcaagcattgctccagagccagcctccccaccaggcaagaaggggtcatggggagggagggacaggtgatgggagtctaggccgagggattctgactaactctgacctggctctggtggcagcgggcccagcctcctggcctgctgggccgccatctgaaacgcattactgatgctttgtaaactccacatcatttggccacatgaaagcctgggacttaaaaatagctgctcccagaggacgccccgcattggtggggctcagctgacctctgcacgcacacccacccaccaccaggccacctcccttgccagggagccccgactggcagggccccacccactcaccctcccagtgtgggcagccactgcctggagccaatttatctgggcacaggtctcactcagctggtgaaagcttcaggccctgtggctgtacccaaggcagaatgtctgggagagccaggaggaggctgctgagggtgaggtggtggtctcaggacccttccccaggcttgtcatgcctggaatgctggtaggaaccttattggaaagctagtggaaccatcttacagaagaggacacagtggccccaaggagggggagcactgggagggtgctagtctggtgtttacttggccactgtccaatgctggacgagagtcactgccaacatgtttgtgagagtagggcagggcctgcccgggagaccccggtgtccggtggaaaacccgctaagcaggaggcagggcagcacaggcctctgagctgctagggttgactctttgccctgctgtgtgggttccctctccttatggtctctatgaccaactgcaaaccactcttttccctaaaaataaacatgcttatgggactgggggaagctttgtagctatcaaaagaaataatagggtgttttagaaaattacattgtgttttaaataaccagcatgaaagtcattaagtttgaagtttcattcaaatcagatggctctgtggctggcgtggtggccaggcaggcagaggtgggtgggccctctgagatgctgagaggcagcctgtggagagccttgcggcagtggcagcagtgaggtctctgctggctgggtacagccaaggtccaggcgggctggccaccgagtgcgtgcctggctgcagcagccaccccagagctcgctggcagcctttgaggcagtgggcatccccatgggcgggggtgtggggacagatgaacctgggagagccaaggccacagggtcgatggccatgttgcagggggtggtgttagggatggagttgggaccagaaagggccggagaggatctgtggggcccaggccacatctgttcatttcaccactgggttctcagtgcccaccctagggcctggcacacagtaggtgctcagtaagcagttgttgaaagaataacaacaactacagtagttcatgtgtcaagcacttcccaagtgccaggcctatgccaggggcttttactcatatcaagattgtacaagtcggtagggcacagtgcctcacgcctgtaatcccagcactttgggaggccaaggcaggcggatcacgaggtcaggagtttgagaccagcctgaccaacatggtgaaaccccgtctctactaaaaatacaaaaattagccgggtgcggtggcacacgcctgtaatcccagctgctcaggaggctgaggcaggagaatcgcatgaacctgggaggcggaggtcacagtgagccaagattgcaccactgcactccagcctgggcgacagagctagactctatctcaaaaaaaaaaaaaaagatcgtacaagccaagaaagtaggtattattgtggcctccctttttgcagatggggaaactgaggctcagagaggataaggaatgcgctgatacctggcagagtcaggatttgaactttggtctgttttaccctgaaacccatgctcctccctgctctatcccatttgctgtacaatgtgtggagatgggggcactgcgggccaagaagctgggtggtacccccagcacactgtcaggttcataagctggacccagctggattcctctggccccagagaaaggccatagtcctctcactccctctccaggggcacctcatagctctgggcctgggtcagggatgacccctttcctccccagacacctggcaagttcagggctcccagggccaaaagggctgtctttcttacttgaaaggcaggtgcccagggcttctagaaggaatgttatatggaaaagtatccgtaaatgacattaggattgattccgatttggtgcctgatggaaggacagttaagacctgtctacaggtggatcacttcctctttctagtgttggtcctgatgcagctcagtgcctgctgttggactcctgggccaggcaccctcctctgtgtgatcccgggctgggctagggggtttcctaggctctgagtcatgggaaatggctggactgaggcagctgagggagtctcagggtatgggtgcgcccgcccaccttattcccccgtgggaaagccgcttaggaaccagagccgctgccagccccactggggcacgttgagggcagtttcttcttctctcgctgccccgccgcctcccatcctctctggtcattgcgggccagccaggagctcagtgatctggcctgacaggaatcaggcagtggtccagaggaaatcaagggctggcggccccaacctggcacaatgctggcgttcctgaaaagcctttgtcttgggacatacttgcttttgatttttctccttttgtttcattttgttcttaagtaaaaaaggaatattaagaaaaaaaccacaaatattagttcatctaatcctcacagcaaccccatgagacctggatgttttacaatggagacccccaggcatagagagacttgcgcctagtgggtactggaggagggatttgagcccagacatctgactcggcgttcgctgtccctccccttacactccgttgcgtctttggccgcgcacgtgtgttgcagccacagctgggtgcctggctcccccgtcccatcccttcccactcctcaaccccagtttggtatttcactctctgccctgtttgcgtcatgctacacccaggtgtgtttctgagagttgtctggggcagttttgtgtgaccctccctcactcgcctcatgaagggctctcctgaggctcccatgcagttggcactgcccagcctcctccctctgctcacactgggtgtgagggctcgggcagcagcaccccagggcctggtgcctccaggagctcctttccacgccttgtttccctttggataaatggctagacagtccagacagagccccaggggtcttgactggctatagctgggggagtgagcgcttcatgaccgtggcggcctcagggcaggactgtcctcctagggctggtgcaggctgcgggacagaacacatgacaagacccctgtcttgtctttgcttctcagaggctactagattaaattggggcaagaatgcagggccaaggctggggaggtgatctccaaggctctctccctctgcccttgagcccctgcctttctgggccttgcctgggctctcagctctcactctcgggcttggagctggacaagccgtggcgagagcaccccagcctccggtggctgtcccacccctcctcacacatggggccagggagcaccagccagacccggtgggaaggatgacctcttgcttttcttttggtcatttatgactgagaatcaaaatcacctccttcaaggacagagtgccctcacctagggccagggggaggttcagagccacactgctagccaatttgtttcaagaaaaattcttggtaggctgctgccagcagaagtgctgcctgttgaggcctgtcactgaatggtaaagatctgtggccaagaaccccaaagggccagattctaatccagatccatcactgcttgctgtgagacctcgggcaagattcttagcttctctgtgcttcactttcctcgtctgcgaagtctgtatgcacagcacaaagtggttgggaagactggtgggattccggcaggggtggagctctgcagactgagacactcagttggctgttactagtgggggctgccatctctaaatctgcacctggtattttcctgccttttctgcaaagcccccagggaaacagcctcagaactcctcaaacacctccctccccagatccctgttttccattccctactgccaaagacagcggagctatgaggttgtgccttgcctcggtccacggtgggctcctggatggctgggcactgatggggagctgcatgaataactgcctgggctgggggttgcccagtctcagggctgctgtgtagtctccaggctgtgttggtagcatcaactagcagctcagttgcagcagctcccggaagcttatattttcctctaaaaacatcctgtcctgaggggcgttcacctcaaagtggaggaaggaaaacgcaagtaaacgaatgcatagaaaccactggaggccatgggccacgccactcggctaagtggggctcagtgagttccgagggtgcctcgggccgggttgggcctagagcaggcctgtggtttgccaaggctgcatgcagggactccagtccccacctccgctgtggcaggcccctttatctgatgtcaaggccaggcggtgggtggactggccacacgcacctagcagagctctgtgcaactgtggcaacagccttgtgccagcaggtgagactgaagcctcttggtccaggagggtgtggccttgccatcccccaccccttccagctcaggtggccacgcatccacactctgtgcttttctgtgctttgtggtgggcgtctggcacagggcatccagcacgctgtgggcagggagcttgcgggccgtcctttggagagcaccgtgtcctgggcagtggtgcctggagcgggggctagggataaaagggcatgagcaggggcgcctccagcctggctggcgcactcagccctactggagtatatctgcagagatggggtctgcgaaagcccacaaatcgaggcctggtccatattgcaggcaagccctgtcccgccccccaggaagtcgattgttgtagtctgagggcttgaggggcatcctgctcagcaactgggcagactcctcggcacaaagcgccattgatgctggacagtggggccctagctctagacacagacgcctagggagctgtggggctgactggtgggccctagcagtgcaaagaaggaaagtgagaaccggaggggctgtgccaggggagctgggccaagggctgagaccagcctgcactgtgcttcccaagccactgccctggcatggcatggcccaggtgtctgtccagaagaaggggtgctttttctaattagcacaaatgccccatgtgaattaatggcagccctgatgttgactggtcattctgactcccaaagtattgcaggcaggagaggacgggggtaggaggaggccaaagggtcttaggtaccaggtaggatgtcctgagtccaagtagtggccccagctcctcccaccttcctaacctgtatgctgcagtgaccctgtgcccagccccagccagggtgccttatttagtgcagtcacattttccctaaacactggcttacacacgcctcccaccccacctgcactggactcaacttcaagggcccagctctaatacattcaatataaataactcagggcaaaatcccagaccacaggaagggcaggacagataacagtcaactatagcacagtggatcggtgctacagaaggagttggggatgtgagcatggcaagggaccccttcctcctcagatgaggaggatagcatagacttctaggaggaagtctcatttatgtgagtcctgaaagatggataggagtttgccaagccaagtggtggaagagtgctccaagcggagggaatcatggccctcagagccagtgatgtggctggagcacagagtgagaaggggaggatgaggctggcaccactgaagacctggagagcccataaagggccctggcactgacctggtggaggaagggctgtggggccacgactgactttctcaccttacagagccttgcttcccacatgtgcgaaatgggaagaatgtatcatgcccacctcaagtgggttgtcacacgtggcatttatgttactcagtgtcacctctgtgtgcttggcaaacagaacagtaaccatagcaatagcccacctttctgtctggtcagcctctgctctggaggtagcacaaggctcaaggtggagatctgcccttccttccatgggcttttccccaaggcctctcccagctccagaccaggcttcaggagcagccctctgcttgagggacctgagggaagaagtcacagccctgtggctgaggagggaggcatgcacaggttctggaggcaccgggattctagaggccttcatgcaacaagcctgctgagtgcagagcccagacagagatgactaaccagcagaccctgccatccaggacccccaggccaacctctctgccagctaggctggtggcaccccaagccaggccacaggcctttccacaaagtgacccttagactgaggtcaggatgagagtgggccagactggcccagagcaggaggaagtatggaacattgcagagggaaggcacctgggccggaggagcaggctgacatggctgtgccgtggtgagcaggggacatggctggggccttggggtcatgctcaactactgccaccaggcaggctgccagtgtagccagaacccccatcccaggggtcctaaaacttggagcatttttcaggttagggaagcactggttcaggtcaccctgaccagccaggctgggaaagggagagactgtgtttagaactgggacagtgtcctgtgcacaataaccataggccctttgcagtgtcgtgggtgtcatcccagctctgccacttactagctgtgtgaccttgtgcctcagcttccccatctgtcaggtgggcgtagtagttgtacctaatatcataggtctatgttaggagtatctgagttcaactctgcacggtgctcagaactctgcctcacacatgggaaatactccgctcacattagcacatgcttttctctaggcctgaagcatttttttgcctggcacataataggagctcataaatacaccctgaccaaatggtaccaatagcgaccagctgagcatcctgatctcttggggggctgtttctgctggcacagtcccctgccactgggaggcgttcttgggagggcctgaacaggcctcacctatcccctaccccccacaggcttgaggccagaggaaacagcaactttcttcgctgggaaagtgttgtggggctcaagcatttgggggttttcagagtcaaccgtcagaggcgagggagtttctctgctggcggtggcaagggctgtcagcgtgcacacagcctgcgagcagaccgctgcggtctacagggaaaatgccgactgtgtttatttttcacctgagcctgcaggaagttggggggtgcgggttgggggggtggtgaagggggatgccaagccaggcccaagcttgacttcagaacagaggagaactacctcaggagtctccgtttccatctcctcctgcttggccctgcctggctgtcttctgggctcctgtctggtaaacaagaaggcacgcaggagcacccgaatgaggaattcctagccatgggctaaggaaatagtccagaagggcgaggagcccctgtgggacagtggactggagtggtctgaggaagtctttgagcagtaagagcaatgcagtggcaggaaggaccacttttgctgggagtgagccctgtcaccaggcatccagtagaaggctggacaggcactggtgggacagagatgactctcagggtagccctggggtgtctgggatggtgggggagacagaggggcaaaggcaaagagcatgggtctggggtttgctgatcaagcagtttggactgctggtgaggcatcaatgcatttaaacatcccagcatgctttgagcacttactgtgcacccagctctaggtttggtactctgccctcagaggatgagggcaagagagatgaaggtgtgccattgaaatgctcggggcctggtggggacaatcaccctaggcctgcctctttccattgagggctgggcacagtcaccatcagggagagcaggggaggggggcttcagtcaccaggctccccatatacatgccaggccccaggtgaccccaccctgttgtctaggcagcctggccctgagacagccttgtgctgaggccctggagtgggacgttccactgggcgagggggacatgggtgccaggccctgtgctagacggtttcccctggctcctaccaccgggcgcaaagcgggctggggattgaggctaagaggcagcctgcatgaatgtgggagggactggccaggcccttgatgctctgccctggagccctggccaccccaggacctccagctgccagtgagttctctgccccacccctgcccatccagcacttctcctgtggtctgacagtagactcctgtttagtgcgttttttcccagttcccaaggaaggctgatagacagaatgagcccacagcctgccaggcaacaccccgcagcactgcccatcacatgcatatgtaccaggccagcagctgtagactgggctggattcttttggaggtttcctaggcccagcctgagctgtgctgcaacctggggctcaggtggcaaagctggacctgggccaggcccagcatggccaaggagggtcagctctggcctccccactcctggcaggagggctctccatggcttcctggccaaaactcctgtgggtagcttctcagtaaaccacctactcccaggggaagggtagtttactgagaacctcaccatggagccatgctctcactaccttggggcagagccccaactctgggcagagcagagactctgggactgtcttccaagagctggcaccgtggacccctggctcagctccttaggcttccctgcctattctgctagccaggcgctcggtccatcccaagggtcaaagagccagagccaaggctggatggcaaggcctcctctgaagcaggagcttagactcgaaagccccccatgctccaggcatttgtgccctaaggtggtgaatggtggaatgctttctggcaggatccaatgttcctgaaggagtaggccctgaggctcagtctccgtgccctcagctgtcacgaggcctggtcagggctgatgttgcctggctggctggtgttattctaggaacctgttaggataaaaacaccccaggggtttccaggaaacttcctactttaacaggcccttggctccttctccctggaactttaggacagaggagaacttttgcatctgtgaccaatgaggtgagtaggactggtattctcatctccgttttacaaggagagaaaatgcagccccagagaaggatgagactggcccaggatcctccaataaaaggtcagtgaaaaggtcagcaagcctagagccaggcttcccaacctacctcacatcatggcacactttcagcattatcactggagtaaatgaagaaggatgctggaggctaaagcacccatgggaagccccaggcattgtgaacaaggaagagagtagaaggtgctggggttacagagggagcaggagccagatcacgtagagctttacttatttgagacagcatctcactctgtcacccaggctggagtgcagtggcacaatcacggctcactgcagcctcgatctccagggctccaatgatcctcctccctcaaccttctgagtagctgaggctacaggcatgcaccaccatgcccagctagttatttttattttatttttagtagagacaaggtctcgctatgttgcccaggctggtcttgaactcctgacctaaagcagtcctcctccctcagcctcccaaagtgctgggattacaggcatgaagccactgcgcccagcccacagagaattttgtaggccccaggtcaggagataccgtgggaagccactggaagctttaggcagaagtgacacgatctgattcctgttgctgctggattgaggactggcggaggggcaggagagaagcatgggtctaaggagggagctgctgcagtcatccaggtgcaaagtgatggtggcttggactgggtgcgggcaaggaggaagtggtgggattctagacacattttgaaggtagagcattaggatttgctgacaaattggatatggagtatcagagaaaaaggagtcaaggatgactccaagatctttagtctgagcagctgaaaggatggagttaccattaactgggtaagaagacagggaggagcgtttggggcaggaagtcagaggttccgatctggatatgttgagtttagggggcatttcagaccaccaagtagagttgagtaagcatttggaaagtagagttcctagaagtggggctggagaagaaatgtggagtcatcacatgaagatgtttaaagctgtaaacccagatgagaggaagatgggagccagaaacaaggtcaggaaggagtggcccatgaagctggaggaatatcaggcagtgtggcattctgcaagccaagtgaagaaactctttcaaggaagtgggagaaaccaattgtgtctgatgctgcagagaggttggataaaatgaagactgagaattgaccattgagttcaggatggtggaagtcactgggactttgacaagagtcatctagtggagggatggggcaagagactgtctggctgggttgaagggagaatgagggctgagaactaggggcagtgaatggggacaggtctgctgaggtttctgtaaaagggagtgagacaggaggtggtagctgggggaggatttagagatgggagaaatggcagcctgtttgtaccctgatgggaatgagacagggtttacaaagtgcatgacacagtccctggcatgtggcaggtaccagatacctgaaggagtgcacatgtgtccacataccctgcagctgccccagcctctcttcttccttgctagccacctatagggacatcagcccctgtctgcctgaggaaaggaggaagcctgtgaagccctgttatgtaaggctcctcccggtgggcagatggatgagcagggccctgacaggtggcagtgtcagcaccttccccaagacctgaggggaagggtgaaggctgtagcccggaggcaggaatgtgaggaaagatgccagcaacagggctgttgctggcaggtgtgggagcctgtgcccagctgggagcttcatgtcttggctacagcagggcttatacccagccttccatctaggcttgccctgggcttccaataaccaagtgccgagggactgtgccaggcctcctcaccatgagccacccttctccaggcctggtaataaaggggccatgaaccctattcactactaggagagatgcctgaagctcttaaggagtctggctaaattcacccagtcaggaattgcactcacagagtggggacgaacccaggccacagcccctcattactgacttgctccaaagatgtcccgtttcctctgtgccaggagtcagagatcactcatccatgctcccagccaacagcatccttgcaaacgggcttttcaaagtgggaagttgaaccttggttgcagatgatgtctccagggccctgacccgtgcagatgtgcactgaggatactgtagagctgggccttggccctggcagtgactccctgcagccaggtcttcctggggagcccctccttccagcctgctgactgaatcgtctcttgatagagcaatgcaactagtgttaagagtcttggctgggcgcagttggctcacgcctgtaatcccagcactctgggaggccgaggcaggtggatcacttgaggtcaggagtttgagaccagcctggtcaacatggcgaaaccccatctctactaaaaatacaaaaattagccgggtgtggtggcgggtgcctgtaattccagctactcgggaagctgagtcaggagaatcgcttaaactgccaggaggcggaggttgcagtgagccgagatcgcgccactgtactccagcctgggccacagagtgagactctgtctcaaaaaaaaaaaaaaaaaaaaaacagagaaaaaagaaaagtaagagtcctgcggtgctgaggaaacaggaagtacgggggctgggcaaggatggccctggaggaagccaggccccatctcccctgatttaggggattgaggagggcccttccctgtgtcagaaaatcctgttaggcctgagctaagacaaatggtcagactcagaatccccagactgggggctagaagatgaggaaagatagctgtgcttcttccagggtgtgctggggtaggcctgggtcctcaggccatgccctgctttagggggctggaggctataagcaacctcccagacaagccaaacctgagatgaggaggccaataagggttttctggacaggggagacgcacctccaggaattgagtgcccagaaagaccaagaggctttctagggggtgggactgcttgggcaaagtcttgggggctagtgggcggggtactggacactgtgacttgagtggtacccccttcgctgaggcctgtggttttggccaccacttttctttgacagctgggcttcctgtataccctcatcccagtgtcttcctccctcaggactcgccacactcacccaccctccttctcatttttcagcacaaggccaatcagcccccccacggtgtcccccaactctctctctacgaacatttcaacagcccacatcccacccctgcacctgcggacatcagccagaagcaaggtacaagcctgggatggggaggggcccagtgaaaccagagcctaagggccaagaccccagcttctgagaccaggtagctgggtccattttataactggagaacctggggctgtgcaaactaagggcccaaagaaaataccagaaagatggactgggggtataagggcatcagaaaactggaaaaggtggtgctaggtcaaaatgtgaaggcttcaggttgaagcctaaatcccatgggtgaccccgctgccagtatggcagcattgctgagaactgtaaaactgtagcctttcctcctctcagtgagaaaatggaaagtggtggttgtgatggctgattcacctcagcctcaggcaaagtcattctgaaatccctcattgtcagctgtgggaaacctgctgactcaaccctggggggcaggtggagccttggctccccaggctgggctcccctagaccaggggcctgcctcctgcccagaaagctaggctggagtcccccgagcagagatgccccaatgcctccatgcctgagtgacttcagctctgcctactggccccctaatgtcttaggcaagtcaccccagccctctgccctgggttcccttgtctgtcaaaggggcactattatcacactgggatcctcctgaataaactagtttatgtctggtcctctagcaaagctggtgggatcttaaggcccctgtaggaggttctaggatgcagtaactgctgatatggcctgccaggtcaggctagcccactcactcagcttctctcctctgcagttcacaggcctctgcagacccctgacctctctggcttctactccctgacctcaggcagcatggggcagctcccccacactgtgagctggtgagtgtgggcccaatgggaaaggggtaccgtgtgctggtcagaccaagacctgcctgcccttccatttcctcctccatccctcttggctggccaccctgctgccagctctgtttagatgccaggggctggccagcaactctgtcctaacctggctctgagctaggggtcctcatgtaccccggcctgcattccccagggagcctgacatactccctttggagaggcaggagagctggtccctggtcccagccctgtctccctcagtgtccaagagatccccttagatgggagaactctgggctgctaagggacctccagggccatatgagtaactgaggaagaaaggtgggcccgagcagggaggggacagcatgagtggctaccagagaggctgctgcttctcagctcactggcctcagtgcctactgcttttggtcctttccttggctgagctgcttgaggggcagtgtccctccctgcccctgtggtgcctgcttaagcccaagcctctgaccagcctgcttggagattcttaaggctggaccaggaaaaggaagcctggccccctaagccagtaggcctgactatgggccaaagggcctgtcctcagctggagttgggccttggcaggctacttggccctttactcatcaacgatagtttgagctgcgcaggtctctagcctatttcagagagctgggctgtggcagtcacccaacagcaggaaaacttggctccccaaggagatcgggcaggccagaggcccaacctgtggcccacttgccctttacccatggtcagcaccctcctccgttccagcttctccttggacaatccattctgaatacaaattaagactactcccatgaatacccctaggatcaaagcgtggcaagatgctcaagagcccagccttactggactagaccagggttccgtggatgcaaatctgtaggccagcctttcaaaagcatcccctaggccagcagtgctgaagaccaagagagttgagcctacagcagattttacccaccaaggctgtaaggaggggacttcaggcagccctgtgctctcggcttccacccggtggcacttggctgtgaggaaagaagtaggggtatttaagccatctctccactgagccctattgtgtgccgggcagggttctgggcaccagggaagtcggcactgctgaagccaactgatcgttaggtccctgccctctcagaactcagtctacctcgtgggcaacccaggcaaaaaaccagacagttacagggcactgttggtagtgctctagttagggactgtaggagcccagagaggtacctcatccagcttggaatctcagggatttgaggaggaagggtcacttagctaaggaagacctgaaggatgaccaggaattgaagcaggcaaagtggtgcaaaacaatccagtgttaacagtggctgcaatggccccaggacagatatcagccctataccgtcaaagaaacagaagcaggctggaggggcccaggggcctgctaagctgggtcccaggagaaggataccatttccatccctcaagcacccatacaagtttatagagggaaaccgcacaagctgccctctggtggcagatgcttgaaattccagcagaggcccatctgtctcacaggatgggtcaaggcctgcctagcaaggtagggaagtctttcctcgtgtctggccagcagccagactgctaacagctatctctcccaaccacaggcccagccctcctctctaccccctgtccccttcctgcggatatagacagcacttccctgcccccactgcagcccctggcgccccctaccccaggtgagtcccctacactgcagctaggctcctgcttcctgttgcccaggcttcagagcccacacaaggccatgcccaggccagtgcttgccctgtgttagtcgtttgtccatctgtccgtctgtcattttgcagccccctgctgtcctgtgcctgagaatgaagctagtgcaagtgccaagaggcctcagcctgggccacaccgtgcagcagagcaccacagaggccaggacagtacaggcatatgtggctcagcccgtgtgcagatgtgtgtgcactcacctctgttcttcatccctacttagaaggactctcctgggcatcccctgagctttgcccaagctgagacagcaccttttacctaagtccccaacctctgacccttaggggctgctggctcagggataatacctgtgcaagcagtaaggggcagaatggtctccacagaatagcaagaaagtgaagtgggaggtgtgtgtacatggatcccttcacttaggtcactccttcagtgacagactcagtgcaaatatgcaatggcaggggattccacagacatttgctgcccactggagctcacagcccagtatagcaagtgtagacatggcaccggcagcttaatgggccagctgagtgatggggaagccccaaggagacctcaccaggcctgatgggtcagggagagcttcgcggaaagagtaatagatcttttgcgagaagaaaacaagggaacagccataactggggctgccggggaacggagagggacaggaagcagaggagaagagaaggggctagcaacagcagcaggatgctcatgcagggctgtgcaggcccttgggagcagcctgggttctattctttggacgctgggggaatttcagccgaagcaggccaggaacattcaggtgtctctaatggttactctggctattgtgtggagagaggcctggaagggtcaagcaggagagggatgaggcctcacagggcagccacaggctcctgaggctgggttggtaggggaaggacgtgagaaggggacagattcaaaagctacttgggacctatgtagtaaccatctgaatggcaatctatgtagatttttgcagtgtgtctgtgtagtgtgctgggagcaggtatttgtatttatctctgtgtacttatgtctaggccagtaggatagagtatctatctgttcacctgtgtcctcaagttatgtattatgcaggggcctctgtgtgtgtccaaaggtctggcccataattcttggctcagtgttaactttcttcctgcctccaggttcacccacccatccttgatgctaggttctggtgtacctggtcacccagcagccatcccccacccggccattgtgcccccctcagggaagcaggagctgcagcccttcgaccgcaacctgtgagtgaaaagacaatgatggcagggggtgtgtcagtcaggatacacatgcctccccaccaggcctgaggactgccacgaggtccctgcctaagctgtttcgtgcctctggctatgtttttgatcctcagaagtaggagggggtgggtgggatggggaacaaggatttttctgagccaacagaggaggggctcagaagtccttaacacatgcttttcccacttgtctgtagtgttcctataaggaacagttacttagctgtctgctcacccatttgggggcagctaggaaagattccacttagaaaactctggtatcatacacttaggcacactctaggcccacgctagaggaggaggctgcaattaggtgggcactcggggggctcctgaacaatctggatttgtgcccctcaggaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcagggtgagaccatgggcaggtgggctggcagggatgctccccgaccatcttcagcctggtgcagcctgctgactccctgatgcaccccacctgcccctcttccctgttgcagtggcacgcgctgtcgcgagaagagcaggccaagtactatgagctggcccgcaaggagaggcagctgcacatgcagctatacccaggctggtcagcgcgggacaactacgtgagtgcctagtgacacacagcaggggtgggcaggggaccctttgagataccatgccccaggccacaatctcagtaaggaacgcagaactactgtcctgaaggcaccgatgaggaagggcacggagggtccaaggcctcccatggctgcctcagaagaggacaagcccacatcctattctccactccagaatatgctcacacatgagctgttacccaacatttgattgggccacatgggcagaaggggagaaaggggtctggaagtcacctccttccattcaaactggagaccagattggggtgagggaagagcttctaaatgcactccatagcagcctagcaagaccagcaatcaagaaacaccagcaccccaaggtaggaggggcctgtacgcccagaatcccagggttacccaagctaggcagcaggctgtgggtatcccaatgtctgcctcccagatctgagcatccctccttttgttccctgcaggggaagaagaagaggcggtcgagggaaaagcaccaagaatccaccacaggtgagaccttctctcagcagcagtggaggctcctctccatgtccccatttcaagagcagccctcctctgacccaaagggaggaacgcggtacccagctaggagccttcagggcctggggcctatgaaaacaaggcctgcatctcacaagtcaaattcccatgcaagaaacagctatattatactaagtcccagggaaacccagcagaactggcttctgctgggtagaattggagtagatggtgcgttcctctgccttgcacccactacctttgctagctccactcaccagagaaaccagcaaagaactgactgtatggtttgatgcttagcccaaacaatgtcctggctagttctgctgagactgggagaggctgagctaggccccatgactaggcccagtagacacacagcctactggctggagcctggcaatttatcacccccacttcaacatttttcatggcagtgcaaagtgctctatgtagagaagcccacaccctgctgcaggcctccttcctaagggtgaattcctgcctctctggtaactgagactccacatccctgaccacctcagccgtgctgtccccacacagggaagctggaggctaggactgggacagagcagggcagagttcctagccctttttccaaggcaaagaataggcccttccttccatctgcaagtgtgtagaacagcataaggtatagccttcagccttatcccttgaaggaatgtaggtcaagaatgaagaaaaactggataaaatgggtagggagttggggaggaggtgggtggccctagggcataaaaggctggatctccatggtcttccttgggcccctctgcagcctccatgctgcaagggccccacaagccacagagatgagccagattgacaggactccctccctcccattcttcccactgcctctactgcgtacctgggtgcccacctttcctgatatcttggctctgggctcttgggctcccactggggctggctgtgccatggagaggcccactctgcctatgggggctgtagggtgtctataactggctaacactgatgttacctcttctttctgggccctgctctgccccgctgcctgctcgccctctgccctgctctacccctctggcatggctgtgagcagaccctggctcgcctaagaaatgccgtgctcgctttggcctcaaccagcagacggattggtgtggtccgtgcaggtgggtttgtccccaccatcgttctccctttgctttaagctgcttccctgactctgcacatgttccactgggcctgcagcccactcctttggcccctcagcccactagcatactcagcagattgggagcccaggcctcctgagaatagtagtaaatactgaacacagcgcgtggagaagaccacttgggtctaagtgcaggaggattggagagaaagacacagaatgttccagaaaggaaggacagactcaagaaggcagctctgatgccagtgggcctagcaggtcctcagcaaacagacagctcagccaccactaagggggcctggagcccattctaccaggcctcaaagtcattatggcccatgggctccctcacttcctcttcaagatgggatccctgcctgtaccatcctgagcccttaatctgaaaaagcaaggtgacaacaacacagaaccatctggttgccaggtagccttatgacttgctatcttgtacctactgataccaaagggctggagaggctgggggagaggacccagggggtaccctgggctgtctgagggaaagggctcatgtgtttcaccatacaacagagaaatacttgtgggtgtgacaaggtttacccaacaagtggttaaagtttcctcagtcagtttcaggccaggcctggcagggctaagatagagggtactccaggcagtaaggccactggctctaaggaacacttgtccagcctctcagtgtacccaccacactccctgtccaagggcaaggaggagtttggggtgtgtctgtgtatccacatacatatgcacggtgggaaacaaccctgtcttcaggggaagttctattccattcattccatcagagacaaactggcccagagaactcaaggatggtaatggacaagagtcactgtccatgtcttcttcctctagcccagcttgaggactgggatggctgggcaaggaagccataggcattgcggccccttgccttggtgcagatgtgagtcccacaaacacatctggagaagctcaaaggccgggactgggagatgactcccttggaagacaggagagatgactcccttggaagacagatgacagcccataggcctagtgacaaaaggcccctttgccaccttgtggctgttctgggaactgcacctgtcctaggtctgggccagaccaagcagaatggcagtctgaggacactgacttaccacccaagtcccaggaagagaggacaaggaatcagccaggcctgtgcaaaggcagcattttttggttgtggtgtatgactatgaattcaccctctgtttacagataactctcttcactattcctaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcagaacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagctcctgggcagcttgagagggcaaacccaaaacctcatgacagccagagcctgtctttcagcattcagtccgcctggccggctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgtcgggccaggcgcggtggctcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaaaaagggctgtccatgtattcacacacccctcaaaaaaagcctttagttcctactttagccactggtttctcagaatccaaagatcacatattctagtgtaacactgcaagaagtcttgagaaaaagattattgtagtgttcaaaatatttttgtattgttaatgcatcatcatagaaaaacttttaaacatgagaataaagatactttttactgggtttgtttttcaaagcctgaccctgaggaataagctgtttcagtaacagagcatgatattctttcctttccttctccacagtcaggaaacttggagtttgtttcctatggtacatatgttcccaaacctccagcctgtagaaaccagggattacacttgtcatctcccctaaaggggtgtgggccctgcctgcctcacctgagagctatgcctatactcccattccaagctttgctcttaaccccacaatgatgcaggccagcctgctccccagtgctcatataagaataaatgagttgccaactgccgtccataaaggctgacaagacaattcaacctgaaataggtacacatgaccactaggctccattttcctctgagggcagagagaaaagaaaacattccacaagtgcatatcctatttcaaggaaaacaagagcaaacgagtcttttataacctattagcaccacaaaatcctaaaggaggattttttaatagcaccccttcctcccaaagactgcatctttttttttaattattattattatactttacgttttagggtacatgtgcacaatgcgcaggttagttacatatgtatacatgtgccgtgctggtgcgctgcacccaaagactgcatctgttaagacgcaaagtatttttcatattttcacacaagccttcaagtttgataaatctattacccactttttaaaaagttacatacgctgttggtggacacgacagccaccatatccactttatttttagattatttgtatacatttagggggtacaaatgcagctgtgttacatgaatatattgtgtagcggtgaggtccgggctatttttagattatttgtatacatttagggggtacaagtgcagctgtgttacatgaacatactgggtagcggtgaggtccgggcttttagtgtgcctctcacccaaacagtgtactgtgcacgtaagtagtgtacattgtactcaacaggtaggatttcatacctcatccccctttcatctcccaccttttgaagtctccaatgtctattattccattccgtatccatataccatgtgtactcactgtttagctccctacaacccactttttacatgagtttccaccaagtacactgctgtcttcctgagacctatcatgaatgtaaaaggtgtcatgaaggcacctcaataggtcagtcaacaagtagatgatacatgtcaggcaagaagtatttcacatgggacagccactgggccaccatcatgcattgtcattgtcactccactgagttctattttttggattttgtgtttaaagtataaagtcattttccagaacagcgtctatttaaagtaggccactggaagttgtaaccccagacttgcttttgcttctgagagagtgctagaggacactagccattctctggacatctgtcccattttaaagaattctgttctggctactggcctagttgtttaaaaaacctacattctaaccagggcttatgcaagaccaggttgctgcatctgatttggtgtctcacttagagtacacagggtacctgaacaatgcagtctttgtgtattggcggggaagtctttggcaactctgtttaaatcagatcagctttttttttttttaatctgacttcataaaggaaactcagatcctcccaaatcaccctggtgcattcctgcgaggccagagggtgacttgagattgcaacctcaagttcaactgctaataccacaccagtcccccttcactgccagctgagaaccaaccctgtttcctgagacatcataagacaagataccttagcctcccttgaacatttccagacaactagcagactggcaacttgggtgaaagacgttcatccctcccctggtacagctgctccccattttgttctctgtggatatggtgagggttcagcccagcaagcagacaaagcctatgtctcccaacgtgaaggtgtctactttaacagaaccccatggatggactctct

SEQ ID NO: 17288 - DNA, 9301 bp, Human
gatgggccaagggagctgataaaaataaaaaataaaacctctagaaacccacccctttcctgattacttactgatgaatatgatcctgtcttttaataaaacagggacttaaggaaacatgctgtgaaaagaagctatttcggtctggagtccctactttttataagcagtagtttcttctcacccatagcaagcgttgcacattcagtcacttgtacctgtggccccagcgctgttgttagttctgcaatctcttcttcactttatcttgtagtattctgaacttttttaacctgaattacccccaaagcactacccaaaataaagggacattttaacaggagtacaccagacagcaagaagtctgtgtagagttcttgtttgcataaacatgtttaatgatatagaaaatctattccaaatcaatcattaaaatctaaagcgaaaaatatattacattttaaatgaagggaaaacatctgattttattcaaggttgtggtgactctgttccgcaacttttaaatcaatttaaagttaattcagatgccttttcaatcattgcagttacacatagggaatactgaaccgaaagatgacaaggcaattgtctgtgtccaaacttaagaaaaactatatttccctggacttttcatcccaacagatttcaaattctcctttccaaggagtatttgaccttcacatttcaggccctgtatctcttcatttcctataccaccatatgttagaaaactcaaactgggctacaagtatatatttctgttaactgactttaatgaattttggttgttttcaaaatctgcgatctgtccattgtgccaaccctgcattgcagggaagtcttagcctgtgattccagcttcgctcctgcaaagatagtcactacaggcaggtttaaattgtatttactcggagagaagagggggaagggaaccccctgccccctgccaacctgacaggccaggctgggtgacaagccccccgggtggctgcacctcccactcgccgacctgggcgctgtccttggtgctgccggcgccatagcgagcacaagcgccttaccttctgcccctgcggaagctgcggacgtcccccaaacgttaaaaacgccatatcccactttttatacaaataactaccccggcctgttctctttgtccccttcccgaagccttcaggcagaccgttccgcaaagtctttttttttgttttgttttgtcttctagacccagctcctcggcgctcatctccagctgctttaagacaaggggtgggggaaggggagggaggcaagaaaagatgagggtgggggaggggaaaagagggaatgcaaggggaaggagggaggagacggggagaaggaaagattggaagaaaaggatctccgaggaaggggctgagagaagggcagggtgaactggactaaaggccagagtaggaaggagaagaggggccaaaaaagaaggggatgaaattaagcacagaagatgggtaaagaaaaaagtatcagggaaagggcaaaataagagaaagccttgaggataagagggtagaaggctaaagaacaaggggaccacggggtcggggaagcgctgcctgaacggcgggacagtgacaaagaaagggcgctggcgatattcgcaccaagggtgcgaaacgcaatcgggaggtgagaaatggaaagaaggcgaatgcccggctacaagtagcctgggactgaaaggggacctgggggaggggctgggcccagggcagaaaagtccaggttcccatgcggcctgggcccacgtggagcgggcgctgaatcaccgttcagccgcccccctcccctcctccccgaccggtgcccgcagtccccgcctcctcggccgccgcctccacggggcggggccctggcccgggaccagcgccgcggctataaatgggctgcggcgaggccggcagaacgctgtgacagccacacgccccaaggcctccaagatgagctacacgttggactcgctgggcaacccgtccgcctaccggcgggtaaccgagacccgctcgagcttcagccgcgtcagcggctccccgtccagtggcttccgctcgcagtcgtggtcccgcggctcgcccagcaccgtgtcctcctcctataagcgcagcatgctcgccccgcgcctcgcttacagctcggccatgctcagctccgccgagagcagccttgacttcagccagtcctcgtccctgctcaacggcggctccggacccggcggcgactacaagctgtcccgctccaacgagaaggagcagctgcaggggctgaacgaccgctttgccggctacatagagaaggtgcactacctggagcagcagaataaggagattgaggcggagatccaggcgctgcggcagaagcaggcctcgcacgcccagctgggcgacgcgtacgaccaggagatccgcgagctgcgcgccaccctggagatggtgaaccacgagaaggctcaggtgcagctggactcggaccacctggaggaagacatccaccggctcaaggagcgctttgaggaggaggcgcggttgcgcgacgacactgaggcggccatccgcgcgctgcgcaaagacatcgaggaggcgtcgctggtcaaggtggagctggacaagaaggtgcagtcgctgcaggatgaggtggccttcctgcggagcaaccacgaggaggaggtggccgaccttctggcccagatccaggcatcgcacatcacggtggagcgcaaagactacctgaagacagacatctcgacggcgctgaaggaaatccgctcccagctcgaaagccactcagaccagaatatgcaccaggccgaagagtggttcaaatgccgctacgccaagctcaccgaggcggccgagcagaacaaggaggccatccgctccgccaaggaagagatcgccgagtaccggcgccagctgcagtccaagagcatcgagctagagtcggtgcgcggcaccaaggagtccctggagcggcagctcagcgacatcgaggagcgccacaaccacgacctcagcagctaccaggtaggaaccgcggctgcgcggccagcctgcgccagcgccagcgccgcgcgcccccgacacttgggctcgtgcccaggcgccctctccgccgcgctccctggtggccgctcgctagagcacgcgcgccgcagacctagggtatttgcggatcagcgtcctcgcccatctcatcctccacactccgcccccacccacctgccccagctgctaagggtcttgacctttttcagaaacgtgcatcttttccagttctaattttgcacgcttgcacgtttaaagcaggagggatgaattcggtagtggataaatcagcaactttaggatagcttatgcagaaacgcgtgtattctctacttttccggcagtgatcggaagagctctcaaaattggcttcagcccaaagggctcagatgggaatggccaggtcagccatggagtttccccatgcatgtttgtgtcctgttgagacgtgttctaagtccactggtctccgtgcgtgatgtgcccaggaagtgtcctattgtcttactgatcttgtatgttcatttgagaatcgcttagatttaaaagaaaaagggggtgggacggggggctgggagtcaggtgtcagcgaggtttgcagaagtggagggagacgggaggaggccagggggaaggggtagcaagtggtttgcgaaggaagttgctgtttgcaaggatgagtctggggagattctctgtgtctgtttcaggacaccatccagcagctggaaaatgagcttcggggcacaaagtgggaaatggctcgtcatttgcgcgaataccaggacctcctcaacgtcaagatggctctggatatagaaatcgctgcgtacaggtacgatgcttactacgtgcgtggccggaacactaaccgcagtgcagaggctgttccggcagagcttccaccacttaagttaaagcaggcagggtgcaggcatcaactcagcacctggttatcttgcttacttaaaaagaaattattctaaagaattgcaagtgtagttttatctctttttatgcagctttaaaagaatgaatactagtagaaacaaaaggtttttgaattacacaaaggaggtgcagattaatctcaatgcacatgcttaaactttttatggaaaaatgttttcaaatgctggaagcatgaacagagttttggtttctaatatttcatctagtggtttcagcttttcaaatgtataatgtcaaggacaaacaccaggacgttctatttctctgtttctctgttatatagcttactattgccatcatctggctgagaatagatatagaatgatagaatatagatatagttcttttatatatgtagataatttatatgtattatattttatgctagactgtagtataaattatatcaatatatcatgtatgatattaatctagatctatagatacacatatgtgcatatgcatataaatctagatatatagacacaaatatatatgatcgttttatagatagtgagataggttataggtctattaactgaagtgaccttgctgttgactaagcgcaaaggacaaaatcgttgattaaaatttttctgctaccaataaggtagttataatataacgagaataaattgcatttacagagctatctctcttttcaggaaagctgaataactacattaaatagacactttatgataaaaattatcaacaaatttataactcgatacacctgaaaatctaaacgtttaagaaagtgactactctcagaaaggctgtttggctttggagtttgggggcgttttgtttatggcttcttgtttttttgtttttgtttttgttttttgctatttggccactaacaagtttttcagcatattcatgttgtacctaatggatctctactgcagggccaagacttagtagctgggtgtggttagtggactattgggcaaggttagtcattgtagggggcaactgtctggcagtccaggagaatctttctctgtcactgagtataatgtaatatgccagtaagtgatagcaggtattatagtgaattcatagaatattctacttatgtaattctatttattcaaaggtagctaccacaatacccagaatgtaatgaagctcagaaggcctagtgaaatttttactatgtcttatgttcttggattttctccttagaaaactcctggagggtgaagagactagatttagcacatttgcaggaagcatcactgggccactgtatacacaccgacccccaatcacaatatccagtaagattcagaaaaccaaggtggaagctcccaagcttaaggtccaacacaaatttgtcgaggagatcatagaggaaaccaaagtggaggatgagaagtcagaaatggaagaggccctgacagccattacagaggaattggccgtttccatgaaggaagagaagaaagaagcagcagaagaaaaggaagaggaacccgaagctgaagaagaagaagtagctgccaaaaagtctccagtgaaagcaactgcacctgaagttaaagaagaggaaggggaaaaggaggaagaagaaggccaggaagaagaggaggaagaagatgagggagctaagtcagaccaagccgaagagggaggatccgagaaggaaggctctagtgaaaaagaggaaggtgagcaggaagaaggagaaacagaagctgaagctgaaggagaggaagccgaagctaaagaggaaaagaaagtggaggaaaagagtgaggaagtggctaccaaggaggagctggtggcagatgccaaggtggaaaagccagaaaaagccaagtctcctgtgccaaaatcaccagtggaagagaaaggcaagtctcctgtgcccaagtcaccagtggaagagaaaggcaagtctcctgtgcccaagtcaccagtggaagagaaaggcaagtctcctgtgccgaaatcaccagtggaagagaaaggcaagtctcctgtgtcaaaatcaccagtggaagagaaagccaaatctcctgtgccaaaatcaccagtggaagaggcaaagtcaaaagcagaagtggggaaaggtgaacagaaagaggaagaagaaaaggaagtcaaggaagctcccaaggaagagaaggtagagaaaaaggaagagaaaccaaaggatgtgccagagaagaagaaagctgagtcccctgtaaaggaggaagctgtggcagaggtggtcaccatcaccaaatcggtaaaggtgcacttggagaaagagaccaaagaagaggggaagccactgcagcaggagaaagagaaggagaaagcgggaggagagggaggaagtgaggaggaagggagtgataaaggtgccaagggatccaggaaggaagacatagctgtcaatggggaggtagaaggaaaagaggaggtagagcaggagaccaaggaaaaaggcagtgggagggaagaggagaaaggcgttgtcaccaatggcctagacttgagcccagcagatgaaaagaaggggggtgataaaagtgaggagaaagtggtggtgaccaaaacggtagaaaaaatcaccagtgaggggggagatggtgctaccaaatacatcactaaatctgtaaccgtcactcaaaaggttgaagagcatgaagagacctttgaggagaaactagtgtctactaaaaaggtagaaaaagtcacttcacacgccatagtaaaggaagtcacccagagtgactaagatttgagtccattgcaaaaggttaagccatatgacaatttcaaaatgcatgtgattggcagcttcaaaacagaacgggttctcccatgggggctccagacattgtattttactttgtgcaatatgaggggactgcatgcaagctcagggtgctccctcctcagtctttgggggattcaaatgcatgatattgtatgtacctgggaaatttgccgatttcctaagctgttggaagggggtcacttaaggggggatgtcttgagatgtattatgcaaagtaccaactgagccaaaaacaataaacgaaacacagaactcagccttaagaaagctatatatgaataattatgtttacctcactggtgcatttaaaatggacttttgttcatgggagaacctcgttgacatgcacagtttgcaatcttatgttgatcgatgttaaacgtcacagcagtacttgctcaataaaggtcatattggaaacatagtcaattgctgagtcttatgtcatttctctttttctaatttttatttatttatttttatttagagatggggtcttgctatgtggcctcaagcagtcctcccacctcagccacccaaagtgctgggattacaggcatgagccaccacgcccagcctgttatgccatttcaaagtgaaatctccactacctgaagctttcttgccctgaaatagattattggggggaatcataagtaaactgcacatcttattgctatttccctgacagcaattacttggaaaacgtaattgctgaagatattttcaggtgtcaacatcttcaccgagcccggtcttcatcccaaaattttaaaatcatatttttgaaataaaaataaaagcatcagatacaaataggaatctggtgggatagaaatcttcagtgtttgtttctatcccaaaacagaactcagaacctctaggtaagaggaccaataaaggaggggttcataacttgtgccttggagttgggacagagacagaggagctcatggcatttatgacgatgtgtccagtggggacagggctgacatcactaacactcctacccggaactatccagcctcagaggcatgcctcctgtgcacaaacacacacatacacattgtctgcatcactaatgcttgatttgactgacagagatttacacctttagtattttactaattgtggaaaatgatataaaaaataaataaaataccctacctgagaaaagaaaaatgagattctgtgacataggcaataagtgtttttaaataaaaagacatgatcttgaccaaggaaatactatcatccccttttcaaaacttgttttaggccttgaagaccattaatatattaattagcacattatcctgtccaagtccatgttttttcattaataggatcagctcaataatacaatccttgatatattttcaatgactttttcaagataactccaattttaatgcctaaacatacccaggaagctaattgttaacggcagtttttattgtttcccaatcattagccatttgccaatcctcacaattttggctacatctgagtattatctgtacaattatgtattcagatttctttctttaaaacaatttatgttttaagttaagatgttaatttttctgaagcaaaaatatccatgacacgcaaagtgacacaggattatttaaatataatcagcaaaaaaaaaaaaaactgatctagtgatacagaattaaaaaataaaaaagagcatattggaaggacacagggtaactcctagagtgaaaacatcagcagaggagtcaggggttgggagagaggagctcggacagccccagggtcagaggtcgcaggaatcatcacgcagtcacagggcggattaaactgaaaactctgtgacacttcattggaattccaggaacagagcatcatctatttgccacacacctttgctagcaaagaggagcaccttgattgatagtctcacccaaactgactccaatgacagcactgcagctcttcacagaaaagtctgggagctgttatcagaagtaggaatggaggctggagttatgtgatacgatctatgtgaattttttaaatgcccattaaatatacaatcattactataaaaatactcatttgcacctaaaatcatctcacttaccagcactggaccctggggcttagaagactttcttttttggtagcatatattgtttaaaaatgacaggatcaatcagcaaaactctccaacgcaggcaccagaaacttaactcttcagctctaactttgttttcaaccacttcattttctttcctaagaaggtaagacattcaataatattgccacatattccataaaaaaaaatcactattttctattctttaaaaatgacagaacacctctggctgcagtggcacaggccaatagtcacagctgttccagaggctgagacatgaggatcactcaagcccag

SEQ ID NO: 17289 - DNA, 64518 bp, Human
tgactgattttttgtatttttagtagagacggagtttctccctgtcagtcacgctggtctcgaactcccgacctcaggtgatctgcccgcctcagcctcccaaagtgctaggattacaggcgtgagccactgctcttggcctaatttttgtatttttagtagagatggggttttgccatgccgaccaggctggtctcaacctcctgacctcaagtgataagaccaccttggcctcctaaagtgctggaattacatgcgtaagccaccatgccaggccacctttgcaggtcttttcctgatcctgagggtctaggaatttttaacggtctgaataaacaatatttgcgaaaacatttgccatctattacctgtaagggtggtcatctatgagacttcctctacataataagaaccttggtcttcacaacctgttttttgtttgtttgtttgtttgtttgttttgagacagggtgtggctctcttgcccaagctggagttcaatggcacgaacttggctcactgcaacctctccctcctgggcttaagcaatccacccacctcagcctcccttgtagctgggattacaggcctccgccaccacatccggtacaggtatgtttggtacagacagggtctcaccatgttgcccacgctgctctccaactcctgacctcaagcaattcgcccacctcggcatcccaaagtgttgggattacaggtgtgagtcaccgtgctcgtgcccacaaccccttatcttcacccagacactctttttattgattccaggtctgtataactcaactcttttttttcttttttttgttttcttttttttttttttttgagacggagtcacagctctgtcgcccaggctgcagtgcaagtggcacgatctcggctcactgcaaccgcagcctcccgggttcacgctattcttccgcctcagcctccccaggagctgggactacaggcacgtgccaccttgcccagctaattttttgtatcttagtagagatgatgggttttcaccatgttggccaggctggtctcggactcctgaccgcaggcagtccgcccacctcagcctcccaaagtgctaggattacaggcgtgagccaccgcgcccaaccagaactcaactcttttaaccaattgccaatcagaaagtatctgaatccacctatgacctctaagtatttcaccctttgagttgtcctgcctttccacacggaaccaacctatgtcttacatgcattgactgatgtcttatgtctctctaaaatgtataaaaccaagcaagctgtaacccaagcaccttgggccaagttctcaggaccttttgagactgtgcctccctccatgcacactcatatttggctcagaataaccttctaaatactttagagtttgactcttctcgacaaggacaagagaagtggaataaacgaataaccgcagttttcctggtggtattggtcactgggttcaggttttggagtagtagccagtcaagcctggaatccccttcctcattcgctttagctttttgtccagtcttggtttgcaagagacttgcagcggcctagacggatggccgggattcacaaaggtcgcagacacgggaactgcttcttccccagcgtcgcctccacaccctcgcgtggatactgacatccgccccattccaggaatgcgcacagctaggcgcagccggccagcgtgggccgggggcggcggggccacctcccccacctccgcgcgcaaggcccgtcgcccttgacaacgcgatccaaggtcacggaggtcccacccccaggcccgaccgtccacgagacgggtagtaccccgccacgcgcccgagcaggcagctgcccggacagcccggcgcccgccgtgacgtcaccgccccgcgcccgaggaagccccgccccgcgcagccccgtcccgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggtgagggcgtcctggctggacgggcagcgggcgggccgggccacggagacggcagggacgtccctgtgctccggggagcgaggcgccggcacctgcttcacaggcgtgggaggtccggcgaggccaagcgcggcagacgcgtttactttcgctccgctcctcgccagctccagcttggctgccttttcctcggctggactcccctcgccacccgcccatgggagccctgaaggaggctgggtcttggggggtcgcggggtcgggcggagcggctgcggggtcgtccctcctggagcttcggtccagtcaggtagcgcacgtgcaggtggagccgctgcggagcgcggagtctttgcgggtgcatgttgcggggaatggactcactcggggtgatcgtgctagttccatggatcgtgctttacccctccccgcctcccagtagcgcactgagggttcatttgttaattcgttcattggacgcacatgtgagcgcccgctcagtgcccggcgccgtgcaggttctggggacgccacagtgaacaaaacctatagcagtcatccgggtccccagagcaggtggactcgatgtcgttgacgcagctgtgtcctcggggcctggaattgatggatgcgccaataaatgtttgtaaaacagagagaacgaccctaacctctgctttcccagtccccactcggaggtaacaacagtgaaagtttcggcattgcttcggggctgtacacagtgttatacgtgtaaatataaatgtctgcgtataagtattttttattctaaaaagcctaaaccatgtatgcattgtgctacgttgtacttcagaaaattttaacgctcccagcattctttccacatcttttcatgtcagtgtatacaggtccatgtgccttccagtgaccacacagtattctgtatgatggacgtgtcatttgtttaaacattgtcctattagtggacgcaataaaggttatttcaggttttactttttattacaatgctgcatagaatgggtgagtacttaaatatttgttcacgtgcggtatttctttagccttacataattagaattttagaattgatatttcagagcctatgcatttttgaaatgttagcagatactgccaaattgtccaaaaaggccttatcaatttatatcccctttagcaggcatcaagactgcctattccaaaggtattttcttcaacgctgaatcttatgtcttttcaaaaccagtggtctataaaagataccttgtggccgggcgcagtggctcacgcctgtaatcctagcactttgggagcctgaggtgggcagatcaggagttcaagaccagcctggccaacatggtgaaaccctgtctctactaaaaatacaaaaattagctgggtgtggtggcgcgcgcctgtaatcccagcttcttgggaggctgaggcaggagaatcgcttgaacccaggaggcagagattgcagtgagctgagattgcaccactgcactccagcctgggcgacagagtgagacttcatctcaacaacaaaaataataataattttccctcagaaagtgatgctgttgctctcttctagcaccagtgtctgatcaattatttatttatttttttgtctttatgaggtggggtttcactatgttggccaggctggtctccagtgcctgacctcaagtgatctgcctgccttgccctccaaaatgctgggattgcaggcgtgtgtcaccgtgcctggccaactgttctgttaatttggttctcgtttcttttgtagctgactcgggttttttcccccttggaggttaagattttttctctttgtcgtttgtggtctcgcgtccacaggtgtttgtgattcatgctttgtatcatgcactgtcccttccatttggaaaatatgtcagttttcagcccagggacattttaattctgtttctttatctctttttctttttctttttttttgagatggagtcttgctctgtcacccaggctggagtgcagtggcgcgatcttggctcactgcaagctccgcctcccgggttcaggccattctcctgcctcagcctcccgagtagctgggactttaggcgcccaccaccatgcctggctaattttttgtatttttagtagagacggggtttcaccctgttagccaggatggtctcgatctcctgacctcgtgatccgcccacttcggcctcccaaagtgctgggattacaagcgtgagccgctgtgcccagccctttatctctttttcttaaaaattgtctctctcctctcgtcctccatcttctggtgcggtggttcaagcattcctctgcctgagtctaagaaatggaacatgttcttggcagccttctgcgtggcaggtgcccttgtcattgtcacctgtgtggatgaatgggaaggtaaattgtttggattgattgaacgatgagagaatttagctaagaaaatacatgtcttgtgcaacaggggagaaagaatagtttaggcagatccacctatgtagaaaatccagacctcttgaaatttttttcttttcttgggaaagtatttccaggttgtagcatgtgcctggcttcaggtgtgcgtgtcttatgtctgtggaatcctctcgcccatgctacgctgcctcagtcacccatgagctcagccctcttaccctttcagacctcactgacccctgacactgccagccctgtcacttgccctcagaatatcttatttgattttttttgagccggagtcttgctctgttgcccaggctggagtgcagtggtgcaacctcagctcaccacaccctccgcctcctgggttcgagtgattctcctgacttcgcctcccacgtagctgggactacaggcgcatgccaccacacccagctaggttttgtatttttaatagagatggggtttcactatgctggccagggtggtctcgaactcctgacctcatgatccactagccttggcctcccaaaatgctgggattacaggcgtgagccactgcgcctggcctaccctcagaatatttctgtgaggggtgggctaggatatccgcttgtggactttatatttgtcatttttgcccataacagtttattcagcaaatacatttccaatgcccccgagtcttcaaagaaaatgtgaccctgctgtctggagtcataggtggctgctgagcagtgtaccagggccatcttggtggcctggacagcacattagagaaacaagagctgcttgccccagggtaagtttcacagatgaggagcgatttgggccgagtgtccaaggctgttttcactggaggggagggaggaacgttccatgtctggaaagctgcaggtgcaagggtaaggagatagctctgaataattggtttgatgaaagacttgcgggagtgtgcaggagtgatggtgaatgaggctagcagttgtgtcttttctgtcagatataagcttgtgcgtaggagcctcatcctgcattcctcaggacagtcacagagccagccctgggcctggtgtgtggggagcccagccacgtggcccaccatgagagcttttcgtcagagctccaactgtcagaagtgtcagatgtgccagtagaaggatgaggccgcctcctaaaggagagggaagacctggaaagatcaacagcagacgcagtctcccaaagcaaacgtgattctgtggtcaggcaggtacggtgacgggttggtcattttgcatgacgaggtgactgccacaatcaccaagggtgccgagtccagtctcctggtcatgccagatgctcttgttttcgtgaaattgccagaacatgactgaggcaaccacgataggactggttggtgcaggcgttaagatcttgggcctttttgttctctgtaagctggagcctttgctggaacttcctgtcttggaaatcagagttgtgagagtaggtcccctgccagcaccaggaaggtcgggagagctggtttcctcactttgctcagggctcaagtactagctagtttgtttcatcttccaaaaagagcctcacctggaccccgctcctgtaggtggtgcctgcctgctgcgccctccccttcagtacttcgttttgttgacgggttttgcctcctccctctgctctccctttgtttggagcctgtgctgtttgatttccgtgtcttgtgtgctgcacccttcaggagaattcaggtgaatttctggtgctctccggctgttcttttcagagtggaggggagtagtacttgctggtcagttgcgactctgtctgtgaaacagctctttgtgttgctgagatgacgctagaggtgtagcgtccatgacatgtttgtcgtctgattaagctgtggtgctggcacttagacggcagaggaaggtgtggcccagctgtccaaggccaccaggaggaccttcagcttagttaggaccaagggaactgagttatctgagtgcctgaaaaagaacacatcaggccgggcgcggtggctctcgtctgtaatcccagcactttgggaggccgaggtgggtggatcacttgagttcaggaatttgagaccaacctggccaacatggcgaaaccccgtctctactaaaaatacaaagaaattagccagggtggtggcaggcgcctgtaatcccagatacttgggaggctgaggcacgagaattgcttgaacctgggaggtggaggttggaggttgcagtgagccaagattgtgccactgcactccctcctgggcgacagtgcaagactctgtcttggaaacaaacacatcaatccgaatgtaagagattagcaaagcgtttattggttactgggtgagtagttggcctaagctaagacaaaagaggaatctccaagtattttgctaccccttggcaggaagagagggaatgcagcttgcggggtggggatgggggtgtcaggttgataagaaaactgtgggaaaataaacatttactcctgccccccatgtcagtaaataccatgtgacaaaggtgagttccatgaaagaggctgttactgaggcctgtgatacttgcttgtctcaaaatgctgacatatcttttttttttttttttttttttttttttttttttgagacagattctttctgtcgccaggctgaagtgcagtggcatgacctcagctcactgcaacttccgcctcctgaattcaggcagttctcctgcctcagcctcctgagtagctgggactacaggtgcatgccaccatggccagccaatttttgtatttttagtagagacgaggtttcaccgtgttgggcaagatggtctcaatcttttgaccttttgatctgcctgctttggcctcccaaagtgctgggattacagacatgagctaccacgtcgggcctgacaaagaatcttgatagcgattgaaaatgtatccattcatactcaaatgaagtaaaaagtgcttttgggttcaaagccagagaatgttcatggatggcgtttttggtgcctcaagtgtagccagctagaacttttcttaccaccgtcctgcttagtcctactgaagacctgccttctactaggaagctgctcttagtccacaaagtggcttccctgtagttccacagcatttaacaaaatagatttcagggagtttatttgtggtgtggctggttatttctgctaaaaccactaggaattaccataaaagctgtagcttggagaaacagtatctacttgcgggagtattactgccacctgtgttttttttgtttttgttttggtttttgttttttttttgtttttttcaagatggagtcttgctctgtttcccaggctggagtgcagtggcacgaactcggctcactgcaatctccacctcccgggttcaagcagttctcctgcctcagcctcccaagtagctggggctacaggcatgcactaccgtgcccggctaatttttgtatttttagttgaggtagagtttcaccatgttggccaggctggtcttgaacttctgaccttgtgatctgcctgcctcggcctcccaaagtgctgggattacaggtgtgcgccaccgttcccagccctgccattggctttttaaccaggtgaattcctgtagattgggtagattgaaaggacatgtagctgaatcattggttttaaaaggaatggctcagttacttcatagccatataattaagaaatgtggctagaaggtaaaaaattggccaggcctggtagctcatgcttgtaatcccagcactttgggggctgcggcgggaggatcctgtgagtttaggagtttgagaccagcctgggcaacctagagagacccccatctctaccaaaaaacccttttttttttttttccaattagctgggtgtgcctgtggtcccagctacccaagaggctgaagtgggaggctcccttaagccttgagaagtcgaggctgcagtgagctgtgatcacgccactgcactacagtctgggtgacagagtgacagtgtctcaaaaaaaaatatatatatatatatatatatatacacacacacatataaaagaaattaattttgagatagctaaattaaatgccatattaagagcaggaggctattcagcaatgctgctgagaagaagacagaaggacgtgggtccttctaatgtaactatgtgtgtcgggttagtgatatgcacctcgaaggagaaattaagacagcacattgccatgttagttcacacttgccagtatttcagcatttgtcaggcaatggaatgttcaagcgaattttccacgaggctgactttaaaacatttcattttaaccattatgatgagaagtctttctagaacactccatcatttgatggcccatgactgaacctctcttggatgttttcagggtcattattacgggtgttaatgtttggtcttctgttttaatatgtaggctcccgtagggccattgaaatgtgaagaatccttcgtctatgaagtgtccccacatcaaaactgcattgtgagtgtttatatttttggcctctcttactgtggccttaacttgcaggtctgtctggagccctgttctctcctttcctagtttgcagatgtggctgggaaacttgttagcatcaaattgttagaatgagatggatttcatatggggccagtagtcttccatgagcaaagctcagggtgagggcttcaggcccatattttgactattccgaggtgccctttcgctttttgttctttttctttatgttcaaggagttatgtttcctgatgaatgaagtatcagtatatcatagtagagaacgattagaccaggttctggaacacaggaaacctcaagaaacagtgagtgttgagaatgccagagctaagaactcagacatttgtgagggaatacaggtctttctgttcagaatgttcatgtacttaagaatcttctcgccaggcgcggtggctcacgcctgtaatcccagcactttggcaggctgaggcgggtggatcacctgaggttaggagtttgagaccagcctgaccaacatggagaaaccctgtctctacgaaaaatacaaaactagccgggcgtggtggcgcatgcctgtaatcccagctacttaggaggctgaggcaggagaatcgcttgaatctgggaggtggaggttgtggtgtgccgagatggcgccactgcactccagcctggcaacaagagcgaaaactccgtctcacacacacacacaaaaaaaagggaaacaaaggtaaactgggaaggaaccgtgtgtaatcttccgtaccttgcattttccacttatattctggggtttgtttcctgtcgccacagagctctggtattccatagcgaggatgttttgtaatttatgtaaccctctcatggcggacatttaggttgttgctgagtttccccaagataacagacggcattgccaacagtttctcacaccttcaccagtgctagaatgacagtatttaaaacatctgtcaatctggtagtgaaaatgctatctcgttttaaagtgcatttccttagttatgagtgtggtaaaacatcttttactaggacgtaaagccattgatgtttcttgtttttgtgaatggccatttttctcttgaaccaatggcctttttcttttttttttttttttttttgagatggagttttgcacttggtgcccaggctggagtgcagtggcgtgatcttggctcaccgtaacctctgcgctagcccttttaaataacttttaaaaattgagacagtgtcgggccaggcacggtggctcacgcctgtaatcccagcactgtgggaggccgaggcgggcggatcatgaggtcaggagatcgagaccatcctggctaacacggtgaaaccccatctctactaaaaatacaaaaaattatctgggcatggtggcgggcgcctgtagtcccagctacttgggaagctgaggcaggagaatgccgtgaacccaggaagcggagcttgcagtgagccgcgatcgcaccactgcactccagcctcggcaacagagcaaaactccatctcaaaaaaaaaaaaaaaattgagacagagtctgactctgttgcccaggctggagtgcagtggcgccatctcaccttactgtaacctccgcctcccgaggttaagcagtcctctcgcctcagcctcacaagtagccgggattacaggcacgcgccaccatgcccggctcatttatttttatttatttatttatttattttgagatggagtctcgctccgtcgcccaggctggagtgcagtggtacaatcttggctcactgcaacctccgtctcccaggttgaagcatttctcctgcctcagcctccctagtagctgggactacaggcacccgtcaccacgcccggctaatttttgtatttttagtagagatggaatttcaccatgttgatcaggctggtcttgaactcctgacctcatgatccatccgcctcagcctcccaaagtgttggcattacaggtgtgagccactgctcctggctttctggctaatttttgtttttttttgtatttttagtagagacagggttttgccatgttggccaggctagtctcaaactcttgacctcgggatctgcccgcccccacctcccaaagtgctgtgattacaggcgtgagccacggcactaaattttattttagaggcagggtcttgctttgtcatccgggctggagtgcagttgtgcgatcctggctcgctgcaggcctgacctcctggactcaagtgatactcctgcctcatcctcccaagtggctgtgacctcttcctcccaaggagcatgtgccaccatgcctggctaattaaaaaacattttttttagagatggggtcccactatattgccccggcttgtcttgaactcctggtctcaagtgatcctcctacttctgcctgccaaagtactgggattacacgcaggagccgtcgtgcctggcccccagtttttttcttaatgtgtttgtcttttttttttttttttttgagttagagtctcgctctgtctgttgcccaggctggagtgcagtggcacgatcttggctcactgcagccttcgcttcccgagtgcaagcaagtctcctgcctcagcctctggagtagctgggattacagatgcccgctgcgactcccagctaatttttgtatttttggtagagacggggtttcaccatgttggccaggctggtctcgaactcctgacctcaggcgatccacccacctcagcctcccaaagtgctgggattacaggcatgagccacctcacccgggtgtttgtcttttgacttaaatttttatgtggtccttatatttatggccttttgggttatatattttgtttagaaacatttcctcttaaggccgggcgcggtggctcacgcttgtaatcctagcactttgggaggctgaggcaggtggatcacgagttcaggagtttgagaccatcctggccaacatggtgaaaccccgtctctactaaaaatacaaaacattagccgggtgtggtggtgggcgcctgtagtcccagctacttgggaggctgaggcaggagaatggtgtgaacccgggaggcggagcttgcagtgagccgagatcccgccactgcactccagcctgggcgacagagcgagactccgcctcaaaaaaaaaaaaaaaaaaagatttcctcttaaatcattttttttaaaaactcaagatgcctggcagtttaggaactgcaaagcaaaactacagtgagttagcacttcctactcactagggtggctataattaaaaattaaagaaacaacaacaaaaaaacaggtgatacaaaatggataactaggatgtggaaaaatcagaaccctcccacactgctggtgagaatgtaaaacggtgcgacctctgcaggaaaacattcttgcagctcctcacacagtcaaaccgaattaccatatgaccccacagttctaccctgaggcacataccttgtagacatgaaaacatgtccacagaacagcctacacatgaatgttcatagcagcattattcataataacccgaaaatgaaaacaatctgaaggtccatcagaaggtggaaacgaggctgggtgcggttggtcatgcctgtaattgcagcacttcaggaggccaaggcaggaggattgcttgaggccaagagttgaatgccagcctggacaacatagtgagactccatctcgaaaaaaaatttttaaaaattgctgggtgtggtggcacatgcctgtggtcccagccatttgggaggctgaggtgggagaattgctcgagcccaggagtttgaggctacattgagctgtgattgtgccactgcacttcagcctggtcaaagagcaagaacctatctcaaaaaaaaaaaaaaaaaaaaaagagtgcaaataggccaggagtggtggtgcgcccttctaatcccacctgcttgggaggctgaggtgggaggatcgcttaagcctgccagttggaggctaccatgcaccatgacagtgcctgtaaacagccactgcactccaggcaacatagtgagacccccaccccaccccaaaacaaaagttacagtaaaaagttggaagctgggcctggtgcagtggctcatgtctacaatctcagcacttcgggaggctaacgtgggtggattacttgaggtcaggagtttgagactagcctggccaacatggcaaaacccgtctctactaaaaatacaaaaattaactgggcgtggtggcgggtgcctcagcaggagaatcacttgaccctgggaattggaggttgcagtgagcggagattacaccactgcagagtgagactccgtctcaaaaaaaaaaaaagaaaaaaagggccgggactggtggctcacgcctgtaatcccagcactttgggaggccgaggtgggccgatcacctgaggtcaggagtttgagaccagcctgaccaacatggagaaaccccgtctctactaaaaaaaaatatatatatatataaaattagccgggtgtggtggcacatgcctgtaatctcagctactcgggaggctgaggcaggagaatcacttgaacccgggaggcagaggttgcagtgagccaagatcatgtcattgcactccagcctggcaacgagagtgaaactctgtctcacaaaaaatttggaagcaacccagttgcccatcatttgatgaatggaaaaaaataatctatacagcggagtgctcttcagttataaaaaggaatgaggtgctgatacatgctatatgtggatgaaccccaaagactttatgctaagtcaaagaagccagacaaaaaaccatatattgtatgatttcatttctgtgaagtgcccagaaaaggcaaatccatagagacagacatagatgagtagttgccaagagctggtgggagagggaaaagagagtgaacatgagtggctgtagggcttcttttggggtgataaaaatgttctgtagttgtccgggcatggtggctcatgcctgtaatcccagcactttgggaggccgatgcgggcggatcacgaggtcaggagatcgagaccatcctggctaacatggtgaaaccctgtgtctactaaaaaaaaaatacaaaaaattagccgggtgtggtggcgggcgcctgtagtcccagctactcgggacgctgaggcaggagaatggcatgaacccaggacgcagagcttacagtgagcccagatggctccactgcactccagcctgggcgacagagcgagactccgtctcaaaaaaaaaaatgttctgtggttagtggtcgtggctgtacaactttgtgaatatactaaaaccactgaattgtgcacttgggtgaattatatggcagatgtgttacatctcaataaagttactaaatctttcatgttttctttcagtacttttagcttttatttttacttctatggtccatctggaattcattttgacttaataagtgacagcggaaattaaaaaaaaaaaaataagaggttggtcttgctatgttgcccaggctggtctagaactcctggcctcaagtgttcctcccaacttggccttccaaagcactggggttacaaacatgagcccctgtgccctgctggaaattaatttaacctttttttgtgtgtgtttactttttgagagttgggggggtctccctatgttacctaggctggcctcgagctcctgagctcgagggagcctcctcctgcctggatctccctcccaaagtgctgggattacaggtgtgagcagccatgcctggtctggaaatttattttaatattgtagctttatattaatgttctttaatatttgatgaatttcctcagttttttcaaaatttctttggctatttatgtacactaacttttccacatgaattttagaatgagaatagtttaaaaatgtgtttgaaattttgtaaatgtgtttatgtttctcgtaagtttttaagtgttttttataatgcaacgttttgtttgttttgagacagagtcgtgctgtcgcctaggctcgagtgcagagatgcaatttcagctcactgaacctctgcctcccaggttcaagcgattctagtgcgttggtctcgcgagtagctaagattacaggtgtgcatccccatgcccagctaatttttgtatttttagtagagacgggttttcaccattttggccaggctgttctcaaacccctgacctcagctgatctgcctaccttggcttctcaaagtgctgggattacaggcgtgaggcacctcacctggcctgtaatgtaacttttgtaaatagttttgttttttgatttttttttttgagacggggtctcgctctgtcgcccaggctggagtgcagtggcgcgatctcggctcactgcacgctccgcctcccgcgttcactccattctcctgcctcagcctcccgagtagctgggaccacaggcacccgccaccacgcccggctaattttttgtattttcaatagagactggctttcaccgtgttagccaggatgatcttgatctcctgacctcgtgatctgcccgcctcggcctcccaaagtgctgggattacaggcgtaagccaccgcgcccagcctaacttttgtaaatagttttataagtagggtatttattttgtagattattgatatatgtagtccaatatgcaaacgatacagaggtatatctgatgaaaaactcgtctcccactgacatgcctcagacaacacccctcctggtggcaagtccattagccagtttttgggtgtccttgcagagatctgcgtggcatatgagaatagctatgcatgcatgtatcacataacatgtatatgcatttgaacaccatggtagtgtgtgcaaaccgctgttctacctctagtgttttttctttgtgttagaggtaattcagcatcagcacacattacacagcattgtcccatttctctataatcccatgctttccaagtgttaccttacgtctgtagtttacttgttagtcctccgcttgtgagtatgtagcatatgtaacagtcttaagtgggttatttaatgacagtctttggccctagtagtgtttcagagttttcttaaaagatcttgccaaaaaagaaaaaaaaggaaagattttgctttcttggtaaatgcattcttaattgtttagtttttgttcctggggtctcttatgtcatattttctaactagttttctgtatataggacgtccgggtgttgatttttgtattctaccatcttactgaatgctttttttttttttttttttttttcaagacggagtttcactcttgttctccaggctggagtgcaatggcagcatcttggcttaccacaacctccacctcctgggttcaagcgattctcctacctcggcctcccaagtagctgggattacaggcatccacgacaacacctggctaattttgtatttttagtagagatggagtttctccatgttggtcaggctggtctcaaactcccaacctcaggtgatccgcctaccacagcctcccaaagtgccaggattacaggtgtgagccaccgcacccagctttttaaatttctcttaaagacagggtctcactttgtcacccaggctagagtgcagtggtgtgatctcggctcactgcagcctttaccctctggtctcaagtgatccttccgcctcaagtaccccaagtagctggaactacaggtgcgtgtcaccatgtccacctaagtttttgtatttttggtagggacggggtttcaccagtttgcccatgctggtctcaaactcctgggctcaagcgatctgcctgcctcagcctcctagagtgctgggattacaggtgtgagccactgccctaggccttattctttaaaatgatctgcctcttgaaaaatgaaagtcttttctcaaaaaacttcttcccaggtctgtgaagcagcacagtggccccttctggctctcaccttgtacctcgtccttgtttgcctcgagcataggaccttgtctgtgtttgtgcctcaggccccctccctctgtgtttgctgggtccacttagtctagtcattgggccttggctcctaagaggcccctagactgaattcctcatccgatgtgtccataccagctttcaagtgacctcaacatcgacagcagggaaaacattagcacttttgtgacagcctcatattttcccccgcccgagatggagtctcactgtgtcgcccaggctgggattacaggtgcacgccaccacacccagctaatttttgtatttttagtagagacagggttcaccatgttggccacgctggtctcgaactcctgactttgtgatccacctgccttggcctcccaaagtgctgggataacaggtgtgagccaccgtgccgggcagcctcatatttttaataatttaatatctgttttgaataaataaatatggtttgattaaccaaaaccatgtgaacaggtaaagcttgagaagtcttgctgctgttcagagcacctgctgtcttcataaccactattagttgcctgtgggtcctgccactacttacttgtatgactgtagtaagtgcagatgtacatattccctcagggacgcacccttctctgtgttctgttactcactacatagctcgtggagagcttgctgtgttcatatatagtttggtgctccttcgctttctgtagccactgtgaaatgccgttcatatcttttgccccaggtttttcttctggactgtctggctattttttttttttttttttgggacagggtcttactctgtcacccagactggagtgcaggggcgcgatctcagctcactgcaacctctgcctcgggttcaagcgattctcctgtttcagcctcccaaagtgctgggattacaggcgtgagctactgtgcccggcttctgttttattttttggtttgattctgtcagttattgagagaggagtgttaagatctccagctgtgattgtggaattgttttgtctttaattctttccgttttaacttcatatatgttgaagctctgttattaggcaaatacacacttgtgattacattttcctgatgaattgtttgttgtagtattctgaaatatccttcttttttcctaataatattttttattttgaaatgtattttacttgatattaatagagccactccagctttcttaaacacactttttggatggtatgtatttttccattcatttgtcttaagtgtatctttttctttatgtttaaagtgtcttgtagatagcatgtaattaggtcttcctttaccaattctgacaatccttgccttataattagagttcagtctgttaatgtaagagtaaatatcgatgtggctggatttattgctaccattttattatttgccttttatttgtccttttggattttttccctgtttttcctttccttatcaatgaaatgtatttgagatttccattgtggtttatctaatgctttttaaagctattcttctttgaattattattttagtggttactctggtgtttgaaatatgcacccttggccaggtgcggtggctcacttctgtaatcccaccactttgggaggctgaggcaggaggatcccttgagccccagagtttgagaccagcctgggcaacatggagaaaccccatctctactaaaaatataaaaattagcctggcgtggtgatgtgcatctgtagtcccagctactcgggcggctgaggcccgagaatggcttgaactgggaggcggagtttgcagtgagccgagattgtgccagtgcactccagcctgggcaacagagtgagactgcatctcaaacaaacaaacaaaaaagtctgggcgtggtggctcacacctgtaatcctagcactttgggaggccgatgtgggcggatcacctgaggtcaggagttagagagcagcctgaccaacatggagaaaccccgtctctacaaaaaatgcaaaattagccaggcgtggtggcacatgcctgtaatctcagctactcgggaggctgaggcaggagaatcgcttgaacccgggaggaggaggatggggtgagctgagatcgcgccattgcactccagcctgggcaacaagagggaaactccatctcaaaaaaaaaagtttgtaaagagtagcttttgtgatagatactttggcataccaagaaatatggatgttcctgtcttcaaagagtgttactgagaaatacaagctttttcctgccctaatttggtgagataaattatacattaaccaaaaaattaacagtgggaaatgtcatatgctggcatatagcagcagtttcaaatgagcagcacaggctgggcgtggtggctcagacctgtaatcccagcagctttgggaggctaaggtaggaagattgcttgagaccaggagcttaagaccagcctggtcaacatggaaacaccctatctctaggaaaaaaaaaaaaaaaagaatttagtcctgtgtgatggtgcttacctgcagtcccagctgttcaggagagtaaagcaggaaggtcccttgagcccaggagttcaagactgcagtgagccatgactgtaccactgcactccagcctgggtgacagagcaatctcttttctaagaaagaaagaaatagtaaatacatgaataaatctttttttttttttttttttttgagacggagtttcactcttgtcacccaggctgctggagtgcaatggcacaatctcggctcaccgcaacctctgcctcgtgggttcaagtgattctcctgcctcagcctcccgagtagcggggattacaggcacccagtgctaattttgtatttttagtagagatggggtttcaccctgttggtcacgctggtcttgaactcctgacctcaggtgatccacccgcctcggcctcccaaagtgctgggattatggtgtgagccactgcgcctggccagtataaaatttttttaaatgggcagcataaaaagttaagtgcagtgaactcataggaagagattattgtgaactgctggggccagggaggcctgaatgggagagagggcctgcagccaggccctgcagcaactcggatgggaaggagtcccagctactgagactgcagctgcagagtggaggagctgcatgggcactggcagtagtgggtagggatgtggggggtggaaggggaggggtgtgtggtgtcacattcaaactatcagtgcttcccattttgtgcgaccccaaaccaccagatagtttaacagtaagatcttgtagcctgacattgaggtttgtggtttttcctttagggtgtaggagaaacacaaagacggaaattgtacagctagcgtgtttggtatctggttcaggcagatttattcctctaatggtttattttttttttaatttttaattttttttttgagacagggcctggctgcatctcccaccctgaaatgcagtggcgtgatcttggctcactgcaacctctgccttgcaggctcaagtgatcctcccaagtagctgagactacaggcatgcaccaccacacctggctgtttttttgtagagatggggttttgccatgttacccaggctaatttcaaactcctgagctgaagcgaccccccggccttggcctcccaaagtgctgggattacaggcatgagccactgcacctgagttagtgattaaaagttgttgtagaagccgggcgcggtggctcacgcctgtaatcccagcactttgggaggctgaggcgggcagatcacgaggtcaggagatcaagaccatcctggctaacacggtgaaaccccatctctactaaaaatacaaaaaattagccgggcatggtggcgggcgcctgtagtcttgggaggctgaggcaggagaatggcatgaatccgggaggcggagcttgcagtgagccgagatggcgccctgcactgcagcctgggcaacagagtgagactctaaaaaaaaaaaaaaaagttgttgtggaaagtttacataacctgaaatcaaatctgcttttaagaatgctgtcaattcaattaatgtaatcttggcgttatgatactaagtcttgcaattctggctggaaatatagatttcttatttttttctttttcccaattgtgaggacttctatatactcctcccataatgaatattatattaaatcctttcaaaaatataggctgggtgtagtggtttgtgcctgtaatcccagcactttgggagactgaggcagacggatcacgaggtcaggagttcgagaccatcctggccaacatggtgaaaccctgtctctacttaaaaaagaaaaacaaaaaaacaaaaaaacacaaaagttagccgggcatggtggtgcacacctgcaatcccagctacttgggaggctgaggcaggagaattgcttgaacctgggaggcagaggttgcagtgagccgagatcacgccatttcactccagctctgggcaacagagcaagaccttctcgaggaaaaaaaaaaaaaattctgcatattaattggggaaaaaccaaaaagactagaaaaatgaaacatggggaaatcatgtttaatcttagagtgaggaaggcttttacaaccaaaagactaatttccttttttttttttttttgagacagagtcttgctctgttgcccagggtggagtgcagtggcgccatctcagctcgctgcaaactccgtctcccgggttcatgccattctcctgcctcagcctcccaagtagctgggactacaggcgcccaccactacgcctggctaattttttgtatttttagtagagacggggtttcaccgtgttagccaggatggtctcaatctcctgacctcgtgatcctcccgcctcggcctcccaaagtgctgggattacaggtgtgagccaccgctcctggcgactaatttccttaatatataaaaagctcttacaaatcaataagaagaagatttaaaatgtagtagaaaaattatcagaggataccaacagtcccttaacaaaaaaggaaataggaaatatttaaaaatacgggacagtgctcagttttgcttataataagagaaatgtaagtgaaaactacagtgaaaattttatctgaccaataggcaaagatccaagagtttcatctcaacactgacttggcaggaatgtaggatgatatgcactttagtacattgctgtgggaacgtaaactgataggatctctgtggagtgtgacttggcagtatctaccactgcttaaaatacataaccttaggctgggcgtggtgtcttacggctctaatcccagcgcttgggaggcagaggccgggggatcacttgagctcaggagtttgagaccagcctgggcaacatggtgaatccctgtctctacagaaaacacaaaaattagccgggtatggtggcatgagcctgtagtctcagctactcggaaggttgaggtgggaggatcacttgaatccggagggttgaggctgctgtgagccaagatcactctactgcacttcagcctgggcgacagagtgagacccagtcaaaaaaaaaaagaaaaaaaaaattagctaggagtggtaatacacggcctatagtcccagctactcaggaggctgaggtgggaggatcacctgagcccgggaaggtcgaggctgcagtgagctgtgattgtgccattgtgatccagcctgggcaacagagtgagaccctgtctcaaaatagtagtaacttacaccagccagttattgctgtggtgtttcctgatggtgtgctttctgttttctgccattccttgtgtttattcattggaattctgctgtgatgaagagctgctgctcctcctctgtttaagtgtgcaccgatgtttgcttgatttgccgggtcacagcttacaatccattattgtcgttcgttattttgccgcacagattgtcctagattctgccactgggagcccttctggctgggctgtgtgttctcctgacacaccccgtcctttctcgtccttctgcacaccactgggtgtcctaggctcctctgtgtgctccgcagggatctctggttcctgtttttggagagaggtattcacaaaccaagatctggctgccaggtagggtgaccagccgtcctagtttgccaggacaaaggctttccctgggacgtgggactttagagtgctgaaactggaacagcttttggactttgctctctgtagcctaagtggggggtcatcgcgcctgggccctgtcacgcgtcagtggacagagctgggaaatgtgtgtgtgtaaatgttccggtattgatttctgcatccagtctgtacacatggcaaaggttgtgagcctgtactgatgcctgtacctccagtgccgccccgcagggtttattcctgccccttccttatcagtgacttttcttcaactgtgaggaccccaactcagtagccacaatcagcttttccgcttgatcttggcacatgcgtaaatcgggctcagacctgctgactccgcaggggacacatctcctgcccgagcctggtgatggtgtgctgtcctctgaggttagttttacagtaacagtcaaagtgctattttctgaagtctcttaggttagttcttctttcagagtggtgatgtcatcgtcacagctctgcatatttgctgtttgtatttcattttgtgttcatgtgcgccctgttttgttttcacggtttctttttctttttctttttcttttctttttttttttttttcgagacagagtctcactctgtcgccaagtctggagtacagtggtgcgacctcggctcactgcaacctccacctcctgtgttcgagcagtccttccacctcggcctcccgagtagctgataactagaagtgcgccaccacgtctggctaagtaatggtttgttttttgagtatgagaaacctgaccatggttctaagagagacatacgaaaagatgtatgtggaagtgtcatgttccctcagctctgccagccctctccccttcccgctttctttgcattctctgtacatatgctggttgggggttgaattgtgtctccccacgaaagatgttgaagtcccagctctcagtacctgtgaatgtgaccatatttggaaatagggtctttgcaggtgatcaagttaagatgagttcacttgggtgggccctaatccagtatgactgtgtccttataaaatggggacatttgaacagacagacatgtgtagagggagaagggcagacgtcctgaagggaagacacagggagaagatgaccacccacaagccaagcaacgccagaggctgcagaggctggaagaggcgcaaacagaccctccctcccagcctcaggaggaaccagccctagtggcaccttgatcttggacttcttgcttccaggactgtgagagaataagtgtctgttactgtaagctaccgggtttgtgccacggggagtttaatacacacctcctgtaggtaaccaagctgtggggtttgaaggccgggtacagtggctcatacctgtcatcctagtgctttaagaggccaaagtgggagggttacttgagtccaggagttcaagaccaggctgggcaacaaagagaaaccttgtctctatttttattcttttttaaaaagaggccaggtatggtggctcacgtctgtaatcccagcactttgggaggccaaggtgggcagatcacttgaggtcaggagttggagaccagcctggccaacatggtgaaaccatgtctcttttaaaaataaaagccaggcatggtggtgcgtgcctgtaatcccagctactagggaggctgaggcaggacaatcgcctgaacccaggaggcagaggttgcagtgagctgagatcatgcccctgcactccagcctggatgacagagcgagactctgtctcaaaaaaaaaagagaaagatacgttcgcgtcctcatccctggtacttgtgagtgtgagcttatttgggtcatttcagatgtatcaggttgtgatgaggtcacactgcatgggggtggggcctaactccagtattcctggtatccgtataagaagagggaaatctggacacagccaggactcacatagagaagagcttgccatgtgacaagagacagagcctggagggtctgcaaagcatgaaacaccaaggatgccggctactgccagaagctggggagaggtgcgggatggactctccctcggcacctccagtgggaagcacccctgcccagaacctgggacctttttttttttttttgagacagagtctcgctgtctcacccagcctgaagtgcagaagtgcggtagtgtgatcttggctcactacagcctcaacatcctgggctcaagtgatcttcccacctcagcctcacaagtagctgggactacaggtgcacaccactacacctgcctagtttttgtgttttttgcagagatggagtctcactttcttgcccaggctggtcttaaacccctgggctcaagcgattctcctgccttggcctcccaaagtgctgggattacaggtgtgaggttgtgtgcctggctcagaactgtggacctttttgaaactgcctagtttgtggtgctgtgtttcagtagtcctaggaaacaaaatacacagtcacatcagtttctggtttatcctttttgtgtttcttttacacaaatggtgagaaacactgatatgctctgtgggcaggtgttggcacttggacacttccctcctgtgcccccagggctggctgtgctttggaaggaggcacagagacttcagcaccctggtttgatgtagactgttcgcgaactcctctaatgccaaataccatttaattccagaagaaatgtcccgggattttttttttttttttaactgtacgaataaagtgaacaatgcaattacatgggcccaaataactggatgtttacatggtttggaatttgaatactttctgaattgtggtagatgtttttaaggtatctgcatagagataaagacaggctagggttggccgggcatggtggctcacgcctgtaatcccagcactttgggaggcctaggtgggtggatcacctgaggtcaatagttcgagagcagcctgaccaataaggtgaaacctcgtctctactaaaaatacaaaaattaggcatggtggctggtgcctgtagtcccagctactttggaggctgagacaggagaatcgcttgaacccggaagatggaggttgcagtgagccgagatcactgcactccagcctgggcgacagagcgagactccatctcaaaaaaaaacaaaaacaaaaggccaggtttgtgctgtttgtaagtccaggaataagcctaaagaataggcaagttttggctgggcacggtggctcatgcctgtaatcctagcactttgggaggctgaggtgggcagatcgcctgaggtcaagagttcgagaccagcctggccaacatggtgaaaccctgtctctactaaaactacaaaaattagctgggtgtggtggcaggcgcctgtaaacccagctactcgggaggctgaggcaggagaatcgcttgaacccgggaggtggaggttgcaatgagccgagattgcaccattgcactgcagcctgggcaacaagagtgagacttcatctcaaaaaaaaaaaaaaaaaaaaggcaagtttttgtaccttttaggagtatgaaagttgatatgttaatttttttttttttttgagacagaatgttgctctgtcacccagcctgtagtgcagcggcacgatctcggctcactgcaacctccacttcccaagttcaagccattcccctgcctcagtctcccgagtagctgggattacaggtgcctgccaccatgcccggctaacttttgtatttttagtacagatggggtttctccatgttggccaggctggtctcgaactcctgacctcatgtgatccgcctacctcagcctcccaaagtgctgggtttacgggcgtgagccaccgcacccctggctgatatgctgatttttaaaaccttgattcctggatattctgttgtctttcctttctacttgttacaaatttgtgaagaacaggagaggctcccagttagatgcggttcatttaggcttagactttgacacggcgtggctggctggccacatatccttgacaccatcacgtattgcaaatctactgaccaaggcagggtcctggtatgtggtccctggggtcagtgggtgttggtgttgggtcggtccagtcctgtgttggagtgaaagtgtctggtttctgggcctgcgtcggtgaactgcgtgcggctggggacacattggctgctttcctccctcgctgggctctgccggcaactttctcagcccactggactgagcaggaagttacagaagacaagtctccttcttagttagaaggtagaacccatcgtcagctgtttttcagtttttaaagtacacaaattttttttaaaaaatctgttttggatgaaaaagcaatgggaaagaatcaacttttagaagatgagacagtttcagaatattaacatttaaatatttggatcccttttgggaggattttttttttgcttgactgtcaagagcaaagaagtgtggcccatcgggggcttctgcaggggctgcgagggtcgagacaggtttcagtttggtaggttgatgcgaggtgtcacccgtgaggcgaatgtgggaagtgctgtcagcaggcatctgccagctgggcatggtggctcacgcctgtcatcccagctctttgtaaggccaaggcgggaagatggtttcagcccaggagttcgagaccagtcttggcaacatagcaaaaccccatttctacaaaaaattttttaaaaaattatgggggcatggtggtctgtgcctgtggtcccagctactcgtgaggcggaggcaggagcattgcctgagtccaggaggttggggctgcagtgagctgtgatcgcagtgacagagcgagaccccctctgaaaagaaggcagcagcccaccccctccagtttcgcttctgcggttctgagaagacacagtatcttacactgatgacatctgtgagggctccttgccaaaaccacaccctgacactgtggcatttggtcctgtggatttctctttcagcaacagcccgacttagagatgtccacgctagcttctgctagacacccttgatgggacgaattaccatattgtttctcgtgtcttcctaattctcattctttctgcatatttgtcttttcaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggtagccttggctcgtgctttggtctgggagggctttttggttcactgctgtgcgtaaaggggcattttcagggtggaggcagtgattggtagagccaccgccttaggtgtgaaatcagaaggtcttggctgtagggagtgctgcgccctccatttctgtcccagcgagggacttctgccagtgtcgggtgtgtcttgccccctctggtggccacccgtgagtttgccgtccggcacctcccctgagtggtgattcatggcacatctgctaataatcatggaagcgggaggggaaactcagcattggcccagtctgcgcaggaccgaattctggagctgtcttttcattccctctgaagtataaaaaagcagtctttggagccagtcctgaagtggctccatttctggcttttaagtgggtcgacaagagtagaatctttgaagttaaaaagagaagtgaggttttcttgttattttgatttctaactaattaatttggaaaccgcttttttgaagaatatagtccaggcacagtggctcacacttgtaatcccagcactttgggaggccgaggcaggaggattgcttgaggccaagtggtcgagaccaacctgggcaagatagaccctttctctacagaaaaaaattaaaaagttagccaggcatggtagcacacaccagtggttccaggtacttgagaggctgaggcaggagaatcggttgagcccaggaagttgaggctgcagtgagcacgatcctgccactgcatagcagcctgggcaacagagccagatcctgcctctaaaaaaaaaagaaagaacatataatctggttcttagaggcagtccagttctcgtaaccatgcacattgggaaaccaggctcagcattccctcgacatagcccgaggcatgtctggcctcagcagtgggaggatttgtcctgccctgagacctcctttctgagagactttttgttttgttttgttttgagacagggtctttctctgtcacccaggccgagtgctgtagtgcaatcatggctcactgaagcctcgacctccctggctcaagtgatcctcccacctcagccccctgagtcactgggaccacaagtgtgtgccaccaccgtcagctactttgtgtattttttgtagagatggcgggatccctctgtgttgcccaggctggtcttgagctcctgggcttaagtgattctcctgccttggcctcccaaagtgctgggattacaggcatgagccatggtgcccagccagactttgtttctgtctgcttctttctttttgttcatgatcttaaatgtgtgggaggccgaggcgggccaatcatgaggtcaggagatcgaggctatcctggctaacatggtaaaaccccgtctctactaaaactacaaaaaattagccgggcgtggtggcaggcacctgtagtcccagctactcgggaggctgaggcaagagaatggcgtgaacccgggaggcagagcttgcagtgagccgagatcgtgccactgtactccagcctgggtgacagagcgagactccgtctcaaaaaaaaaaaaaaaaaaaagtttaaaactcataaacttaagctttctttggaatgtgacgtagcgtattcttgcacaaaaatagaagttaaactttgttggttgtgtctgtgtttcattactaggttccacttccaaacatgagttccaggccgagacaaagaagcttttggacattgttgcccggtccctgtactcagaaaaagaggtgcgttccctgctaaccatgcccgatgctagcaaagtttcttttcacaaagctggtttttatgccattctggagaattgccagataatatattcgctgtgagaaagcattaaactttggacaggtcctcatcttaagctaccagtgagaggagttttaccagaatctattttggtttcctggataagtgtatccagatggttctttgggctggatcaactctgggaattaattgaattttgccaataattttaaaagttcccgaaatacaggcctggtgtggtggctcatgcctgggaactcagtgctttgggaggtcgaggcaggaggatcacttgagcccaggagtttgagaccagcctggtcaacacagcaagactccgtctctacaaaaaatttaaaaaattagccagctatgggggcactgacctgtggtcccagctactcaggaggctggggtgggaggatgacttgagcctggcagactttggggctgcagtgagccatgattgtgttactacactgacctgcacaacagagtaagaccctctctccaaaaaaaaagtcccccaaatcctagcgtgcagctctgctgaattccgtctctgtggagctttggatacgctctgaggcccctttgcctggtgggactacctgcaggtcttggcggctttggctgccggaggaagaaggttccccagtcctgtgtgtatggagcagggaggagttactgaggaaattaaaacgcatttggggccaggtgcggtgacccacacctgtaatcccggcactttaggaggccaaggtaggaggattgtgtgagtccaggagtctgagaccagcctaggcaacgtgaagagaccccatctctattaaaaaaaaccccgcaaaactcatttggggtgacaggacaaggaaaaagaaagatgaaggccaccatcgttgacatgctgattattgctggaaggcaaaggagagtcctgaagaaagtttgtaaagcagcagatttcaaagctcagagggccttctaggagctgtttccgggtttcgtactgatgagtgctgcattcctgactcccagtgacctccagcttccgcccagatcagccaccgcttcctcttcacctatgtgctcttgcggacttaatttttctatttttaattgtgtgggtttttgttttttttttttttggttttttaattttttggaacagggtctgggtctgacgcccaggctggagtgcagtggtatgatctcggctcgctgcaacctccgcctcctgagctcaagccatccttcctcctcagcctctggctgatatttgtatttttttgtagagacggagttttgccgtgttgcccaggctggtcttgaactcctgggctgaggtgatctgcctgtttcagcctcccaaagtgctgagatcacaggtgtgagccaccacacccggcctctctcactgattttaaatggaaggtctgtttgaggtcagtgtgcttttcagctcctgagggacagctgggccctgaggcctgtttttctccgggtgtggtagacctggtgtttggtggtccccactagatgagatgaagctagggaacctgtttttgtggagtaggagtgtattagtccattttcacgttgctgataaagacatacctgagactgggcaatttaccaaagaaggagctttaattggacttacacctccatgtggctggggaagtctcacagtcatggtggaaggcaaggaggaacaagtcccgtcttacatggatgacagcaggcaaagagagaatgagcaagacacaaaagcagaaaccccaaaaaactgtcagatctcatgagacttactcactaccacgagaacagtactggggaaacggcccccatgattcacttatctcccaccaggtccttcccacaacacgtgggaattatgggagtacaattcaaggtgagattttcgtggggacacagccaaaccatatcaaggagaaatggatgtttgagtgatatgccgtcatccctgtgcaggagttgggaaagaaattgttcctcgcaggcctcttttgtttgtttttttgagacagagtctctctctgtcggggctggagtgcagtggtgccatctcggctcactgcaacctccgccttgtgggttgaagcgattctcctgcctcagcctcctgagtagctgggattacaggtgtgttccatcacgcccagctaattttaatatttttagtagagactgggttttgccatgttggccatgctggtcttgagctcctgacctcaagtgatccacctgcttcagcctcccaaagtgcctggattacaagcatgagcccccaaccccagccagagggctcttcttaaagttataattaacagatggacacgtaacttcaggcttgattaaaaatcctgaaaagggccaggcaccgtggctcacgtctgtaatcccaacactttgggaggcggaggcacaacgatcacttgagcctgggagatcaagaccagcctgggcaacatagcgagaccctgtgtctataaaaattttaaaacaattagctgggtgtggtgcatgcctgtgggcccagctacttaggaggctgaggtgggaggattgcttgggtccaggaggttaaagctgcaataagccgtgattgcagcctccagcctgagtgacagagtgagactctcaaagaaatcctgaaaggaaagtcagcaccttcagtcactttgtgaccggcccagaggaactgcctttgactaaagcagaaactctttatgctttgagaattgactattctcctctaccttttaacagttattggaagtgcagctgaccagatagatcctgcaggatgagtgtccttcattgtctgtgcctcccatttctattcctgtaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggtacctccctcagtgtccaggcgtgtggcaggcccggccatgcagcaaggacaggatccgccttctagtgatgtctcgggtcccagggacgtactggccgtccgtaccaccaggataactctggctataatttagtgttacagtagcactcattcattatagaaaattttggaaaagcaggtaagcagaaaagaagaaaatttgaaatcaccccatcatccagcaataactactggtaacatcttagcatatggccacacagggttttggtatatgcaggtattaacatatctaaacatatcttatttttaatgtactcttttcatatttttaactgcgttttcccctcaaaatgccgacgaagcagtgctgtggctgctgctgtagccttgtggaaattttaaggctgaaaagttaggccaaagaggatcaggtaggggccctgagagacattgcatccaaagacagctgcctcaggacctgtcatcccagggtcacggcgtcattgcgggggtgtctgtctctgtggagaggtggacagactggcctcggtgggatctgagtattcccttttagggtgctggcttgctctgaaggtcatgccacataaatgaatgcaggcacgcgtgaatgaatggacttgtgaagggatggctgttttaattaaaggaggggcttttgtgaggtgtcagctttacgcactccctcttgggtttagagaatccagactgagccccgtggtacgtgccagctgtttgtcatagcccttggtcataaggattgggtggggagtgggtttcttctctccctgcctttgctgagctggcctggctgtggaatgggccctgtgggcagggctgcagcgccctgtgctttcctcctgttttcagcacagaggttccttgcagatgattgaaaatggatgtgctggggcaaggggtcatggggacatgattcttggtctttagcagaggggccagtcctcatgtgccagtacttcctggtactaagaccatttatgttacaataatgatttttggttttgtcttttgtcttcttttttcttaaagaacagttctagatttacagaaaatttgagcaggtaatttagagctccattatatcctttgggacccagtttttctattctcaatagccgatgggagcgtcatggtccatttgtttcatcttttttccttttttttggagacagagtgtggctgtgtcgcccaggctggagtgcagtagtgtgatctcagctcactgcagcctccgcctcccaggtccaagcaactctcgtgcctcagcttcctgagtagctgggattacggatgtgtgccatgatgcccaactaatttttgtatttttagtagagatggggtttcaccacgttggccaggctgggcttgaactcctgccctcaagtgatctgcccgccttggcctcccaagtgttagattacaggcatgagccaccatacccagcccatttattacaattaattaactaatattgatagattattcttacctaaagttttagaaaaggaagctttcttgtggggtctcagaggtattatgccattccatctcatctactgatatctcagctacattgctttttgttatttttaggggattttctagggaataaaatatgcagccttaatttatcactgtctagcttgaattgatatttaacacttcattgtaagaatcttacaacagtatcattccggtggcaaaatcatctttttcttttgatgtcaaatattttatgtatatacctgttgtaaaccctcacaaattcctttttatttttgtttgagacagagtctcattttattgcctaggctggagtgcagtggtatgatctcacctcactgcagtgaggcctctgccccccggatttaagtgattctcctgcctcagccccccaagtagctgggtttacaggcacatgccaccacacccggctaatttttgtatttttagtagagatggggtttcaccatgttggtcaggctggtctcaaactcctgacctcaagtgatctgactgccttggcctcccaaagtgctgggattacaggcgggagccaccgcgcctagtctcaccatttccttttaaaatcacattgtgcgggtcgcctggcaacagatgatttctgtctacatctgaaaaatctatagtttttttttttttttagtaaatattttagaacagatttcaattttcagaaaaattttaaagatagtacagcgttgccatctactccaacacccagcttcccttatgattgaaaccttatggccgggtgcagtggctcacgcttgtaatcccagcactttgagaggccaaggtgggcggatcacctgaggtcaggagttcaagaccagcctggccagcacggtgaaaccccatctctaataaaaatacaaaaattagccagatgtggtggtgtgcacctgtaatcccagctgctcaggaggctgaggcaggagaattgcttgaacccgggaggcggaggttgtggtgagctgagatcgcgccattgcactctagcttgggcaacaagagtgaaactcgtctcaaaaaaaaaaaaaaagaaatgttagtatattacattggttacagttaatcaaccggtatggatatattattcttaacacaagtctattcaggtttccttagtttttacctcatgtcctttttctctcccagcatcccacatgacatttagttgtcctggccccttagctcctcttggctgtgacagtttctcagactttccttgtttttgatgaccgggaagatttttttttttgaaatggggttttgctcttgttgcccacgctggagtgcagtggtgtgatttcagctcactgcaacctccgcctcccgggttcaagcaattctcttgccttcagtctctcgagtagctgggattacaggtatgtgccaccatgcctggctaattttgtatttttaatagagacagagtttctccatgtcggtcaggctgatcttaaactcccggcctcgtgtgatctgcctgcctcggcctcccaaagtgctgggattataggcatgagctaccgcacccagcctgacctggaaggtttttatgtttgtttagagtcaggatcttcttccgtctccaggttggggtgcattggtgctatcagggttcgctgcagccttgacctcctgggctcaagtgatctaccacatcagccccctgtagctagggccacaggcacatgccaccatgcctggctaactttaaaaaaattattttttttgccaggcatggtggctcacgcctgtaatcctagcactttgggaggccgtggcgggcagattgtctgagctcaggagttcaagaccagcctgggcaacgtggtgaaaccctgtctctgctgaaaatacaaaagaaattagctgggtgtggcagcgtgtgccggtagtcccagctactcgggaggctgaggcaggagaattgcttgaactcgggaggcggaaggtgcagtgagcggagatcacaccactgcactccagcactctagcctgcgtgacagagcgagaaatttttttttttttttttttgtagaggcagggtcttgctttgtggcccaggctggtgtcaaactcctgggctcaagcaattttcccaccttgaccttccaaagtgctgggattacagatgtgagctgttgtgtccagccctatgttttcttctagaggttttatagctttagctcttatatttagatctatgatccatttcaagttaatttttgtgtatggtgtgaggtagggcttgaggtttatgttttgtttatgggtgtacagttgtttcagtactatctgttaatagacctatcatcccccattgaattaccttggaatctttgtcaaaaatcaagtaatacactctctgtgcatctctgttcctgtgctctgtttggttctttcatccatgtgtcgatccttaaatgcccacatcgcactgtcttaattattgtagctttataggaagtcttaaaattaggtattttaaattctccaacttcgttcttcaaaatattttgaaaattttctaagttctttgtatttccatatacattttagaatcggcttgtcattttctacaaaacctgtgaggatttagactgggattgcagtgcagatcagtttgggaaaaaataaaaataaattgaaaataggagctattagttgcattttttcctttaccttggtctaacattaacctttcccttaaggactctatttaagtttctgatgtattaaacacttaaatgaaacttatatttaatgactgatatcaactagatactaattttaagtagttttttattcataattattacatgatctacaataaatgaatcaggctggattttggactattcaaaccggcacctcagaaataattgcccagaagcctcttggtgccatgtttcttgttggctgctggggcccgtgaaacatgcacacatgtgtgcactgcagtaactggtggtgatgtggttttggcacccattctgcctgtgctgcctacaatgggaaggctgacagctggccagtctccctggcctgctgcttgctgtggattatttgctgagtggcactgaccacccttgctttgccaatggagacagcactggcgcctggtgctagtgggctcccatggctcctgcaggctgtcctggagaggaagtctttagaaaggaacttcctagaaggaagttcagaaaactgtttctgagggcctttgtcccaattcatagatgtggaggcttggagtgagctcttttatttaaggtggtctgcacatcatagcagagcaagctggggctgtggctacattatgggcatgttgagcgaggatctgcagatgggagtctgactgggctttgaggaaggaggagcccatggtcagtaaggccttgtgtgttcaccagcgcgttggtctgtattgtgattcaggctgctatagccgaataccttagactgggcaatttataaacaacagaaccctattgcttacagttctagaggctgggaggtccaagagcaaggggccagcagattgggcatctggcgagggccctttgactcaggcagtgcctcttgcatcttcatacagaaggtggaaggggcaggcaagctccctcaagcctgttttctaagggccctactcccattcatgagagtggagccgtcgtgacttgatcacctccccaaggcccccctcccagtgccatccccttgggacttaggtcttaatatatggatttgggtgacactggcactcagagcagagcagctgcaacaggataggccagatagaggctccaacgcaagggctctgccttcccgcaggagaggcgtctgtgcccgctgttcccatggtggtagggtgggagtaggtgccgcgtgcagagctgcgttcccaacacctgcttcctggtgtcctcagtcagatcattctgctggattgagagagccaccagaggggatcactgttccccagaaccacagccagggagaaggcgtgggggccacatcttgatggtgggagagctgtgcttttcctaattgctggtgtaatattttcttttcggaatggtttttaacaaacaaagcaactttctgctgtcccttcctgttttctctggtgaggccaagctgctatgactagaattagtcttttcgttttttctttttttttttttgagatggagtctcactctgtcacccaggctggagtgcagtggcgcaatctcagttcactgcagtctctgcctcctgggttcactgggctcaagcaattttcctgcctcagcctccgagtagctggaaccacaggtgctcgccatcatgcctggctaatttcttttttagtagagatggggttttaccatgttggccaggctggtcttgaactcctggcctcaagtgatccgcctgccttggcctcccatagtgctgggattacaggcatgaaccatcactcccggcccctagaattagtcttttctgatgagcatctggtgctacctggctgggccctgtctggccaatgtcattgacaccacttgagtccctgggactgctggtgcactcacccggctccccaggtgctgggggcttggcacttagtgcgtctctctcctcaggatactggtatcgggatgacacaggaagagctggtgtccaacctggggacgattgccagatcggggtcaaaggtaagcgtggggcccccacacagcctcccccttcccctcagggtgcaaggatccctccagtaggggtggccctgggtgccagattaagtaagaacgttgtcagttgcatgccacgcagtgggtactgtgggaacacctcatgacatgacagccatccctcagtatctgggggttggtccctcagtatctaggggttggtttcaggaccccccttggatagcaaagtctgcagatgctccagtcccggattaaattggtgccgtatattgtagacacatcttcttgtatgctttagatggtctctaggttagttataatacctgatagaatgtaaatgctagatatagatataacatagttatgttttttatactactttttatcattgtgttgttttttattttttttctgagtattttcgatccttggctggttgaatctgcaaatgtggaacccgtagataggaggaccaactgtattggctcactgcaacctctgcctcccggttcaagcaactctcctgcctcagcctcccaagtagctgggattacaggcacgagccaccacgcctggccaattttttgtatctttagtagagacggggtttcaccatgttggccgggctatcctccagcctcagcctcctgaggcgtgactacaggtgcacgtcactatgcccagacccacagagcagttctgaccagaaccatcaaacccacagacgccgcatcccaagcccgttctcatcacggcgctgtgtgagaggggactgatccctctgaccctctctgcgtcaagcccacaaggctcagggaatcgactttgcagaaaagtgctgtgaggcagagcaacacatttggactcagaccaacagcctgggaacctccagcggtcgcccttttccagctctgggcaaagcacttacttcagtctcctcatctgtaagatgaaaacactaggtcgggtgcggtggctcacgcctgtaaccccagtactttgggaggccgaggcgggtggatcacgaggtcaggagatggagaccatcctggctaacacggtgaaaccccgtctctactaaaaatacaaaaattagctgggcgtggtggtggtacctgtcatcccagctactcgggagactgaggcgggagaatcacttgaacccgggaggcagaggttgcagtgagctgagatcacgccaccgcactccagcctgcgcgacagagcgacactccatctcaaaaacaacaacaacaacaacaacaaacaaaaaacccaccctaactgtgacttgacccccacgttacgtcttttgttgtatttctctcgaggttggtctgctgtcctgtgtagcggccaccagctgcatgtggcagtttaaatgtaaatgcattcaaattaaataaaaggggacattgtgctcctcagctgcacaggccacattgcaggtgctcggcaggctgtcgcattgcacctggcagaacgttcctgttgttggagaaagttccatcggacaacgtgggccagggcagtgggcgtgtgtattttacttgactttggccttaggacctttggcagtattatagtagaaaaatgaagtgctgtgcggtgcttacagacgcatgcgcgtgatttctactctttttcccacaaagtgtagagtccaggagacttgaatatggaagccagtttggagcctctcctcactcctggccttcctatggaaggagcttattcaagggaaagagcttattcaagctgctctttccccacccccaggtgtgacccacaggcctccacctgtctgggacaggcaggactgtgagctttgggaatcaaatggaaaacacacttgtcccactgctgccagctggttgtcctagggctaatgtgtcacctctctgtgacttagctcttcacgtgtagaatggggtggaaaagtactcggtgtggctgttttcaggatgaaggggtcttagcggtgctcgcagaagagccacggtgttgggagtgtctgctctctggaggggaggctgcctcactaactggcctctgccccacaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatgggtgagtgacgaatgtcgcctgacaggcagctcaaagctgagctggagcccttagcatggagtttggaaagggatggactcagaaaacgtacacaggcattttctgggctttttatatgaaatctgactctcccattttggggagttagtgacttttgtggctccaggtggcctatggcacctgtctggtcccatgtggttggtcaccaccactgcgctcgggaaggcaggtccggcccgcgctgagctcctttctcagtggctgagctgcaggactggcctgtcgcctggtggacactatgcagcctcctgtgaccgaccttctgcaagagctcattctgcttcctcccagccctggcatttcctggctttgtctccccagcccacttctgcctctatagggtgaggagcctgctgggggctttttttttttttttttcctttgggacggagttttactcttgttgcctaggctggagtgcaatggcacaatcttggctcactgccacctccgcctcccaggttcaagcaattggcctgcctcagcctcctgagtagctgggactacaggcgcatgccaccacgcccagctaattttgtatttttagtagagacagggtttctccatgttggtcagactggtctcgaaccccgacctcaggtgatctgcccgtcttggcctcccaaagtgctgggattatagacgtgagccaccacgcctggctccgagggctttttagcaggtgagccgcttccagccagccgaggcgtcctccctccgtgatgccatttctgctccacagtgtgtgcactgtgctcagcttgactccccactctcccaaaactaacattcctgtttaattccatgggagcggggctcagagtaaacttaggccaaggcatcaacatggccctgccgggggattcccccctcctgtgcttcggagatggttttctgctcttcttagggggcgcctgtccccctggcctttgtttttgcccctgggcatctggcacccgatttggagctgggccagtcccccaccgtgccccagacctgcttttggggtaagcccagaagcttcttcgaagcccagggtcggtggaggacccccgcccccccgccccccgcccgagggaaccaggagaactctgccgcctgcgacaggctcatcgttcctgatgggcatgtgatggcctgagtggtgcgctggggtcagaaatggggcatttgaggtgtgttgtgtgttgtttgggctctgcctatgaaaccctcgggaaccgctggagtcccatgcagggtatgtcccagtgtcacatccacctggcttttcctttccttgcctgccttagttctggagtgtttgaaatcgccgaagcttcgggagttagaaccgggacaaaaatcatcatccacctgaaatccgactgcaaggagttttccagcgaggcccgggtgcgaggtgagcgggagcccgggcccaggctcactctgggatccatgtgtggcctggaggccaccaggtcagcaggcattttccctggttctacctgcacgtagggtgcacaggcagagccgtgaagggccgagccgctgcgggactgggaggggggctgcccgccagggctgcgtagcatcgagctcctgctgggactgggaggaagctggcctggctgaggcggacctcctcctccttcctctgcgtggcccttggcctttagtgcacctgggggtttggcgcagtcctgtcccaggatgtgggcgtggccttccctctttgtgtcctgctggacactcagggaggccctgagtacccccaggagtcagcccagaaagccatgttccagccacaagctgacattgcagtctcgcagcagccggggcctccacagctctggttctcacgtgggctccgctgctgcccccgtgagactggggggaggacaggtgtccccactgtgccctgtttctgtacctgtgaagtgtacacagcatggaggacccttcccagcaggctggcgctcatcctggagctgctgcaaagcttgcgtttccacaagcattgtagatgcagtgtggtttttcttttgtcccttccagatgtggtaacgaagtacagcaacttcgtcagcttccccttgtacttgaatggaaggcggatgaacaccttgcaggtgagccctgagttcctctagggactggtcaaacatggagacaaatctgtacgtttcagggcagcggagaagagatgagcccaggggatgcggcccagagtcacagggcgagctgctctgtggagatgagacctgggtgtggggatgagacaggggcccagctctaccacagccctgcccctgtgcaccgggcagccggggtcaggggtcagggttcactgaggcgtaacgcccatcccagctggctcaccacatcagtgtgcagccatggtgttcagtgcagccacagagctgtgcagccaccccgcatcaattccagaacatcccatcaccccaaaaagcagccctttccccactgcccctcccccagtcccagcagccacggtctcctttctgtccattgtgctgcctgttccagacgtttctcctggatggagtcacacggcatgctgtcctcagtgactgacttccccctcgcggctcagctgcggtgcagcgtgggtcgtcatcgctctcacggcccacactgtattcgtcagctcgcccctgctgggcagcgtcatcctctcccacaggccccctcaggtcccggctggtcctcctgacatgttgtcctgaggagctcctgccccagagccttgtgtgtctcccctgcactacccggcatagcccagcggtggggctggagaggggtctacgcctgagaccaccgcccgtctgtcccaggagcctgtccagggccaggcgctgcactggctcaggcctgcacggtggtggagaagacgtgcgtggtgaacacgacgccctccccgccgatctccgtttccaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatggtgaggcactgtggcagtcccacggccctcagggtgactctgttgtcccctgtggcatcagctctgcagatgtcacatgattaacatggcagtgtgagggcatgaaaaacataggtagtgctgggtgtggtggctcacgcctgttatcccagcactttgggaggctgaggagggtggatcacctgagcccaggagttgcagaccaggctggccaacatagtgagaccccatctctgaaaaaaaagaaaaaaagaacagatgcctctgggtgggtaaccacagaggtttcctctgtctcaggggtcacacatggcgagggaaggattgatgggcatctcagtgcaggctggggtggaggcttgtggactggggtgtgcctggggagggccctcagagcctacatcatctgctgtggatcagtggatgctgtcctgccaggcgctctgggaagggcctgtggtctgcctctccgttggcctctctgtgtgcttcctccacaccctccaactcccctggtttcctttaccacattgaagttcccgcaaatcctgccgtaaggagacctattcggggctgagagccagcccgtcctgcccccaggctcttctgtccttggctgcctggaaactctcctaatgtcctgcacagctggcatccatcttggaaagagccagccaggtgtggcctccaggggcttgttagagtctcaggccccacccagggctcctgcgtgggagcccacattttaatatctccccgcattttaaccggatcccccccattttaaccaggtcgccccacattttaaccaggtctcccaacatttgaactagatacccgccgcattttaaccagatcccgtgatgaggtgtgggtcccggttcgggaagtaccagtgtggagcaggtgttggcaggcacgttccacgagggccagacaggagctggtcccagcgtttcgggcccggtgtctttcgtagccactaaccctgccgggtgaggaagcagcactgccctgctgccctctgagcacacagggccgggtcccatgagctgcgtagacactgaaatttgagtttcatcttcacttctcatgagatcatcctttttgaaatctttcctcaactgtttgaaagtgtaaaaaccactcttaggctacacagaggtaggcagtgagctggatctggtcggagggctctttgctgatccctgacctgtagcaaggtttggctgtgttcagtgtgttcaggggtacgtgcaaggttcactctcttgtgtcctccttaggggctgggctggggagggcggcagctgccagagaaggccttcagcccctgcagagccacagtgtggggcatcgtggggcccctgcactgggcttcaactcagagcagacgctgggggagggcgaggcgggagtgggctctggattcatcgtgtccgcccccacctcccagccagggcctgcctggggagggtcagtgctgcatgatggcgtgttctcctcacccccagaaaccgtccatgtttgatgtgagccgggagctgggctccagcgttgcactgtacagccgcaaagtcctcatccagaccaaggccacggacatcctgcccaagtggctgcgcttcatccgaggtacgctgctcagagtccgtgagcagtgcccccgtggcccagtgtcgcccgctgcatctgtgagggaccgtgctgattccattctcagcagccctctgcagcgagagcaccgccgtcggcctgcgctgcctgtgtgtcagtcgcgtttacagaccccgggagctgccccacctccctacgcacatgactgatctggggggagcactggggtgttcagattgaggtctttccatatgtagggatactgagtttcagattgatatgtgagttgtgttacgtttgagtgagattatagtttaagaaagacttcagtatttaagccttggtacacagaggtgcgaaccatccctgatagagttttgtttgtttgttttttgagacgagtcttgctctgtcacccaggctggagtgcggtggtgcaatcgtggctcactgcaacctccttaagtgattctcctgccttagcctcccgagtagctgggattacaggcgcccgccaccacacccggctaatttttgtatttttagtagagatggggtttcaccataattgccgggctggtctcgaactcctgacctcatgatccgcccacctcggcctcccaaagcgctgggattacaggcgtcagacactgtgcccagccagagttgtgatttttaacataaagcccaggctgtcattttccgagtgttaccccgaggctgtcccggccacccacagcccaggtcactgttctgggaggtggcaggacgtagaggaagctccggcagtgccgcctccctgcttccctcttagcacacgtgctgggttgaaggccaggcctgaagacaaagggcaggttaatggggaatgttgggtggtgtggagggccgcagccccgggagaagctgactgccgtgtctcccaggtgtggtggacagtgaggacattcccctgaacctcagccgggagctgctgcaggagagcgcactcatcaggtgagcctcgggccgcggggagaggaccctgctggggacaaggcccctacctgctcctttgcccccagagggccctagccgtggcccatggagctgagagcagaggtggtcggggaagcccggcctgcacatgggggccctcaggagccttccaggtgctggcctggcctctgaagcttgtggtccagaagaaggtgggggtggctggtcatggctgaggctggagtctggatagggggaggggccgcagagccagacctgcccacctgtgccccagggttgtgactgcagccctgcagcaggccagccctgtgtggaggggactccagtgtgctggctccaggttctccatcagtagctatcacttccccactctggccccaggctcaccaaatagtctttattcaaaacctcgcttactggctttttttcccctaatgcaagtagtatttccttactagagcacattcaagtgacctgtgctctcacctagagatgactgctgttgatggtttagggtggggtagattggcagccacatagggcaggtttcagagggagcctgtggggtgaggattcagctggaatttggagccctggaggtctctcaagagcccaccacgtgcagcatgccatggaacgggccttgttggagcccccaacgtgcctgcagtgtttctctgcccaccggtttctctccagtgttgaaatggaagcagatcctcggaaaaaggatgagtctgggtaattggtgtgtgttggggctgcgctgtgggcatggcgagaggcccacaccgagaggcactggtcctcagagattctgtcctgtgccgcgggcaggagcaggtctggggagatggtgggcagtgtggtttcctgcctggtgggtccatgcccagccctgcgaggtcacatggcctgccggtgatatcctcctgcctcaccttcagaggcagaaagccatggagatttttttcttttttcaaccaagcaagccgcagtgatgttttattggttgactgatagggtctttcttgttgtccaggttggaatgcagtggtgtgatcacagctcactgcagcctcaacctcttgggctcaagcaatccttccacctcagcctcccaagtagctgggactacaagtgtgagctaccatgcctggctaatttttttgtatttttttgtagagttgggatctcactatgttgcccaggctgatcttgaactcctgggctcaagcgatcctttggcctcagcctcccaaagtgctgggattccaggcatgagccactgcacctggccacttagatttttttttttttttttttttttttttttgagacggagtcttgctctgtcgcccaggctggagtgcagtggcgcagtctcggctcactgcaaccttcgcctcctaggttcacgccattctcctgtctcagcctcccgtctcagctgggactacaggtgcctgccaccatgcccggctgattttttatatctttagtagagacagggtttcaccgtgttagccaggatggtctcgatctcctgacttcgtgatccgcctgccttggcctcccaaagtgctgggattacgggtttgagccactgcgcccggcctgtttttgtttttcatgcaattgaattcatattgcttatactgtttccttttttctacctagtttatttgcaccacttcccatgttgttttttggaagcacttttaattgctacatcatgggacatcacagggatgtaccatagtttactgatcccgtccctcggggctgcacagctgggctgtctcagtgtttctgcagttatgacactgcagtgcatgtttatctttgttctgaaatcttttttttttttttttttttttttttttgagacggagtcttggtctgttgcccaggctggagtgcagtggcacgatctcggctcactgcaagctccgcctcccgggttcatgccattctcctgtctcagcctcccgagtagctgggatacaggcacccaccaccacgcccagctaattttttgtatatttagtagagacagggtttcactgtgttagccgggatggtcttgatctcctgaccttgtgatctgcctgcctcggcctcccaaagttctgggattacaggtgtgagccaccgcgcctggcctgttctgaaatctttacctgcagctgtatttccttaggatagaatactaggggtggggttacttggtcggaagatataactatataaaaggtattttccttgctgactaaagagatgttatataatcaatgaaaagggggcctcagtgcttgtttccccacacagccgtgctggcttctgacagcaggaccccgacttgctgccgacatgaccacagggcagcagttgtgctgacctcaacaggatgcatccccgccccacagcagcgactgttctgtggtcgttagagtcgtgctctttggtgtactgaccctgtgcacttcgagtgcgcctgtgggttactggtgatctgcccaatgtttcagttcacttcagtgaagagagggcttggggctgactcccggattattattgctggtgctggagttgtccccaccttgtccatccccatcaccctgcccaggagtggccacaggaggggaggttccaggtacaatgtccctgggctggataaggcaaaggacacccactgaactgaggacacgtctggcctcatctgggaagctcacggatgaagtggaggcaggggccaggccctgtggagagggagctcctggcgtccctgcgggccgaggcggctgcgttcctctccccatcctgaatgtgtttcctgagtatttcttctccactgagaactgtgctgagcctgcataaacacgtgtttcatcctgtgaggggagccgtgagtcctcactcatagttgtggaaactgagtcacagaggggtggtcctgctcagtaagggagctgcattcctggctgtggcaggcatgctggcccactggtagtgcccgaagctgcagagcaggggtcctcatcccagcttgtggttgtcaaaggttgcgttgtcagtctgagaactcatctcgatcagaaaagagtcagccgaaattagagcttttgaaagaatcacaggcttaaaagttggaagcatggtaccaagaacatgtttttcctcgaatcctgtgagaggaagttgccttctcgatgcctttggggtgcatttccaacaaacaaggatgtccttccctttgtaattaacagatgttataggtattttgaagctatgtaaatgtcacattcttcatgaaactctcaatacattcatttatttacttaaaatatttatgtgttggccgggcgcggtggctcacgcctgtaatcccagcactttgggaggccgaggcaggcagatcacctgaggtcaggagttcgagaccagcctagccaacatggtaaaaccccgtctctacttaaaaaatagaaaaattaggctgggcgcaatggctcactcctgtaatcccagcactttgggaggccgaggcgggtggatcacgaggtcaggagttaccagcctgccaagatggtgaaaccccatctctactaaaaacacaaaattttagccagtcgtggtggcaggcaggtgtaatcccagccactcgggaggctgaggcagagaattgcttgaacctgggaggtggagattgcagtgcgccaaaatcacgccactgcactccagcctgggcgacagagcgagactcatctcaaaaaaaaaaaaaaaaaaaaaatcagccgggtatggtggcaggtgcctgtaatcccagctacttgggaggctgaggcaggagaattgcttgaacccgggaggcagaggttgcagtgagccgagatcacgccactgcactccagcctgggggacaagagcaagacttcgtcggatggaaaaaaaaaaaaaaattgatgtgttatatttatactatttataatttatttatatgggctgatttcctgttttattcaagagtttataatcttgctatcattaataaaatttttttatttttatttatttatttatttatttatttttgagatggagtcttactctgttgctcaggctggagtgcagtggcgaggtattggctcaccgaaacctctgcctcccggattcaagcgattctcctgcctcagcctttcaagtagctgggactacagtcacccaccaccatgccctggtaattttttgtatttttagtagagacgggggcttaccatgttgaccaggctggtctcaaactcctgacctctggtgatccgcccgcctcagcctcccaaagtggtgcgattacaggcaggagccaccatgccccgttgattattcttagcacggttacccatttgaccaatccccctccatgtaaccaatctaccattgccactgccctcttctgcgggtgtccctgtcacctacttgggctctgactcttcacggtgggctggtcacgcccccagcctggacacccttctctggggttcttgggctctgacacccataccaggctcttcccaaccatggccctgcatagacaccttccctgggctctgcaccgcatcctgggctactgtccccccgctcccaggcacgaaggcatgtcctgtcccattctgccctgtggctgaaggactgagtcactggggatggagtgtgggaggaaaggctctaaatgaactcgagagagtgttgttcccatgctctggattattgaaatacattgtaatttacctgcttaaaggaaagactaaatattaagaagaaaataaaaatatccctagtcccagtgataaagttgttcctaattttaggccattatgtaatgctgcagtaaatatcctgatccctaaaatcccaattttgaaaaattagagtatacatatattcagtataaatcccaaattacagtgtacatatatagtatatacagtgctgctcctaatgatggaaaattgttatgtacatgtagaatgtgcattctttgcctgtatctatagacgtactgtaatttacccacattgggatttttctgggttttctttcaacacagctaactttctcatgtcattgaggattattaaaagatgcagttttttttttttatggccatttagcattacataattttagcctatattcttgaacatgaggttgttcataattgttatattttatgtgccacagtgaaaatcctggtacataaatcttggtgtgctcacatgtttcctaaggtgcagttcctataattggaacaactggctcaaaggttggaagggttttccgggcgtgggtatcttgtctctgggggcatcggttctcctactgcctccagggggtgtctgccctccaccctgctgcctcctgtccggccactgcccagggtttctgtctttctgctcagtctttttcagtttggccaataacggtaccttgttgttttcacttctttgattcttagcggggctgaacattttttcgtaccctctggccatttgtatttcatagaggctgcttgtatgtattaaatgcatttcttttctgtaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggtataggagctgtgttccaggcctttttctgggccaccttgtccctggggctgctgaggaagctggtggaggtgtcccctgatgtggcgacggtgcagctgggtaccctggctgctgctgctgctgccaccagggtcaggaaatggaaggccaggcttctgggcctctggcaccttccaggcacatccttaccctcccaccagtgctgtgctgtgctctgaagggctcagcctcactgctgtgtgaaggtgcagcccagggagtggcaggaagagggcgtgcacacactgtctcccctcagaggatgttgggggctggggagccacagacaggtgggacaagccaaggactccgatcccgtgggtggggaagtgggtggtctcagtgtctgttgagggactattcatcatgtactggatatcagtctccaaatactatgctacaggggccagtcgttcagttaatccaatagtggatggctgaaaaacgaaacatttgttccataaacattttttgtccattttttattgagatacaacttacatagcatcagattcacagaattcaccttttaacacgtaaaattcagtggcatttagtgcattcacagtgtggtgtggctgcctccactgtaaccccagaacatttcatcccaggagcccatcccgtgctggtgtcccttctccccagcagcaggaggagggtgaccacgtgtgtggggtcccaaggaggccgtgttctggttgtttgccgacttcggcagcttctgacacaggcctcttcattctcctttatcttcatttgagttaacagcacacaggtaagagtcagagacatttctaggtctttgtaggtgtgcacgtgtgacatgtcttatcaatgcagacccaccatgtgtgcaggggtggcctgggccctgctggttgggtgtccagctccttgcttttccctctttctgttttccccctgcgtccttccagctgcagctcccatgagctctagaggtcacagctgcgttcagctgatggggaggagggcaaacccctcccctaagggcccttctccaaatcccactgaaacccactgggcaaagccagtctctgccatagccagctgtgaggagggccgggaaccgtggacttcacccgtgtccgtgtgcccaccagagactgactctgtcactgagggcagagggaagacgctgggtccaggccgggctctgctgttgggtggggtcccctcccagggcgtggtgcgcgtagctccctggagagcccctgggccacctggggcaggaggtgcttcctaagcccccagagctcccaaaaggggcctgatgggcagagcaaggcctgctctcggacaacccccgagtccactaccgtccctcgggtcagggccagcctggagtgccaggaggccatgggcatcggagggtttgcgcccagttagttgggcaacattgagcccatgggcctggaataagtggtgacctgccccgtcccttctaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggtgggtgagcggtgggtggggcgggctccgggggctgcaacctggggagggtcttgaccttctcagctctgtgctgggtgaacctgcccaagactccgggcagggctgcacagtgggtcagggtcacgggcacagaggccggaccgactgtgacggctgtttcccacttggaggtcacatgtggttttttttgtttgttttttgtttttttgagatggagtcttgctctctcgcccaggctagagtgcagtggtgcgatctcggctcactgcaacttccgcctcctgggttcaggtcattctcctgcctcagcctcctgagtagctgggactacaggtgcacaccaccacacccagcaaatttttgtatttttaatagagacggcatttcaccatgttggtctcgaactcctgacctcatgatctgcctgctttggcctcccaaagtgctgggattacaggcgtgagccactgcactcagccacatgtggatttctttatgcgtggagtgcttctgccttgaaggcagtcagagccttccttagacccaggtgtcgtagtaactgtcatgcaggcctaggaaccccaactgccccggtgttccccagtgtggcccgcttggctcccccagccctcctgccgccctcatcctttcttctgtggtggctggaggcccccggggtctgatggagctgctcttggccacctgcaggttctcttctgctttgagcagtttgatgagctcaccctgctgcaccttcgtgagtttgacaagaagaagctgatctctgtggagacggacatagtcgtggatcactacaaggaggagaagtttgaggacaggtccccaggtcggcatcccctgctctctaggcgtggggctggtttccactccccgcacgcctctcctgccccgcagcgagggcttcctttgggttttcgtcagttgacctgggctcagccacccccgagaagagccttgtgggagcaccctggtgactggaggaaggtgcctcctggtttagatatcaggggtctgtccagtgctcctgccacggtggcttctggagctggcccagcttcttgagaggctgtgtatttttttaaagccctaaccaagttgtatgggcctcaggcaacctgaagcatcctttgaggttttacttttagatgaaaagcatcttgctagcttgtgtctccatcctggtgggagaggaggtgggagctggaagcatgctgcgtggcccccatggaagccggggagttgggatgcaggcctgagctccctgtcgcctgctcttccgcagccgccgagtgcctatcagagaaggagacggaggagctcatggcctggatgagaaatgtgctggggtcgcgtgtcaccaacgtgaaggtgaggctttcccggggatggaccaccacttggccgcagtgtccctaacaggctggccagctggtggctcccagtacctggcccgttgggtgtccttccagcagcagcagaagcccttggtgtcaggtggagaccctgtgggtccctgctcggcacgtgttgctcgggagtgccgctgaggcaggaaggccgtgtctttctcccagccctgctccagagcaggtgtgaactgagaactgaaaaaccagcatcctgagtgggagctgcaatggctgaggacgtgggggttccaaacaagggacatgctaccccagccctcaggagctcacatgctcacttgggtgcttagtcgggggttttgggtgggcttcagagagctaagactccccccaccaacctgtctagctcagagtgagaaatgagcgtcccatgcatggtcacttggaggaaggggcctcatgcagggtgggctggcatggagcagaggacgatggattcgggcagctcctggaggcagcagcggggcaccagggtggtggagcccctcgggcacagtatctttgcgtggggcatcagctcagggcccacaagttagtgggtaatggggagggagcagcgctggtccaggggagtccttgagaccccgcctgctacctcgtggtctgggtgaccttcacccctggtaagatcctgccagccctctcacattgggaacctctatcaccctcaaccccgggctttgctcacaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggtgaggccacgctcctggctcttccagcctgtgggattccccagaatcctgtgtgtggtgttcttttgttgtggaatgtgacacagaagaaaagtgcgtgaggcctgtggacatgtgggtaactataaggagctgtatgcagtttaggctgcacccatgtgaaatggaacctggccagccccttaccatccccaggtgtcacctgggaggttagccacatcccagcctgtgaccatgtcctcgttttgctttatggctttgccacctgtgcgtgtcctggacatgctcagttttgcctgttttgagctttgtacgtggatcttggtgtttgctgaagtctcacgttgctcacttggcatgagggttgcccatgcagaggggctgccacaagttcattttcatagccgaataatgtccgctgcagaaacccacctcggcacagcagactgctccgttctgctctgctgggcctccggtggttcttggtcagaagttgtggagagccaggctgctctgagtattcttgtccacgtgtctggggcttgtgtgggtttctctgtggccccggtggtgggagctgcttccagggtgcaccgagaaccccccagccctgacagtggctgagccgtaagatttccctcgtttcttcctgttgttctttatatgccctttatctgttgtaaatgtcttttcacctgcctttaggtatcttttgagtttctttctttttacagtatcacttctttgcacccatgaatgtgatctatttaggtctttaacatcctttggtaccttacattctctgtagggttctggtaccatttttaaagaattattctttgatgtgtcttatggggtattttaaaatttcattttctaacttgtatatgaactaacttgtatatgaagtttcttttttgggggaaattttgaatgtagcaattttttaaaaaatgaagttacataaacatgttaccaaaaatagaaaacagcaaaaaggaaatcaaaatccatagacttaccaccccccccacaatgtagcctaagtagtattttaatttttgagacagggtctcactctgtcccccaggttggagtgcagtggggcaatctcagctcactgcaacttctacctcctggcctcaaacaatccacctgccttagcctcccgaagtgctgggattacaagtgtgggctaccacccccagccagtttttgttttgttctttagtacatgtctagtttttttcttttgtcattttacaaccataacttttaaaattatactggaggcgagggagatgcatcttcctagccatggcactcctggggaaaggctgacttggcttatggctgtcagtgcacagcagcgccagtatgcagaatgcctgtgcctctgctggagcagctcagtgaggcggacaccaggtcactttaactagttttggtgccaaactagttttgtgagatagctgcagaagtgctcgtttctgtctgttgccacttcacttttggagacagggtcttgctctgtcacctaggctggagtgtaccagtggcgccatcagagctcactgcagccttggcctcccaaagtggtgggattacaggcgagagccactgtgcccagccagcttcactttcatttgttttaaaatttggtgttctgtccacatagttcagaattcaaaactgcttacaggggaaaatttcctcctacctgtgtccccagtgcagccagcattagggcttttgtatttctgcagagattatgtgcatttgtgggcagctgcgcccgtgggcttccaagggggaacttgctgtgcagtgggtccttgccttgcttttctcccttagggtaactaggtgacctccacattagcatattaagaatgtcctttttttccagctacgtagactagaaatgtgaggatgtgcatttgaagtgtttcctctgttaggttgggtgcggtgcctcacgcctgtaatcccaacattttgggaggcctaggcgggtggatcacttgaggtcaggagttcgagacctcatctctactaaaaatacaaaaactagctgggggtggtggtgggtgcctgtaatcccagttacttgggaggctgaggcaagagaacctcttgaaaccaggaggctgcggtgagccaagatcatgccatttcactctagcttgggtgaaggagtgagagtctatctatctatctatctatctatctatctaaaaaaaaaagtgtttaaagggatgcagttaggaaatggaatggctgagtctcagcatatcatccacatgtggttttcccgactccagttgtcctctggagaggttgtacaaatttacagttccccagagccctcggttttatcagacttctaagtgaaaaattataatattcatgttaaggttaaatactacatgatgctttttcctatgcagaaaaaaatattgttctgacgtcaaatatgtcaatcattctttactttttggtttgtggttttgcttggaaaggctttccccttctgagatgatgaaacatttcttccctagaattgtgcttgtcatctttgatccctctggaatttactctggtctaaatggttttctgcatggctcccagtcatcccagtgctgctggatggagtgatctgtctcctccctcttctgtgaaatactgtcctcatcagacactcagtgtccaccctcgttacatggagttgtttgccttccccctttccagacctaaactgttttatttactagagccctataatatgtttcaacatgtgggtcttactcccttctcttttattatttatctaggaaccaaggcatgtcttcacgtactaagctccttttgtccctttagtgtatattaatcttggagtttggctaccttacagcattttctaatactgacactcctgattctcttgggttttctgggtatataatgatattatctataaatgatcattaacataccttatttaaaaaactacagacagtcttactgtgcttctttaaatatcctgataatcccaaaacatgaagggagggtcacagcacgtggtactgagctgctttttctggtgggttctgtgttgcaggcacgcgctcatcaagaagctgaatcagctgcgcgcaagcgagcctggcctggctcagctgctggtggatcaggtgagtgcagcagcttaggatgactgcagggacccaggctaccagccctgccagcctgccttcagggtggaacagcggtttcctctaaaatcctgtctttttgtttgtttgtttgttttttgagatggagtgttgctctgttgccaggctggagtgcagtggcgcgatcttggctcactacaacctctgcctcccgggttcaagcaattcccctgcctcagcctcccgagtagctgggactacaggcatgcgcctggctaattttgtattttagtagagatggggttttcaccatcttggccaggatggtctcaatctcctgacctcgtgagccaccgtgcccagccaaattctgttttaaaaacggaaaaatggccaggcgtggtggctcacgcctgtaatcccagcactttgggaggcggggggatcacctgaggttgcagtgagccgagatcgtgcctctgcactccagcctcggcaacagtgagactctgtctcaaaaaaaaaaaaatgaaaaggtgccccatgcccctcataatgggtttctcctcttgcctttcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgagtgtgtgttgggctttttttctgggtcctgtggcaggatgggtcctctcttcctgcagttcaactggtgtggggaggggctgctcacttcagcatcacctccactggatagtggtcactgatggcttgggcctgcaggcaagtgggcacagggtctgggctgagcctacctgagctcctgtgtcccatcctcatgtggctgtgcaagggaggacacataccagttggtcactcaggccataggcagcctggaagttaaagggaagagccgagtcgggaacaacggcgcctcggagcagcatccctgcaaccacgatcctgatgggtgttgggaagagaaagtaggttcccctttcacacatgggcctggctcagcacccgcaggaactaaactaagagccctgggacctgccagtgcaggtctgtgggtgcccaaaactgcacaccctggtctgtgcccctcaatgtggaaaccacatgacagcctaggtgtctgcctctcctcttatccccagatgtgcttttccgaaaaaacctaaaaatcgtggctcttgttattctgttccctgtagtggatcaactgaagctcagttgggtgagtgttcaaaggctttgaggcttctgaagcccgacctatgagtcacggctgcccttggaggtgccctcagtctgccctaagcgcgaggccctgctcacctgtcataggcacagtgcgtgggtgtagctgtggtgtcagcgctgtcggggatcagccactggaaggtggggcttgtccacaggcggatggatgaccactgggagggtctcacatagctgcagcccgcattgaagtcgcccatcaacatgacgtcctaccaggaaacgctgcctgtggccctgggacatgcggaggccgctggtgcccactgcccctgggagggcctcacctccaagccccatttctcttggacatccaggtagacgtcatagagagcgtcgatctcggctactgcgtcccccggggccgcatgcaggggaacaatggcaaactccctgacctctgtggagacagccacgtcgtgtgaggcacactccctgggggcaggttcagtcaccatgtcagctggaactatgtatcatgacagtccccccggggggtggatattttccaaatgacttgaatggaaaacccaagccccagggactgggagggcagtgtgtgacacaggcattccaggttccctaggagggggtggaggccataagcgccaagccgagccccaccctggcccaggcagcacccacctgtgaaccgggagaagaacctgacaatggctggctctcggttgaaggtgtcgttcccgcagggctcgcagccatcatcgtagtagtagctgtccaccgcagacacctggtcaggcctgcgggaaggccgggcaggaggaggtgaccccaggctggaagctgccccactcctgcttcccaggaggcaggcgtcgcgtcccaggcgacaggagggcgggggagccaggcacctgctcaacccattggtccgggacccaggcgacaggagggcgggggagccaggcacctgctcaacccattggtccgggacccaggcgacaggagggcgggggagccaggcacctgctcaacccattggtccgggacccaggcgacaggagggcgggggagccaggcacctgctcaacccattggtccgggacccaggcgacaggagggcgggggagccaggcacctgctcaacccattggtccgggaccttggggtgttttcactccaccctggaccctgctctgaagcctcaggttcttgccataggacaaactaataggacaaactacttccctgctctgttggggccctcccaggtgagggaggggcttcctggctttctagaccacccacctgtacacgaacaggtagcgctccttatagctgttccgtcccagtggctcactgaccacgtagtgataggtgtctggtgcatccctggattgaagaaacaaaaggtcccagtggcgggggccataggggacccctctggctgccgatagcgaggctgtgcccaggtccccacccttggggcccaagtgaagtgaggctgtgccgtggacgagatgtcaccttcctatgaccctgccactgtcacccactgattgaggttgtccagcagcttccccacggcagtcaggtggctgtctctgacctcctggaccagggcgatgtcatagcggctcaggatctgggggcagggccacagtggtgctgagcagggctggtgccacccagggaccctacagcgccacaaagggagccacagctgatgctcgtggcattgctcggtttaaccgcagcctcatgtttctgcctgggctcctgctgccagccagggacagcacagcagggatgaggaccttggtccacagccaagagcctgttccaccgtgctgggagcagtggtgctcagtaccccacacccgacaccctgtggctccatagggctggccctgcccaccagccctagactccagagctcctctgcttttggggggaggctgccctggcctcacctgcacaatgtagctgacgagggtggcattggacatcttggtctccccaaatgtctggatgttgaaggctgcgatcttcagggacacggccccctgcagtagggccgccagtgccagcagcgcccccagcagcttcatgcccctcatcctgggagagcacagggcacagagacataacagaagtgagacgtcatccctgccacagcactccagccttctggagcccagctggcaggggctggtggagctcaaggtcagggggacgcaggcgggggaaaccctttcctacaacgtccagaaagccaaacagctggcaccacgtagaggaccccgagtcactcctccatccaccagaaaacccgcccgggagggacgctggagcctccgcctcactcgctgctggaggatgagactctaagcctccctccctgctccaaaccggccagtcacccagaggcactccacctggtgctcacct

SEQ ID NO: 17290 - DNA, 11929 bp, Human
aggtgaggtgcgtatagtagtccctcaaaacaaatgaggaaactgaagtttggggtttagtgagattacataagttgcctgagattacatagtaaatgtcagagaaaagtggttttgaggctagagtcttctgcaattggttatgagtctagaatctatgtctcttgaaataggaatgtccaatgatcgtgccattgcacttcagcctgggcgacagagcaagaccctatctcaaaaacaaaagaacaggaatgcctaaaaccaccagaatggtcctagggagcaaacaaggctttccaaactggaccttgagtgctatggggtcgctggctctgcatctgccacgacagcctgtggatctgtcatcttccctggaataaaatttttaaaaaaggccaggcgtggtggctcacgcctgtaatcccagcacagtgggaggctaaggcgggcagatcactcgaggtgaggaatttgagaccagcctggccaacatggtgaaaccccgtctctactaaaaatacaaaaattagccgggcgtggtggtgggcgcttgtaatcccggctactcaggaggctgaggcaggagaatcgcttgaacccgggagggggaggtttcagtgagccgagactgcgccattgcactccagcctgggcaacaagagcgaaactccgtctcggaaaaaaaaaaaaaagaaaaaaactaaaatatcagtactcttttcacttagtcatcacaaacccctttaatcccatattaccctctactatcatggtagcctcacctttgacgacagactagctgtgtgacccaagtaaatgacttcagtgccaccacctgtaggaaggggctgctaatagcatctgcttcatactaacgtgttttcaggatcgatctgcatataaacgctcaatacacggtaactgattgtcacattctatcccaggacgcttccatttgcggatctcatggcccggaggacctgggccgcctcacaactgggcagccccgctcaccgacacaaagcccacaaccgcgcccaatagggaatcggccctgcggccctcctgccactcgcccccaactatcacagtccacggcggagctggaggcagatcccgcccttgcagggctgggtaagagactgaaacttggagaatgaactgcaggcgctgcacatctcgggcagatttaaaattcggtctaaaatcggaagcaggtgccgcgaacccagacccgagcgctcctctgggacgtccagccgcagaagcgagcccaaagcccagcagggttctccgcgggactcggggtttcagaaccgccgggctcttgggcgctcgcccagggcgcacgcgcagtcgcgaggccgcgccgcggactgcatctcccagcaggccccgcgcagcaggccacgcggcgccactgactgggcgggcggctagctccctggcctccccgacatgccgaggagcccctggcttccggagccgacgaggccgcaggggccaatgggaccatcttcagccagcccagagtagccgaagcgggtggggcctggcttgggaaaggattcatccggggaagctgattaacaattcagatttccgggtctcaccccgacactgacgcactggagagcgcgtggccctgggatctgcgttttcccaagcgctccggagtaattctaacccaggttgcccgccagtcacaacgacctcaggcttgttttcttcgcttggatccagctgccctgcccccagtcactcccagaatttcagggcgcgccccgtggccccgcctctcgtctccaattggtccctcgctcatccagtccccgtaggcaaatcttcccttctcattggtaggcggtgagtgtgtggagaaacctgacctaatgggcgctggagttcgcaaaacgtgacccggaaattggtcacgagcaggcgccgtgggcttgtggacgcctaacttgcgcgctgagatttccggcgtgggagcagaggtctgagtcttgcgtgggtcctctatatagggtgagaagcgtggcgctcggttcctgcctcggggaagtcctggcgcagatgggccacggggccggcgtggcggcgcctgggaccgactgaggcctaggcgccggagccggccgcgcctgggctggagcggggctcctcggcctggactgggagcccccggccccgggctcctgctggcgccgtccaaccttacatgggttcagggcgccttcgtaggcgggcacggctggtttcgggctaaggcgctctggagacctgacgatggcgtcgggcccgggctcccaggaacgggaagggctcctgatagtgaagctggaggaggactgcgcctggagccaggagctgcccccacctgacccaggaccgagccccgaggcctcccacttgcgcttcagacggttccgcttccaagaggcagctggtccccgggaagccctcagccggctccaagagctttgccatgggtggcttcggcctgagatgcgcacgaaggagcagatcttggagctgctggtgttagagcagttcctgaccatcctgccccaggagatccagagcagggtgcaggagctgcatccggagagcggcgaagaagcggtgacccttgtggaggatatgcagagagagcttgggagactgagacaacaggtgagagagagagagagctgttttatctgtggtttgtttagccctgagcactgggacattgcgcccccggtcgaattcaagtaaattgccctgagtagaccttacgtggggaagaggacttgtgatttaacctggaacactcatcctccagattttcccccaaatgaacgaaagcagtgaagagtgccctgtttccacgcggaggcggtgtccctgcaacagttagtgttagccatggagttagatcgccagcgttcaaatcctcaatctgctagtactagctttgttactttggcaagttacttgatctctttcggcctgttttcctattcgtaaaatgaggatattaacatactttctagggcttagagggagagcagcatgtaaagttgtgaacactactagcttatgagtgcttagtacttgttacctgttgttatgttagggtccacggtctggtcttctctgcaaagctgggcctccgttaattgtgaactttgaaagataatttggcaccgaggccctgaggtcattggtccccagggctaccccaatttagcctatcctatagtgaggaatagaagcacctagaaaaggtggggagagcaaaagggagtgaggtgtatcttaagagctgtgtggggaaggtgtgctctgggagtgggccctttccctaacccctccccctgcacatgggatcaaaaaagcctttagtgtaaaccatttttctgttacctgggcccaaagggatcgcctgaggttctctgttgaaggtttgctctcagtatcctatactaatttcccttcctcttgggccctgttgtgatgatgagtgatgtgggttggttcccaggtcacaaaccatgggcggggaacagaagtgcttttggaggagcctttgcctctggaaacagcacgagagtcaccgagcttcaagctggagccaatggagactgagcgaagccctggccccaggctgcaggagctgctaggccccagcccccaaagggacccccaggctgtaaaggagaggggtgaggcacagttatctgggcaggtgggagggaggaggggcttgggggttgcccccgacactagctggatgtagcaatgatgcgaaggagaaggaatttctgaagatcaggttctcacctgtggaatgaaagacctgcagttggtggtgtgggttctcctggggctgggggaagggaagggagtctcagtagagcccttttttatgcagaacagaggcgatttagaaccacttgaatgacgcagggtttggagtgctactcttggtactccttccctctcaccctgtcattttggatatcagctgattaggcctctgtgcagtttagcgtcattcccaaaagcagaggctgggtgttggggaatggatactgtgttttaataatccttgggttgccaagagttaggaatgccattctcattataatttctgtcaccttcagcattatctgctccctggctttctctttttcctcctgaagggaacatggaagacaaggagatgactgggccccaggtgatgtggaagtttccattgtctccccccagcacccttcctcccctgagtgttgggggtgggggttctccatgtggaaggtcctttgtcccttaccacagcgtctcccccactgctttgtctatttcacacctcacttggaggcctgatacccttcttcccccctgacatgtgcttggcatccctggattttgcccctttaacccatgactctgcttgaattgttcttggtgcatcaggggctaaaggagatcttgtgctgtttcagttgcctgagagcttagaggacgtggcaatgtacatctcccaggaggagtgggggcatcaggatcctagtaagagggccctctccagggacacggtgcaggagagttatgagaatgtggactcactgggtaaggacttcttttccagggatgatgactgcgccatttctgaccagggtcctgcccgttattcattcacctcctggacacagactctgagttttgccaagaagcctccacaggagacttccctttgtctaaagtcccctgtacgagagtcatgtatctgccaagtggtacagttggcacaggcagcccgggactggagtcccagctgccagagcctaaggcgagtctgagccatgtgcacttcctagggcagagcaaacccaatgcggtgacaacctgccagcatcacacacatgcagtattccaggatgctggggggctctaaatggttgattccttgcaattttcagatgcttattcttatgagctcgccagtgtttcctgtgttccgttagtgtttctaggctcgtccccaaagacaaaaatttcaggggtagtaggatcaacattccagcctatcatctctcacagcccataaaaattcagaaagtggggagggtcttgtggaaatttggaaacaatgtatagctccaaagtaggccatatcataaattaagatttacctatgtcttgtactgtactcagagttttaaaattatgcctacggaatatgacagactgacatatagttggatttaggtggaggatatgcttgtatttattgtacaattccctcaacttttctgtatgtatgagaattcttttaataaaaagttggggaagtcttaacataaaacaagactgtgtgtacattatgattatacctatgttgaaacacaccagtagaaagactcactggtgtggtggtggtagtcccagttactcaggaggctgaggggagaatcacctgagcccagtaggtcaaggctgcagtgagctatgatgatgccactgcacctcaaccaggtgacagagtgagactctgtttcaaaacaaacaagacacaccgcacattgtttccatatatcaggtttgcctaaaaagtatcacaactgtacatttgttgacactaattctgcaaacgcaatcttgctcactgcaacctctgcctcccgggttcaagtgattctcctgcctcagcctccagagtagctgggattacaggcatgcgccaccacacccggctaattttttgtatttttagtagagacaggatttctccatgtaggtcaggctcatcttgaattcccgacctcaggtgatccacccgcctcccaaagtgctggaattacaggtgtgagccaccacacccggccttttttttttttttttttttttttgaagtgagtctcactctgttgcccaggctgctctggaacttctgggctcaagcagtcttcctgccttagtcaggaagtgtgccactgtaccagtttccatattacttttcactgctgtgatgtccaaagttgaacatggcccttttagtgagagatgctaaataggaaaagatcagattacagcttgttggaattaaacttctgttggagtccatgtttgctggaggtggaggtttttgtttttctttttggcacagcatagaaatggcacttgtgggttttaatctcatggtcctcttagagccctgggtccttttctgattgtctattatgttatattttctttccctggagttgtccggtcaaatttagttctattttgtatttatatgtagagacaaggcccttttatgatattaaatggattattcaaggaactgaccatgttcattttatagttatttcaattacagtagtgtacattctcattgcaaaaaaaaacattccaagtaccatgaatatttaaaaaaaaaaaaaattggccgggcgcagtggctcacacctgtaatcccagcactttgggaggccgaggcaggcagatcacttgaagtcaggagttcgagaccagcctggccaacatggtgaaactccatctctactaaaaatacaaaaattagccgggtgtggtggtgcacgcctgtaatcccagctacttgggaggctgaggcaggagaatcgcttgaacctaggaggcagaggttgcagtgagcggagatcgtgccactgcactccagcctgggcgacagagtgagactctgtctcaaaaaaaaaaaaaaagtctccctcccctaatttctttctctagaggtatccactgggaacagtttgtgtatattccaagtaactgctgtcagatttatggagcattctgtatttatccactgagggcagggaacaagactgtttccctaccctggtagaggaaagtggcagtacagaaatctgtttctttcattgtgaacagagtctcacattcccagtcaggaggtcccaggcacccaggtgggacaaggaggaaagctatgggatcccagtgtccagagctgcaaggagggcctgagccccagaggcccagctccaggtaaggaatgaagacaagtggcctgcgcagcaagcagcaaggctcttgcagttaagagtgaggcattttttggttttgttttgttttgttttgagatggagtggcactcttgttgcccaggctggagtgcaacagtgcgatctcggctcactgcaagctccgcctcccaggttcaagcggttctcctgcctcagcctcccgagtagctgggattacaggcatgcgccaccacgcccagctaattttttgtatttttagtagagtcggggtttctccatattggtcaggctggtctccctgacctcaggtgatccacccacctcggcctcccaaagtgctgggatttacaagtgtgagccaccgcccccagcagagtaaggcatttgaggatttgggtgcagggccggcccagcacagctgctagagaggtacattacgtcctttgaccctgccattctccatcccagtgaggcaagtgaggaacccagggtgcagagttcaaggaggcccttattcttgagcttacttgtcccaccctactctcagccctgctccatcccacccattcctgaagggcagaatcgagaggctcaggtggaaaggaaaattctaagactggtctcggctctgattccttgaccagtggcccgaccctttatcctgatgcttctccagagtgctttacctttaggagaggatgggattctgaggtagaagcagcccttctgggctgctgacctaacaggcagcggcagacaggtgggattttcttttctccagcatagaaataatgtacgggtttggtttctctctctctaccaggagaagagaaatttgagaacctggaaggtgttccgtctgtatgctctgagaacatccaccctcaggtgctgcttcctgaccaggcccgaggggaggtgccctggagtcctgagctgggaagacctcatgaccggtcgcaaggggattgggcgcctcccccagagggtggaatggagcaggccttggcaggagcctcaagtggcagagaactggggcgaccgaaggaactgcagccaaagaaactccatttatgtcccttgtgtggcaaaaatttctctaacaactcaaacctaattaggcaccagagaatacatgcagctgaaagactgtgtatgggtgtggactgcactgaaatctttggtgggaacccacgtttcctgtcactacacagagcacacctgggagaggaggcccacaagtgccttgaatgtgggaaatgcttcagtcagaacacccatctgactcgccaccaacgcacccacacgggtgagaagccctatcagtgcaacatttgcggaaaatgtttctcctgcaactccaacctccacaggcaccagagaacgcacactggggagaagccctacaagtgccctgagtgtggggagatctttgctcacagttccaacctccttcggcaccagagaattcacactggagagcgaccttataagtgtcccgagtgtgggaaaagtttctctcggagttcacacctcgtcattcacgaaagaactcatgagagagagagactttaccccttctctgagtgtggggaagctgtgagtgacagcaccccctttcttacaaaccatggagcccataaggcagagaagaagctctttgaatgtttgacttgtgggaaaagcttccggcagggcatgcacctcaccagacatcagagaacacacacaggagagaaaccgtataaatgtaccctttgtggggaaaacttctctcatagatccaatttaatcaggcaccagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcacacaggttagtaacagtggggtttctctttgccccaggtgaggtggcatattcagaggagcctgttggcaagagctggtattccctgcccagccgaccaaatgacctctgcattcttcaggtaatgggggctcattgtgagggaggtgcagaggcagcagaggattggcataaaactgaaaaggagttctgtctgcatgagaaaggatggcaagtctctgaggtgacctcagggtggaattctctgttaagtccaccctgccccagggtgctcctaccctcttggtctttttaaagccaaggtgcgatttgggcacctgactgtccagtttaccttaacaagtttgggaatccatgtgatgtttttgatacttcttcctcatttgggacattcagtaggagcatttgggcttccggggcccctgagaccaaagaagaggggccaagtaccctgggaaatcagctgaaggtcaacaaaagactggttgtgagttgcagctgtcccgaaggccccagttgggaagccatgggcagtccagatcaagccaccacgtgccctacgatggcctaacaggagtgcccattggcagattacacatgtaaatatgacctcagacaaaaaggaaccagaggcccaagggcaataataaggtggaatttgcaggtcagcccaggaattggcagaggaagtaggtgtctgataaccctttgtggagaatgagattccccccacctgtgtgagaaaaataaacagctctggagtcttgttcctgactccagaggaacgagagcattccaggaaagagagattccctggaaaattgaaaatgtgaatcctagggggaaattggggattgtgtctttccctgttgaaaatgtttggatgggaataaatatcttcaggaaacataaatgtctgtgagtcttcaatgaaagcctctgtctagacccccgagtgttgatctgtctcccctctgccttggtcagaggccctgctttctcatagacttactgggttggtcaggaagatgctgacaaaggaggcagcagacaggcagaggcaggtgagggcctggcagcctccaggctgggactgccatgtggtaacaaagggtcaagccaaatggctgctggggtgatgctgtcatagggtctctagaaagtattctttccttctgtggtctatagcagtaaaaatgttttcaattctttgtttagaatgtttacattcttactcagtagctgaggaagatctgactcttagagaacaggatattttggtcttgcaactgatttccagggtggaagttaagatggtcccagtataactgagttattgattattaatggtaggaagatataggagatggcgcaattattaagggaaagcattatatttattttttggtagaggtggggtctcactatttgcccaggctggtcttgagttcccgagctcaagccttcttcccatcttggcctctcaaagtgctgggattactagcattgcattttagaatggcatatcagaaataggaattctagtagtgtgtatctgtgggaaacgggggagtattctaagagtaggaaatcggatgccaggaaaacacctcaggatacagccccggaggaaggtatccagctgttcttcgggtgaaaaagatgaagaaacagtcctttgggaacaggctgatggatatagcaacttgaagtcatggaaacagcgctccattgatccttctctcagccctgcctcagtttagtatgtgtttttctttggttgtctgagccagttttttaatatctcactatttctcatttctgtaacttcctcttaatcagcttgttcacaggaggagggcagtggtggtgtgggggttgagggcagggaagtggagggttaggattagagagatcagagtaggatcaacagtggtaggagcaggaccacactccagtggagcagtgcagggccagccaggctgctgatgtcatgaattggatggaatgtaaagctggtgttcctacaaagcactctggttaagatggcagtttatgtggacagagactggaaagcgccccttccatctactctccctcccttggtaacatcacccacacagatcttatgatgtggtccaactggtgctgctcatacttggaacactgcagcttgaagctgggaaatgactctcaggtatttgccataaaaaggcattccattggaacgcttcactcaaatcttcagtctagttccccttctagtaaacttcacatgcttagctgttcttggcctgttttaatgagatgacatcacagaaaataactacataaagcagcactatgcctggcatgtaagaaagtgccaactgtcgacagatgatccaaaagatttccttctaagcatctaacactgactgaggtcactgaagaccacactggcaggaatttcagggactgatgacatctccttcccttgtactcatgtttgagagagtaggtctgattcccttactgcaggcccccatgaggtctgatacggttcggctctgtgtccccacgcaaatctcatctctaattgttatccccatgtgtcaagggagggacctggtgggaagtgcttgcatcatggggacggttttcccctatgctgttctcctgatactgaattctcccgagagctgatggttttaaaagtgtaacagttcccccttcacttgcgtgcttgcttgttctctcttgccaccttgtgaagaaggtacctacttcccctttgccttccgccataattgtaagtttcttgaggcctccccagccacacagaactgagtcaattaaacctcttttgtttgtaaattacgcagtctctgtatctttatagcagtgtgagaactaggtcactgcaaga

SEQ ID NO: 17291 - DNA, 16782 bp, Human
tcatagctgggtaatttccagagtatgaatgcaccaatttactcctttccttacgtatgaacatgcatgtcatttctagtttttgtcactacaaagaattctacaagaaatttgtagacatcagattcacagatgagattgtgaaggtcaaagggtacatacttgtacttttaattttaatatatattacaagatgacttcacacaccacactaccagcgaaaggagtgcctatttctccaccttcattgtttgataggtgaaaaatgtggttccctttaaaagtgataatcttgactagtagtgtggttaagcatctttttaaatgttaatgaccaattagttttcctcctctcgggaagagctcctcattgcctttgctttttgtcagttggcaggggttcattttgtcttaggaatgtataatcttttgtgtagctaatctttacaattatcttccagtctatttcttgtttgttaacagagtcaagaaaaagttcttaaaaaatacaatcacacaggtttatattttacttcaagacatctcagttatctgttttgcctcataattcaaaccataatgctttgattaacggaggctttttagtaaattttgatctgaaaaggcagatattccttatttttctagaatgtcttggtgccacacagttttcatactcgtttctttgtaacatattttaagccatcgtcagccattagtcaggtataattaactttaagaagaggcattcatttatatttttacttttgtcaactttctggaggctggtattacatcgagaaataaggccatccctgcccacaagttgtccgaaccctgatcagtgcgtcactggggaacgaaccgagtgtggatacaacgcacaaacacaaaactctgttcggcctccgtaggaagctgaaattgagaaaggaaaccgagacagtaggagaagggcaattaagatgtctttaaaaacaagacggccggtgcggacagcagtgtagaagttagcaagctggagtgggcaatgtcggtgccccatctctaacctatgggagtcaccagagcgggggcggagtcccatggcggccacaccctgtccgcctccgcagtctttttactggagaaccgcagtaaaaggcggaaaccgcggaggcgtcttgattttccggtcggagagatagcttgcttcctttaagcctcggggtaggggggtggggagggtaggggggtggggagggtaggggggtggggagggtaggggggtgggggggtggggagggtagggggtgggggggtggggagagtaggggggtggggagagtaggggggtggggagagtagggggtgggggggtggggagagtaggggggtggggagagtagggggtggggagagtaggggggtggggagagtaggggggtggggagagtaggggggtgggggttggggggtggcgccgtggggggtggcggggtggggggtggggggtggggagagtaggggggtggggggtggggagagtagggcggtgggggagtggcggggtaggggggtggcggggtggggggtggggggagcgcgggcgctgggtgggcggggggtggggcggtgggggggcctgccccgccccaaccgccgcgcctgacggtcgtccattggttgtttgcattcgaactacatttcccagcaggccctggggttagactggccgcagctggagaggtgccagcccgtcgtggatgactagagccaaccacctgccttccgtcttccaggcagaaccacagagaggctacagccgtcctggcctccctccggccctgagagctcctctggcctgtctcaagtcttaacgtctcaagcgcagactgccggctccgaacggggagaccaggcttctgcaccggaaacaaggcaccggttgtgacgtcacagccgcagagcgcccgacttcccagaaggcaccgagtccctgccgttctcctcaactggcggcggcgcgaacgaatagtcgccggcgacctgtgagggcactcggaagggcgaggggagggctcgaccgctcgcgcctagtttttctatctctcccggagcctgagtctctgagccgtccccagcaaacgctcaggggctgcagaggccccgagaggtgaggggctccgtgagggcgggaaccaggctgaggccgcctctggggagcggagcgtgtccgttgctgagggagcaaggccgggtagggagcctggtgagcgcctcaggcaggggcgcacgctgagctttacggtaaaggtgttccttgaccagcggaagaggccccagagtgagcctggcccggcggtccttagtgggatgtcgcctgccgctctcagcagagctttgacggcggagaggagtcggcaggcggtgtgtggacacctcctcggccttgcatctgctccccgggagagtcaccaaccgcctccccgcccaaagggcaccggagggagcttcggttcgaggggtacagtatggccagattcagtgaccaacctgcttttaggcagatgtcctcggtattgaccccagatttcctgtcttctagcccattgctctttctccaagcctgatttaacctattcctggtgggttttacacaccgtctttctttctgtcttttctttctttttccttttattttctttctcttccctgattcccttcctccttctttcctttctcttttcctttctttttttagagtcagggtcttgctttgtcgctcagactgcagtgcagtggcgcgatcacagttcactgcagcctcgacctcctgggcacaagcaatcctcccagctccccagtagctgggaccacaggcttgtgtcgccacgcccagctaattttttttttttttatggagtcggtgtcttgctgtgttgcccaggctggtcttgaactcctggactcaagcgatccacccgccagggccttccaaagtgctgggattacaggtgtgagccaccggtacctggccacactttgtatttctcaggaggctggaccttggccttctccgctccacccttactcccttccctttggacttgaggtttgcacagtctctgtttttcattctcaggatcttcctttcacatcttcctaagcatatcttgttcaaatactgcgtttcagttatgatttccctatcccagctgtcgttttctttagatctcatgtagcctcaccagccatgccacatattggagtgcagtaatgccgtgcctggtcttttgggtaatccctggtttctctgtctacagcttggctctctggcagatttcctctagtaagaggtggctctggaggccccgcgaaacgagtgtggtgtgtggttgcaaggcatgatggctgcaaaagtggttcctatgcccccaaagccaaagcagtcctttatactgagagttccgccagactccaagctgggccaagacctacttcgagatgccactaacgggcccaagaccatccaccagctagtgctggagcacttcctcaccttcttgcccaagccaagcctggtccagcccagtcagaaagtcaaggagaccttggttattatgaaagatgtgagctcaagccttcagaacagaggtgagaagcacatgcttgtttcactagaagaggaggaggaggtactggagtctaagataggtttctgtgttagttataaattcaagttaggatggtgtatattggaaaaggagtcaattctagtgttggaaagaggaagttcttctcaagtgctgggtgtgagtaaggccacagaataaacagtgtgcatctttctgtagtgtcagttttacccaaacattctgagggaaatatcttttaaggataaatcagatgaattattgagttaggttgatgtggaattttagaaattttgtgctttttctgggcatcttcacactttacgttgccctaagctctcctttagtaatactctatgggaaattctgaaaggtgcttagagaagtcattcttttcataacagggagatgccataggttcaagaccctagagtttatggcttgaactctataagggctcacaggagcagaaaaggccatgagttacctgtcaaaggaatgaggacagcctggcctcgcggtatggggagtctctgtgttagagtcactgagtttttcactaactaaaccttcctctttccccagtgcatcctcgtcccttggtgaagcttctgcccaaaggagtccaaaaggaacaagagacagtgtctctgtatttgaaagctaaccctgaggtgggtttggttttcccatttactgcctgaatccatcaccttccgtgcttggccaacctgtgtgtaaaaacacattcttaggagttggccttcttgggtgtttttcttctgctttttccttgagcccttctcagcctggctgtcctgtctttgctgcacctctgtgggatttataggtccctcttgctatcccttcccttgatctttgtgtgtcagcttttcttaccagtagggctgtcagtgaacctcagttactaagatgaaaggggcctcttgctctttcaggagctggtggtctttgaggatttgaatgtatttcactgccaggaagaatgtgtgagcttggatcctactcaacaactcacgtcagagaaggaagatgacagcagtgtcggggaaatgatgttactgggtaagaaatcacagcctttgtgtgttcaggttgtttgctttgggaaaagcatgtccttcatctctttagctttgggggacgattcacacctggtaagcctatgtgcacacacacattttattttacttttgttttattcaatgtagcagagccttgccacagaactccagctgtgggtgggtggccatttttccctgtatcttgggggcagtgaggggagaggtagggaaaacctgcagacatagaaactgtggatatagaaactgttctgaacccattttctgaactctgttctcaacaggtatatttgaatgttttcattgaacacatgactaactcttgtaatccccctcccctttttgatgttcaatagatgtgaagactactagcctaagtgaaaatatattccactattggtgaaagtaatgtttaacacttaatgagcacttatatgctgttacatgctaggcactagtccaaatgcttttcatgtgtttattctctcatgtacttctcagagtaatactgagtggtatagaaattactgccaccttacaggtgacagaactgaggcagagaggggttacaaaatttgctaaagttcacacagttgtaagtaggggaacagggattcggactcagggaatctgacatcagaatttgcagtaatggcccagggctgtactgtctcctagatgcatttctcataattttgtcaatgaattccgtgtatggttggtgaatggggcattctttatttgtcctcatttcccagtaatagttgacaagtgtcccccagtgctgtgtatgaactgatcaagcagcagcctctctataatttgcttagagatgctttaccttttctctagaaatgttgcaaccctagaggcagaggcccgcacaaatgtctttactgagtgccggacactttttactttgccttcagggctttttgtttctgagggtgaagttgtacagagaataggttttagaagttgcctggggtgacagaaatccattatgactgtcaaactcttagctgtaattataccgtatggtcagaagtattggtatgtaatgagtgtagttaatttcccgcaggttgctctatgtgatatcttctttattttagagaaaaggataaaaagatcagatttattaacactgagtttttcctgagtcttgggcagagctggcatttattttgggtgactggttagtggatatattgcctccaagatcacttcgactatgcacttcagggcccctaagacccaatcctcaccctctgttccccacttcctccacccgtaccctgaagctggtggcttaagcttagtcatttaccagcatttcataaatgtactagttttttcctcaggcaggattgggttctggaattgtattcatcaggttacgaagatgttatattcttgccttttgtaaccttccaatttggtttgtaagacaagtcattcatcaaacgataagcagtgtgaaatttttataggtataatgagctatcgcaagactgaggtaagatttggacccggggcagagtagtgaagaaggtggaattgattttggatgagattgaatccatgatgggaaataaaatgagattatcctccagatatttggaaattggggattggagttcagatgtgaggatatagggattggggagccatcaatttataggtgatgataattgaaacagtaacatttaaccaatttttgcaaaggaaaaactataacggattgaacattgtggtggcaggaatcaaagaacagtccttgataacctagggaaacagagaatgtgtgtgttggccaagtgaaccacgtaaaaataaggaaaaacgtagaacacttaaacagattttcagtaagataattcttattatagctactgtgtgctgtgataggagaatacaccttttcaagattgaagaaaattgactaaatactaggcaacaaacaaagactcagattccaaggagtagaaataaagtaggatctgtcacaatgcagtacaactagaaattaataataaagatcagtaaattaaagttccttccacctggaaaatttaaaactcttaagcaactgtcttagtacattttgtgctgctataaaagaatacctgaggctgggtaatttataaagaaaagaggtttatttggctcacagttttctgtaggctgtacaagaagcatggcgtcagcgtctgcttctggtgagggcttcaagaaactactcatggttgaaggagagcagacttcacatggcaagagaggaagaaagagagtaggaaggtgccaggctcttttaaacagccacattgttagtgaactaagagtgagaaatcacttattattttgaggtggcatcaagccattcatgagcgatctacccacatgatgcagacacctccgactaggccccacctccatcactggggctcagatttctctgtctttatttatttatttatttttttgagacagagtttcgctcttgtttgaatttggaagtttccttctttttttttttgagacggagtctcgctgtcacctaggctggagtgcagtggtgcgatcttggcttcctgcagtctccgccccctgcggttcatgccattctcctgcctcagcctcccgagtagctgggactacaggtgcctgccaccttgtccggctgattttttgtatttttagtagagacagggtttcaccatgttagccaggatggtctcaatctcctgaccttgtgatctgcccgccttggcctcccaaccttctttttctatactctggaaattttcctagcatttgaattatttaatttttaaaagtttagaagaattttctgtggaactgtctgaggctggtgcttttcttgggtaggtggctagtctttttttgataatttcaattttctctatggaaattggtttatttttgcttaaatcttactagtttttttctatttttaactcattactttctaattggtatttattaataccttcattcttttaaatttatcctattgtttttctaactttgaatcagaggctttattattctcatttttctaaattaatacatgtttttacagccatgagctctcttatgagcatcactttaggttataccataaattctgatatacacttgtccttggtattcatgggggattggttccaggacccccactcagataccaaaatccatggatgctcaaattcattatataaaatggtgtagcatttacatatactccacacatatcctaccatatattttatttctagattaattataatacctaatacaaagtaaatgctacataaatagttgttatactaaattgtttagggaatgacaaaaaaactgaatatgtacagacaaaaccatcctttttttttctctcaaatattttcaatccttggttggttgaatcctcagatgcagaacctatgaatatgaaggtctgtataatgttttctagaaaaaatatgcaattttaatttgtctttacccctctgacgcaaggttgctgatatagtttggatatttgtcccctccaaatctcgtgttgaaatccagtccccatgctgggcacagtggttcacggctgtaatcccagcactttgggaggcaaaggcgggtgatacctgaggtcaggagtttgagaccagcctgtccaacatagcaaaaccccatctctactaaaaaaaaaatatacaaaagttagctgggtgtggtggtgcgtgcttgtaatcccagttactctggaggctgaggtaggagaatcacttgaacccgggaggcagaggttgcagtgagctgagatcacatcattgtactccagcctaggggacagagcaagactccatctcaaaaaaaataattaaaaaaacagaaataatacaaatctattaatatttcttatatataaaggagaaaaatcatttgtttacttgtatagttactgaaaagatacttgacaaaattgaagcctctcctttataagaacatttaacaaaatagttaacagatacttccttataggtagaacagagtaatcagaaaacttaaaaataagaacatttatttgtcttaagtactctcatgggaaaaaatgagaccattcactaaggtagtgggaaataaagtgaataaacagaaatcattggctttcacatatataaatggggtcatttagaagatacagtggaaggccccattagaatagaaacatgaaagtttaaatacttaggaataaactcaagaaatgtgcaaatttatgaggaaactttaaaacaaggctaaaggacaagagtagatttcaacgaaagcaaaaaaaaaaatactatgtttttggctagggagacaatatcataaaaaggtcatttctcctcttgttgatttattaatttgatgtgttttttttcaacaataccaatagcatttttcccttggaacaagactgtgatctcagaaagtcccgaaatagcctcaaatacacatgggagtttagtgtgtgataaagttggtgtattcgtccattttcacactggtataaagaattgtccgagacttggtaatttataaaggaaacaggtttaattgactcacagttcagcatggctggggaggcctccagaaacttaaaatcatggcaaaggcaagaggaagcaaggcatcatcttcacaaggcagcaggagggagaagtacgagtaaagggggaagagccccttataaaaccatcagatctcatgagaactcactatcatgagaatagcatgggggaaggcccccccgcccatgactcagttaccttcacctgatgtctccttgacatgtgggattacaatttaagatgagatttgggcgaggacacaaagcctaaccataaagggggactttttgataaaaggtgttaggacgactgacagccacttgataaattagtaccttactttacataccaagaaaaagtccacatggatcaaagattttaaatgtttaaaacaaatataaaaagcacatttagaaaatatgagtgattcctttataaccatgggataggaaggtttttgtaattaagactcaaaagcccagaagccttgaaagaaaagattgacagattcaaatacgtacaaaaggctggggcatggtggctcacgcctgtaatcccagcactttgggaggccgaggcaggtggatcacctgaggtcaggagttttgagaccagcctggccaacatggcaaaaccccatctctactaaaaatacaaaaattagctggatgtggtggggcatgcctataatcccagctactcgggaggctgaggaaggagaatcacttgaacccaggaggtggaggttgcagtgagccgagatcacgccactgcactccagcctgcgtgacaggagcaaaaagaagtgcaaattaagcctctagtgaattaacattttgcgtatttcatatttatagaaataaaaacacattgatggtgaggttgttgagaaacaggtatattgctggtgggcatataaaatggtatagtccctgtataagggtaattgcatctgtaactacccatcttatcctttgttccaggagttcaattctggaaatctgacctacagatatagcaacagaacacattcgaaatgatgtacaaagaagattattcactgtggtattgtttgtaaaaacacaaggttggaagcagtccaagtgtagttaaagaggaagagttgagttaaaaattatttagacaagaaatcattgacaaagatatacatttataaaagccttaacccagtagattattttgcataatgaaaatccaaagtaaaactacaatgagaaactattttatacctattaaatattttaaaatttaatgctaacaagattaggtaaagttaatattcacatgaaattagtagagctgcttttgaaagcagaatggtagttcatgtcaagagctatggtaaaaattgacatttcattatcctaagggagtgattaaaaagaataattaggtcgggcgcagtggctcatgcctgtaatcccagcactttgggaggcctaggcgggtggatcacgaggtcaggagatcatcaagaccatcctggctaacacgatgaaaccctctctctactataaatacaaaaaattagctgggcgcggtggtggacgtctgtagtcccagctactggggaggctcaggtaggagaatggagtgaacccaggaggcggagcttgcagtgaactgagatggtgccattgcactccaacctgggcgacaaagcgagactccatctcaaaaaaaaaaaaaaaaaaaaaagaaaaaataattaaggctgggtgtgggggcttacacctgtaatccccagcactttgggaagattgcttgagtacacgagtgcaaaaccagcctaggcaacatagcaagaccctatctctgccaaaaaaaaaaaaaagtgaaataaaaaaaaatctattggtgtgaaactgctgaatccagcagagattccaactccagcttcaggatcagcccccatgtcttggtggttgatttgaacccttgactctcagtaggcctgagttgaggggtcccttgtcacacaagtatatccacagcatggttctttttcactttgttacccagtctttataatctgcttacactgacttttttctgaagtataatggaaatatagaaaaagcctaccaattgtaaatatatagctcaagttttcacaaaatgtacacactaagcaccacccaaaatggacttttcttagcatcccaaaaatcccttttgtgccctgtacccactcactacttcctttcctacacaaagagaaacactactgacttctaatcccaaagcttcattagttgtagtaatctctttaattgccaaataataaacttttttctgttttgagacagattcgctcttgttgcccaggctggagtgcaatggcgcgatctcggctcactgcaacctctgccttccggtttcaagtgattctcctgcctcagcctccctagtagctgagattacaggcatgtgccaccatgcccagcttattttgtatttttagtagagacagggtttctccacgatggtcaggctggtcttgaactcccagccttgggtgatctgctcgccttgacctcccaaagtgctgggattacaggtgtgagccaccacgcctggccaataataaacttttgtatgaatatgctgtgccctctttaattttgcttattggaattgtttcaattttctcattgtaagacattatgatattatttagtgctataatagtgtgataatatttaatatagtgaaaacctacaagtggttcgtcttactattcagttaccagactccttcaagatgatgagtggttccctgtatagatgtatagtcttcatccctagtccttacctgagtgctctacagagtataaggtgaatatgaacttgtcgagtaattaacacctatgaagagaacaaacatttgaagtctttcagtgaaatcccactcattttatttctttaaagtgtgcttgcattgtggtagatggaaagatttatcagttatgtatcccaccctcaataagtatggaaaaggagtgcgacggcagtatccgccactccccagattgacgttcaaggtggctgtggcataagaaacctgacttgttttttcctgcctggtgttgtgatatctctcagaagttgttaaattctctctttgtttcagcagtcaatggcagtaatcctgaaggtgaagatcctgagagggaacctgtagaaaatgaagattatagagaaaagtcttcagatgatgatgaaatggattcttccttggtctctcagcagcctcccgataaccaggaaaaggaacgactaaatacatccattccacaaaaaaggaaaatgagaaatctgttagttaccattgagaatgatactcctctagaggaactctcaaaatatgtagacatcagtattattgcccttactcgaaatcggaggacaaggagatggtacacttgtccactgtgtgggaaacagtttaatgaaagttcttacctcatttcccaccagaggacccacactggagaaaaaccctatgactgtaatcactgtgggaaaagcttcaatcataaaacaaacctcaataaacatgagcgaattcatacaggagagaaaccttattcctgttctcagtgtggaaaaaacttccgtcagaattctcatcggagtcgtcatgaaggaatccatataagggagaagatatttaagtgtccagaatgtgggaaaaccttcccaaagaatgaggagtttgtgcttcatctgcagagtcatgaggctgagagaccatatggttgcaaaaaatgtgggagaagatttggtcggctgtcaaactgtacccggcatgagaaaacccactcagcctgtaagacccgaaagcagaagtaatactgggaaccctttctgggtctgatggtgctgcctcaacctgagagctttcataagtagttctgaattcccaagctgcctaaaaaggtataaatgtgtaaaaatctcattattgccaaaattggataaatgcccatcttagctaaaacctcaaattgctagaaaattcacagggaagaaaacatttcaagggctatacctcagcatctaggctttttggactaaggagctttcctttttgaagttatatgataatgtacaggtcacagatcccctttcccaacactttgaagatgaatctggagtctgcttacttggaaggcaaagagtgacttgtgtctattgaaagtatatccgttttccccccacatggggattcatacttgagaaatagtgcaaagatgcttatctggaactgtgttctggtgaaagaaccaaattactggcttgttagccaacagcttctgatagcaattcatataaccctctaagaatacctgtttaagtcttgagtgttgaaaggaattgtttactttggaatataggaaaacagttgaatgtcagactctcatttgtatgtgatctaaatttgcaatcaatttcaataatatttacaatttgtgataaaactgacttttacagattccttttcacaacataatttaggtgtctactgttcttattgtattttgttctgctgttgatctctccagcagccgtctcatgcttctcccttgctaaaagaagtttggattactcaggcagggccatccagccccaccactagaaaagctcttcagaatcttgtccctctgttgagcccagatctcatgtgctacgaaggaaaccccaagacccagagaggaagggtcaacctggaggcaggaaaaagttggcttggatccatgtctcatcaataaccttaccatatgcttaggtcccctctatgctgtcatcagacctttggcaatggggtggtcactacctcacaaggcaaagtgttgtatgattagaaattacgtctccagtggttagctcacattgcctctcaagagacaggtttccaggtgtcttcattgtagtgggtattaattgtcttcagcctcttgatatccataccttcctgtcctctgcctagaagcaaggccagcggtgcctttacggactgatcgtgtggtgcgatttagggattcttcagttttgcttgctttaggtttccaaaagttatacattggtgttttgattggaataaagaaatcctataagctatttgggaaaaattatagtgtatgtttcccatccagaaacatgcctttctatttattagagtattatattcctgtgaaaatttttctaattttcttcacttgttttacacaattttgttattgtagttttttccattatatttttatagttgattattgcttttacatgggaaagttatttttaattatatatttgtatagtcatctcactgttgttaattttcaatagtttcttggtttagttctgttaacttttggtaaaatgacaccatctacaaagaatagtttttgtttcttgccttctgcctattggtcttttttgttttgtttgttgttattaacatgtaattctgaggtttcttgttttggcacaaagcattctgaaagaaggacattctatgatacagttcagtcctgaatcgtaatttaaaaacaacaaatcctccacaacagagaaaggccacagaaaaactgtctttaccaacattgtatttcaggccaacaggaagtaccctgtaaagccagcaaagcgaacaaaacaggctgcccacaacgttattcgcttatttgaaagtctgaccagtgcactaggactgggatcctgaactgtgtttccagagtcggcaggctgttaccatgtgcagtggacctgcctgtgcacccagaaaagtagctgccaggaagtgagtggtgagagagagtctccactcactctttggtacccctgcccagagtcgggtattttatcagtcctcatgcagccatggcacagtacccgagacagttaattttttctttgagactggctctgttgataaggctggagtggggtgatcttggctcgctgcaacctcccgcctgctaggctcaagcgatcttcctgcctcaacctcttgagtagcttttcgtttaagtgtaggtgggtgaagccaccacaacccacaccatctcatgtgtaggggacctgcccatgcatccagaaaagtagctgccaggaagtgagtggtgagagagagtctccactctctcactctttggcagccctgcccagagtcgggggttacatcagttctcatgaagccatggcacggtacctgagacacttttttctttagttgagactggctctgttgctaaggctggagtgggacgatcttggctcactgcaacctccacctcctaggctcaaacaatcctcctgcctcagcttcctgagtagctttttgtttttttaagtgtaggtgggtgaagccaccacaacccacaccatctcctggactggggaggtgcccacggtcagggttgccgtcaatcagcacccagtgtcccagagggcaggacatgggccgcagggtttccttccgcaatagtgaggctgggtgggaatgagaggagcgccccgaccaggaccaggggccgcccccaaacacgagagcccctgggaagttgttggatgagtaagttctgttacctaaggagcctgatcaccagttaagttgaaaaagtaaacaacagtgaacagtttcccaatatagcggtagagcgagagttggaaaatgtaagagaccaaagatccaattccagtagtaactacagaaaataagccaggcgcagtggctcacacctgtaatcccagcactttgggaagccgaatcaggaggatggcttgaggccaggagttcaagaccagcctgggcaacatagtgagaccctgtctacgaaaaaaaaaaaaaaaagatttggttgagtgcagtggctcaacgcctataatcccagcactttgggaggccaaggcaggtggatcacctgaggtcaggagttcaaggccagcctggccaacatggtgaaaccccatctctactaataatacaaaaagtagccagttgcggtggcaggcatctgtagtcccagctactcaggaggctgaggaaggaggattgcttgaacccgggaagtggagttgcagtgagccgagattatgccactgcactctagcctgggctatagagtgagataccatctcaaaaaacaattatttttaaaatctaaaaaacattatcaagacggcatggtggcatgtgcgtgtagtcccagctactctggaagctgaggtgggaggattccttgaatccaggagttagagaccagcctgagcaacttactgagaccacatctttttttttttttttttttttttttttttaagaaacagggtctcactctgttgcgcagactggagtacagagctgtgatcatagctcactaca

SEQ ID NO: 17292 - DNA, 112114 bp, Human
gctatgtggccttttttgtttggcttctttcactagcataacgtttcccgggttcctccacactgcagcatgcatcggtgctccattcctttttgtagccgaataatattccattgcatggacagatcacattttacttttattttctaattcaacagtgagacctggtgtgggccccggcgctgggcctgggaggcgagggaggggatggaagagagccccgtgactggcaggaggcactgtggagtgtggggagaaggggtcgggatctgcatgctagagagaataggattttatttacacgtggcaatgtttatggaggccaatgcacaactgccattatgggacgcggactcctttgaaagtctcatttgtgtaaaaggaaaagcagtagttcatgaggagggggagaagggctcaaggacagcaaggtaaactacccctggggcaggggaacgtggtcgtcggtgggcccagctttggaggctaggcccgtgaaggtcgccccgtgagcaggtccagggcaggccgagtgccccggggcccgcattcattgcttacagagcaaggggagcctcccgggagggaaatccaacggttggaaacttcgatttatcccaaaggcgtgccgagtgggaaggcaacattttgatttcccaaacgttgcggccagcggcttcttccacggcaggcgccttcaggtctctccgcagggtcgggaccccgggcggcgcgcggcctctgggacgccgagggaggccgggcccacagcgcccggagcgcggacagcggccacagcccgccgcctagaagcggcgccgcccggggcggggggcggagccgagcgcgcgccccgccccgccccgccccgccccgcagccccagcccagcgcgcgcaccaaggcggggcggcgcgcgggcccgtgcgcgtgtccggggccaggaggcggtggcggcgagcgcgggccgcgcgtgcgcgctgcggctgggcgaggggcggcgcgggcgcgcgtctgtcagtgacagcgggcggggcaggggccggagatggtggcggcggcagctcttccgacatgaggcagcggccgcgggggacacggcggcgggcgcggcggcggccgcatctctagctcggggaggcggcccccggcgtgggcgcgggcgggcgggcgtcccggccggcgtcgcgggagcccggctctgcggcagcgtctgcaccgccgcccggcgaggggcccgcgtccgtggttccacgcgctcggtcccgggacagctgcggccgcggcgggagcggcggcgcactcggggggaagcaggccccactagacgggccgcgccgacgggctccgcgcactcgcagcccggggcgcccccacccccagcgcccgccgccgcgggcagggccggcccggagcgcggggggcggccggggagcgcgagccgggggcgcccgccgaagctcgctgctccgggtcggggtccggggccggggccggccgcgcgccgcctttgacgcatcggagcgcggctcctgcaggatggagggctccgcgccgccagcggagttgtttgtgcgcaggcggctcgcggggctgggagcgctcaaggtctgaacttccctccggagccgcagctggaggaggcgagcgcgcgaggaggagaagccgcgcggcgcggaggccaccctcggggcgagaggcgcggaaggcgagcgagcaaagcggtcccggagccacggcggccacgcggcggggacccccgggcgttctaggtccgtcccgagcggttctcgtgcgcctcgaaggtgggggcggtgggggcggtgggagcaccgctgagccgggaaccacaggaacagatggtgcctgtccaggtcgcgtgctggagccgccccttaggacaggagcaggtcccgggcctctaggcgtgcatgcctaggtgggagcgccgctaactctccccgttttgctggcaggtactggtgaccccggccggggcaggccccgggactcgacaacatggcttccccgccccaccagcagctgctgcatcaccacagcaccgaggtgagctgcgactccagcggggacagcaacagcgtgcgcgtcaagatcaaccccaagcagctgtcctccaacagccaccccaagcactgcaaatacagcatctcctctagctgcagcagctctggggactccgggggcgtcccccggcgagtgggcggcggaggccggctgcgcaggcagaagaagctgccccagctgttcgagagggcctccagccgctggtgggaccccaagttcgactcggtgaacctggaggaggcctgcctggagcgctgcttcccgcagacccagcgccggttccggtatgcgctcttctacatcggcttcgcctgccttctgtggagcatctattttgcggtccacatgagatccagactgatcgtcatggtcgcccccgcgctgtgcttcctcctggtgtgtgtgggcttctttctgtttaccttcaccaagctgtacgcccggcattacgcgtggacctcgctggctctcaccctgctggtgttcgccctgaccctggctgcgcagttccaggtcttgacgcctgtctcaggacgcggcgacagctccaaccttacggccacagcccggcccacagatacttgcttatctcaagtggggagcttctccatgtgcatcgaagtgctctttttgctctataccgtcatgcacttacctttgtacctgagtttgtgtctgggggtggcctactctgtccttttcgagacctttggctaccatttccgggatgaagcctgcttcccctcgcccggagccggggccctgcactgggagctgctgagcagggggctgctccacggctgcatccacgccatcggggtccacctgttcgtcatgtcccaggtgaggtccaggagcaccttcctcaaggtggggcaatccattatgcacgggaaggacctggaagtggaaaaagccctcaaagagaggatgattcattccgtgatgccaagaatcatagccgatgacttaatgaagcagggagatgaggagagtgagaattctgtcaagaggcatgccacctcgagccccaagaacaggaagaaaaagtcttccatccaaaaagctcctatagccttccgcccttttaagatgcagcagatcgaagaagtcagtattttatttgcagatatcgtgggcttcaccaagatgagtgccaacaagtctgcccacgccctggtgggtctcctgaacgatctgttcggtcgcttcgaccgcctgtgtgaggagaccaagtgtgagaaaatcagcaccctgggagactgttactactgcgtggcgggctgtcccgagccccgggccgaccatgcctactgctgcatcgagatgggcctgggcatgatcaaggccatcgagcagttctgccaggagaagaaggagatggtgaacatgagagtcggggtgcacacgggcaccgtcctttgcggcatcctgggcatgaggaggtttaaatttgacgtgtggtccaacgatgtgaacctggccaatctcatggagcagctgggagtggccggcaaagttcacatttctgaggccaccgcaaaatacttagatgaccggtacgaaatggaagatgggaaagttattgaacggctgggccagagcgtggttgctgaccagttgaaaggtatgtgcactgctttacctcggcatcccccctccctgatcctgattgtattaaattaaaaaaaaaagcttccagcctcagtgtctgcagacagctcaggtatctcagaatgccttaccatggggggatctcagggtcagtgtgacttttctttcagcgggtcaaatatcacagatctgttcacactgcagaaagggacgctgtgcagagatgacctagacgcgacctttagaaggaaggagaactttgaacgtgcataaccactggttggctgaaatgtgggggcacgtccggtgaatgtaagggtatggagcccttcagcattcagcactgtttagcacttaaggaaattgcctttgcattcatttggtcaccctgaagtcccatccaaatgtttctctctgccctttttgcgaaaacgtggagaataaaatctttctcctctctaggcctcactttgcttatcctcaaaatagggataggaagtcggcgcagtcctgcaggtctctggagaattagacggagttacttacctctgagtacacactgtcttttatctaggtcttttttttttttaaaaaaaagtttgcattttcagctttcagccatcatttgtttaaggatattttattatcatagtatttgccttaagtgaagagcttcatattgagcttctccagccaccaggtgatttggaagggagaaacgtacctgccggagagctggtattcccctccctcatcctctcaggtttggatctggtgcctggtccctggtttgaagctccttactgctattcttgatgtttttactgggctgcttgttttttctaatataggacaaaagtctttgagatctggaaaatgatattaaaataagtaggacgaaaaagaaagattttaagtaatctgctacatttcttcccccacttcctcctttttaaacagtccttatgttttactaaaatcttcaggattgaggggaacatctattgtggaagtatgtagagaaaataacactgattttttttaaaagcctgcttttgtgaagctgtattgtattttgtggtccccacacactgcatacttaaacagttaaaagcctcaggaaagggaatcctcggaagaagtaattaatagttccaatcagagatggcagaagtaatagtttcaatcagagacggcagaagtaatagtgtcagtcagagacgtccagtggttgaggtagggcctgcataggtcgttggtgtgagatcatcctatgtgtccagttggcattctctttctctggcttgtgatctgagctcctgtatcttttatgtatttgttctctggcaagggaacatcatctttcttctgatttttctttattttactaactttgctgttgaagattttatggatgtagacgaaaactattttcacccgagaattcccctaacctagagcactttaaggactatgttaacaaggtcagaaactacactttctgttcacttgaaagatgctgccgtgatgagtgtctttccgtttagggcggtggcactcgctcttgagtctgaaggtctcagtggacggggctgtgggtgtaaccccctgcttgccaccttggcatttttagggcccaggtgttgtgagctctgtccttggagactgtgggacggtggagctgggcggcagtacgttaaattaaatatgttggcccacaggacaatgagaacgttttgtaagctgtactttgtatgctgtattactcgaatttcaaaaatgaagagggtgtaattattaaatatgtttggaaattgccaagtcattgaatacctattttgtgaatttatgagtagttttatttttaagtttgtagatcaggggtctcagacacagagccaaaaaaaaaaaatgctagagtgagtttgtgtttttttttttttaaacctcaaatagtgtaaatttggtaagttaacttttcttgacatttgtgtacattgtatatttataaaagttttagtactgtagggagtagggaagatagaaggcttagcttagctgctgattttttaaaagtgatattctttcctttagctctttctctgagaccacgattttgttttcttgagctcattttacaaacctttgtggataggactccaggaatagagtatgtctacacaacttcctggcccttttggaaactgtccttacaaagctaaattgagatgacagcacagtttgtagaagaccctttcacacacatagttaagcttatctacatgtaagatcgattttagcctctgcctttgggctggtggcagatgttttctctatacaatattgggtattacgggaggctgaggcaggagaattgtttgaacccgggaagagaaggttgtagtgagccgaggctgcgccactgcacaccagcctgggcgacagagcaactctgtcttaaaaaacaacaacaacaaaaacaaaaaaaaccccaatactgggtgtattagcctttccctcttacccccttttctgatcccagggttaaaaagcagccagtagcggccctgcaggaatgggcatccatagaatgagaaggggcttctagaactagcctgggagcacagaaggaagctcctctcattcaaatttatccgaacaggctttgcagaagggtagtttcatgatttctgcacattccttcactctgaaatctgtgtcgtgcccctggcactgactgtgcacctggcactgtggatgtggagcaggatccgtgatcgtggagcaggatccgtgatcgtgaggtaggaggtgggactcgactccagaggcggggttcagatgccagaccgaattgaggactagctgatacagggatggggcagaagcagcgttctgcaaggcacgcccaccagtgtgccttgttagtttactgtcgccatggccacacccggagttactgcctctttccatggccgtgacctgacaacccaaaagccaccacccttttcctagaagtgtctgcctaagcctacctttactctacaggaaattaaaagtaggtataaggtaaggctgggcgcagtggctcatgcctgtaatcccagcactttgggaggccaaggcgggtggatcacctgtggtcatgagttggagaccagtgtggccaatatagtgaaaccccgtctctactaaaaatacaaaaattagcctggtgtggtggtgcgcgcctgtaatcccaggtgctcgggaggctgaggcagaagaatcgcttgaacccaggaggtggaggttgcagtgagctgtgatcatgtccactgcactccagcctgggcgacagcctaggcgagactgcgtctcaaaaaaaaaaaaaaaaaaaaaaaaaagtaggtataagtatgattgcaaaactgccctgagctgctactttccgcctttgggaaagcccagctctgcaggagcagtcatggagccgtataacactgcctgcctcttcaataaaggtgttttctttcctgccaccggctcacccttgaattatttcctgggcaaagccaagaaccctcttgggctcggccccactttggggcgcgtctgacctgcgttaatagttcccaacctccgtgagctcacagttaaaaatgttgtggagtatgttcgggagtggggagcgctttagagggggctcctgctggagctgggtcctgagatcaggctgtggctctccaggtggacagaagagcaccagggcagagcggagaggtgggtatggctgggccctgtgcttctctgtgggggcggacgattgttagttgttcatcaggacaaggaaggccatgggtagcgtgggaaggagtttgcatttgaccccataggtgtcagggaaccactcaacagggggcttaggtgatctgacttgcagttttagaaagttcactctttcagagctagtgagtgtgggttggaaagagattaatgaggtgtcgagtaaatcccaggtaggggtgatggtggcccaatccaaagttacagtagcagtgatggaggtgatgggatctgagtggcattaggaagagcagcttgatgggactgcaagccagatttaaacaaacgactggcaggaggggaagggcttgaccatgtgaatgggaaatggcattttaagtttctggaagtgacttggcgacaatgtggagtcaggaatgggtgaggggcctttgaagttgctatggtatgaatggagaatgcaggatggacttgcagagtacagaggcccggaacccctggcttgcttactcattcagcaaatcatttactccgtgccaggcacggttctgggttctggcaatacagccgtaaacaaaacagacaacaattcctgctcttgtaataggggacaagaatttttaagtcaataatataggaggatcgctggagcccacgaggtcgaggttgcagagagccgtgattgcaccactgcattccagcctgggcgacagagtgagaccctgtctctaagaaacaaaaaccaggccttcaaataggggagatctaatagaggggacaacaggggagtcaaaccataaataagtaaaatagaaaaagtgttttgtgaacaaacataaagcaggaaggggatacagcagatggggtgtacgagtgtgagaaatcttatctagggtggccagtcactgggagaaggttgcaggaatttttagcatactgctaggattttggaaataatctaaaaagtgaggggccaggcatggtggctcatgcctgtaatctcaacactttgggaggccgaggtaggcggatcacctgaggtcaggagtttgagaccagcctggccaacgtggtgaaaccccatatttactaaaaatacaaaaattaaccaggtgtggtggcaggtacctgtaatcccagctactcgggatgctgaggcaggagaattgcttgaacctgggagacggaggttgcagtgagccaagattgcaccattgcactccagcctgggcgacaagaatgagaccctgtctcaaaaaaaaaaaaaaaaagtgtgagggacagttattaaagatatggagaaatgggccgggcgtggtggctcatgcctgtaatcccagcactttgggagaccgaggtgggcagatcaggaggtcaggagtttgagaccagcctgaccaacatggtgaaaccctgtctctactgaaaatgcaaaaattggctgggtgtggtcgcaggcgcctttagtcccagccacttgggaagctgaggcaggagaatcgttcgaacccaggaggtggagtttgcagtgagccgagatcgtgccattgcactccagcctgggcgatagggcgagactttgtcgccaaaaaaaaaaaaaaaaaaaaaaaaaaatgaagaaacggtctgattaaggtgagggaccttccacagcatttgggatgaaaccgctaggcctgagggaaccgtggctgttgtattctgccttgggccacaagcaaaaaatggtgagacgtgttatctcgagctgttggcttttcctgtcatagatacagggtcacaaagacagaaaatgaaactgttagaaaatatctacaggcatcttcttttcccgtgtaaatattaggaagacagaatgaagatgctcctccgctctcatccacacccatggtcatatctctgaagaggggaataccagggagtgatcacattgtcagatgcagaaattaaaaaagcttttttccccagccaaactttatgcttgtggagcaacttggggaggagacccgctggtatgcatttgggcagattgtcacctgttggccacctctgtgatcgagacctttgccttagaggagttcctatgtagaccctgtctggtgggccgacagaccgacagtggacggaggcattctgtatgcgttagcctctgcaaacaaacacctgtctcatgccggaaatctgggcgccccattaaccctgagcacgggcctgccagctgacagaaccctagccaggtgttggtttggggttcagttgcatgctcaggtgttcccctttcttcccccgttagcttgtccccacctaagcctgcaacccttgccactgggatgctaacccgttagcagagctcagtctccttgcttggaaattctgtgttgacctgcactgcattcttttttttttttttttgagacagagtctggctgtgtcacccaggctggaatgccatggcgtgatctcagcttactgcaacctctgcctcccaggttcaagcggttctcctgcctcagcctcccaaatagctgggattacaggtgtgcgccaccacgcccggctaatttttgtatttttagtagagatggggtttcaccatgtaggccaggccggtcttgaactcctgacctcaggtgatccaccagcctcagcctcccaaagggctgggattacaggcgtgagccaccacgcccagccttgacctgcattcttgagcaggatctgttatgcacgtggaaatacagcctctcagatagcaaatggcagagatgagatgaggcacacagttcccctccacagctggggtgggagacagaaaacagcagtagagtcgacactcaagctgcccccagtgaccatttgttcaggctctttgagacctggcttacagtgacaaggacacagctgttaattctgaagacaagctttcgagtagaagtaacctctggtaaagcaagagaaggttaaggtttgctgaattgccaatgggatgaagaaggaagggagggctgtcttttcaggtagaatgcctaaggaagggaaacatggagaaggaacaattagagcaagtcaagaagtttcaagatttttgtcttctggccagcttggttagatagtaattatgtttctgcatattggtcagcgttgcctatgtactttgctgtggaatagtaatcttggaaaaaaaccaaccaaccaacccacattaatctgtccatgtctgggcacagagtgtgcagaagcctgcgtgggccgtaagtctcgtctttgtcttggttggtgattttagtattggtgtttttgctggaattccaaaactgtaagagtgtaatcattcaccattagaattctgcaggtcccctcctgactctggactagctgagcttaggggcctgtcatccatctggccctgggcatatcatttgtactttgcctgtgacacacctcaagaccttttccaacaggaactagcatccctggagggaattttgtgaagagatgagagtttttgaaacaggaagggaactggcaagggaagtggccgggcaccggtgctgccgcggaacagaagggaagggactgggctgcatcagagggtggatgtggggccgccatccgtggtgtgggccaagggtagggtggtcctcccctgggaagactgcagacagcagtgatattcttgtagtcttgtggatgtacccagtgaaccacaccagccaagccaacccgtggctaaattttagtcaacttcagcgaagaagactgccccttgtaaaacttgtctgctcttggaaatcaggttttttgtctcattttccccagcctttgctagcattgcacttgtaaaaaattcctggcatcctttctgcggagttaagtgggaaggctcaatgttctgggataggtgggaacatcaaacccgctagaggctgctggtggcagtggaggcagaatgagttgtagcagtagtggtggcagtagtgtgacctagagggcagaagctgggaaacagggtgaaatgctgggccccgacagtcagggatagctgcacctagcttatatgccttcctctaatccagtagaaattgttgtttctgtaggttttttttcttttctttttgagacagggtcttcctctgttgcccaggctggagtacagtgtgcagtcacagttcactgcagcctcgacctcctgcactcagatgatccttccatgtcagcctcttcagtagctaggacacaggcgcatgccaccacatccaactaattttttttttttttttttttgagacggagtctcactcttgcccaggctggagagcagtggtgtgatcttaacttactgcaacctctgcctcctgggtgcaaggaattctcgtgtctcagtctcccgtgtggctgggattacagatgcatgccaccatgcccggccaatttttttttttttgtatttttagtagaaatggtgtttgaccatgttggccaggctggtgtcaaaatcttggcctcaagtgatctgcccgcctcagcctctcaaagtgctgggattataggtgtgagccaccatgcccggcctaattttaaaaattatttgtagagatgacgtctccctatgtttcccaggcttatgtgcattatttatataggttgtctattgatatttacagtattagaaattgaaacaaactgagaagcttaaaaatcttttctaaatttatttcaaaatagtaattcatttcacccattgcatgttaatgtaagtaacatttttataaaagtaactatattttgtaaaatgaaaaaatttgatgagaagggtggcactgccatacatttttgcaaatctctttaatgtctggattaataaacggttgaagttttttgttttttttttggtggattttttccctcttgttgcccacattggagtgcagtggcacgatctcggcttactgcaacctctgcctcctgggttcaagcgattctcctgcctcagcctctcgagtagctgggattacaggcacgcaccaccacacccggctaattttttgtatttttagtagaaacagggtttcagcatgttagccactgcgcccgacccacggctgaggttttttgagtgataaaatgtacacaacagaaatctaccgtgttaaaacacttttaagtgtgttcgctgaattttcttaaccgctttggcattcaatttgttgcaatatgttgaaaaatgtgtagaaaatctggctttagttggaagagcattttcatagcctttttatgtgattctggatatttttctttgattctgtagaaacattcaacaagtgagtagtagtttctttttctttttctgagatggggtcctactctgtcacccaggctggagtgcagtggtgctaccatagctcactccagccttgacctcctgtgctcaagtgatccttctgccttggcctaccaagtagctgggactacaggcatgcaccaccacaccccgctgattttttattttgagtggtagtttcttaaatgttagttgcaatatggaatctgaaattttattatctttttttgtacactattatattaaatgctgttgggtttttacccaggtgtgattttataacgtcatgcactagtcatttggaaaatattggtctcttgaatgatgcagctcttccacatgttgacgtcagtaaagtctaatagtctgaagatgttgagttcatcacagtggctgatgtaagttttccaaaactctacttgaaaactggaattttttatcattggcggcaaatactgtcagttattttccttgaagcgacagactcattcatattcccaggaatggtctgcccgtactcaagcctgaacgaccgtggtttgtctgtaggtcacgtgtaaataatgtgctaccaaaaaggtggccagttcagcttgcaatccaaacagctgcacagctgcttttctccaggaccgctgtgctttgatgggcagcagcgtcgtcgtaggcgtgcttctcatttcatcactcagactattcagaagacacctactcaagcttgcgatttaaccaatcattcatgttgacagcttcatctgggacattcttttttttcttttttctgtttttgtgacagagtctcgctctgtcgcccgggctggagtgcagtggtgtgatcttggctcactgcaacctccgcctcctgggttcaagtgattctcctgcctcagcctcccaagtagctgggatttacagatgtgtgccaccacgcccggctaatttttgtctttatggtagagacggggtttcgccatattggccaggctggtcttgaactcctgacctcaggtgatctccctacctcggcctcacaaaatgctgggattacaggcgtgagccactatgcccggcccatcagggacattcttaagtgaagctgtctgcctttcctttcgtaagtgtggggtagtgaaggacaagctgagggctagtgcagtttggtttccctgcatcgggacctgctcaggcactagcagtttcacccatggcttcttctgcactgtcactgcaaatgtcaacactgaagaaggcaaatgctgtcttagtgtcattgtgcaaatagtttagactccacagatgccttgcaaaggcctcaaggacctctagggatctgcggatcacactttgagtactgcttcgctagctgggctgcaagatgggaagactgagggttttgtatgtgccacccaaacacgcattctcatgtgtgtgaaacaacgccaattggagttgtcacacccattacatgttgcctgtggaaatagcaagtgaccttagttcatacattgaccttttcttacaaaatccttaaaaatcttttgtgattctggtaaatctttgttgctcatgttcaaagtgtgtgataaagaccatcaacttcgagctggccatggctcgtgcctgtaataccagcgctttgggaggccgaggtgggtggatcacctgaggtcaagagttggagaccagcctggccaacacggtgaagctccgtctctcctaaaaatactataattagccaggcgtggtggtgggcacctgtaatcccagctactcaggaggttgaggcaggagaatcacttgaacctgggaggcggaggctgcagtgagccgagatggcaccactgcattccagcctgggcgacagagcgagactctgcctcaaaaaacaaacacatggctgggcgcagtgagtcacgcctgtaatcccagtactttgggaggccgaggcgggcggatcacctgaggtcgggagttcgagaccagcctgaccaacatggagaaaccccgtctctactaaaaacacaaaattagccaggcatggtggcacatgcctgtggtcccagctactcgggcggctgaggtaggagaattgcttgaatccaggaggcggaggttgcggtgagctgagatcatgccactgctctctagcctgggcaacaagagcgaaactccatctcaaaaacaaacaaacaaacaaagaaacaaccatcaactttgtttctgtaaattttttttggaagggctcacccttgaatggttgggtgcttggattttgatttctgatacattcgggcttaattctgggttgtatggtttcctaactgtgggactttgggcaagctacctaggggcgctgcaatttataggaatgatggtgtctctgtcagagggtcgttgggagaatcaactgggataatgcaagaaaagcacgtatttgcatagtgactcgatggtggacagccattccatcaataactaacgctccccgctggctgagtcacatttcgtattgcactaaagggtgtttctttcttcctgcgctcaatctggcgcacatcttgtgtcgttcagtaccgaaacctagaacacactagggactgtgattgtgtcagtttctcgtactaaaaagggcaagtgtccaaaatacaaaatactgatagctcgccctggttaaactctagctgccgaacttggcagcctctttactgaaaaccctcgggggttcagcaggctcgttcctaggctgcttcagttccccagagcctggaggttcttaagatgatgggcccctcgatggttgaggaattataagcagatcttcagctgtgcaactccagctattggccgtggtttgaactagagtggtttttttcaactgtactgtatcctactgtaaactcatttgtttattcattaaatattgaatgggttcctaccattggcaaggcgaggactaggttctggagatagaggggtggcccctgccctcttggggcatgacgcctagaaagggaagtagacagtgatcaaatagtctgtacaggccaggtgcagtggtcatgtctataatcccagcactttggaaggccaaggtaggaggatcgcttgagtccaggagctcgagaccagtctgggcaacatagtgagaccctgtctctaaaaataataaataattagccgtgcatggtggcatgtgcctgtattccaagctacttggcagactgagatgggaggatcgtttgagcccaggtggtcgaggctgcagtgagctgtgattgcaccactgtactcagcctgggtgacagagcaagactctgtctcaaaaaaaaaaaaaaaaaatcacctgaacaaatattgtactagacttcctgactgtattacagatagggttgagatgatctctattttatagatgagaagactgaagcacagagaggttaggtaacttgtgatgatcacacagccagaaagggatactaaatggtggagccagtatttaaacccaaaggctgtattagaaaacactagtacccatctcacagaattgctgcgaggattaaatgagaaaatacaagttcttagaaaagttcttggcacataatacctgtcagtagagaagagctagtgttactgaaagttggaataattttcttagcagtggcagcaacagccaaaacaacgatacctgtctttagctctctgcatttaccctgctgtcatgtaccctgccctcacgtatcctgctgtctcagccactgtgaaatcctaggatcctgggagccgtgtgtgtttagatgcttttatttgcttggttctttccctttctataccatttacagactgagtttgtttttttcttttctttttttttttttttttgagacaagagtctcactcctttgcccaggttggagtgcagtggcataatctcggctcactgtagcttccacctgtatcagaccattctaacactgctataaagttgctacctgaggccaggtgcatggctcacgcctgtaatcccagcactttcggaggctgaggcgggcggatcacttgagctcaggagttcgagaccagcctgtccgacatggcaaaaccccgtgtctactaaaaatacaaaaaattagccaggcgtggtggcatacgcctctaatttcagctacttgggaggctgaggcaggagaatcgctggaacctagaaggtggaggttgcagtgagcccagatcgcgccactgtactccagcctgggcaacagagtgagaccccatctcagaaacaaacaaacaaaaaagatgctacctgagactgagtaatttataaagaaagcaggtttaattggcacagttctgcatggctggggaggcgtcaggaaacttacaatcatggcagaagatgaaggagaaacaaggcgcatcttaaatggtgtcaggagagagagagagtgagagagagagcatgcgaagggggaactgccacttttaaaccatcaggtctcgtgagaactccctcactctcacgagaacagcatgggggaaaccacccccatgatctagtcccctcccaccaggtccctccctcgacacatggggattacaattcaagatgagatttgggtggggacacagagctaaactatatcaacctcccagggtcaagtgctcctcgtacctcagcctccctgtgactgcacatgtgcaccaccacgcccagctgattttttcaaatttttgagagagacagggtcttgccatgttgcctaggctggtctcaaactcctgggctcaagccatcctcctgccttggcctcccgaagtgttgggattacaggcgtgagccaaggcacccagctgagttggtttcttaacgtcctccaaaggtgatttttttcaagaatcaatataaactcttggattttagcttatttgatgtatttcattccattacagatacatgatttttgatgctcagattgtcccatttggggcccatgggagcccctttaagttggctgctgagtcctcttcatgcaaccccagtggtctttgataactttcatacccttttagtaacctttttaaagagttgagaaattataggtattaaaatctcattaattctgtttgtctgatatgtttattcagagagactgagctaaagtttaccctcatcttttttgaaaagaaaatgaatagtatatgcatgtttctatgaggaaataatgccacccaagaaacggtttgtgcatcttcgagttccttggaagctttaatttgcattcctacaattgagagcaatgtagaatttctttctgtatcttcccactaatgcctgttgaggggcaggtgtctgtgaatgtaggtaaatcgtgataaaaaaacaataaaaaggccgggcgtggtggttcacgtctgtaatcccagcactttgggaagctgaggcgggtggatcacttgaggtcaggagtttgagaccagcctggccaacatggtgaaaccctgtctgtactggaaatacaaaaattagccgggtgtcgtggcgcacacctgtaatcccagctactcgggaaactgaggcaggagaattgtttcaacctgggaggcagaggttgcagtgagctgagatcacaccactgcactccagcctgggtgacacggtgagaactctgtctccaaaaacaaaacaaagcaaaacaaaacaaaaccaaaacaataaaaaaaaatcccaaaccaaaatgtagatgacctgtttgcagactgaggagtcctgcagcaaactccatcccccaggacagctgcggaatgttctagaaggcccaactctaggaaatcccttagtaggagccttgctctcaacagtgcctcctggaacgatgggccggccactctcttttccatcttgcatcatatgtatttgacttattttgtttataacctgtttccacgccactggaatgtatcttaagagcaggaattttccatgttttacttcctgctgtgttcctagtgctgggaatatagccaggcatataatacatgcctgataatattggctgaatgaatgaatgaataaatgaatgaatattacaggccagacacagtggctcatgcctgtaatcccagcactttggaaggccgaggcgggcggatcacctgaggtcgggagtttgagaccaacctggccaacatagtgaaaccccatctctactaaaaatacaaaaattagccgggcttggtggcgtgcacctgtagtcccagctactcgggaaattgagacaggagaatcacttgaacccgggaggcagaggttgctgagattgcaccactacattccagcctgggtgacagagtgagattctgtctcaaaaaaaaaaaccaaaaaccaaaacaaaacaaaacaaaaaatcccaaaccaaaacgtagatgacatgtttgcagactgaggagtcctcccccagcccagcaaaccccatccctcaggaccgctgtggaacattccagaaggcccaactccaggaattcccttagtaggagccttgctttcaacagtgcctcctggagctatgggccagccactctcttttccagcttgcatcatatgtatttgacttaattttgtttataatctgtttccacgccactggaatgcatcttaagagcaggaattttccatgttttacttcctgctgtgttcctagcgctgggaatatagccaggcatataatatatgtgtgataatatttgctgataaatgaatgaataaataagtaaatataagcctggtatggtggctcatgcctgtaatcccagcactttgggaggccaaggcaggcagatcagctgaggtcaggagttcaagaacagcctggccaacgtggagaaatgccatctctactaaaaatacaaaaatcagctgggcatggtggtgggcacctgtaatcccagctactcgggaagctgaggcaggagaatctcttgaacccaggagatggaggttgctgagattgcgcccctgcactccagcctggatgacagagcaagactctgtcttaaaaaaaaaaaaaaaaaaaaaaatatatatatatatatatatatgtacatatgtatttatacatatatatagtgtgtgtgtgtgtgtgtgtatgtatatatatatatatatatatatatatatatgtaactccacatgtgagtaccctgttatgtgtgaaaccacaccccaaacatctacacagaacaagcctccaggtagaggaaaggcagtaaccgctttgctggaatgactgagtggttcattaaatagaggctccggagggtcttgataggctctagcaaaggtggtggccgagagggctgaccagcgcatggtgcctgggaatgtgaatgggcccaggggcgccagagtgtggacagcttgggactgtgggctccgaggtgctgcgctgagggcgtggggcgcagggcagaaacacagaggactgagtgcttaggggaggcccaggaaatgtggggttgaacggcctagttctggcaattgtttttaagctttgtaagatggagatttcaagaagtatatttatcttaataatattgtagctcctggtaattcttatttgattaccatttatacacatggaaaaccagcatgcctgtttctggcaaagctccagggtagtctttgtgcataatttccaggatttttatgtaatgctattaaaatctgttcttttttttttcccccttccaaagcggggaaaaagcagcttttgaatcatttattttcgtgtttgagttgtttgggaaatattaactacattttctaacactctagcctggagaaaggaagaaaccccacatgcgtgtgatttatttccttgtgtatggatattaaatgcaatataccattaaggctatgacactttaagtgaaagtgttcattgcatgttgattcagttagttcgtaccctattgtgttactatttaaagtgtggattgcatcgcattctggaacttcataaatgagttctttttcccataaggaaaggccactgcttctgatgttcattaatgtgatttttgtgtgtgtgaatgagctgcctaaaaactgggtgtggtgagggtggtttctgaaagggaagcacttttatagcatgatcttatttgaaaatttaatttgtttttgtaaattagcttttggtcttaatacatttcctccactaacaagcacttttgggcaaataatttaatctctctggttctgcttttttcatattggtaaaatataaagtttgagatagatatgcttaaaatctccaccattgtctaagtatagctgagattctcacgtgattgggacatagtgctcattcttaatttgaaaagtgtttttttctttgtcctcttgtttcaactacgaactctcatttagacacatttagcatagggaagctccgatttatagagccactaaattgcagggcgtgtgtgagatttgtaacttcataaaagattctttacttcctttaaatataaatacgtaagattgagttctagaagtataatttacacatggtttcctgaggatcacgtttcctgaataaagcagggtatcgttagaggaaccccatttgatttttttttttttttttttttttgagatagagtcttgctctgtcacccagggtagagtgcagtggcgtgatctcagctcactgcaaactccgcctcctgggttcaagtgagtcttgtgcctcagcctctcgagtagctgggactatagtcatgcaacatcatgcccgtctaatttttgtgtattttgtagagatggggtttcatcatgttgcccaggctggtcttgaactcctgagctcaagcaatccagctgccttggcctcctaaagtgctgtgattacaggcgtgacccatggtgcctggtctgggaatcctgtttgattttgaaagtctgagaaacacttttgaaatggcttggagaaaatgtgaagtgaataattattatttttttaatgtgcttcagttcccatgtgaacattattttagagagagattggaaggttagttgccagtaaaatgaatttcactgtgttggcaagtttttcactcgtaggactgagtgaatcctggactgacagtgttcttaccgatgattctgttgaggaaggacttgcttgctcttgttgctcttgacggtgagcttctggatctactggccctatattgagtgtgcaaggggacgtgttagtcctctagttgtcccccacattaatgcatctggaaagtgtctaccttagatgttgtaattagaaattagagggctgggcgcggtggctcacgcctgtaatcgcagcactttgggaggctgaggcatgtggatcacctgagatcaggagttcgagatcagcctggccaacgtggcgaaaccctgtctctactaaaaatacaaaaattagccgggcatggtggtgcgcacctgtaatcccagttactcagaggctgagacaggagaatcgcttgaacctggtaagtagaggttgcagtgagctgagattgcgccattgcactccagcctaggtgacagagactgtctcaaaaaaaaaaaaaaaaaattaaatgtcatcaacattgaaaggaaactcttggattttgtcaaagatttataaaaagttttgaatgattttatttttttcattcagaagcataatttccctcttaaaatccctgatgtggatcatttggttccctgtcatttccattttctttgttcagagtgtctcttctggatctcctgagtttctgtgtgtgtgttcttcctttttgctcaaatgatgagcacacatgaaagcttttcctcctttgcctgggtgaggcggtgttccaggtgtgatctgcagtgcctgattattatattgtattaatctcctcaattttattttctggcttgtctgcatttttccttttctttcttctcccttttttttttcttattagagatgggggtcttgctgtgttgcggggcctcgagcgatcgtcccactttggcctcccaaagtgctaggattacgggcgtgagccacagcgcctggcctccttttctttatagtaatttgaatgtggtgattttaatcctccatggttttcttatccttcctcaacaaacagcaaagaggctgctggaaagccacatgacatttgctgtgatttgcacggctgatgggaaaacactacttggttctgaaggacagggttgtcattggatacctttgccctctgacccgagtgagaatctcacctggacaaagacccgagttgtgaaatcacacagagaaagtgtgattccgaacctgctgctgtcctgtgcttcctgaggacaagtgagtgactgactccgtgtgccaggaactgcaggaggttaaaaactttcagaactaccatgcaaataagaaatttcaaaggacttttctctaacacacatttcatagtgaacgtctcagctggattaacataattaacgctgtgttctttctggctcctgaaagaaattgtgattaggaacactttcagggctgatgagtctaaggtatcaactttgtcccttctgccacttgaagttcaaatggaaatgtttgctttcatagctccagtcatgatgttactgtatttagtagctattaagtttccaattccatagactcctgggagaagttccagttcgcactaaggcttctgttgcatttagcaccactgcctatggtgtgtggagctttcctgaacaagtaatagcagcaaggttcttagcttagtaataattttaagctattctttgattttttaaacaattaattaattaattattttgagacagcgtctggctctgtcgcccaggctggagtgcagtgacgtgatctcagctcattgcagcctccgcctcctgggctcaagtgatattctccagcttcagcctcctgagtagctgggactgcaggcgcatgccaacacgactgactaatttttgtattttttgtagagacaaaaatactttttttatgtagagacaaaaaaaaagttgaatgataaaatcttttattacttaataatatactttgattgagatttagccatttcattttcactagtgtccagacgttttcctgaaaggcgtgattccatgagatttaatactgaattataatttgatgtaaatgttttatataatcagttgtttgtttttaaacagtagcctcttttctaggcctgctctaggttgattaaatattaagttttctgatcagccagatccttaatagagagcttcggggacagcaaatggttgaatatgaaaccaacctcatttgccatgttgttagatataaatgtcagtgatagcactttctggatggttgagttttctgaagagcagaggattttctcttttagtcaatcagataattttctgttttaaccaattcaaacatttgattttatgtttctgaaatagataaagcactttcataaaaatggactgtgccaaataagaggtaattttcttgatgactcagttatttttgcctcttatttggcttttactaatatagcaatttctctataaaaataggaatctttgcttttttaaaaaaactgagatcattctgtttttccagttcttacattttaaaaaataatttttttggcttcttttgctatccatgtatgtagctgttggtgtgctttcctgtatcacatttgctcctggtttttacttcgttacattaaaaaaccaaaccaacaagtaattaagctcgttcagcctgcagatatcgtttgatggaaagggctaaggagtcagcctttgtgcaggtttttagttgtcagctatagtctgagtaagtgaggttgctaggtacaggcgttcaggatgtgtaagatgttattacagttatttttagtgtattattaagggggaggaggagaaagagaaatttgaatcaaatttgtgtcttattaaataggacacgttttccataagaccaaaagggcatttcttttgcttatgtactagaaatagaaaatggaaattagatattagattgtataatcgaaagtcaattagaattaatgaacaattctataactagttatactgtaagctaaaatgtgaatgttaaattagggaagtattgatttttatgaaaatttaccagaatttcaggaaaggactttgcttactttcccaagaaacgtctggtaggagtcactgtagaaatttggtgtgttctgtacaacactgcccaggaggaactggccacatttcttcctacttggttcttttgtttgtttgttttttgagacagggtcttgctctgttgcctagaccggagtgcagtggcacgatctcagctcactgcaacctccgtttcctggattcaggcaattctcgtgcctcagcctcccaagtaccggtgattacaggcacccgccaccacacctgtctaattttttgtatttttagtagagacagggtttcaccatgttggccaggctggccttgtactcctggcttcagatgatctgcccgcctcggcctcccggagtgctgggattacaggcgtgagccacagtacccagcctgctttatttttaattgaagctaaattcacataacttaatgatttttaaggtgaacagttcagtggcatatcgcacattcacagtgttgtgcaaccatcccctgggtctaattccgaagcgttttcatcacccctagaaggaaaccctacacccactaagcagccacttcccagctcccaagccctagcacctggcagccgctgtgctgcactttgcatctgcaggatttaccgagtctgggcgtttcttatacttggaatcgtaggatacgtggctttgtgtgtctggattctctcgctcagcatgtttccaaggttcattcatgttgtggcatggagtagtacctcctttttgttatgggtgcataaaattccattgtatggataaaccacattttgtttttccattcttccattgatggacattagggttgtttctgcctcttggctattgtggatggtgctgctgggaacactcgtgtacacgtttttgtttgagtatctgttttctcagttctttggggcacatacctgggcatggagttgctgggtcacgcggtaactctgtttaactttttgacaaacctctgccacttttaaaatgaggaacttgggctgggtgcagtggctcacgcctgtaatcccaacactttgggaggctgaggcaggaggatcacttgaggtcaggagttcgagaccagcctggccaacagggtgaaaccccgtgtctactaaaaatagaaaaatcagctgcgcatcatggcgcgtgcttataatcccagctactcgggaggctgaggcaggagaatcgcttgaacctggaaggcagaggttgcagtgagccgaggtcatgccactgcgctccagcctgggtgacagagtgagactctgtctcaaaaaataataaaataaaataaaataataaaataggaacttatatgaagaccctgtaaaaagttacctgtggcagtccgatgttttggaaaacatctgaaagcttaggtcaatttggtcatagatgtggctggccattatgtttcttgattgaaataattactttgttcactaccattcggaatagttttgtgattaggataaaaattataatgtagatataagagcctagagactctttttatatgaatgcataagttttggctgttcccttcaaattggcatgaggcttggcaacactggaattgtgtgttagataaacagttggtatctagggcaagcttgaaaaaaaagtagtatttaaacattgaccaaaaaaaaaaaatctcaacaactctaggaacttccttgttcaaatgaatccacaccgtctaaatacagcgtgataaaattaggcttccctctggtttccgtggggtcgagtgagccctgagcgtctcgtgcccagccaggactctgcctgctggctggcttcggagcacagggaggtgggacggtttccacggccagcagtgttcccacagcacttccttaatatagaacgtttttaaaagcagcgttggccacagaaaaagctcaactcccaaacactgtcatcagttcatagttcatttttattttgttttcatgttgttaaaacaagaaatagcatgtaaacatgtctgcattaccgaacatcagtagtgtttaggatagaagaggaacacattgagtttctaagtagaaaaaaaatctgttcatccttaaaggcaaaggaaggggcaaggtccctccttgaacaactgggtgaggttggacgcctccagctgtatttgctaagttgggcttggaagtatccatagggcgtggggggcctgctccagggctgacctcagctggagtcccctccaagtcaggggtatcgctcggcacacatttgtatgagttcacctgaaaagtgcccttgttgggggagcttggaatggcctgtagggcagctgggtcacagtggctgccggggatgcctgccaagctgttaagcagccctcgggcccacggagtcccagcaagtgtggtttactgtttgttaggatgtaattcaagcctgtgggtaggtaaaactacccaggattaaggggggttggcttttccagggaacaaaaggatcccaccagggagaggactgttctgggaagtgccctggtcccctgtggccaggcttgatttgctctctctttggaagccaccttggcacgcaggcactggtggaaaattttggagtacctgctggaggttgaagatgtgagcacgaagaaaccatggtcttgtctcgggagcctcccagactttcccctttacggctggtgagaacgtgaaatggttcacttgctgcagaagacagtctggcaggtccccaaaaggttaagcacggagctaccgtagggcccagccatgccactcctgggtttgtgcctaagaggtgaaaaacacacatccacacaaaaacttataggaatgttcatagcaacattatccacaattgccaaaaagtggaaacagcccaaatgcctgtctgctgatgaacacataaacaaaacaagtaacacatcaacaaaacgtagcacctctgtaggatagcatacgattcagccttaaaaaggaatggagttctgatacatgtgacaacgtggacgaatactgaaaacatgcccagtgaaaaaagccagaccacaaaggccacgtttcgatcgcttgagcccaggagttcgagaccagcctgggcaacatgtcaaaatcctgtcaactcaaaaattagccaggcatggtggcatgcacctgtggtcccagcccctcgggaggctgaggcgggaggatcacctgagcccaggaggtggaggttgcagtgagctgagattgcctgggtgacagagcaatctctgtctcaaaacaaaacaaaacaaaaacccaaatgccacgttttatatgattccatttctaggaactctagaactacaggcaaatccatacacacaaagtagattagtgatggccagggctggggaaactgaagggaaatgggaggtgaccgccgatgggtatggatggggtttcctttcggggtgatgaaaatgttctcgaatgggctatggtgatggttgcacaactctgtgtgcgaaacctccctgaattataaactataaacgagagaattacacagtatatgaattctctctatataaagctgttatgaaaagcgaacctaccagaccaacattaacaattagagtatattgtagtacaagacagttgtagattggcaagataagattggacatagagattttgtagattgtggagcggagagggatgaggtggacggtgctgttacagcctcttaggagggacagagatcctgaggtgatcaccgagcttcaggatcttgttcataattttgagattaagaatcttggtttggaatcccatgcctgtcatcccagcacttcgggaggccaaggtgggcagatcgcttgagctcaggagttcaagaccagcctggttcacatggtgaaatcctgtcgctgcaaaatgcaaaaactagatgggaatggtggcacgtgcctgtagtcccaactactctggaggctgaggtgggagggtcgcttgagcctgggaagttgaggctacagtgagctgagatcatgctgctgcactccagcctgggcagcacagcaagaccctatctaaaacaaagacaaaaacaaaccagaatcttcatttccatcagtcttcagaactgtgtgagtttaggagttgtgattcatgctgaccatgagaccgatgtataaagcaggtgccagtgtattaagttactttggggaatatgatgtacttttccagtggctggaatattaatatctacttcccaaggcagttcctccatgagatcaaggtatctgtgaggcctcattaatagtaacaagttagccgggcatggtggcacatacctgtagtctcagctactggggaggttgaggcaggagcattgcttgagctcacactgctgcacaccagcctgggtgacagagtgagactctgtcgcaaaaaaacaaaaaaaaagaagaagaaaggaagaaagaaacgaaagaaagggagaaagagagggagagagcgagagagacagaaacaaagagaaacaaagaaaagagaaagaaggaaggaaggaagagagagagagaaagaaagaaaataaatagtaacaggattgcttcaggactgtagtatccgagcaaatagtaacaggattgcttcaggactgtagtatccgagcaaatagtaacaggattgcttcaggactgtagtatctgagcaaaggatctgatttgatccagcacatcccacgagggactgagtgtttatgcccacagactcagtgccctccctgaactgtgcagagtaaactctgccaaactcttagctgttgttgttcttctttttttttttttttttttatctttttgagatggaatctcgctctgttgcccaggctggagtgcagcaatgtgatcatagctcactacagcatccacctcttgggttcaaacaattctcatgtctcggcctcccaagaagctgggattacaggcatgtgccaccacatgtggctaattttttgtatttttaatagagacagggttttgctgtgttggccaggctggtctcgaactcctggtctcaaccagtctgcctgcctcagcctcccaaagtgctgggatgacagacgtgagccaccgtgcccggccttccttgttcttaaagaaggagatgttacagaacaaacgaatctccatacaaaacaaaacctcaccataaaagaggaaactccctgcttcatgaggggtgcaggtaaatgtagaaacgctcaccaagaaagccagagtggatttcacattaatagaatgcaggtaaaagacataacttgttgggatgtagggcgcagtatcagaatggaatagggttcaggtgagctcctaggatggcaggatttgaagaaggagcagcaccttgattaggggagaatgaagaagctttggagggctgggcgtggtggctcacgcctgtaattccagcactctgggaggcctaggtgggcggatcacctgaggtcaggggtttgagatcagcttgggaaacatggtgaaaccccatctctactaaaaatacaaaaattagccgggcgtggtggcgcatgcctgtaattccagctactagagaggctgaggcaggaggatcgtttgaacccaggaggcagaggttgcagtgagccaagatcatgccattgcacttcagcctgggtgacagagtaagaccctgtcttaaaaaaattaataaaaataaaaaacacagtccaatttttttgagctaattatggaagtattaatggataaaatctacattttgtactggtgctgagagtgagctgtcccctaagtagattatgtttcatgattctgtgtcaactttctctgggctgatgggccctctttggacactgacgtctcctcacgtccatgatccctcctgggtccgtgccagctgcgcgtgtcatcagagcggagcgtgcgcttgtccttcatcgcaggcctgggtgatgtgtggctgacatgcgtcacatgggataggctctccgatctcagggctcgggctgccacccctgccacgtagtacatggcatgtggctgattctccacttgcttgcaatggaccctctgtggaaggcaccggagaggcggtttccctgtctcttctcctcctgtgttgccctcctccccctcgatagatgtgacctcccttccagctttgtgccagtgtctggcagcacttgattttttttctccttgtccttcatctgttttcattgcgtcgccaccttccccacccccaagcagcatccttctgccccttggtgctctccgcgcggccgtctgcctacctgtgagtacgctgaccagggctggttgactgcctacacattagcggagtctttctcattttttagggcacagtagatactcagcgagtgttgttttttttttaataattatgcaataaatgaatggatgtccgcacaccaccctgaacaccagcacccactggtcatccctggacacgcatgggtggaaggaccacactggttgtccctggaagagtagctcactctcgagcctgcaccgatgtcatctgagtcaaaacacagacgtctgggccccaccctagagagtctggctcagcgggtccagggtggggcaagaatgtgcattcctgcaagttcccaggtgatactgaggcggctgctggggggataccatttcaagaagcactgcttggaggcaacgcagacctctccctcttcgacgaggtcctgttcacttccatgtaaccagtcagggttggaatcccacatggagttcccctcctttggtgaccctctgctacagctcttgggagcctcccctttagatgagttcctccctgctctgaccaggagttgctttttctataccacctcagctgatggtgttcacacacacattcatttaacacacatttacggagggctcctgggggctgggtgcacacacttggtgcggctctcttttggaacctggtgccttctctctctccttcatttttgaggcagagtcttgctctgtcgcccaggctggagtgcagtggtgcgatctcggctcatggcaatctccgcgtcccaggcttaagtgattcttccacctcagcttcccaagtagctgggattataggtatgcgccaccatgccccgctaatttttgtatttttagtagagacagggtttggccatgttggccaggctggtctcgaactcctgacctcaagcgatctgcccaccttgacctcccaaagtgctgggattacaggcgtgagccactgcgtccagcttccagtgtcctccctttcagcctctgggtgttgccagccagtgccaccactcagcactgtttatacctaaggcaccaatgggtaaatggagagacaggcgtctgaagacttttaaaaatgtgtactttatttggctgtagctaaaccagttagaaggccgggagttgaagttgatatgagtatcataaatgcgcaagttaagtagttacttaagaagtcacaggaatatgggtcgttccttgttgggtttctgataactagcaggcggctcagtttggctatgttaataacagaaacacagagattgccactgattctatcacatttcctgtttgtttgtttttgtttttgtttttgagacagtctcactctgtcatccaggctggagtgcagtggtgcaatcatggctcactgaagcctcgaccacccaggctcaagtgatccttccacctcagcctcctgagtagctggagctagaggtgtgcaccacctaatttttaaactttctgaattttttgtagagatggggtctcactgtgttgtccagtctggtttcaatctcctggcctcaagcaatacccccaccttggcctcccagagtgttgagattacaggtgtgagccaccgtgcccagccaacatttcattttttaaaaaatgctttattgaggctgggcccggtggctcatgcctgtaaacccagcactttgggaggctgaggcaggcagatcacttgaggtcaggagttcgagaccagcctggccaacatggtaaaaccctgtctctactaaaaatataaaaattagctgggcgtggtggtgggtgcctgtaatcccagctacttgggaggctgaggcaggagaatcacttgaacccaggaggcggaggttgctgtgagccgagattgtgccactgcattccagcctgggtgacagggtgagaccctgtgtcaaaaacaaaaacaaaacaaaacaaacaaaagaaagctttattgagatgtaattcacctgtcacccagcctgggtgacagggtgagaccctgtgtcaaaaagaaaaacacaaaacaaacaaaagaaagctttattgagatgtaattcacatgtcacacaattcagcagtttaagtgtacagttcctatactttgacatccatcactacagacaatttggggacgttttcttcactcgacagagaagcccggcacacccgagctgccacccccagtgctcccagcccctggcagcccctaagctgctttctgtctctttgcatttgcctgttctggacatttcataaaaatggaatcacatcatatgtggcccttcatgactggcttctctcactgagcctaatgttttctgggttcacccatggtgtagcatgtattagtgctttcttccttttcatggctgaataatattccattgcgttttgtttatctttgttgattatccattcctcagttgatggatatttgggttgtttcactttttgactatgatgaatagtgtttctatgaatgttggcagacacgttttcctgtggacatatgttttcatttctcttgggtatgtacctaggagtggaattgctgggtcatatggtaactctgtttaactttttgaggaatgtctggagtttgttttaaagtggctatgccattttctcttcccaccagagtgtgtgcgggccctgatttccccacgtctccataaacacttgctgctgttcgtcttttttattatagccacactagtggaaagacacttttgtatcccacacaaacagaaaacttatgtataggtgatttttctaaaaaaaagactttatgttttgataaaataagcatgttatattggttaagatggtttttgttgtgagttaacgaaaacctaactaaaattacctaaaacaaacaaacaaaaaaacgcatttactatctcatgtaacaagaagtatggcagttccagggttgattaattcagaggtgtgatgacatttccaggaccccaggtgcttttcatctttgctctctgctgtctttgccacgtgggagatgtcttcccttgtggcacaaagtggctgcagccattccgaatgacacagtgatatctagtaaagaagaggggcttttccaatcctgcatgtcttattttactagcatggaaactaagcagacatctctcagctccctttggccaaggcggggccatgtgccacatcctccttagttactggaaaggggagggaagccccattggggtgaacttaccctgctccagctacttactgcgggtgggctgtatgtgcgcatgcatggtgtgtgtgcgtgtgcgtccatgcgtgggtgtgcatgtgtgtgcgtgcgtgcatgcgtgggtgtgcatatatgtgtgcatgcatgcatgggtgtgcatgggtgtgcatatatgtgtgcgtgcatgcgtgggtgtgcctgcatgtgtgtgtgcgtgcttgcatgggtgtgcctgtgtgcatgcatgcatgtgtgtgtgtgcgtgtgtgcatctccttcctaagcaggtagaagggagataccccaagcagaatcaggcttctgctggtaaggaaggtaggtgtgtgggaacggggaggacatgaagaaagaaaatgattcttagggatgcaatgcattagtggctgtgactttagttaaaacatagaattttgtttgttttttttcttttgagacagggtcctgttctgttgccctggctggtgtgcagtggcaatagtggctcactgtagccttgatctcctgggctctagccatcctcctgcctcagcctcttgagtatctgggaatacagtcgtgtaccaccatgcctggctaattttcaattttttttttgtagagacagggtctcgctatgttgccgaggctggtctttaactcctggtgtcaagtgacactcttgcctcagtctcccaaagtgctgggattacaggtgtgagccactgcccaaccttcatgcagcattttaaaaaatgaaaatgtagctgcttgttctaggagaaacttgtgaaattggatcatttaaccaactctgcctgtgcgtgacttgccttcagttctccagcttggcctcaatccctttttcttgctgcttggaacccacatcaccaccagtgacctcacaaggcagtgcccctccgcacccctcccttctccaagactcccccgccgccccctttcttgctcttacccacacgccactgcagacacagcgccctcctcccctgctgcccccctcttgctcttacccacacgcccctgcagacacagcaccctccccccacccaccgttacaccctctcttgcttttacccacacgcccctgcagacacagcgccctcctcccctcctgcaccctgggggctccccgcatgtgctgtgatgttgaacatgtgggtgtcaggatgaaaggaagaaatctagatttgatgtggtgggaggtaaaagcactctcgaaggctttcgagctgggctatgactgtcaggatgaatgtggttttaatatgtggaagagatttatttctttaatagtcacctgttaagagtcttagatatcactgatgtgtcttgttaagaaaccttataacaaacgtatttcttaaacttacatctggagctctgcaaagcattagctgttctgcaggaatgacagagggtctcctgtgcggccagctcctctggagtcagggagccatggagccactgctggttctgaggatggtgacagcaggaggtggagatggcttcatgatctgctgtgagcaacgtgcaaccttctccctgctgttaagtgactagaattcccaggtgccgcctgctgattagttccagtttgtgttccacgagagcagatgtgtgtgaggtgcagggaatgccccgctgcgggagatggttttctcctgccaccgtccctccccaggccacaccatccacacacatgagcacgctcgtcttcctttctcataaagcacagacctagaaatatttctcggtttaaaaatagtgttttccctacctcgagtcaaggttcagttctcatctctctaattttagttccttgtttttatgaactttgaaatgttttccttaaccagaaaacagaaaaaagcaatcccagagacaagggaaatttcttgctccatttccctgtagtaaaggcatttctatgtgagattttctttttatcctgagcaggttatcagaaaccaaaattttgaattaggagtttaaagaagaggcaagggggaaaaagtgctctctacgggaccttggttgccatgtggaatgtttttggagcataaaattgatatttttacaaaaaaaaaaaaacgaaaaaaatgtttctggtagaggcctggagaacgccgtcatgattctgaaggtgtatatattttttattgtttctgtcaaactaattttatataagacattaatggaaaggtcaaaacacataattctctgaagcctattagaaaaatttcttccgttgggctgggaacggtgggtcatgcctgaaatcccagcactttgggaggttgaggcgggaggatcactcttgaggccaagagtttgagactagcctggccaacgtggcaaaaccccatctctatcaaaaaatgtatatatatatacaaaaattaatcgggtgtggtggcgcacgcctgtagtctcagctactcgggaggctaaggcaggagaatcacttgagcctgggagatggaggttgcagtgaaccaagagcatgccactgcactagagcctgggcaacagagcaagactgtctcaaaaaaaaagtaaagaaaagaaaaattacctctgttaacttctttaaattcttaggtacaggtggtaatttttttctttgttaaaattgatgttggtcattttgtgtttgagttttctgttgctatttcatggggattttcctgtgcatctacataatatagtatttctttgaattaatatgccatagtttaatcatttcctgtttgagctttttagattgcttgaaggtttttctttcctttgtaaatactgcagctttaaggaatgtgtgacttttgaagctctctgtttaggcagatggcaaagggggtgaccatcttatttttattaattttttattataaaagtaaaacatgtttttggtgttttagaaaagacagataagcaaaaagaagattaaaaaaacatttaccaactagagatagccattttgaatgtttcaacatgaggtttttagactttttcagtgcatatacgatatatatcaaatatttattcaaaatcaaatatatatcaatgcatataaatatatatagatataatggtgtcatatgaaacaccattaacaccattaaacaccattaacaccattaaacaccattaacaccattaaacaccattcatggatcatgaatacctttccacttaaatctgtatgtacatctttgtttattttattttattttatttttttgagacagagtcttgctctgtcatccaggctgaagtgcaggggcatgatctcggctcactgcaacctctgcctcccgggttcaagagattctcctgcctcagactccccagtagctgggactacaggcgtccgccaccacacccagctaatttttgtatttttagtagagacggggtttcaacatgttggccaggatggtctccaactcctgacctcaggtgatccacccaccttggcctcccaaagtgctgggattacatgcgtgagccaccatgcctggccaagtctgtacatacatctgtatcatcattttaaatgacttagattttattctggggatgtactataatttattcaggaaatatctcttgttggaaatgtagattgtttccagctttgaatcattgtatatcacaatatgaaactgttaataatccagccatccctcacatcaggatgcattgtataatttaatggtatgtcatagtttaattggcagcactttgcattatattttaatagaacaaaaagtaatgaaacatcatcattggcatcttagactcgatgaaatataatattgtcaattataacagtgtgatgaatatccttatttgccgttgtctttgcccacgataattagtagtggggccaaatctctttttcatatgtgtgttgcccttttgtatttcttcatgagttgcttgtgaattggttgtcttttccttattgatttgtgaaagttctttatttatgtaagtatcttaaatctttgtcttccatatatgttgtaaaatgcctcccattttctaatttgtctttcaatcgtgatatttcttgatatgtggaaatttaaaatctttatgttggtcttatctatcaatcattgtttatggtttctacctttagtatcatggttagaaaagccttccccacctgagaactatgtaaaatattaacctatattttcttctaatacttttatgtttttttttttttttttttttctttttttgagacagggtctcactctaggcaggctggagtgcagtggtgtgatctcactgcagctttgacctcctaggcttaggtgatcttcccacctcagcctcccaagtagctgggactacaggtgtacaccaccacacctggctaatttttaagtattttgtagagatggaggtctcattatattgcccagtctggtctcaaacttctgagttcaagcaatcctcccaccttggcctcccaaagtgttgggataacaagcatgaaccattgtgcctggactggatataccaccattttaaaaaatcagtttatcagttgatgaatatttgagttgcttgcagttcttggctattatgaatagagttgctgtgaacattcacaagtcttccgtggatgtatatttttatttgtttcggttaaatgcataggagtggagtgactgggttgtatgatgagtgtgtttaactttataagaaactatgaagctgaacatgttatttttctttgtaactggacacttaattgaatgcttattgtgtctgaatttttttttttttttctgaagcagagtctcactttattgcccaggctggagtgcagtggcaccatcttggctcactaccacctctgcctcctgggttcaagcaattctgccgaagactcccaagtactaggattacaggtgtgcaccaccacgcctggctaatttcttttgtatttttagtagagatggcgttttgccatgctggccaggctggtctcaaactcctgacctcaagtaatccacccacctcagccttccaaagtgttgggattacaggtgtgagtcaccgcgcctggcctgtgtctgatttttaaaaatcagatagccttagatttttcttggcagaaaatcatataaatttaaaatcccctccttttcagtttttatatctcattttaaaaaattggactgaaaggtaaaggccaaaaatatgcctattctctgcttaggagttacagtaacttttgatgtgtgtgtgtgcatatacctgtgtgcgtgtgtgtgggtgttttcccgctgtaagaaaagaaggcatgatgtaatgtgcaggaaataatcataataaagagaatgctggcgtacttcttgagtgctcattgttgctaaattggtcatttactcctaaaggacgttggggaagggtgtgtttgatctctctacagccagaaagaccacctgaaaaccctcctgggcctcgtgaatctgctcatctctccagatgtcacaggaagtgtcctcggagggggacaaggctgtgctgttccatgcaggcatggtctcaggctgttcccaattgtgagtgagttttgaacaaaactgtaacttccctgtatagggcttacagttggcctcatcttacaccctgtagtccagtgagtccgcatgctagctgtggaaagcgtgtacagaaaggaggctgattcttttttttttttttttgagacgaagtctcaaccttgtcccccaggctggaatgcaatggcgtgatctcggctcactgcaacgtccacctctgaggttcaagcgattctccttcttcagtcccctgagtagctgggattacaggtgcctgccaccatgcccggctaatttttgtatttttagtagagacggggtttcaccatgttggccaagctggtctcggactcctcacctcaggtgatcctcctcccttggcctcccaaagtgctgggattacaggcgtgagccaccgcccccagccaggaggctgattcttaattattgatgcactgcagcctgggcaacagagcaagaccttgtctaaaaaaaaaattattgatgccatttggttctctttgaaactaattaatggctccttaatttgtcagtgcatcttctagcgatcacagttgctgtttgggtgctcttgtcagtttttggtaaccatttctggtattttcttttcaaatccccagcctcactttgtgctggttatcacaagatccacttagaccttagaggtgagagcttgggaatatttcatctgcaagaaaaatcattcgtctgtctttgtgtgggacgagttaggttatgtaagctgatggaacacgaaacagaaaactggagcctttttctttgggcacacaaaaatgcaaaaatctaaatctcttattttgttgaatttttaagtggaaggagttgtagatttgccaccatcagtcctggagctgacttgaatttttcttttaggctcttgttagcttttctaacagagatgtcacagattagcaactaggcataaacctgagaaattgggcactaattttgttttgcatttttgttttgtaagacgggggtcttgctgtgttgcacaggctgcagtacagtggctgttcacaggtgtgatggtagcgcactgcagcctcgaactcgtgggctcaagtgatcctcccacctcagcctcccaagtagctgggaccacaggcatgtgctacgccacccagctgttattttgcatttgctctgtcatcacgttgtgcttttgtgcctgccttttctcctcattaactagatatctgtcacttaaagaaataacagcgatgcatttcaggataatagaacccctatgaactcttccagacttaaaatttatctgtttctccaaaaaacactgcctgcatttttcccaaataagccagatactctcattagccaggtatctgtgcaggttggacccctgcccaccttacaagatccagtagcatctccgttggaaagcttttcctgagccctcccgcctggcccccccgctgccccagccgccattccttgccaggtctctttttacctccttttgcgttaatgggtctttggagttgtgtctccccttcactgagctctccaggacacattttgcaacatttttgtgtccctggtgtatggtgtttagcagacgctcagtatttacatgttgacagattgcacacatgggaccgggtacatttcttgccagtacatccagttttcccttacctcttctgctgtaaattaatgttcctctggggtttaaaaaattaatttagtggttaatttagtaagagattaaaattaggcactggccaggcacggtggctcatgcctgtaatcccagcactttgggaggctgatgtggacagatcaccagaggtcaggagttcgagactagcctggccaacatggcaaaaccccatctctactaaaaatacaaaaattatctgggcgtggtggcacatgcctgtaatcccagctacttgggaggctgggacaggagaattgcttgaacccgggaggcggaggttgcagtgagccaagatggtgccactgcactccatatatatatagtaacaggtctcaccttgtcacccaggctggagtggagtggcatgatcacagctcactgtagcctcagcttcctgggctgaagtgatcctcctacctcagcttcctgagtagctgggactacaggcatgcaccaccatagctggctaatttttctatttttttgtggagacggggtctcaccatgttgcccaggctggccttgaactcctgggctcaagcgatcctcctgcctcagcctctcaaaagtattgggattacaggtgtgagccactatacccggccataaagtagtacttaaaagtgtaacaactttcaataaatctttgtgagattcagaacaaccttttgaattgtctatgtaaagaaataccgaactgcttttttttcccctcgatcactttttaaccttccactttgtagacaatttgctagtgtgttttctatttttttttttttttttttttgccactgggtattgccctgtcatccagactggggtacaatggcatgatcgtagctcactgaagcctcgacctcctgggctcaagcgacccacccgcctctgtcgcccaagtagctgggaatataggcatacaccaccatgcccggctaattgtttttttaatttaaattttgtttttttttttttgcggaggcagatcctcactatgttgcccagcgtggtcttgaactcctggcctcaagtgctcctcccacctctacctcccaaagtgctgggattacaggcatgagccactgtgcccagccagatttttgtcatgattctatttttatctcttctatcgatttatttcttatatattttttctcacttattttaagtgattgcccgaaatttacaaagtacattttttatcagtatgcctccaaatattataccatttattatataagaacctcgtaagaattcttcataactgtaagttactacaaggttctatgagaaccttgtaaatgtttatgatgctaatagtgtcataataatgtattttatatatattataaacctcataacatgttatttttacagaaaattaccttttagagcaatgccgtttgatgaaacttcctgcaatgatggaaatgttttatatctagactatacaatatggtagctactatccatgtgtgaccattgagtacctgaaaacaactgaattttaaataaactagtttaatttaagtaatttaaatttaagcggctgccatatagacagtgtagttttagaacaatggaagattttcaaaatacttttgaaaattattttgaaaatctttcttctttttaggccacttcaggaactcttcgtttctttgtgtagatctataggtttctgtctcatctcccgactgaaaaacttcctttaacattttttatgctacaggtcttctgggaataaatgatctcagcctttgtctgtctgaaaaagtttttatttccctcccattagaaaatgtttttaggccgggcacaatggctcatgcctgttattcccagcactttgggaagccgaggtaggtggatcacctgcagtcaggagttcaagaccagcctggccaacatggcaaaaccctgtctctactaaaaatacaaaaattagctggatatggtggtgagagcctgtcatcccagctacttgggaggctgaggcaggagagtcatttgaacccaggaggtggaggttgcagtgagctgagatcgcgccattgcattccagtctgggcaactgagtgagacttttgtctcaaaaaaaaaaaaaagtttttaaagagggctgggtgcggtgactcatgcttgtaattccagcactttgggaggctgaggagagttgatcacctgaggccaggagttggagacctgcctggctgacaaggcgaaaccccgtctctaccaaaaattagctgggcatggtggcgcatgcctgtagttccagctacttgggaggccgaggcaggagaattacttgaacccaggaggcggaggttgcagagagctgagatcacgtcactgcattccagcctgggcaatagagtgagactctttctgaaaaaaaagaaaatgtttaaagaaaaatttcataccaaggagatccaagagacactcatttttaagagtcggttttttcttttttttggttttgtttgtttctttttttttttttttttcttttaggatatgaaggtttgtgttgaaaaattttttttgcaacttattcttttagtactttaaagatatcacaccactgccttctggcttttgttgttttggtgagaagtctgctataattcttttctttgttcctctgaatgtaatatgtttcccaattcccactgtcaccccggcagcttttaagattttctctttatttttagttttcgacaatttggacatgatgttgttttggtatttctcttttttggagtcctctaaacttcttggatctgtgctttgatgtcttttattatgtttaaaaaattattggccattatctcttcaaatatttccttctatcctttctttcttcttcaagcattttcttttttcttagaaacatttaataggggcttatgcacagaagctatgtctgttctcaagcttctgttcattagtctgtgaactggggctgcagcgagaagagacagtggatccctgcaccattatcccctggtcccagggcttgtataccgtagggaaggggtgattcagagggatgtgtaggtcagtgtgagtacaataacatcaaagttgtttgacctaaggtcaggctttatggtaagttcttggtcttacacgaggaacagcgcataagctggaaatctcagagggtttcctggaactggggttaatcagaagccacatggcggagtagcatccacgatggagctacttcagcctccacagtccactcttgtaatccagctcttgtaatctcacatgccctcttcttccttcatggtccctgagcctttaaggagggtgcttgatactgtatagctttagcagcagtgccttggtcatggaaaacagatcgggcccagtgggattccaaacaagggagattcacaggcttttaaatcgtcttcagtcttcagaatgcagtggctttggttctgtcagaataggcaaaacaatgtgagatatataacatcgatcactcggatagtagaattctgtgcacacagagattgcaatagaaagagaatcgcctgtaatcccagctactcaggaggctgaggcgcgagaatcgcttgaacccgggaggtggaggttgcagggagccgagaccgcaccaccgcactcccgcctggatgacagtgagactctgtctcaaaaaccaaacaaaaaaaccccagaattcgtgggccagaacaacaatgaaaaaagaacgtattctgttaagaagccaactaaaatgcatcatgatgaaaattaaaactcggttcttctttagagacttgttgcagccaggaaatggttcaggattagcccaaattgtaggcagataataaaaactcacaaacaatggttaaggctagaatctaaatttttctttctccagtttccccatttctaccagggataaattatatatataatagtaagaccaatttatttgcaaaacaaattttagttgctttatacttggcctgaagatttgcatcaaatgtagcaagaattgtgatccaccatacggaccctttttaagttggctttgcaggaacctttataaggaattttggatttgactttttaaaagcctcaatgccagatattgatctgttttcaacttttttgattttttttttttttttttttttttttttttttggagactgagtttcgcttttgttgcccaggctggagtgcaagtagcaccatctctgctcactgcaacctccgcttcccgggttcaattgattctcccgcctcagcctcccgagtagctaggattacagacatggatcaccatggctggctgatttttgtatttttaggagagatgggatattaccatattggccaggctggcctcgaactcctggcctcaagtgatctgcccacctgggcctcccaaagtgccgggattacaggtgtgagccaccacgcctggctactacttggttactttgtaaccccgcctctttgatgggtcaagaaaagttgtggttatattatttatcttggtttttattattattattattttattttttgagacggagactctctctgttgccaagactggagtgcagtggtctgatcatggctcactgaagccttgaccttctgggctcaaagtaatcctcccatctcagactcctgagtagctaggactacatgcatgcatcatcacacccagctcatttttatgtatttttgtgtgtagatggggtcttatgttactcaggctggtctggaactcctggggtcaagtagtcctcctgcctcggcctcccaaagtgataggattacaggtgtgagccactgcacttcgcttttttctttttaaagagaaaggatctctctatgttgcccaggctggacttgaactcctggactcaagcgatcctcctgccttggtcttcgaaagcactgggattacaggtgtgagccaccaggcccagccagttttaatttctgttaggtggaatgacattccaggtttctaaaaataacttctacttggttatttttcaaaagttttgttgagttcagtaattatataaggtttataacataatattatttgaaactttcatccacatcctattctttactggtagagaaaagccacatataagaaatacatgtgtgtttgtcttttataaatatatgttacccagttttccagttactagctgcaagttttttttccaggtcataatttggagaaaaatatatgcgtgaaaattataacgataaagcttattttctatacaacaaacagtgagtgatatggaaatgtatgtccttactagtaattttaaaagtacaaaagagaatgccttaaaagtacacacacacacacacacacacacatacacacacatacatatttttttgagacagagtctcactctgttgccgaggctggagtgcagtagcgcaatcttaactcactgcaacctttgcctcccgggttcaagcaattcttgtgcctcaccctcctgagtggctgggattacaggcatgtgccaccacgcctggctaatttttttgtacttttagtagagacagggtttcaccatcttgggcagactggtctcaaactcctgccctcaagtgatccacctgcctcagcctcccaaagtgctgggattacaagtgtgagccaccatgcctggccgcattatatactttttaaggcagagaaaattttctaaaacttgatgggtggcctgttgttgctggttcacttcttctaaagaacagaagtaagaactgtaacactgtccgaatcctgggagagtcgccttagaagatggtcctgtagatacaagagaataatttactcaatgatacgaatataattgagaatagcaaaaattgaacagcagccaaattggtgatgagtgaggtaactctggtaagtcaccctgatagaatatattccatttattcattgttcatagaatatattctatttattcgttgttcttccaacctttgttgaagccccactctgtcagactcggcaccaagtgtctgagatgccttcgctcattacatcttcacggctcccccgagaagtagatgttactttcattatctgcattttacaaccaaggaaccgggatattaaattacttctctaggtcatgcagctagtgtgcggtgggctaaatgtacaatccccctaataataataataataataataataataataataacttacaacaacagcatattgaaataagaataaaaatttgaaaaatctctttgattcgtaaagatgaaaaaattgattctagttgttggtggtgagaggaaagggaacgcaggccctctgaaacactgttggtgggactacgaattgcagaaacctttttgaggacattttgcatatcttcagaatttcacatgtcatgccatttgaccaagtcctttcacttttagggatttaccctatggcaatatttgcacaagtacaaaaatgtatgtatgagaatcttggttactgtctttcttgtaatagcagaaagtgggaaatcacttgaacatctattaggtggaaattatggtctgtccttatggtggaatagttgtaaccatttgtaagaatgagatagatctgcgtgtacccatatgtgcaaaagagccaccgtgaattgtttttttttttttttgagatggagtctcgctttgtcactcatgctggagtgcagtggctcgatcttggctcactgcaagctccgcctcctgggttcacaccattctcctgcctcagcctcctgagtagctgggactacaggcgcccgccaccatgcccagctaatttttttttgtatttttagtagagacggggtttcaccgtgttagccaggatggtctcgatctcctgacctcatgatccgctcatctaggcctcccaaagtgccgggattacaggtgtgagccaccgtgcccggccatgaactgtgaattgaaaaaagcaagcaactgtaccatatgtaaaacatgatctcattttccataaaatagcgtgtttaataatgtgggtctagagagataataatacatgcattgaaggatatatacaaatttatatatagcgcgtgttctttacagtgggattagaggaacttgtactaatattttttttgctttgttttttttttgcaacagatatgattttattattagaaaaaccagatttaaaaaaagccattatatgagttttcctagttggcaaaaattcattatatgagttatcctagttggcaaaaaaggcacttaagtgaggaaaggagatgcaaaatcatccttgactgtaaaggggtgcaggtgggatatgagcttgtctgggtatgagaatatcatgttctatgcattttttatttcctaaactgcttaaattataaatcattaatggtaattattaaaagactttgttttccctacaattagaaaaacttatttgaagacctcaaatcccaaaagtgaaagaggaaaaaaaaaattattgccacggtttttcccttaacccatttaattaaagaattaattaaattctatgttgcagtttttcaccaaaagtgcaacatagagttagttcagtcaccacaaaaagattcagagattggattttgctgacttagtgaagctactaagatacaaattcacaaagtaaatgtttgcacacattagctacagtggcaaagtgtttgggaggttgcagtccacctcccggtgagggagatccatccttttggtcagcaaatgccctgaattgaccctctcccgagggtcagctgcaggctgtgctgatctcggaacttctctgggggtccagttctgtttaggacagaccataaaatacatctctctggggtgggtagagctaccccagtacttaccctggaaatggactcagctgtccctggagggtgactcagttgaggcagaattgtcttaatttggtaactctcctaatttgaagcagaagtcctgggtttgacccagacccatcttggtctggagtggagttgtggtgtgtctaatgctgccagatcatgttcactgttagaagcctggggaagggaaggaacttgctcagccaactcagaagcaggcatagcgcaagagggaggattttaagaattagtattttactatccttgtgagctggtgttattgacaaacattatttcaatctgtttaacgattttaagaattagtattttactacccttgtgagctggtgttgtttctaaatattatttcaatctgtttaacaattccattttttaaaaaccctgcactttgggcaggagttcgtatttctaatttaggatgaattttttctcatctccccccattctgtgattctaattttttttaagttatttcagttcttaaaactctttcatagagctgggcatcagccgcaattttctctaaatctgtctcagatgagcacttgcagtctaattgtataaaagatcaggaaatttagtattgaagttgcacttgctttgatgtaatgatgaatgtttccttcatctgaagagcatttgaaatttatggaaaagtaaatctttttgaattatatgtaaatgaaaacgttgggatgaaccaggttatgtttaactgggcagttttgaaattctaatagctcctacaagcgggaatcttttaaagctaattttgtgatatgaattgtttattattctaaagaataatattcacttttttttcatggatctcatgtaaatgttactggacaatatgacccatctctttaaaaagtgaaattgttagtgggaagctgtggctcacacttataattccagcactttgggaggctgaggcgggaggatcacctgagcccaggcatttgagaccagcctgggcaacagcgagacctcatttctacaaataataaaaacattagctgggtgtggtgacatgcatctttggtccaagctactctggaggctgaggtaggaggattgtttgaacctgagaggtggagcctgcagtgagccctgatcgtgcccctgcactccagcctgggcaacagagtgagacctccatctctaaataaataggtaaaggtaaaatcactgctcagtcactagagagaggagagagaaaagtaaatatactcaaggagtgggaaaagctttgaagtggcatatcaaaatgagaaaaataagtgttttttagagagaaaagatttgtggagaattatatattagaactatttaagacttcttaaaacttcacgattatatggttttgtaaggtttttggggattttcataatgagatgtagatggaacgtccccattgcccatcatagactattcaggcaagttcatacccattcctagaatggagaaccgtctcctctgcggtgaagaagcgcccctgttccttaagaggcagcagcaggaggtggaaaacaacatcccgcttgctaaagtcatgggccttagtccaggcgcggaggctcacgcctgtaatcccagcactttgggaggccaaggcgggcagatcacctgaggtcaggagttcgagaccagcctgtccaacatggtgagacccagtctctactaaaaatacaaaactgagccgggtgtggcagtgggcgcctgtaatcccaggactttgggaggccgaggcgggcagatcacctgaggtcaggagttcgagatcagcctggccaacatggcgaaaccccgcctctactaaaaatacaaaaattagccaggtgtggtggctcatgcctgtaatcccagctgttcgggaggctgaggcagaattgcttaaatccgggaggtggaggttgcagtgagccaaaatagcgccattgccctgcagcctgggtgacagagtgagactccgtctcaataaataaataaatacataaaaataaagccatgggcctcgatgggaggctgtacattgacgtgcgacattcgacttctgccattatttcagatttcgcacctgcccttctggcaacatggtgttgctgtgaggatcttgagaggagatgaatgatgctttccaagtagtaagtattattccattagggaaaataggaataaaattggaaagcatcaagtatttgaaaggaaacgaaaacagggcttactttccctttcggccagcgttagaagggtgcagtttggaattgaaagtgaaaggagcatgcacgtgttcggggcaggttgcggggagagtgaagatcattttaaagaccctggtgctttgatcttagagcaccactcatttgtactcagttcagatctaagtgaattactgtgcaaacgacatgacgagagaggggcattttccaatagtagcttctggtctggcacatgagccagttagagattgacacacgcagtcatgtagctgctataaattgaagcctggtgatggacgtactacaggcatggctgcagcgaatgcctatgacctttcacttctcctccctctgtcactctgtgtattcgctctctccattttcctccctcacctattcaccagccatgaatcaggagtggactgggcaaggatcagcctgtagggaaatgatgtgggccgagggtaaagagtgaggaataattaaggcagcccttgaattagttgtacatttttttcttttgtgtagtcttcttttttttttgtaagcaaacaaaaaccacgttgctggccaaatgtagtggctcatgcctgtgatcccagcactttgggaggtccaggtgggaggattgcttgagtccaggagtttgagaccagcctgggcaacatggtgagaccctgtctctataaacaaataaattaaaaaaattagctgggcatagtggtacccacctggagtcccagctaatggggagactgaggtgggaggattgcttgagcccaggaaactgaggctgcagtgagctctgattgtgccattgtactccagcccgagtgacagagtgagaccctgtctctcaaaaacaaaaaacaacactttattatggatgatttcaaacataaacaaaagtgaagagagtagtataatcaactctcaggtacacgttacccagcttcagttacccactcataacctttcttgttaatttctacaaaaagcttgctgggtcttgttgaatctgttgatcaatttgggaagaaatgccatcttaacaatactgagtccttcaatccaagaacctggtatctccttacatttatttagatattatttaatgtatcaacaaagttttgtaattttaacttactaattttgatgctattacaaatggaattatttcttaattttgtttttggattgttcattgctggtatacacaaaacagttgatttcctgatattgattttgtatcttatgaacatgttaaacttgcttattagttctagtagttttttgtagactcctgaagattttctatatatagagctagtgaatatgaagagttttacttgttttccaatctgtgtcttttaaatttctttttcctgccttattgttctggatagcacctccagtacaatgttgagtagaaatggtgagagtagacatccttgttttgtttctgaacaaagaaccaacttttggtttcatcagttttctctattactttccctaattcattgatttctggtctagtatttattattgccttccttctgctttttttgggatttagtttactctcctttttatagtttcttaaggtggaaactcaggtttgtgttttttttttttgagacatgatctcgccccgtggcccaggctggagtgcagtggtgcgatactggctcactgcagcttccaccttccaggctcaagagattctctcacctcagccccccaaggagctgaggctacaggtgtgtaccattgggccagctaatttttatttttattttttgtagacacagggtctcactatattaccaaggctcttcttcaactcctgggcttgagcgatcgtcccagcttggccttccaaagtgttgagattacaggtgtgagccactgttccctgctgatgctcagtttattaacttgagacttttcttttttttttcctgatacaggcttttaacattataaatttctccctaagtacttctcatagctgcatcctaaattttgatctgctgtgtttttcttttcatccagtttgaagtatttttaaacttcccttgtgatttcttctttgacctttgaatcctttagatatgttttctaatttctaagtagttggggagtccacaaatttatttctgttcttgatttttaaaaatttcattttggtagagaacatgctttatatgattttaattcttttaaatttattgatacttgttttatgacctagcccatgattcattctagacaatgcgatatgtacacttgaaaagaatatatattctatttgttgttgcttgacatggtctacagatgttagttacgtcaggttggttgacaatgctgttcaaagtctgtatatccttgctgattttctgtttaactattatgtcaattattgagagtgggatattgaagtctccaaacattattgtgaattgcctatttctccctttggttcagtcagtgtttgctttattgtattttgtgctctgctattaagtgcttatgtatttatgtttttatatattcctcatgagttgacccttttattgttacaaaatttctttttctcttataacttttttgtcttaaagtttattcagtctgtgggatttttttgtgtttttgtttgtttgttttgagacagggtatcactctgtcacccaggctggagtgcagtggcacaatcatagctcactataaccttgaattcctgtactcaagcaatccacctgccacagcctcccatacttactttgatattattatagccactgcaactttcttatggttttgtttgcatagtacatttttctccatctgcatctcttgcagacagcacatggttagaacttctaaaaaatttaatctgacagtcttcaccttttattggagtgtttaatccatttacatttaatgcaattattgatatgcttggattacatctaacattttgctatgttttctctgtctcacatctttttgttctgtttctccttactgttttcttttgtgttaaatagatattttctagtgttctgttttcatctgtttggtgaggtttttaatattttttggttatatttttagtggttactctaaggattgcaatatgcatctcatcacagtctactttttaaagatctatatatagcttttaaaaagtagagatggggttttgccatgttgcccaggctggtttcaaactcctggattcaagtgatccttccatctcagcctcccaaagtgctgggattacaggcatgagccactgtgcctagagctcacagtctactgtagattaatgctaattcattttcaataaaatatagaaactttgttccattaaatgtctatgtctatctacctcctctgtggtattatgtcatgtatatgatatctttgtatgtcataagcccagtagtaaaagtctgtagttattgttatatgtacttgtcttttaaatcagttaagtgtaaaaaagagactatttataaatctgctgtatatttgcctatgtaattagtattactagcattctttatttcttcatgtggattcaggatataatctggtgtttttttctttcatcttgaagggcttcctttagtatttcttgtaagtagggtctgccagtaacaaattttctgtctttgtttatctaggaatatctttatttctacttgttagttttggggtatggttttgatggatatggaattcttgattggaagtttttctttcagtgctttgaatatgtcattttactgttttctggtctctgttaatttctaacgtgaagtcagctgttaatcttatggtagtgctccttttcatgaagaaccattttgtcttcatgcagtcaagattttctctttgtttttggcttccagcagtttggctatgatgtgtcatggtggctcactttattgagttggagttttttgagcttactttgagtttgttggatgtgaacattaattttttaaaatcaaatgtgagaagtttatgccattagtttttcaaaaatttttttctgcttccttttgcttcgttttcttttgaaacttcctttatatatatgttggcatgcttgatggtatccctgtgtttctgaggttctttttatttttctttatgcttttttatttcttcttcagattggataattttaagttcactgattctttcttctcccatgtcaactctgttgttgagcccctctagtgaacttttcattacagttattatacttttgaactctagaatttctgtttggtttctttttataatttctgtctctttattagtattctctatttgatgagtcattgttacatactttcctttagttctttaaacatgaattccttcagttccattcttacagtagtttcttataactttgaaatctttgttaagtccaatatctgggcccccttagagtttccagttatgactcttgcctgagtataattcacaatactttatgtttctttgcatgtcttatattttatttttttaagctctgtattttagttaatacgttgtagcaactctggattatgatcacctttggcaaaatgcaggtttgttgtttatttctttttgtttgtgacttgcctggattaattctgtgaagtctgtctctgtagcagctgctgatgatcctgctcattttttttttcttatttttaaaatgtgtttaagcctggctttgcaggggttaacccaggtcagcatagcttagtggtcaggcaatgattattcagaggtgtgctgaaacaccttgagctactaatgcttttcacagtttgcggtggatatgtgtgtacgtttagggacatgttcagaattcaggcatatattatacgagcctgtcttggtttttcctttttgccaggccttttctggcctcctttgtgcgtggggtaggcctcactttagccaaggatgagtggataaccagggccctcttcagtctttcctgcctgtgtgcagccttccagagcacgaagaatgtgtgggacttcagggactttaccactgcccgtgatagctcccttattctctgtatcttccggctaggtttttggctggtctcctgatctgttggttgccacaaccggcattgcaggctcagggtggctgagatgttgaccttctgtacatttcctgttgtttacaggaaatcaccgtggtttatgtcagtgcctttgggcatgtgctctcctccaaatcaagtcaacccctccagcagtggagccaccaattttcacagctcgtcccaccctggtagatgtagcagcatgggtgagctgaggggaaggaggggagcccctcaagccaaagcatcacagaacaccaccgctctaactcaagatttggtcatttttcttcttcattttattttttaattcttgagatgaggccttcctctgtcactcaagctggcgtgcagtggcacaatcatagttcactgtaacctcaagctcccaggctcaagagattttcccacctcagcctcctgagtggctgagactacaggtgtgcatcaccacgccaggctgacttttttgtttttcgttgagacggggtcttgatatgttgcccaggctggtctctgactcccagcctcaagcaatcctcctgcctcggcctcccaaagtgctacaattgcaggtgggagccaccatgcccagctgcgtagtttttcttgaataaacatttttcaattttttgtatgtctttggttgatttccaaccctgtggtggttgtttttgaccgacttgtctagttttgttgttactttttgaggagaggttttgccaagcttctcacttcattattccagaagttcttcccctctccccaggtcatctttttggttttttcttctaactttctttccttctttttttttctttttttttttttttgcgatggattctcgctgtgtcgcccaggctggagtgcagtggcatgatctcggctcactgcagcctctgccttccaggttctagcacttctcctgcctcagcctcccaggttgctgggattacaggcacccgccaccagctaatttttgtattttttagtagagatggagtttcatcatgttggccaggctggtctcgaactcctgacctcaggtgatctgcccacctcggcctcccagagtgctgggattaaaggcgtgagccatcgtgcacggccggtttttcttccaactttctaagtactataagcttgttgtaaaatttggcaatatagaaatgtataaaatggaaatgaaaatctttactaatcccatcccttaaagatagccactgttaataagttagtgacttgctttccaagctttaatcatctttctttaatcatcatatttttgattatatcctcttaccaaaattcctttacccctcaccacaaaggtttctaattcagagacttcctttagctcccttgattcaaggagataaagttaattagcaatcaggagatgaggagccctttcctggcaaggacagaattctaagacggagggatttttagctcctcggtggactcagttccgctgcaccttttgcagcatcttgcctgctgggtctcctctctgcagttttcttgttccctggccttttatcctcctgatcacacataccttcccaggttctccaggaaagtagtggatcagtcacttccccctgcaacgtcattgtaggcatgattacatcttggagtgttctctcaacaagagtcagtgtagcatggggttccgggcctgagctctggtgtcacattgcttggagttcaaatttcaattcttcttcttttttttttttttttcttggagacaagagtttctctgtttcccaggctggagtgcagtggggcgatcttggctcactgcaacctctgcctcccaggttcaagtgattctcctgcctcagcctcctgagtagctggtactacaggtgcacgccaccatgcctggctaatttttgtatttttagtagagacgggggttttaccgtgttggccagggtggttttgaacccctgacctcaagtgatcttgccaccttggcctcccaaagtgttgggattacaggcatgagccactgcgcccagcctcaactctctttttttttttttttagacagagtctcactctgtcactcaggctggagtgcagtggcacgatctcggctcactgcaacctccacctcctgggttcaagcgattcttctgcctcgacctcccaagtagctgggattacaggtgcccaccaccacgcctggctaatttttgtatttttagtagagatggggtttcactatgttggccaggctggtctcgaactcttgacctgaagcgatctgcccaccttggcctcccaaagtgctgggattactcaactctccttcttagagtcctttgtgaccttgggttccctgggccttggttttctcatctctgaagtggggctgggagcaactcttggagcactgggttggaacgtgctggccacagtgctcacacatcgagaacacgccgtaaatgctccccgggcctccgcttcctggtgtcgtcatccttattcagaatgaacaagaaatcactccttcagagtaatgtttcagacagaggagagagctttgtgggggccctctggcgtgctcacagaagctttggtattcgtcaaccactgtaggagccaagcatttcctacagaatgcagggagcagggctggcggggagatagtgcgtgaaaagagaggctggtgttgggaaagaaacagagacagaacggtggccggcggacaaacgacaataagccaggatgatggtgtcactgcagccgggtgcggagtttctttctggggtgatgaaagtgttctaggttgatggtggtgatggttgcacagccctgtgtgaatatgctagacaccactgaattgtaccctggaaacagatgaattgtacggtatgtgaattatatctcaataaagctgttattaaaaaaaagatggacagtcccagctactcaggaagctgaggcaggagtattgcttgaggccaggggttggaggctgcagtgagccgagattgcaccacggcactccagcctaggcaacagaaccagacgcttctctttaaacaaaaacctaaacaattgtagatttttttaaaatgaggctttttgttttttttatgccaaaacccttcatagacatgaaataacagaagagtaagattggcgggggtgggggggggtttcatcagtacaggttacctgaaagaactgagttgttggtctgacctctgctaggactcgccatgtgtcatggcaggcctggcacctgaaggagagctttagcaatttgcactcacatcatcctggacctcagcctgggtgatggtcactgtcttgagacagcttcagaacaggcaacctgggtgtggccgccttgtcaaccagagataataaaaacacaggtaaacctctgcacctccatcgtcactccgaattataacaacagcacatatttgttgaagtcttactatgcactaggcacagtgctgagtgcccatgatgcagaggggaatttgagagtgtcagtcatttctgccccttcggatcacgcactgctttccagtgttcccaggagaccagttttgaggttagaattctgcttcttacagtgaggactgattctgactcctaggaggacgaaagccccttttaaatttactttggctgggtgtggtggctcacggctgtaatcccagcactctgggaggccgaggtgggtggatcacttgaggtcagcattttcagaccagcctggccaacatggtgaaacaccatctctactaaaaatacaaaaattacctaagtgtggtggtgcacgcctatcgtcccagctacttgggaggctgaggcaggagaatccctggagcccgggagcggaggttacagtgagctgagattgcatcactgcactccagcctggatgacagagtgagactcgtctcaaaaacaaaacaaaacacaacaaaacattactttgaagccacagcattttgcacaggtaggaaaactgctgggcctggagatcttctataaatatgttgagagctgatgttgaagagattattgaagaatcctgatgtcacagaattttctatagacaacctccttgcggggagggcgcagctttcgggttctgtatcgcacaacaccggctgggagctccctgcatgtgtgtttccagcactgcctgtctatgggagctaaggaagtggcttcaaaaccgcttgccagagacgcgcagtcacccagtcgttgcagcgcttgtacttgtgggagctgtcttgcaggctcaggcatctttgataaggaattcctcatacttagaagtggcacctttgttctgctggggaattgttcccaaaaggtatctttttttttttttgaaacggatcctcgctctgtcgcccacgctggagtgcagtggcaccatctcggctcactgcaagctctgccttctgggttcatgccgttctcctgcctcagcctcccaagtagctgggactacaggcgcccggcgccacgcctggctaatttttttgtatttttagtagagacggggtttcaccgtgttagccgggatggtctcgatctcctgacctcgtgatccccccaccccggcctcccaaagtgctgggattgtaggtgtgagccaccgcgtctggcctttttttttttcctttttgagacagagtcttgctctgctgcccaggctggagtacaatggcctgatcttgactcactgcaacctctacctcctgggttcaagcaattctcctgtctcagcctcccgagtagctgggattataggtgtgtgccactatgcccagctaattttttgtatgtttagtagagacagggtttcaccatgttggccaggttggtcttgaactcctgacctcaagtgatctgctcgcctcagcctcccaaagtactgggattacaggtgtaagccaccacgcctgaccccaaaagacatctaaaaaggctttttcacttgtgaaatctgctgaatagagctggcttcctgaggcctgggggcccttcccggtgtggaagaatggctctgctgttggctaccacagtgctggggcctgtactcccacctcctctgcctctgtctgccttgtgtgcctccccttccgcgggggccctgctctctgcctctttctgaccttccagagtttttgaggtgtgagtgtgttgttgaatttcatttacataataattaaagagtcagggtttcatgatctactgatgtaaaacccgcaaaaaccctaaaatctcgagtggtgttgtacagcatgtgggattcttttgtataacttgatgattttcaaaatatccatttcggctgggcacagtggctcacacctgtaatcccagcactttgggaggtcgaggcaggtggatcacgaggtcaggagatttagaccatcctggctaacacagtgaaacccgtctctactaacaatacaaaattagccgggcatggtggcgggcacctgtagtcccagctactcgggaggctgaagcaggagaattgcttgaacccgggaggcggagcttgcagtgagccgagattgtgccactgcactccagcctgggtgacagagcgagagtccgtctcaaaaaaaaaaaaagaaaaaaatccatttaatcagagccatacttgttgattactacaggtgcttcccgtatctaatacctccagcaagaaggtttgcgaaatgggcagagagtaataggaagagtttcaggaagatggtttgagtgaaaatcatttcagaaccgagccctgcgaagtcttggtttctgcaatccaccacagtttgggaaaatcgggaattttgtttagtccatttctatttttgtgcaccacaaatatgtaaacaaagctgggatcttcgtcgggggcggggggaagggcgacagaaccctgacatctaatactggtcatcggtatttccatgtgtttcctgatcccattgtctctgctatttaaattaattaattccacaagtatgcactcagtaaatattgtgagccaggcactattctcggctctgtggttgcatcagtgaacaaaacagacgctaatcctgctttcgtgagccatctataatagaatgggcgagtcaagaaattgacacatgcattagaaaaatatgtagcgtgtcgctggtaagtgcttgagagctcatcagggaagggcaggagtttgtggagtgggggtgagggatgtggggtggggcggggcaagggtggcaagaggcctggggctgctggttgcaactgtaaccagagtggccagggaaatccttgctcctctgggtaatgccctatccagaagacccttgcaaatttctaaaatgctgtgttttattaccgagaaagagtcgtctgggagctctccgaggcaaataacttttgaagttggcatgagcaggatattgtgcaatggggctcactggctgcgtcccaggcctccgcatctgatgtgaaccacagctttgcaatcggtccccgtgccatccaaaaatattttgtgaccttgccggttggcagttttttaaaaatgttattttcagtctccaaaaaagggaaacatcaaagtgcaggctgtccactcctgcccttcttgatagacacagacagctgggccacacaatcagccattgtggcgacaagtgcccaactgttataaatagacggcgggctcgcacgtgaagcgctccagaggaagggcaagtgctctggggacactgccaactgctgtttccgtcgagagctcttctcaaagatcaatattattttatgtctcagtgactgaatttgaaaaaacgactgtgaaagcacctggtaacttaactgtctccaggattccattccaaacgcatcttctctcttcactgttaatcttagatgtttcccatgcttatttagtaatcattgcctgacggcccacttcactgcgatttacagtctcttgcggctcacttgaaatggtagagttatggataaccgcgctggtgtatgtgcgtgtgatgcgtggccggaagcgcatgcccattgaataatcacgttcgtcccacatcttagcccctcttccaagacatgtttactatcgtttacgtgtgacatgtcaaaacatcttaaaactatgccacgcatgtaataggctctcagtgattaaaaaatcagtttgtctcttaaggagaaaagaataacagcatgtgactcttgtgagtccctgacaaagaatctgttgttccccgtgcacttgaagagccgctcatgtcaagaagcaacttgtgattatgcaatgtgtgacttaaggcattgtcagatgcgttcggctgaaacgggaccccgccccagcagtttgccttactaagttaacatggtaggtcagattttagtattgtagaaaaagccacattcaatattctttgagtagcatatttatttcctagggctactgtaccaaagtacctcaaaccaggtggcttcaaacaacagagttacacgctagttgatatctagtgattcaaagaacagaattccacactagttgttatctaggaatgcggagtgagtgatagagggggttttggtggcgttatattctaattttgaagtaagtttaaatttacagagatgctcccaaacagtataaagaattcccaaatactcttcacccagattccctgaattaacattccgacatgtttgtctgtctgtctctccacatacacacatcccttttttccggaataatttgagaatagactgcagagagtgcctctagattctcctgtgtgggtttcctaaaaacaaggacgctgtcccggatagcctgcaccgacctgcccaaatcaggacgtgggcactgtcacaccatgccaccaaatgcagaggccccggagcccgcccaggaccacaggcgccgtctgtgtcaatggctctcgagtctccttcaatctggggctgttccttcgtctctgtctttcacgaccttgacatttttttaagagaacaggccagttactttgtagaatgtccctcggtttgggctggtctcatattccttcatgatgagaatcaggtggtaggttcctggcaggagagtccctgcagggttgtcacgacaggaacgcacacaggtctgatcagtcccatttctggagaagttaacttatcatttggttgaggtggtgtctaccaggtttctccactgtaaaattaatttgttggtattttgtaattatcagttaaaaagtactgtttctggtggggagattttttggggactcggaaaatatcctgtttctcattaagctttttgcccatttgttttagcatcctgggatgattcttgcctgagggaattagtatgagcattgccaaatggtgatgtttctagttgcattgtttcttttgcattgattagttggcattccactgcaagctggagcttgcctgctgtctttctctccttcctatcaatacactcatagactcctattttacccattgggttataattcattaccattatcatttgcttcgatacccagattgtcccagatttggccaaaagcagcgcctccaagctggcccctgtgttcttttgatgtgttcatgtcattctttgagcacatctttacttcttcttcttttttttttttttttagatggagtcttgctctgttgcccaggtgggagttcagtggcgtgatctctgctcattgcaagctccgcctcccgggttcacgccattctcccgcctcagtctcccgagtagctgggactacaggcgcccgccaccacgcccggctaatttttgtatttttagtagagacggggtttcactgtgttaaccaggatggtctcaatcccctgacctcgtgatctgcctgcctcagcctcccaaagtgttgggattacaggtgagagccaccatgcctggccaggttttttcgtttttgtttttgttttttttgagatggaatctcactctgttgccccggctggagtgcaatggcgtgatcatggctcactgaaacctctgcctcctgggtccatgcaattctcctgcctcagcctcccatgtagctgggattacaggcgtgcgccaccacacccagctaatttttgtatatttagtagagatggggtttcaccatgttggccaggctgatctccaacttctaacctcaggtgatctgcctgcctcgtcctcccaaagtgctgggatgacaggtgtgagccactgctcccggccacatgtttagttcttggttctaggctcacccggaactttccttgctccagccctggaatcagccatttctccaataagccctggttccttttagtagaaagtggtttttagaaaccaggatctaagtattaggtgtgttcacgctactgggctattacggctacaaggacttctcaagcagcgtagttaggaatttttttttttttttttttttttttgagacggagtttcactcttgttgccaagactggcatgcagtggcaggaacttggctcaccgcaacctctgcctcccggttcaagcagttctcctgcctcagcctccctagtagctgggattacaggcatgcgccaccacgtccggctaattttgtatttttagtagagacggggtttcaccatgttggtcaggctgggtctcaaactcctgacctcaggtgacccatccatcttggcttcccagagtgctgggattacaggcatgagccaccgcgcctggcatagctaggaaattaaacatatgcatgtacttccctacacgtacacatatgtttgtacatacacacacgggcacacatgcgtttgtagttctttgtatccatctgtcccgctcgtatctatgtatccattcatctcatataaaaatcatgataccatccaagtcaaatggtttgtttcagctttctcccctttccttggctgtgcccctcttttctaacaataacagtaacagctcttatcatattaactgtttttatttattgacccttgtatgtcaccagtcttctgacatgcaggccatccagtccatgttcctggcccaggaacatggcagccaagggtccccacccccacttcggcccccaacagtggactctcgggatagttctttttttttttttgagacacagtctcactctgtcacccaggctggagtatagtggtgtgatctcggctcactgcagccactaactcctgggttcaagcagtcctcccaccctagcttcctgagtagcagggactacaggtgtacaccatcatgcccgtctacttttgtattttttgtagaaacagggtcggtcttaccttgttgcccaggctggtggatagttctttatagcagtagcctaaacagaaaaacatatacaacataagctaagaaaaaggcctcccttatcgatatttctgggttaatctgaaagattttgaagtctggaagaatcagctggttgttggtaaagggacggtggacatgaaggatgcggaagggatgggttggaggcgggaggtgagtttcatgtggtgtttttgactcagagggtcacttttattgttctgccttgtagtcagaagaaaaatcttttcacgtggtttcggctcagaagtatgttagaaagtagactacagagactgaaggtgacattccagagactttttaaggataatctggccaaaggtgtttactatttgattagccagcatccttgggctcggctagggtcttggtctggtctgagaacatgttgggggattgtgccagtgtcggtggtgggtgcctgtgcctggtcatctatgggcagctaggggtgggtgctgccccttccgactttctctccactgcagagacgaagccttcagcagcatttccctggaccctcttctctctggtcccaggtcaggttctgtacagcaatggaaagcaggggagaggatgcccacgctgtgcgtggccgtttggagcagactcagggaccagtgggacctcctcttctgggtgagcttggcaaccactcttttaggaattccagtttgtaatgccttccgggtgagccctgtgagtcgcttgctcttagtagtgtcctttgctgccccagccttctgcttccctgtatttaaaacctttctgagccaggattacgatttcctgataccatgactgacccttggtcgttatgagtcctgatggtcccaggagcttttccttcatttgcttgggttttgagttgtgagctggagaccaggggttttgcttgatggggacattcctggctcttctcctggggagtgaccatgggccctgcctaggtgagatcctctggattgtgaggagggacttgagcagccctactagagtgccgtctatgggaaccctcagcatcgcctgtccaagccagcatctagtggacgctcacgctgtgtgagacactgagcttatccagcaagggcagaaatggcagctcttgggaaagaagggagtggggcatcgctgtgtctcctattatttgccattgtggcctccctctccaggtgcaccgaggggcctatctgtgtgattcttgcaggggtactgacgtccgtttcatctcacccgtgtccctctacaagtgcaggagttgtagggctatgttattcttaggtagcttaatggatccattttcataataaactccattttattttgtttgccattgtactgccatttgcggaacaaagagaagttatataaaccacagaagggggagaatgtgacccaggaataaactgttgtgtttcacagtaagtgtatggaactaatttagaatgatttttcattgtcaaacaaagaacaaatggaaatttgaacaatgcatggttacttttaacaaagacttcattttaatgttattagtgttttctcattttaaaatggcagtgcaaatataaccttaaaatagggtttatgactaattacatttcttttttgtatgtctgacaatttccaattattgggtgtttgtgttccccagcccaccctcccccaaaaatgacagggaacagaaaccagtgaaaagatctctctttggcgcccttcccagactaggacctgttttgttcagggtgagcacagaggagaactgggtcctcttgtcaggctgaaggggacgtcacagaagccccaagtgggtcacggcagagcgtcagccagaacctccagggctcactcccaggcctcagtcaccagatgcttcgtggctacctgggtaagggagggttcagggcaagttagggactgcaatgagaaaacaacacactctggccggatgcggtggctcacgcctgtaatcccagcactttgggaggccgaggcgggcggatcacctgaggtcaggagttcgagatcagcctggccaacgtggatttcaaccaaggacctgcttggtcatagatttcaaccgaaggacctgattggtcatggatttcaaccaaaggacctgattggtcatggatttcaaccaaaggacctgattggtcatgcagacagaactttgaaggctgtcatgggttgtgtccatgttgtttggttttccatcttgaacgaataccagtgtgcgtctaacagctcacacagaagcccattggttacaaaggaattgcaattgtcaatccaattgccccccagggagaactgaagatttttttaaataatgtcttcgtaacagctgtgtaagtcccccaggcccttaactagagaaaccacatcacagaattttatttactttataaattctaatattttagaattaagataatttgtagtttagatgatttttgctaagctagctctctctttctttttatctcttcctttctctcttttctttctttctttgatggagtctcaaaaaaaggagaagggtgtccaaacatcctggatgaaaatggctccatgctatcatagaattttatttactttataaatcctaatattttagaacttaaaaaagatactttgtagtttagatggttatagttaagctatttcattttttttaaaaaacgaagaaattagcattcaatgtctgcctagaaacaatcttatatacagtccttatgtacaaatcttttttgtggaatatgttttcgtagttttttgttttttgttttagattgggtcttgctctgttgaccaggctggagtccagtggcgtacttatagcttactgcagcctcgacctccagagctcagtcagtcctcctacctcagcctcccaagtagctgggactgcaggtgcatgccagcacacttggataatttaaaaaaaaaactttttttttgttgttttgttgagacggggtctcacttatgttgcccaggctggtctcgaacttctgggctctagcgaagctctttcattttagaaaaggatcatgtcacctcgatatgtgaggtctgtggaaaatcttgctttaagatgatctgcgtgaactagtagcttagattattgagtcttattttcttcagaactctgataggcacaattactagatttaagttaaagggctgtaaaacagcctcagtactttttcatgaagtagacaagtttcacagtgctttggaaatgactactaagctactcccagcctgctcattgagaactcacgatttcctctggatgagtgggaatgttgttggttctgcatttgtcatcagtgcttaggacacacacacacaagcaacgtgtgctggcccatgcagtttttccttatttacaaagctcatgtgagaattgtgactctgcccattcgtggatctgcacaacatatggtgacgaatataagttcgggggcgtggggggaatgcgcatgtgctatggttcagtgctgggcactgggtgttgtggttcagtgctgggcactgtgtgccgtggttcagtgctgggcactgtgctgattgcttctgcgactccggacagatacttaaggctcagctcaggttcgtcattaacacgaatcacaaattcagacctggtgccgtggctcacacctgtgatcccagcactttgggaggccgaggcaggagtatcacttgagcccaggatttggaggccagcccgggaaacataggaagacccccaactctacaaaaaatatgaaaaaaagtttagccaggtgtggtggtatgcaactgtagtcccagctactggggaggctgaaatgggaggatcgcttgagcctaggagttcaagaccagcctgggcaacatgatgaaacctcatctctacaaaaaaaaaaaaaaaaaaaaagaaagaaaaaaagcatggtggtgcatgtctgtagtcccagctactcgggcggctgaggtgaaaggatcacttgagccaaggaggtcgaggctgcagtgagccaagatcgcgccactgtactgcagcctgggcaacagagtgagaccctatctcaaaaaattcacaagggttttcaaagctagttactgcctgagaccatcttcccctcttggatggatgcagcaaattgggaggcaaaattatttggctcttttttttttttttttttaaggcagagtcttgctctgttgcccaggctggagtgcagtggtccgatctcagctcactgcaacctcagcctcctggattcaagcaattctcctgcctcagcctcctgagtagctgggattacaggtacacgccaccacacctggctaatttttgtatttttagtagagacagggtttcaccatgttagtcaggctggtcgcgaactcctgaccttgtgatctgcccgtcttggcctctgaaagtgctgggattacaggcgtgaaccaccgtgcccagccgcgtttggctccttcctaactaaacagagattaaactgtttattcttacctgggctttcattttttcatagcagtcactttattttcatctctttgtcctcagcttcccctcaaatatttgtcaagtgtctaccaaggctgggaatgatagtaaaaggagtttaaaaaacaaaagaggctctaaaaatggtactagactcttccattcaggactttgtccaaagcctcactttataatgcttttgtgatttatcctcattcccataaactcagatgatacgaatttatacgagtttgcattaataaatatttcttgcatgcttgtcttatcaaccataccgagccagcacagcctcatctcgtaaagagttggcagtcacgtgcgggagccgggagcccgttgctgtgaggccgggaagtggattgttggtctggggaaagatttattttctgggggcaaaagaggcggggtggagagtccctccgcctgcctggagtgctgatgtggcctcagagctaggtcctgaaaaattgctgggatttagatgcaggctctacatgtagagagattgtttaaatgtataatggttcagaagtgacactctcttgctatgtttctctgaaaatagatcagccttctctgttgggatctatgaagctccagagataaaactgatatacattaaagtggctcgtggttaaaggaagtatgtttgttaatattaaaccgaggtttctctggtaactagattttaaatgatttgattccataggtttataatggagaaatccagatctccaaaatgtaagttttactatatgggaagccttttttttatttcctttgctgtgtttggtaaatagcctggaagaaaatggctccgtcctatcacagaattttattatttacttcataaacctagtgttttagaattttttttttgtttttttgtttttttgttttttttgagatggagtctcactctgttgctcaggatggagtgcagtggtgcgatctcagcccactgcaacctccgcctcctgggttcaagcgattctcctgcttcagcctccggagtagctgggattacaggcacacaccaccacacctggctaatttttgtatttttagtagagatggggttgcaccatgttggctagactggtgtcgaactcctgatctcaggtgatccgcccacctgggtctcccaaagtgctgggattacaggcatgagccaccgtgcctggcctagaattttaaaaagattctttgtagtttagatggttctagttaagctatttcatttttttaaaaaggaagaaactagcattcaatgtctgcctagaaaacaaaaataaaaaaacaacaaaaaaggaagaaactgaggtctgtggcacttaagtgccccactcaaggttgcagagttcctagtgatgttattttttaatgaacttttcttctccttctcttttttgttaaattttggcagactgttttaccaaagcctaactgtacttttcttaattaactttggaatgaattctggatatactcattccagcaatgcacagaaaattctaggcaaagaataaaagactccacattgtttattattattatttttgagatgtagtcttgctctgttgctcaggttggaatgcagtggcggaatcttggttcactgcaacctctgcctctcatgttcaagtgagtctcctgcctcggcctcccaagtagatgagattacgggcagctgagattacaggcacgtgccaccatgcctggctaatttttgtatttttagtagagatggggtttcaccatgttggccaggctggtctcgaactcctgacctcaagtgatcctcctgcctcggcttcccaaagtgctgggattataggtgtgagccaccgcgccgggccagactccacattgtgaaaaaacgagggaaccgcttctgattttgctccagtggtgtattcctctgtcttgttataatgctttatgtttacatataacacattatacgatttttaaagcaaccccacagggaagagttttaattttttgtttgtttgtttttgagacagagtcttgctctgtcgcccaggctggagtgcagtggcgccatctgggctcactgcaagctccgcctcccgggttcacgccattctcctgcctcagcctcccaagtagctgggacttcagtcgcccgccaccacgcccggctaattttttgtatttttagtacagatgaggtttcagcgtgttagtcaggatggtctcgatctcctgacctcgtgatctgcccgcctcggcctcccaaagtgctgggattacaggcgtgagccactgcgcccggccgagttttaatatttttagtcctgttttacaaaggggagaaacgaagcacagagaagtttaggaacttgcccaaatcatacagttgataagttagcagaccaaaaccggaatcgtccaaacggagtggcagccagaaagcattttataggtaaagtcacatcctacactgtaaataaaaacctcttggaacacagagttcgccaggtggctgttggattttcatgtcagcgctggtctagctccgttttgcaggattttttgttgttgttatcacagtatattctaaaaataactatatgttcatttccactctttcagataattaatatttataaatcctagtcactaggaaatatagttcaaccaacaattgaatggaatgcaggtcctctgggaacttatctaaaattaaatcctattttaacagaattagctagattaaggtcatggtgtaaaaactgatttttcagaaggaaataaaaatgcaaaatatcctaagaattcattttgtaaataattgaatcaaataacaatggggcggggaagaagccatatatttttcctctctttttagaaatgaattgaaggccagacatgctggttcacatgtaatcccagcactttgagaggccaagcgggagaattgcttaagcccaagagtttgagaccagcctgtgcaacataggaaaaccctgtctctacaaaagaatttaaaaacagctgagtcagctgggcgccgtggctcacgcttgtaatcccagcactttcggaggctgaggtggatggatcataaggtcaggagttcgagaccagcctggccaacatggtgaaacccccgtctctgctaaaaaaacaaaaattagccaggagtggtggcggacgcctgtagtcccagctactcaggaggatgaggcaggagatctgcttgaacccgggaggcagaggttgcagtgagtcgaaatcacaccagtacacttcagcctgggcgacagagcaagactccgtctcaaaaaaaaaaaaaaaaaaaaaacttagctgggggcagtggcacatccctgaggtcccagctacttgggaggccgaggtgggaagatggcttgggcccaggtgatcgaggctttagtgagctgtgattactccaccgtactccagcatgggcaacacggtgaaaccttgtctcaaaaaaaaaaaaaacaaaaaaaatcagataaataaaaacaaaaaattgtttagactcatgaatcatcaactttttctttttctttgcccattttcttttttaagtattagcttggcattaaagcagtagtatatgaagatggaatttgctagtactttatttgtgattccagagttaaatgctactgcaatcaagtcttccttgaatttagcaatagatttaaaagtttagaaagagcctctttttttttttttttttttttggttttaatacggggccttgctttgtcgcccttgctcgatcgcccagtgatctcagctcactgcaacttctgcctcctgggtttaagtgatcctcctgcttcaggctcccaagtagctgggatgacaggcgtaaaccactacgcccagctacattttgtgtttttagtagagacggaggtgtcaccatattggccaggctggtctcaaactcctgacctcaggtgatccacctgccttggcctcccacagtgctgggattacaggcgtgagccaccatgcccagcccaagtctagctctttagaaggaaaaaataagggtagaaattcagagaaggatgagtgtggagtggcttccttgctctatttctagaacatgccatttcttgggaagtcttatgaccctgctggtctttaatgtcccctatatgattttcctccctgggctttgattctctgccttatctcctgtggtcttttccatccagaaattttgaaggggtatttaccttcaacttaaaactgactactacaggtaagtagtggccctgctgtttccaccctcccatgtctactggaagcagaattgtttcacctgtctcgttggaaaatcaaatgaggtaatggaaatgaaaagtactacacaagtgtgattattaaagacagttcagtcaataggtgaaaagactcgtgtagatactttatttaacctggaatcaatgtcttatactcagtagacactccttagatgtgagtttaaagatgtcattactcctataataccagcactgtgggaggccaaggcgggtggatcacctgaggtcaggagttcgagaccagtctggccaacatggtgaaatctcgtctctactaaaaatacaaaaattaaccaggtgtggtggcggctgcctgtaatcctagctactcgggaggccgaagtgggaggatcgcatgaacccaggaggtggagattgcagtgagccgagattgcgccactgcactctagcttgggtgacagagcgagactctatctcaaaaaaaaaaaaaaaattaagaagatgtcattttaatgagcagttctttgttaagtaaagaagaagaggaaaccaggaaatatgatagtgcttggccacctcaccaagtgtttgtcttaaaagaagctttcttgattaagtaaaaatttaaaaggaaggaaagaaaaacccaacctcaccgcaacaaactaccctagtctgaggtaattgtgtagtgtaatgtccctacacctgaatttttcatgcacctgcagatttaggggctctgcctatctttgagtataaatgtccactgaattattagcaaaatgatttgttctcagaaaccaaaattttagcctagatgaatgccgccattggagttatttatatgaaaaggcgtgttaagctcaatggtcttctcttctcttctcttgttttcttttcttttggatttgagacagggttttgctctgccacccagcctggagtgcagtggtgcaatcatgggtcaccgcagcccctacctcctgggctcaggtgatcctcccacttcagcctcccaagtagctgggactacaggtgtgcaccatcatgcccagctaatttttgcatttttcgtagagatgggatctcactatgttacccaggctggtcttgaacacccgagctcaaacgatccgcctgcctcgacctcccaaagggctgggattacaggcgtgagtccctgcacctgacctcaattgttcctttcagcaaaagtaaaattttaactttcaagggtgcaatcctgcttttttttttttttttttttttgagacagagtttcactcttgttgcccaggctggaatgaaatggtgcgatctcggctcactgcaacctctgcctcccaggttcaagtgattctcctatctcagcgtcccgagtagttgagattacagatacatgccaccgtgcctggctaatttttgtatttttagtagagatggagtttcatcttattggtcaggctggcctcgaactcctgacctcagaacatctgcctgcctcagcctcccaaagtgctgggattacaggcgtgagccaccgcacctggcctgcaatcctgcatttaaagcatttttaaagtgtcgttggaacacttaaaaagacaagaattaaaacagtagcagaacacctaaaatggcaaggaaacggcatgagggcgtgtaacacagaaaggggtgggtgtttgagaaacagcaccgcaagtacgtggggaagcagcaaagatggaggacatgggagatgggggtggaaaggggcttggggcctggtagtgaaagactttgcatgccacgttagagtctctgctctgttctgttagcaggagtttgtagtagtacctattcacagactggtgcgggttaactgtgagggtagtgcgtgtaaggtgcttagaacagtgtttgacacataatccgtattctctaaatcttagttgtaggagatgttgttgctattatttttataaaagggcaagcattacgagtttcagagcaaggcttatggggtgataatataatggaggatgaattggaagaggagaaactggaagcctggagaatggtttggaagctctttgctggggcccgagagacattcagggttcaggcagtgggagtggaaggaaagtagtggattccacagcgagacttggcagggcttgatggtgagggaaaggaaggagaagaaagtgacctggaggcttctggtttggatggttggggagtgatgaccccgagagaagagaggagagaaacagggttgtgaggatgagacccaactactctgttcctcttttctcaactgaaaccatgctgacttcatactgcaaagagtgtacagcgacacggtatctcagtccgttttactgctgcaacaaaatacctgcaactgggtgatttccaaacaatagaaatttatttcttacagttctggaggcagttctggaggccgagaagtccaggatcgaggccttggcattgggtgtctggtgccatgtcctcacatgacagaagagcaaaggctacggactcgttccctcaggcctttcatgcggttgctcacccctaagccctctcgtattagggtcttcatcccatttgagaaggtggagcactcatgacttcttccttacctcctaaagaccccactgcctttttttttttttttgagacagaatcgtactctgtcgcccaagctggagtgcaggggtgcaatcacggctcactgcagcctggacctcctgggctcaggcgatcctcccacctcagcctcccttgtagctgagaccacaggcgtgtgccaccacgtctggctcattaaaaacaattttgtttttgtagagacggagtcttcgctgtgttgcctaggctggtcttggactcctggactcaagtgattcttccacctcagcctcccaaactgttgggattacaggtgttgagccactgtgccagtaagaccccacttaatactatcccttcgtgatgaagtttaaacacgtcaattttgggggacatttagaccatagcacataggtttcaaaaatgagtcaaagccttaaatggattgtctcttttctagtaccagctgataggcctcacgtctgttcactgccttctgatgctcctccttaaccctgtgtaggactctgtagtacaggtctccgctcaaagacagttgtaaacgtggcacagttagtcaagagcattacaataaaaaatgctcagcatcactcatcacagagaaatgcaaatcaaaaccagaaggaaatatcaccttatgccagtcagaatggctattagaattatatgagaataatattaagaagtggggtcttactgggcacaatggctattattaatcccactactagatatctacccagaggaaaagaaatcgatctatcaaagggatacctgcacttgtatgttcatcacagcaatgttggcaatagcaaaggtatggaatcaatgtggccatcatcgaatggatgggtaaagaaactgtggtatatgtatatgcagtgggatactgtccagccatcaaggggaacaaaaccctgttatttacaataacatggatggaactgaaggtcattattattatgattattttttatttttattttttagagaagagtcttgctctgttgcccaggttagagtgcagtggcacaatcatagctcactgcagccttgacctcctgggctcaaatgatcctcccacctcagccacacgagtagttgggaccacaggcatgtaccaccatgcctgtctaattttgtttattttttgtagacatggggtctcactatgttgcccaggctggtcttgaactcctggggctcaagcgattgtcccaccttggcctctcgaagttctggagttacaggcatgagccaccatgcccagcttggaagtcattaagtgaaggaagccagacacaaaagacatattgcatgttcttatatgtgggacctaaaaggtttgatcacatggaggtagagagtggcaagaagggtaacagaggctgggaagggtgagtggcggggaggagaagggtcaagagaagtcggttaaagggtacaatcatgcagtaacgtagaaggaataagttcaaggcttgagagcagagtaatattattctaatattatatatattctcacctaacaaaaaatgtattgtggctgggcatggtggctcccgcctataatcccagcactttgggaggccaagacaggcagatcacctgaggtcaggagttcgagaccagcctggccaacatggcgaaaccctttctctactaaaaatacaaaaattagccgggtggttggtgggtgcctgtaatcccagctactctggaggctgaggcaggagaattgcttgaacctgggaggcggaggttgcagtgagccgagattgcaccactgcactccagcctgggtgacagagcgagattgtctcaaaaaaaaaaaaaaaaaaaacaaacaaaccccaaaaccaaaatgtattgtatttgagtgatgggcaccctgaatgccctgacttcatcactgcgcattatatacatgccataaaatttctcacataccctccaagtttgtataaataaaaagggggtgttgaatacagactttcaaagaaaaagcattctgctcaaaactcataaggggacgtggtgtgtgtgtgagttctgaaagaagtttgaaggaccagggttgaccacatgatcacgggaaacagcagctcctgggttgcttcaaggtgctgtggctgttggtggatgaaatcagcctactaggagataggaagatacaaggagcttctccagtgtactggaagatcacagctctggcatcatgggatctaaggagctggcttgtctttagtgaagggaggggggctggggccccttggaatcttttttttttttttttttttttttttttggagatggagtttcactcatttgcccaggctggagtgcaatggcacgatttgggctcaccacaacctccgccttccgggttcaagtgattctccaccctcagcctcccaagtagctgggattacaatcatgtgccaccacgcctgtctaattttgtatttttagtagagacggggtttttccatgttggtcaggctggtctcaaaactcccgacctcaggtgatccgcctgcctcggcatcccaaagtgctgggattccaggtgtgagccaccgtgcccggcccccttggaatctttaaggccaagacctgggaggctggaggtcgagcatgaaacaaagcgaaatttccctgagaaggaagaaagaagtgaggattccctgaaaccaagaagcagctctgtgttcccatctttcctcgtgtgtgtcattggcttcccatgcatataggctttgcgaggcaatctaagcatgtgtgcacgtgtgttttgtgtttttgtgtataattgagtatggctgacttttgagtgggcacccataatcactctgtatggcaattacacttatattaactttaatccatttcagagtaatgactcataatatttaatacccacatatcattgtgtattatatattaagtaattattaagatataatagctgtcctgtggttctttctgcagttctgcaatgcataagtaaatatatatctacttagcacctggcagaattctgacactggttccctggagtgagggctgttgtggtagcaaaggccaagtggaagctgccagaactgcctctgtctaccaaaatagtcaacccaaagcaattatcacattcctgggaggatggcagagattagtgccaccatcagggacttgaaagatgcaagggtggtgatcgtgtcacatctccgtttaatccatatttggcttgtctagaagacggatggatcttagagaatgacagcaggttgtcataaacttaaactaggcggtgactgcagttacagctgctgtgccagatgtgtttttgttgctggaacaaatcaacacatttcctggtacctggtatgcggtgagtgtcttctccttctctacctggtagtaaagatgaccagaagggtcttgcttccagccggcaaggtccacagcccgccttcatagttacacttcaggggtctgtcagctaccagccttatgttatcacttcagtctccttcttcattccatggggtgccaacggataaccactcagatagaatgtaaaaggactttgggccaggtgcagtggctcatgcctgtaatcccagcgctttgggaggctgaggtaggcagatcacttgaggtcaggagtttgacaccagcctggccaatatggtgaaaccccatctaataaacccctactaataatacaaaaattagctgggcctggtggcaggtgcctgtaatcccagctactcaggaggctgaggcaggagaaactcttgaacctgggaggcggaggttgcagtgagccgaaatcgtaccagtgcactccagcctgggtgacagagtgagaccttgtctcaaaaaaagttcataaaaggactttggctcctcttctggggagagggttagcatggttttggttgtaagacggatagtagcattatatggcatggaagcctagttgctatttacttgatttggaagttaagtacggttgaaaagaggagtagatatggacaccaagttgacaaggggtacgtgtagtgagttcgttttgcgtcaccttggctaagttggagctctgtatgtaacttgagccacaagagaccatttgtgtaagaccgagaaggcagaggggacacagcagccacatgcactgtggctcatgcacgtggtctctgatctgcaggctcaccttgttggcgcacggcagccatcaggcctgtacctcttctgaaacccaccaaatctttcgttgttcccctcatctgcgtatgtggcagacagtttttctatgttttcaggcaattgttgagcaaataataatagaatttttgaacaggccagcatcggtgctaatatgtgccaggcacagatctgagccctttagagtatttactcatttaatcctcaaaaccctgtaaagtcactgatgttgccataatctgtcagactcagaaactgaggcacaaagaggttaagtaattgcttaagccttcacaggaattgggatctgaacccaggcattttggtgtcgagtccatgaactgacgaagaacatagataactgttgtcagcttgtcaaggctcatgcctgtaatcccagcactttgggaggccgaggcgggtggatcacaaggtcaggagattgagaccatcctggccaccatggtgaaaccctatctctactaaatcataaaaaattagcgtctgtagtcccagctactcaggaggctgaggcaggggagtcgcttgaacctcggtggtggaagttgcagtgagccaagattacaccactgcactctggcctggcgacagagcaagactccgtctcaaaaaaaaaaaaaaaaaattacttcaaggagagactgctgagggttcctctgtctcctgtgtggatggaatttggcctccatttggaatcgggaatcttgcatatttagttctgcagtattacgtgaatctacggaagcaactcatttggaattagattccaagccgttataaataataaattttttgtctctgtcatttttgtagtaacagcaagagaaaagaatttaggaccaaaacttatgagagttttaaatattttttgctaagtgcttatatgtgatttatgggaaaatcataatttttaccctggaaggcagccttactcataaagaatggccatcttgtagcacctccaggacatcagtctgaagtctaagttaggtgtgtttgcacagcaaccaaatggtgagagcatttagcagctgggggacggcggcattgttgtgattgggttgccacgtggtggggcgggtgagggacggcagcagagccttggcagagcggagctgtgtggccgacggcttcctctttcttcctccagcgtgcgattataacttgttgctcatgcaccggcatgcagctctgtttgctcagtctgtttttctgtaaagtctctttttaaaaaagtatatgatacaggctgggcacggtggctcatgcctgtaatccgagcactttgggaagccaaggcaggtggatcacttgaggtcaggagttcaagaccagcctggccaacatggtgaaacctcacctgtactaaaaatacaaaaaattagccgggcatggtggtgggcacctgtaatcccagctacatgggaggctgaggcacgagaatctcttgaaccagggaggcagaggttgcagtgagccgagatctcaccattgcactccagcctgggcaacaagagcaaaactccatctcaaaaaaaaaaaaaaattgtgtgatatagatggaagaccacgtaaaataaatgtacaatctgattgttataaggtgaccgcctttgcatatctaccaggcaggttgcaggagagcacagccagccacccagcagccgtcctgccctccacctgccgcagggggccagatcttgccattcctggtggtcccgtctctgctcttcttggttttctttctttcgttctttctttttttttttgagatggagtcttgctctgttgcccaggctggagtgcagtggtgccatctctgctcaccacaacctccacctgctgggttcaagcaattctattgcctcagcctcccgagtagctgggattacaggcacgggccaccatgcctggctaatttttgtatttttagtagagatggggtttcaccatgttggccaggctggtctcgaactcctgaccctgtgatctgcccggctcggcctcccaaagtgctggggaggtgtgagccactgcgcccggactttttggttttcttatccaactgtgagtccttcaacacttggcgtcgggtgtttggcttgtctgttttttggcttgcttttgcttttttctccaacttttaatttaattttaattaattaattttatttatttattgagacagggtctcagtctgtcactcaggctggagtgtagtggcacgatgatggctcacctctgcctcgacctcccaggctcagatgatcctctcacctctgccccctgaggaactggaactacaggtgtgcaccaccatgcctgattaatttttgtattagccagtggtttcgccatgttacccaggctggtctcaaactcctgggctcaaacaatccacccgcctcggcctcccaaagtgctgcgattccaggtgtgagctactgtgcctggccttcgcaacttttcattttgataaatttcaaacctacagaaaagttgaaataatagtataatgaacactaatatcccacttcacctgattgacccgtggttaacattttgccaaatttctttggctgtctcagtgtaggtgtgtatatatgtatgtgtgaatataattatacacacatttgtgcaagaaccctgaatgggatataatacagtacacacatatgtatgtgcatatgtgtatgtgtgtgtatctatatttgtcctcttttttctttgctgagccattgaaccgttaactgactaaattgcagacattgtggccctgcacccttaaattcttcagcatgtatctcctatgaacaaggacattctcctgtacagacaaaacaaattatcctactcaagaaatataacattgacagaatactcttataaaatatatagttcatgttcaaatttccccagcatctaacagtatcctttagagcttttatggtgttcatccaggatccaatcagggatgatcttttcctaaaagaggacactcaagatctagatctagaacagttccgcacatttttttttctttactgctattggcatttttgaagagtttggtttcctgtttcttaaaataaattttgcattgaagtgtaatatgcatgcataaaatgcataagtgtacagtttgaagaattatcacaaaaggaacacatccactaaaccagcacccagatgaaacagaatatcccagaagcctccctcgtgtccctcccaacgctacccacttcctccttctaaaggtaaccatgtcctgacttctggcaccataaattgcgtttgcctgtgtttgaatttcgtacaaatggaacctgcagtgtgtattctttttttttttttgagaccgagttttgctgttgttgcccaggctggagcgcgatgccatgacctcgactcactgcaacctccacctcccaggttcaagtgattctcctgcctcagcttcctgaggagctgggactacaggcacccaccaccatgcctggctgattttttgtatttttagtagagacggggtttcaccatgttggccaggttggtctcaaactcctgacctcaggtaatccacccgcctaggcctcccaaagtgctgggattacggacttgagccactgcccctggtcagtatatattcttttgtggctgcctctgtcactcagtgtaaagtttgtgagcttcattcctgttgcctgttgcttacgctggggttccttcatcgtcactgctgttgtgccttctcggtcatatcacaacgtatccatcgatcctcctcttgatggatacatgggttgtttctgggctttgacttttacaataatccctgtgaatacttacgtactgtatcctggtgcacacttgcatgcatttctttggccgaaatcaatgtctagaaggggaattattgagccatagagtgtgagtgtcttcaacttccatcggtaataccgacttgttttacaaatggtgataacaaatggtgataacattgttatcacctcatacccgtcagcagagtatgagggttcctgtgggtggctctgcatcctcaccagcgcttgtcactctgttgaattgcagccactctggtgggtgggtgcagtttcttttggtaattttcatttgtgattctgtatttgatttgcagttccctggctgagtgtcttttcatatgtctgctggccacctgggttggctcttcagtgaagtgcctgttcagctttgttacacatttttctactgagtggtctggttttgttttcttattgttgggcttgttttgttttgttttgtattgtcttgagacagagtctcactctgtcgcccaggctggagtgcagtggcacaatctcggctcattgcaacctccacctcccgggttcaacattcttttgcctcagtctccccagtagctgggattacaggcacgtgccacctcacccagctaatttttgtatttttagtagagatggggtttcaccatgttggccaggctgctcttcaactcccgacctcgggtggtccaccaaccttggcctcctaaagtgctgagattacatgtgtgagcccccgggcctggcctcttactgattttgaggagttctttatattcaggctaccagccctttgtcagttatatgtgaggcaaataccttctcccactctagttttgcctttttactacgaaattgccatttttgtagatcgaaatggtcaaatattggcaattggcatatggttcagcctaccataaaattgatccactttttttctttgttaggtgaggactttttttgtcctatttctctacttctgaggtcatgaaactataatattatttcctagatactctattgtttcacttttcagatttatgtctataatccacgtgaaatgtgaactgatattttttgtgtacactatgaggtagggatcaagttttactttaaaaaatatatagctaggccgggcgcagtggctcacgtctgtaatcccagcactttgggaggccgaggagggtggatcacgaggtgaggagttcgagaccagcctgaccaagatggtgaaaccccgtctctactaaaaatacgaaaattagccgcgtgcagtggcaggtgcctgtagtcctagctactcaagagactgaggcaggagaattgcttgaacccgggaggcagaggttgcagtgagccgagatcgcgccactgcactctagcttgggtgacagagcaagactccatctcaaagaaaaaaaaaagaaaaaaagaaaatagataacgaattgagcactttttattaaagaaagttttactaaggtatcatttgcacactatgaagctcagctgtgaaaagtatacaattttatttttagaaaatttagggtatcatctggttttagaacatttccatcatcccatgaggtccatcatatctggtttcaggcaatacctgcttccagtcccaaaccacaaatctactttctgtgtctatagatttgctttttctagacatttcatataattggaatcatgcactattgtagtcttttgtagctgacttctcaattagcttattgtttttgaggttcttctgtattgtagcacagatcaagtatttaggtcctttttcgtgagttaaattcggtggtgtggatatatcacagtgtgtccatccattcaccagctgctggacacgtggattattcccacgtcttggctgtaataaacagagctgctctgaacatcgcttgcaagtcttagttgtttccatttctcgtgagtagaggcttggattggaattgcaagattgtatggtaacgtataattttattttgctaattatcatttgtgaactgacttttttctcttgctatacggttctaaggatcataacacatgtataggttttgtagccaccagtacaatcaggatacagaacagtttaatcaccccccaaaaatctttcccaagggttgaccttttaatatgatttggctgtgtccccacccaaatctcatcttgaattgtgactcccacaattcccacatgttgtgggagggacccagtgggaggtaattgaatcgtgggggcaggtcattcccatgctgttctcgtgatagtgaataagtctcacgagatctgatgggttttttttcttttttttttttttgaaacggaattttgctcttgtcacccaggctggagtgcaatggcatgatcttggctcaccgcaacctctgcctcctgggttcaagcgattctcctgcctcagcctcccaagtagctgggattacaggcatggaccaccacacccagctaatttttgttttactagtagagatggggtttcaccatgttggccaggctggtctcgaactcttgagctcaggtgatatgcccacctcggcctcccacagtgctgggattacaggcgtgagccaccacgtccagttgatctgatggttttataaagaggagttcccctgcacacactctctctcttccctgccgtcatggaagacgtgacttgctcctccttgccctctgccatgattgtgaggcctccctagccatggggaactgcaagccagttaaacctttccttcataattacccagtctcggataattataaagtctttatgaacagtgtgaaaacagactaatacaccctttatgggtgttaccagtggagggtcttgactacaagttgtctgggttcttaaccagattcttggcattttgaacaaagaattggacaaaatgcacaaacaaagcaacgagaaaacgaagcaagggaagcacagatttactgaaatgaaagtacactccacggagtgggagcaggctcgagcaggagcaagtggctgattagagaattttctggagccttaataccctgtagaggtttcccattggttacttggttacaccctatgtaagtgaaggagtggcctgtgaccagtctgattggttgcaggaggcgaccaatcagaggttgaagtgaagttgcaacgttacacctgaagacctggcctgggaccagtctggttggttgcgggagggaaccaatcagaggtactttccatttttcatctgccacgaggtgcaaagggagtagtagcctctgatccttttgttacctgggtatggttttccttttgattcagttctaaaaagtcagggtgaatcggccttaagttccctgcctccaggcccctgccgacccagcaacaactatccattccctgtagttttgcctttgggagcctgtcattaaaatggaaccacacagcacgtaccctttgaagactggtttcttccacttagtctagagctattgagattcgtcctggatgctgcatgggtctctagttcattccttgtgatgctgagtagtgccccattgtggggagggaccacagtgtgtttatccattcatcctgggaaggacattaggttggtttccaggttttggcaattatgaatagtgccgctacaaacatttgcgtacagcgttttttgtaaacataaggtttgatttctctagggtaaatatccatgattggggtttctgggcgtatggtcattgcaggattaacttttttttttttttttttttttgagacggagtcttgctgttgttggctcaggctggagtgcaatggcgtgatctcagctcactgcaatgtccgcctcccgggttcaagtagttctcctgtctcagcctcccgagtagctgggactacaggtgacgccaccatgcccagctaatttttgtatttttagtagagacagggtttcaccatgttgcctacgctggtctcagactcctgacctcaggtgatccacctgccttgacctcccaaagtgctgggattataggcgtgatccaccgcgcccagcctctacttcagtttcataatgggctttaatttgtgaattaacttcttgatgtatctgctcatccatccattcattcattcatttctatattcacccaacaaatagttaagtgccttacttctgtctttgctatttctttgcctttggagcactgttttgaaagagccagcgcccactgtcagctgtccagctggtagcactgtcatctggaagattttagatactttctcatgagtgaatctacaccagcctgaatctcacactacctgacatcctctcaatcgtagccacacccaagggtcctactttgctgtccccactgccaccagaccaaacacacccccttccctgaaagtctgggagtcggtttcttcttcacaatagaagttggcctctgctggtcatgccccaaaccttctggagctgcgggttctgccttctctgcagctgccttcccgtgggctgccctggtcagtgcaggacatggcgcaggacctccgccctgccacacccccgggccatttcctcggcaggcctcgtgccagacttctccaaaggactgaccgcgtgtgccttctccaccttgcacacactcgcacaccaacctgccagcctggcctgtgctcttcgccgcccaaacgcacctctccctggtgtggtcactgacagtctttgcgtggccagtggccaaacccaggctggctttcctagtggcctcatcttctctctgcagcgttcacagtgatccacttctttttttttttttttttggagacagagtcttgctctgttgccctggctggagtgcagtggcaccaatgtccgctcactgcaacctccacctcccgggttcaaggcaattctcctgcctcagcctcctgagtagctgggattacagtcatacaccaccatgcctggctaatttttgtatatatatattttttaatagagacgggggtttcaccatgttagccaggctggtctcaaactcctgggctcaggtgatccacccgcctcggcctctcaaagtgctgggattacaggctttagccatcacacccagcccccctccctacccctttgtccctcctcagagccctgctggcccacttccctggccgttcaaaacattgcagctccaaggctgcttcccaggcctccccacctgctgtcttctccctggtgatattatggacagtggatctctggccctgagctcccttctgatttcatggtatagccacctccttgtccctatcgcttgagcgtgtcaccagcatcttcagcttgggaggtccagaactgagctcctgattttgccccctaaacttttacttcttctggtctcactcatccgtccacgtactgaaggcagaacccaggaacccaggaagtgtccttgttccctttgttcacatcctgtcggttctgcctagaccttaaatcatgaacctgacctaaggccactccagcttttgcctggaccacagcaaaaggccaggagtgagcccccgcttctactcctgacacctccggagccattcgccacccagagctgtgtaggctttaaaaagagccagccagccgcgtgggatcctggatgggatcctggaacataaatcaggtgaaaaattggtgaaactcaaatcaagttcatcgtctagttaatttcctgttcttgattatcaagctgtgcttgacgtcgtacaataagacattcacgttaggagaagtggagcgagggatatatgagaactccctgtaccgtatatgtaactttcctatatgattaacattagtttgaattaaaaagttttaaaaaattggatgggtgcagtggctcatgcctataatcccggcactttgggaggctgaggtggccggatcacgaggtcaggactttgagaccagcctgaccaacatggtgaaaccccgtctctactaaaaatacaaaaattagccaggcatggtggttggtgcctgtaatcccagctactcaggaggctgaggcaggagaatcactcgaacccaggaggcggaggttgcagtgagccgagattgtgtcattgcactccagcctgggcaacagagcaagactcagtctcaagagaaaaaaaaaaagttaaaaaattaaaatgcaaaataagaaagaatcgaactgtgtgctgtcttacttaaaacactgcagagctcttgtgtgtgcctagcatgtaagtcagatgcctcttgtcgttttgagacagagtctcctaccgtcccccaggctggagtgcagtggcgtaatctcggcccactgcagcctccacctcctgggttcaagcgatgctcgtgcctcagcctcccaagtagctgggatcacaggcatgtaccccgcctggctaatttttgtatttttagtagacacggggtttcatcatgctagccaggatggtctcgaactccttacctcaagtgatccgcctacctcggcctcccaaagtgctgggattacaggtgtgaatcactgcacctggccaggcagaaacctcttaatggctcccagggcctggcccacctccccagcctcctctcatgccacactttcttccctcagtctgcatcgggaacagttgccacctttcagccacgtgagcatgctgggaccgtcctttccatgctgatccctgcatccctcgtgccttccccagacctacaccaccgcaattgcctccatctcactgtgatatctccacttcagtctcatttcttcagaaaggacgtccctgactctgtccaaaccgcatgttgggtattctctattgcaggaagcttttgctttcttcctggctcttaatcacagctggtgactcgggtccttgcttgtggattctccctgccactggttcctaccactgagtcaggtgatggacgccatgttcacagttttatcaccagcgtctagcgtggcctgcagcgggtgctcccatagaacccataaacaaacaacttcttgtttcttattatgtgaagaaagttggtctgtgtaattcaccctccagagaaatgacagcactttcagtactttgttctgcccttccttgatctccacgctgtttgcagatggaccaccgttgtagagatgtgatttgattcttgacgtttctgagtgtccacggtgctgcgccttcccccaggtactacagtactgagattaataagacagagtcaatgtaaggtgttagtaggatttagaataggtctaatctcattcttaacggatttcaggagcttattatgtgttgaaagaatgaataggataaaagttgttaagaaattttctccgtttaatttttatttattaatttatattttagagacagggtcttactctgacacccaggctggagtgcaatggtgcagtcacagctcactgaggctttgaattcctgggttcaagcaatccttctgcttcagcctcccaaattgcggggattacaagcatgagccactggctctggcctattttctccttttaaaaaaaattgctgcagatatacacatatgcacggatatacacatacaaatatgtaccttatacatatatgtatataataaatacatgcatatgcagaattgtggcatagtcttagtctttttttttttttttttttttttttgagacggagtctcgctctggtgcccaggctggagtgcagtggtgcaatctcggctcactgcaagctccgcttcccgggttcacgccattctcatgcctcagcctcctgaggaactgtgattacagcatgggccaccaggcctggctaatttttgtgtttttagtagagatggggtttcaccatgttggccaggctggtctcaaactcatgacctcaagtgatcctcccacctcggcctcccaaattgctggaattacaagcatgagccaccatgcctggttgtatttagtctttaacctgtcctcaggctgtttctctctgggcagggagaagcatggaaagggggatgggccctggtggccacctttgaagcatggaggctccggtgccaccctgcccttaggctgggcacaaaggtggctgagggaaggctagtcagctgctggaggtgtcctttatggtctcagtgattaaaggttatgttgtccatgaatttaattttatttcatgatggaaaagaggacattgcaaattaagtatgtcacagaaatgtaaggagccacggggtctgatagggctgagggtgagtggcttgccgtcgagtttccagaaggcgttattatggaccctaaaggggatttcatgcgtttcaaagactctaacagaagtgttctgatgaagtggagtctggtgctgggacctgccacttcagcctggaattgtcctcgtgtgaagcgcagtaaaaacccagaatggatgtcggcaataagggaatttctgggatatgatgggggaacgaatattgtcacctccatttgtgtcaggaagtctcactatgcagatgagtcagctgcagggggtggcctcccaggctgctggtggagcccagaagcagggggcaggcgtttggcctctgatactctcctagctctgagttgggacggagctcgtgtatctacagtgtgctcacacagacttggtgccggtagatggtgaggggataggttggcaggtgggtagggggcctcccaaggcagtagggacctggaggaggctggtagaaagtggagattggccaaagtgacctgaattagattctacctggttcatgaatttgcctgaggctaaggcttcagcgcaagggatggtggagtaatacctttcctgaaacacctgctgccggcgtggccttgtcggtctctgccagatcttgttagcactgtggcttcaggcctagttaaacattcaagcccaatgcggttggagagcacccatggcacgcccattgtgcagcagtgtgtttaatacatgtgctgcttttaatgggtgtgaaagatcagagagcttgggtgtgtgttttaccaaccactttttaaactcacatagtaaaatttatagtatataaaaagcagaaaatatggtgtatcttctaaatattcacatttaaaacattttttagaaataatgtatgtcaagcaaggtcaagctaatgtgtttatataggctctaaattagagttgtgaaccagtatctcatcccacttatagggttttttttgaaaacgttcaaatgtttccagctcttttgtttctttattctaaaacattatctgctattttgttcgatagagtaactgtttctattccactttctttttttttttttgagacggagtctcgctctgtcgcccaggctggagtgcagtggcgcgatcttagctcactgcaagctccgcctcctgggttcacgccattctcctgcctcagcctcccaagcagctgggactacagacgtgtgccaccaagcccagctaattttttgtatattttttagtagagaggggttttcaccttgttggccaggctggtctcgaactcctggcctcaagtgatccacccgcctcagcctctcaaagtgctgggattacagacgtgagccaccacgcctggcttattccactttgtaattggctatccctgctattaatatacagggtactctccctctcgtatttgcgtctaaatgtcatctataataaataacagtgaatacttactgatttcatatttagttttacttttatcccacccattttcttttagtagttcttatgacttcacgtttatttaataaaggtaaaaaagaactttctgtttccaattcattcctttcaccaataaggaaggatgtggatcttcactgcttcctacatagctgccagcctcatgtagctgtttaaaatttaaattataattgaaatcattaaaaaattaattccttgttcatactagctacatttcgagtggtcagtagccacatgtgcctggaggccacagaactggacggctacaggatgtacccatcatcacgggaagttcatagaaagttctttttctttttctttttctttttttgagatggagtcttgctgtgttgcccaggctggagtgcagtggcgcgatctcagctcactgcagccttcacccactgggttcaagtgattctcatgcctcagcctcccgagtagctgggattacaggctcccgccaccacgcccggttaatttttgtatttttagtggagacagggtttcaccatgttggccaggctggtctcaaactcttgacctcacgtgatccttccaccttggcctcccaaagtgctgggattataggcatgagctaccatgcctggcatgtatctcttcttctctaagtactcagctgtcttgtttgaggctagtacctccactagtctggaaccctccttcctgggctttctgcccacttccatctctcctttgacaacagtggtttttccagggtctgtgcagagctcagctttctgccataagacaggggagtttctgaagactcctcaccccttttgggagtgagggctgctgactgaagctccaggtcactgttttatgagctagctctccgtttgttgatggccggggacccagcctttgtcccctcctctcgtgcttgggcactcactactcactgcctcggttttgctttcagttttgattgtgcattgagtccacaacttcaatgggattttcttaaggcataaatgacagttgcatggtgtgcagtgggagaacaaatcgcccagcctgggacatccctgggtggcagagtggacctgctctcaacttatggaatgtgcagcaacaccttgaggttattaataaatacctgagtctgggcatggtggttcatgcctgtaattccagcactttggcaggctgaggccggaggatcacttcaggccaggagttcaagcccagcctgggcaacatagtgagattccatctttaaaaaaaaatttttttttaaaagaaggtgggcttggtggtgcacacctgtcatcccagctacttgggaagatgaggtgggaggatcacttgagcccaggacgtcgaggctgcagtgagccgtgatcatgccactgcactgcagcctgggtgacagagaaagaccttttctcttaaaaaaacaaaacaaaacaaaacacacacacacacacacacacacacacacacacaactgcgattcttccagaaaagttcagaaaaaggaagtccgaaatacatagtccatagtatttcagccaccagtgctgctgaagtgaaattagagatagcagagatatctcaggagaaaatggaggtttttgggtttctccgttagatgactcgagcaagtctgcatgtgctctgtaaacaagaaaacacagtctgggaaactgtcagcctctgccccagccagtgtgcaaaatactcttcaaaagagagaaaactagaaaacaagttgaaaaccgggtgatctgacaagtgtggaaattcacagcaagcatgtgcctgtgctgcagatacgatctgggagagagccagcagcctggatccacatttcccagaagcaacaggtggtgaaggcagcggcatgactgctcccgcggaaggttagtcacgcatgttcagcatcagccgggcgcggtggctcacgcctgtaattccagcactttgggaggccgaggcgggtggatcacttgaggtcaggagttcaagaccagcctggccaacatggtgaaaccccaactgtactaaaaacacaaaaattagccgggcatggtggcaggtgcctgtaatcccagctactcaggaggctgtggaagagaattgcttgaacccgggaggcagaggttgcagtgagccgagatcatgccactgcactcctgcctgggcaacagagcgagactccatctcaaaaaaaaaaaaaaaaagagaagaatattccgcaacttagagcttttcctttgcatgatatgatgtttacaggcgaggtggctccgcagcctcggtggcctttcttccagctgaagatgcccacaggaggtgtcagtgcaggtataaccacctgtgggtcagaagaaaatgcctttgcaagtaaatctcctcctggatgaaaaggcccatctgtgttccaggcaaggacagtggccgcttctgcgtttctgtggccaagcgtctggcgtgcgggtgtggctgggctcaccatgctgtgcgggctacacctgctgcaggagaagtgtgtttgtgctcgaagaagacaatgtgggtgtcggcccggcgtttttaggttggactacaatagtgagagctgcaaattggatgattcttggagctatttcatgaaggtcaaattttcttttgttttgttttatttaatctctcccagacttctgaacttttgctatgttgaatttttagttcttcaaggttatttggccttattcttgacttgcatgtttttctgccctagctctaccacattatctttttttttttttttttgagaaggagtttcactctgctgcccaggctggagtgcaatggtgcgatcttggctcactgcaacctctgcctcctgggttcaagtgatcctcctgcctcagcctcccaagtagctgggattacaggcgtgcatcaccacgcctggctaattttcgtattttcagtagagacagggttttaccatgttggtcaggctggtcttgaactcctgacctcaagcaaccccccgcctcggcctcccaaagtgctgggattacaggtgtgagccaccatgcctggcccacattatctatttctaagcctttaatatttttcatttacctgctactgctcactctaccttgtattctcagggagggtgtatttcttcccagctttattttatttcttctctaaatctcagaattattgcaccttgttgatgttcacattactgtatttagtttattttattgtattattaatattattattatatttgagacagggtctcaccctatcacctaggctggagcatagtgacacagtcatagctcactgcagccttcatttcctgggctcaagcagtcctcctgcctcagcctcccaagtagctgagatcacagaaatgcaccaccacacccagcttccttttctttttcaaaaaaacagctttattgaagtataattcacatatgatgcaattcaccctctcaagtgtatgatttggtggtttttagtgtattcatggtgttgtgcaaccatcaccacaacctaattttacattttcgtcaccccaaaaagtaaccctgcatccgttagcagttacaccctctctctcctaaacccatggcagccactcatctgctttctgtgtctacagatctccctatgccagacatttcatataaaggggatcacctagttcgtggccttttgggactggcttctttaactaaacatcatacagctttatttccattttcagtgtattccctttttttgttttcaagtatttagtggctacctagtctcagattttaaatttagtttttcctttctcttctttctataatctatttttcatcatctacactgtgtgcttgaatcagcacctcttagaaacctacggatgagctgttagctctctagggacaagaacacggtctgggacccccgtccctgctgcaggtgtgacctgaccccctccctctgccgacgtgacctatccccctccctcccgtctgtggcatctggtgcatttggtgctgtcatttcacaaataaaaggtgatcagctggtggtctgtttcagttctggtatctttccccagctctcttgtttcatagcctcttcccattatttaaactctgctctgttacaggattcttaatagttattgcagaccttcatttccattttgttgtctgcaactcattgttgaagtgccatttgttgcttctgaacagcccatagacacttggacttgaatgcatatgactctcttcttgtgggtccagatcgtcactcactgactgtcctcacattcacagctgttctcaggacaagcaccgtctttccctttttcggatgtccctgtttacctgaatcaactcatttaatcctcacaacagccctgtgctatgatatgaccatcatatcacagcattttcgttttctttttcttttttttttttgagacagggtctcattctgtcacccaggctagagtgcagtggcgtgatctcggctatctgcaacctctgcctcccgggttcgagagattttcctgccttagcctcccgagtagctgggacttacaggcacctgccaccacagctggctaatttttgtagttttagtagagacagggttttgccatgttggccaagctggtcttgaactcccgacctcaagtgatccgcccacctcggcctctcaaagtcctgggattataggcgtgagtcaccgcgccggccagcatttccattatctagacaagggaactgaggtcaagcattggagtgaaagtcacctaggtggctttttttcttttttaacctatttatttctttcaacccttagcccagatcctaaccttcggtaagtactcagtaaacatttagtctgctgggtgcatgaacgagcgaatgagcaaatgaatgacagcgatagcacctggtgggctgttcgctggtgtgctgggtgtgctgggtgtgctgggtgtcgtctctcagagactcatttctacagtctttgtgaaggctcgtgctagtaaaccctaattcaagaggtttcttagaggtgggaggcgaaggtctctgaagtgtgtggactcctggactctccctatgttagcattctggaatgtagcatttagcagtggggcatttattaactcggaatacagaagataagaagccaagccaggcacggtcgctcacgcctgtaatcccagcactttgggaggctgaggtgggcggatcatgaggtcaggagatcgagaccatcctggctaacacggtgaaaccccatctctactaaaaatacaaaaaaaattagccaggcatagtggtgggtgcctgtagtcccagctgctcgggaggctgaggcaggagaatggcgtgaacccgggaggcagagcttgcagtgagctgagggagccactgtactccagcctgggccacacagcgagactctgtctcaaaaaaaaaaaaaaaaaaaaaggccaaaacaggggaatgtggtcactcaggggatgcctgtcattcccatttggctgtgatggcagctgtttagccattactgggagagagagggaagctgggtatagaaggtacctgtttagaagcaggggtggggaagcgggagggagagagagagagagaatgcgtgcacatgctctaaaattttattttctggctgggtgtggtggctcacgcctttaatcccagcactttgggagacagaggcaggcggatcatttgaggtcaggagttcgagaccagcctgtccagcatggcaaaaccccctctctgctaaaaacacaaaaattagccaggcatggtggcacacacctgtaattccagctactcaggaggctgaggcaggagtattccttgaacccgggaggcggaggttgcagtgagctgagatcgcgccactacgctccagcctgggcaacagagcaagactctgtctcaaaaaaaaacaaaaaaatttttttttggttaagcagaagatcaaattaaacaggcaaggtgcctaccctttgtttctttcactttcttccataaatccatctcatattttattatttgggacttcttttttttttttttcttttttgagacaaagtctcactctgtcacccaggctggagtgcaatggtgcgatctcggctgactgcaacctccgcctcctgggttcaagcaattctcctgcctcaacctcctgagtagctgggattacaggcatgtgccaccacgcccagttaatttttgtatttttagtagagacgggatttcgccatgttggccaggctggtctcaaactcctgagcacaactgatgctcccgtctcggcctccctaagtgctgggattacaggagtgagctaccgcgcctgacctgggacttcatttgttaagaagaggttaagtttcaccagcagccatttgtagtaggaacttgagatttatcatcaaatattgggacaacaagaacaaatcagttcttatgattatttatggtgcatatgagtaggaaggacttacaaccctccggagagcattttaatgttaacatatgaaagatattctctcttttgtaccaaaacttttgttcttcttacgcagaaagaatagataattataaaatatatctatgactccataggctttggctatttggtagattaagagtatttttatctttatttttcttattggctgattacagtttagtttaaataactctcatgccgcttggtcgtttccgacctagtcgtgaggaagaatgcaatgcaaagtgaaagacgtttttggaatgtttctgaaccagcccaagctgattgcctcttttctgtttattgttttaagtcataagtgacgtaagcttctaggcatttgttatgctatgtggctggctcccaaagtcatgtcttaaaacattctttccttcctgattattcttctctttcttgtttttcttttcttctttttcttttaatttttttttcttttttgagacggagtttcactcttgttgcccaggctgaagtgcaatggcacgatctcagctcactgcaacctccgcctctcaagtttaagcgattctcctgcctcagcctcccaagtagctgggatttacaggcgtgtgccgccacgcctggcttgtttttctttttttctttttttttttgagacagggtctcactctcttgcccaggctggagtgcaacggcgcagtcacagctcactgcagcctcaacctcccgggctcaagtgatcctcccatcttagcctcctgggtagctgggaccacaggtgccaccacacccagctgatttttaaattttttatagagatgggatctcgctatgttgtccaggctggtctcaaactcctgggctcaagtgatcctcctgccgcggcctccgagagtgccggggtcacagctgtgatccccgtgcctcgctgttgttctctttctgttgagttggcagtcaggtccttgattcttggtggctgagggtatctcagtccaaggcaagaatcccacagaaagagactgggacaaatgaggccagaaatgggcctcgcccatcactcttttccaaaatgggctttgtcagtcactcttcctatacttgggtcaccaaacctgatcaccactatgtgcaaagtgcagttttagttttcaaagaagtgacactatacttaagaatacttaagaacgttaactgcgttaacctccacgcacacagccatagacaaattcccccgtcagacaggagcccattaggaaatgcccacccctctctgtagcctttgtaaaattaagctgataaaagacatcgctgttgttgaggtttaaaatcaatggataaccaggaaagaatataagaaatcatattaattattctcctgtttacactacacttaaatcatttagctgtcttttttttttttttttggaccttctgctgcaaaagagccattctaatgaacttggaccccagggtccatgtgtgtggttattcattaaatcatgtcgcctgcagagtctcctgacttaagactttcgctgggcttgaactcagtaacctgtcctgatgtatttctcaggcgtttgtgattaggcagctgggctctgccttacctgtcagggtgataacccttctggttctgacaaaaggtttcactttaaatttagctttccatattgaagcataaataaaaagataatttacttcccgattttgctcgttgtggacacggaggtgtgtttgaccttcgtaaagctagtaggatcatgttatcactatgggttggtcattcagcgcttcctaaagaaaaactcaagtcagaaacaaatcaggagcaattattgatttaacagttttgcaaatgcttttgtatgtagaaggtgcatgaaaaagattccagtgatacgcagatcaaacactgcgtcgataatcacagctaatgtcgagtgcttgctgcgtgcgtgttgatcatttaagcctcacatgcgagccgtgcggtaagccctcctcctgccctcgccttagagatgaggaaactgagaggcagcgatgaagcagctcactagccctgctcctgtcctccccttagagatgaggaaactgagaggcagcgatgaaacagctcactagccctgctcctgtcctccccttagagatgaggaaactgagaggcagcgatgaagcagctcactagctctgctcctgccctccccttagagatgaggaaactgagaggcagagatgaagcagctcacttagatcacgggattagggggcggacctggacccgactccgaggccccctccagcagccaggccctcgcccatcacgcttggttgcttgtaatgggagccttgcctctcgccagcagtttgtggggagtaggtttcccgtttccactgttatttcctgactcccgtgcctcccaacttcccacccgctgtggctggcatttccaccggctccctggcttgtcctacgcctcatgcctcctatgtggctcttctttctcctcccgcccccctgctgcccgtggccccagaatggaggcttcccaggatggcccacacagtgccctgcacaggtgctgtggctcagccctggccattccctccacacgttctctgctccagccacactgagctccaagccatcctttagctatgcctgctgcaggccacctctgtagagggcctttcatgacctgttctagtaacccccctgcctggtgtcagccacccccgcccctggcctggtttgctattgccgggctgacctcgccccgtctttcagttctccgtgtggagggtgctgatccgtccgtctccatctgcttgtgaagcaataacagaacagcataggctgggtaatctatacagcacggaaatttctgtcctcatgcttcaggaggctgggaagtccaagatcaaggcaccagcaggttcaggtgtctggggagggctgcatcttctggaagggagaaggaaactggagggcaagcgagagagccccttacagcaagcccctttatgcaggcgcctgatcccatcgcaggggaggagccctcctggcctcgtcacctcttaaagccctgcttccttaagactctcactccacaacgcctgaactttggaggggacacattcgagccacagccccttccttcctgaggcttctcaagatgccccctcctgtgcttcctggagcacccgtccttccttgtcctgggacttggcacgcctgaccatagtcatacctgcttgtcctcttggcccctcttcaggtaatgggctccacacaggtcacgatctcggccaaaatagtcacacatcgtccctgcacccatcagtgtgtagtaaacaggaagtgcttaataaatgtttgatgaattaagagtgactcagtaatcccagtacaaaaaagcaacagcagacgttggagatgtgcttgaggcacgtgcccagcttgtgagcagaggccgccgctgccactccgtgctccccgtggactgccgtgctgagcgctgtgaatgtgctggctgtcccgtcgtgctccagctcttcaggcctccctgctcagcctctctcagcttcagttgccacgcacttctaggagaggccatcttgactttctcttgcagtcccggagccacacagggagcaggtgcgcagtcacctgggtgagggccccttcctgggtttcagaggcagcccagttcatgctcccagggcagcccttgtgcatggggagccgtagcctcaggcaggggcaccctgagccaacagcaccttgcagggccagccacagacataatggaaaacctcatccttcagccgcaacttttcctacctcccatcaaaaaaatgtccctcctctctcagtatgtggggactgcggtctccagagtggccatccacagtcacactggctgtcagtggctcctgtcaccaccctgccacctggtgacttgtgggccacactcaggagtcatgggaaggagacccttagagcagccccaggacaggcctccttgcgtgtacttctttgatgaaggcgggtataagccctggcagctcattgtcctctcttgagtccacataggttgcattttttaactctggcaaagtgaagttacaaagtcagtctggtgtcgcctgggacaggtccgagaaattagtataaagatggcttcactcctgcgtcgtattccagttcacgtttccatttcagtgtatacatgttacagtcgtgattgatcctgtgcataaattgggatgtgggtttttgttggagaaaaaaatgcacaaaagttcaggagctaagtaagagtgaaagattttcattggaccaggtgtggtggctcacacctgcaatcccagcactttgggaggccaagatgggcggatcacttgagtctaggagttcgagaccagcctggccaacacagtgagacccccatctcaaaaaagaaagaaagaaatagttggacatagtggcggacgtttgtagtcccagctactcaggaggctgaggctataggaggtgggggctgtagggagccatggttgcaccactgcgctccagcctgggcaacagagcaagaccctatctctaaaggaaaaacaaaacaaaacaaaacaaaacatgaagagtttcttggggccagttggcatctaaaaatatctaagtcttttgattctcagctatgacctggctacgttctaggctgtctttacgtgtttctaggactcttggcaaattctcagaacagttgacttaaaaagattagccacgtagtatttttacaaggagagagggaggtgaagtgatgagatggggccatacttataaaatgattcgggattattgatgaagtagtccctaggtttctgattaattaattttaaagcgctgaccaaatatgtacccagcgtaagaagccagagtcgatcagtgttgtagacacgtcgcctctcgatggcatctttccatgccacacccttcacgacctgaagctggagcttaaacccttcaagaagggtccctgcgaccgggtgcagtggctcacacctgtcatctttgggaggccaaggtgggcagatcactaggagttctaggccagtctggccgacatggagaaaccctgtctctactaaaaatacaaaaattagccaggcgtggtggtggacacctgcctgctcacaggctgagtcaggagaattgcttgaacccaggaggtggaggctgcagtgagctgagatcgcaccattgcactccatcctgggtgagagagtgagactccatctcaattaaaaaaaaaaaaaagaagggaccctgctttgttcatgattttattctcggtgtgtggcatacactaggcctgaaataaatgttatttaaatgttaaattacattgtccctccttccgatacatttgccatctggttaaattccagtgaagtcaaaggatggatttctttaaataaagtttgcttctttttcaaaaattccttgggctctttctagaaaagctgctcctttgccatcttcccagcagattcccggggcaggatccacccacctgttcacagctccttccagcgcagtgtgggtccggctgttagctcagcctcaaaggagaattgtaaagatacaggtcaagtgtccttttgaccaccttttttttttttttctatatgcgggattttgtgagacaataaaatgcatgtggacctcagcttaacaaaagctgaatgttcctggggtgagtgtttgaatccaacaggaaatagatgctcaacagctctgagtctggggaggttttaatggcctcttggtccctggtagggtcttgtttttcggggtagttttgcagcctctgacacaggtaagatggtcagtaccggaagctgccatgacgtctagactgaccgttaggaaggtactcactggactggtattcacagatggaaataaaccaaagcagtgtctagggtcaaccaatctgctttgctgccttcacagggaggtcctgggaccctttcatggaggaactttttaatgcttattttaaccctgaaggtaaaacatgaaacatgcagccattactccaagaaaacgtaacgtgggtgagtggtgtgtctcgggggcccacggtctccctgaggccgcatctctctggagagatcgtggacgtccgtcgtaaactatgacctattcacattttcactttactctcaactttccaggagtgagtcctctccagagagcaagacggagctgcgtttcaacagacggtgctttcaatctgtgctgactgtaacttttatccatcataggtttgaagacatacctgatatcgggtcagagagccaaggagtctcgctgcagctgtgcagaggccttgctttctggctttgaggtcattgacggctcacaggtgtcctcaggccctaggggacaggggacagcgtcatcagggaatgtcagtgacttggcgcagactgtcaaaacctttgataaccttaaggttagtttttttgttttttttttcctacttctaaaactttctattaattctgcagtagagcacgtgaaataataagcagcctccaggtctgaggcaaacaacttggaatgaccttcgatttggttttcacgattttaatatttagtctaaagttagtagcattctgcatttttaacatccttgctttttgacatatgacgcacctccattgcctttccattgcacaaggatgcttctcatttgaattattagttattttctcttcctgggacctgtggtgccttttgggatttctagaagctggtgataaatgacagtaaaggtggctttccttggcaccttgggtggagagctagttgataatctgatttcagagaccactttctcaaatacttctacgtctcttgaaatccactattttatgattacttgaaatgatgttggtgtgggtgaatcctaggacacagctcactgagaggacaggctgccgagaacattgtagtatttcattattggaaccgggatctcctggtagctgcctagaagtgcccgtttctggactgacctgtcatcataaactaccagggaattggcgcggtcgaccttgggtgtgtgaaatcatttcagtttatgagctgttcctttgctttcacatttgatttagtttccccactggtaccttctgtttatttttatagtttaaacatctactgtctccattcttaaaatgagacagagaatcaaaacagctctcctatgctgctttgtgttctcagataacacagtggggtatgtgtgaggatggcggccagtggttacagcttcacccaatacgtccctgcctctccacattcattcacaggtttgaaagccgctattggtatttacgaggaacagtcttcattatgtggcagtcagctggggtatgcagattacttactgggtcagaatacatagtgcctgtcgcccagttacacgtaatgattgcactcgggttctgtcaactccgctcgtggatcgcggtcgttgggtgctttgttagtgtaatgcagggcttctcaccttggcaccgctggcattttggaccaggtagtcatgtgttgtggggctgtcctgtgcactgtcagatggctggcagcatccctagccgccacctgccagatggcagcatacccacccgtaccctactccccagctgtgccaaccaaaaatgtctccagacatggcccagtgtcccctgggggtgcagagtcacccctgggtgaaaaccaccgggacagtggtgttggaccctctcttccctgtactcttggcacatgtgtaaagctcatgtatctgagattccctggatgcctgcaaactttagagacagccgccttgcctgggctgacgttgtgcaggagtcagaaaatggagctctgggctcctagacagcggacccgggcagggaggggctggcgtggggtggaatcgggaatggttttgctatttggggaagaattgtttcctccagcctgcaaactgagctgtatttaagtcgtgaaagacagccccgagccaaaaatatataattcgttgtgtttgccattttagcttccacatatgtgtgtttctgtccgttaggggatgcggtcgcagagttcaccatatcacatgctcacgggtttagtgaccacggttttagcaatggcgattctacactacattgcactctagtcatatatatttgttttggtcggaatgagcaaaaaccatttagcgtatcttcttggcatgtggagattttccaaatattgttgaaagtttctgagaatcttgtgatctatcaagttgacagaaggccgggcatggtggctcacgcctgtaatcctggtgctgtgggcggccgaggtgggagggatgcctgaggctaggatttccagaccagcctggtcatcgtagcaagacatcatctctacaaaaaaattttaaaaattaactgggcttggtggcctgtgcct

SEQ ID NO: 17293 - DNA, 17743 bp, Human
ccaaatactctgtgaaataggaaacaggtggaccagctggacagtaagttaaattcaaccaaccagaactcatcaaagccttgaatcccaggctgggcacacacagaggagctcacacccagagctgggtgttcagctaggcgtcgcaatgttgtgactgacctgtggaagtgacccatcctggacctcagtggtcagctggaaatgtgacatccatgggtagtcattaacagtaaaatcacaaattattgtcatgcaggagacgatgttgtgaagtggtttgacgtttggatcttggctctaggcaagtcactaagctacagattcttggctgcacagggggatgataaacgcagccctgcagggtgctgcagagattctaggaggaagtgtttataaagctagtggtggctggtgccgaggaagtgctggtgaagggtaaattgcattattaacaaaacttctggccgggcgcagtggctcacacctgtaatcccagcactttgggaggccaaagcgagtggatcgcttgagatcaggagttcaagaccagcctgcgcaacatagtgagaccctgtctctataaaaaatacaaaaattggccagatgtggtggaatgcacctgtagtctcagctacttgggaggctgaggttggagggttgctcaagcccaggaggcagaagttgcagtgagccaagatcccactactgcactccagcctgagtgactgagcaagaccctatctaaaaataaaaaaattagggtatgcaacggtcagaagtaggtaagtgaggagtcagttcaccctacatgtaatttttcatttatttattttttttgagacaaagtcccgctctgtcgcccaagctggagtacaatggcgcaacctcggctcactgcaacatctgcctcccatgttcaagtgattctcctgcctcagcctcctgagtagctgggagtacaggtgcgtgccaccatgcctggctaatttttgtatttttagtagagatggggttttaccgtgttggccaggctggtcttgtactcccaacctgaggtgatccacccacctcggcctcccaaagtgctgggattacaggcgttagccactgtgccctgcccccaacatgtaacttctgttagcttcaaagccacctctggggccctgcaccacatatgagctgaaggacacccgtgccttttcacccgtgtagctccagcatcttggcacactgtctagaatgttcaatgaatgtgcacggaagagcattctggctccagggagcgaggactgagtcagctctgggaacagatgagtcaggctggtggtccaggcattgcttttcaagtccttcatgtggctggaagaaccagtcaactggaaccggatcaacaggggtgatggcatggcaagagttatctcctggcagtgcccttctggcctcacttgccttcttgggccaggaaaggcaaagctcacaggactgtattcagtgcccaccccttcccccgtcctgtgccattggctctggaaggtccctgaaaccccgagtctggaggagaacagttgaccagcagggcgggccctcagcatagtcctctctgttcccactcacccgctctgccagccccagatcctggcaggaaggaagattggagggggtgtctggaatccaatcccagaccttcccttgcagacttgcccatctgtctgtggtctagtgtggaggcgaggtccagggtttgggaggggtgtgggggcacatgtctgccaaggcatggagccctcccagctggaaaatcctctgaacctgtaagaagagaacacagccggcatggacacacccttacccttagtctcagttcccaccaagacacagagcatttcctgtgccttttccgctatttcacaacctgccttttcttgctcaccaaggacagaggcttcttttcctaccagaagccagacagctggctcgagcctctcctgctcagcaccatggctaagacccctagtgaccatctgctgtccaccctggaggagctggtgccctatgacttcgagaagttcaagttcaagctgcagaacaccagtgtgcagaaggagcactccaggatcccccggagccagatccagagagccaggccggtgaagatggccactctgctggtcacctactatggggaagagtacgccgtgcagctcaccctgcaggtcctgcgggccatcaaccagcgcctgctggccgaggagctccacagggcagccattcagggtaagcgggcccaggcctcctcctcatccagtgctgagtgctggctgctttgtgggaaaggggaccaggagctcagagcagctcactctgacctggggattgggagtctcaggtctaccaaaatccagatgactttagttcaggaacgtccctttcttcactctggcctttggaactgggttagtaaacttccttcaggctcctaatgggttttttaagaagcaggtcagggtcacgaaaggcaggagctggaacacctgttctttgagacttcttcactacatttatgattaatactcatgtcagacaaacatctctaggttagcaaaaagggattgctatgcaatcatatgaacggggttggtatagaatcttctcagtgctgttcaccatgttggccaggctggtctcgaactcctgacctcaagtgatcctcccgcctcagcctcccaaagtgctgggatttcagacataggccaccgtgcccggcttatttttatttttaaagcgtataatctgggttttgctgacctgtgtaagatcttatttgaaacagttgtcctgcttaaaacgtttgaaaagtactatttgagaaatataggctaggcatggtggctcacacttataaataatctcagcactttgggaggctaaggtgggtggattgctagagctcaggagtttgagaccagcttgggcaacatggtgaaaccctgtctctaccaaaaatacaaaaaaatgagccaggcgtggtagcacacacctgtattttcagctattgaaaaaacagaaaacaggctgaggtgagaggattgcttgagcctgggaggcagaggttgcagtgagctgagatcacatcagggcaacagagcaagatcctgtctcaaaaaataaaataagagagagagaaatacatagcaacatcaagcatgttcttactgaatggtaattgactgccattgtctagtctaggaagtcctgaacttttgtttttgagatggagtcttgctctgtcactcaggctggagtgcagtggcccgatctcagctcactgcaacctccacatcccgggctcaagcgattctcatgcctcagcctcccgagtagctgggactacaggtgcgcaccaccgcgtctggctgagtttcttatttttagtaggaacggggttttgccatgttggccaggctggtctcgaactcctgacctcaaatgatcctcccaccttggcctctggagaagctgggattacaggcatgcgccaccacgctcagcttatttttgtatttttagtagagacggggtttcaccctgttggtcttgaactcctgatctcaggtgatcctcccgcctcggcctcccagagtgccgggaatacaggcatgagccaccgcgcccggcccgttgttttcctcaatttctaaactttaatatccaaggggattctctctcctctgccctgaatcttgggccctaaacgtgggacagcttcatcattttgcatctggttgtccttccagaatattccacacaagaaaacggcacagatgattccgcagcgtccagctccctgggggagaacaagcccaggagcctgaagactccagaccaccccgaggggaacgaggggaacggccctcggccgtacgggggcggagctgccagcctgcggtgcagccagcccgaggccgggagggggctgtcgaggaagcccctgagcaaacgcagagagaaggcatcggagggcctggacgcgcagggcaagcctcggacccggagcccggccctgccgggcgggagaagccccggcccctgcagggcgctagaggggggccaggccgaggtccggctgcgcagaaacgccagctccgcggggaggctgcaggggctggcggggggcgccccggggcagaaggagtgcaggcccttcgaagtgtacctgccctcgggaaagatgcgacctagaagccttgaggtcaccatttctacaggggagaaggcgcccgcaaatccagaaattctcctgactctagaggaaaagacagctgcgaatctggactcggcaacagaaccccgggcaaggcccactccggatggaggggcatctgcggacctgaaggaaggccctggaaatccagaacattcggtcaccggtaaattgtgttctttcctactttatatcggctgcagagaaagaatggctggccgggcacgatagctcatgcctgtaatcccagcgctttgggaggccagggcgggaggattgctggaggccaagactttgagaccagcctggtgaatgtagtgagacccccgccatctctataaacgaaattaaaaaaataaaaacccaaaggttgggcagggcgtggtagctctcgcctgtaatcccagagctttgagaggcctgcacgggaggatctcttgaccccaggagttccatactagcctaggcaacacagtgagaccccatctctacaaaatacaatagtggcacgcgcctgtagtcccagctgctcgggttcacttgagcagacggagttccaggctacagtgagctgagatcatgccactgcacaccagcctgagcaacgtagccagactccacttctacaaaactaaaaaaaaaattagctgggtatggtggcacacgcctgtaattctagccactcaggaagctgaggcaggaggattgcttgagccagggagttccaggctgcagtgagctgaggatgtgccactgcactccggcctgggcaacagagcaagaccctgtctcttaaacattttggggggaaaaaaaaagaaagaaagaatgtccgattgaaaaaggcaatcaggtgttatcagtggccaaagaatggagaaggggagctcacctctgcaggcgtctgcttgccagggatgggaggcagggcgattttagagtccagggaggggaagggagataggtaagcaggcccagggcagggttccatatgtgcaggcgctgtccccagcatgcttcttcctacatcgcatggacacaaaaccctggccatcttcttttaggggagggacctttagccttataacaatgtgtaaatgatcttaaggtaactggaagtcacctcttccagtttgcactggttttgctctgatcttaacttcctctggtttttggcaagggatcaggaggctccaggccatctggatttttttaagcagctgtccctataggtaaagagactaaaaaaaaactgtaaaagaaaaatgccaccagtttagagggtaccgaggctatccaggtgacaattccatgctcgtggtgggggcagcattcagaaacacactttcctttttttttttttttttttttttgagacagagtctcagtctgtctcccatgctggagtgcagtagtgtgagcacagtttactgcagcctcaacctcctaggctcaagcgatcctcccacctcagccttccaagtagctgagactataggtgctcaccaccacacctggttaattttttttttttttttgtattttttgtagttacgaggactgtctatgttgcccaggctggttttgaactcttgggctcaagcgatcccccgccttagcctctaaaagtgctaggatttcaggtgtgagtcactacacccagcctatggaacacactttccaatgcattgttggctggagaggagaaatcacagcactcaaggaggagaaatagaattgggggtccaggccgggtgcggtggctcatacctgtaatcccagcactttgggaggccaatgggggcggatcacctgaggtgaggagttcgagaccagcctgccaacatggtgaaacgccatctctactaaaaatactaaatttgctgggcgtggtggcgggtgtccataatcccagctactcagaaggcttcgaggcaggagaattgcttgaaccgaggaggcagaggttgcagtgagccaagatcatgccactgcactctagcctgggtgacaagagcaaaactctgtctcaaaaaaaaaaaaaaaaaagaattgggagtccagggacccctgagacctgggaggggaaaggatgtggtatgctgcatgagtcttcaaatccagaagtccctgggtcttccagtgagaaaggaccctgggatctggaaaacctagcatccttaggaatagtgacctgaaaagtactgaagtatttcccccctaattttcttttatccctactgtattttttttaattttttttttttttagatatggggtcttgctatgttgcccaggttggtctcgaactcctgatctcaaacaatcctcccatctttgcctccgaaactgctgggattacaggtgtgcaccactgcaccaggtccccactgtatttatatcattgggattcctgggtgtctcctagggccgcttcgttaatctgatgcaggcttagaccctgaaaaatgcatatatgcacagcttcacaaatgtcacatcaaatttcaggtagttcttggacactctgaagaccatctttagaatccaaggggtttatggataccaggtagaaaatctggggaagactggttaaaaatactccctctcacaataacctcacagcaatgcatcatcatggggttgagattctaccatttgcctttctctcagcagaaagaaaagcctattggctaaagtcctaactatctactgctgaggtagtcattaaaattatgtttggttgtgaataatagaaacacccaaataacagtaacctcaacagaaaagaagtttgtgcctccttcacataaatgatacacaggcggtcccaggcagatccgtgggccaggaccctggggtcctgctgttgctctgtcccaccaagtttgtcctcaagcttctgctctcagaaggtgacgtcctcatgccaggcagcaagatggaggaacagaggggaatagtatccctcgggaaagctctagaagtttctagaagctgcttgtgacacctccatttacatccctttggtcatattattgtcaaatagccacacctaactgcaaaggaggctgagaaatgcagggcatttggggggcaatgggaggcagggaaacagggaaacgtggacaattaattctatcacgagagaaggagggagaataatttctggtgactactagcagtctcatttacagatgtgctgtgaatttctgggacactgtgaggtgggaggaggtagcaggggctaaaggattgagtgtgtttctatttctttttttttttttttttttttttgagatggagtctctcttggtcacccagactggagtgcagtggcgcaacttcagctcactgcaaactccgcctcccgggttcaagcaattctcctgcctcagcctcccgagtagctgggattacaggtgcccaccaccacgtccggctaatttttgtatttttagtagagacagggtttcaccatcttggccaggctggtcttgaactcctgacctcatgacccacccgcctcggcctcccaaagtgctgggattacaggcgtgagccactgcgctcggccttgtgtttctatttcttcttgtatctcgtggcatgtctgcttatgaagttgcaattagagtcttggagtagagctattcataactgttaggtcttcatgatgagttccagtctttagccctataatgccccccttctttgctttttcttttaagatggcatcttactctgttgcccaggctggagtgcagtggtgcagcatcaacctcctaggttcaagcaatcctcctgtctcagcctcccaagtagctgggattagaggtgtgcaccaccacacctggctaattttttaattttttgtagaggtgggctcttgccatgttgcccaggctggtctcaaactcctgagcttaagcagtcctcccaccttggcctcccaaagcactgggattataggcatgagccaccacccagccccttctttgctttcatttaatggttattgaactcatatgtgagcagtggtctatttattccttcattcaatactcattttccaaatgcttgcatttgccaggtactctgctaggggctgggatccagctaggagcgaggtacacaagtcaccatcccctggaagcctccactcacgttatgggcagccagggatgggttcaagtggcaaaggaacactggtcagaatgtctctttccttggcatcacctgctagatctatgtctgtgcaggaggaacagcacaaggccatgggtctttctttaggataaatgcccaagaattccaaggctcaggaatgtctgaggtctggcccttagctctcaggcccagtggcctgtttgcttcctcactggatggaagtcgggggaggacaagctaggaagtgggcagagtctaactgagaactcgcacatctcaggcaagggctgtgtccgctgtgctttgtgatacctctgtgtaagcaacttgggtttgccattcagggggtttttccactgcatgtccccaggaaggccaccagacacggctgcgagtccccgttgccacgcccaggaaggagacccagttgacggtacctgtgtgcgtgattcctgcagcttccccgaggcagtttctgggcacccccaggcctcaggcagccgctcacctggctgcccccggtgccaggactcccatgaaaggaagagcccgggaagcctaagcccccagcccctgccacagtgtaagcgccacctgaagcaggtccagctgctcttctgtgaggatcacgatgagcccatctgcctcatctgcagtctgagtcaggagcaccaaggccaccgggtgcgccccattgaggaggtcgccctggaacacaaggtaggcactccctgcctgtgggctcttctctgccaggcacttggacacactgggccttacttcattttcccaacaactctgggttgttggtgcattaaccagcattcttgggctggaaatggcaagaacacaatataaaccagtccagcaaagaggggagctacaggtttatgttgctcagagatccagggggagctggcttcaggtatggctgaatccagaggctcagaggaagtgcctctcagctctgctgcctttggcaattcagccattcctccctcctctttcctgagcacccctccccatgccgctggcagcagcaccctcagccttgctaccagaaggagatgttcccctccagagttggcaccagctaaagatggcaggagccaaattcaagcttttcaacaagtgctgtttttccagaagaaaattcagaagcagctggagcatctgaagaagctgagaaaatcaggggaggagcagcgatcctatggggaggagaaggcagtgagctttctggtaaggtcagaggtggctgatggcccatccgtccctgggaggagggtgggaagagtgagcaggggtccccgagattctgctgtggttcacagggcagcagggatggccacctcctctcaggggacagagggtaaccagcagccaagggtaagctcatccctgtagagggagaccacccccagcaggcaggggtcacctctgaggatcctgtcatgctttctcatactcaccagaagatggtagagagcaacctatgccggtgactattgcagaaagatgggattgaggaaaagggaggagaacgccactttctttttttgtgacggagtctcgctctgtcacccaggttgtagtgcagtggtgtgatcttggctcactgcaacctctgcctcccgggttcaagcgattctcctgcctcagcctcctgagtagctgggattataggtgagtgccaccatgcctggctaatttttgtagttttagtagagatggggtttcaccatgttggtcaggctgttctcgaactcctgaactcgtgatccgcccgccttggcctcccaaagtactgggattacagatgtgagccactgcgcccggccaagaacacttttaacttcataatttactctctgtttttttgttttgtttccaagatggagtctcgctctgtcacccaggctggagtacagtggcacgatcttggcttgctccaacctccacctccgaggttcaagcaattctcctgcctcagcctccttagtggctggaattacaggcgcctgccaccgcgcctggctaatttttgtatttttagtagagacgggatttcaccgtgttggccaggctggtctcaaactcctgacctcaggtgatccacctgcctcggcctcccaaagtgctgggattacaggtgtgagccatcgtgcctgggctggtttttttgttttttagggttttttttttttttttttgagatggaatctcactccgtcgtccaggctggggtgcagtggtgcaatctcggctcactgcaaaccttcgcctccccagtttaagcaattctcctgcctcagcctcccgagttgctgggactgtaggcacatgccaccactcctggctaatttttgtatttttagtaaagacagagtttccccatgttggccaggctggtctcgaactcctgatctcaagtgatctgcccaactcagcctcccaaagtgctgggattacagacatgagccaatgcacccagcccaaatttccccattttataagacaacatttatattggattagggacccacccaatcccagtaggaccacatcttaactaattacatctgcaagaactcttatctccaaataagatcacatgctgagtactgggggttagggcttcaacgtgtaaattttggaagggacacagttaaaccttaacaccaggtttaaggacattttcccagagctagccccagccatgctcagtcttttctggaaggttccagacaatatcgcctcctgctctggaatctaggccttgaagaggcagcataagcccacctcttatccacctccaggaggtgggcttctgggggttcctggacatccacgtccacccacagcacagacccccatacctccctgtcctctgctccccagaaacaaactgaagcgctgaagcagcgggtgcagaggaagctggagcaggtgtactacttcctggaacagcaggagcatttctttgtggcctcactggaggacgtgggccagatggttgggcagatcaggaaggcatatgacacccgcgtatcccaggacatcgccctgctcgatgcgctgattggggaactggaggccaaggagtgccagtcagaatgggaacttctgcaggtgggtgtgcctgggcccggctttcttgggtcccctgtgcctatcaggatgcctcaggctcccagctctgccatcagccgtgctggaacaagtgggtgaagcccctaaggcctaggataggacttggtcttggtgacccacagtgcctcttgtgcccagacccctttgatgaggtctctcaggagcccagggtggcctggtatccaggggatctctgccatttcccagaagggatcagcagggcttgagggccgttccattgcaggcctcgccacctgggatgcctgaattcccgtggttagaattagacttgaagaaaggtgctccacttccactgacaccctagggcagggagccctggtaagtgcagcggggagctaaaagtccaggagcccagaagtagaggccaggagtcagcccagccactaggagcctggtaaccgacagtttccttcttttttctcctaggacattggagacatcttgcacaggtacagcgaggtcctgtggtgtaccctggggtgtcttgcagaaagcatatgggggagacagtcccagaagggacctgggagggagatgttcccaaccccggggtctgtgattccagactcctccttttttctgcagcttcccaaagcctctctggatttgatagggagaagggcatctggtcagcagggaggctggccgggtatggagctgcagactgggaagggtgaattcagcccatcctgctgaaacaagatggaggctccctaagaaaccttccgagtgcattgtgtcccgtgcagttcatctgatgaaagctgccccttcaggcctactggtggccttgggaagcttgtttggagtggagctgggctaagcccagcaggaaggggaggggagggaagggacaggaagaggctaagccttaaaatcacctgggagctttacaaaatcccggtgtccttttgtgtctggcttcttcacttagcataatgtcttcgggcttcatccgtgttgtaacgtgtatcagaatttattttctttttatggctgaatcatagtccagtgtgtgttcatacattttgcttatccattcatggatatcgggacttcttctaacttttggtttgtgaataatgttgctatgaacaagggtgtacaaatatctgcttgagaccctgctttgttattttgggtacctacccagaagtggaactgcgggaccatgtggttatcctgtgtttaattttttttgaggaaccaccatcctaattctcacaggggctgcatcgcttcacattcccaccagcagcgcacaggggctccagtttctccacatctttgccatcacttattttcttctgtttcactctctctctctctctttttttttgaagacagcgtcttgctctgtcatccaggctggagtgcagtggcgcgatcttggctcactacaacctctgcctcccaggttcaagggattctcccacctcagcctccctagtagctgggactacaggagcgtgccaccatgcccagctaatttttttggtagacagggtttcaccatattagccaggctggtctcaaactcctgacctcaagtgatccacccaccttggcctcccaaagcactgggattacaggcgtgagccaccgtgcccagccatttctctttccttccttccctccctccctcccttccttcctttcttccttccttcctttcttttcttcttgagacaaggtctcactcccatcactaaggctggagagcagtggcacagtcacggctcactgcaggctcaacttcctgggctcgggtgattctgagtagctggcatcctgagtagctgggactacaggcatgtgctaccacttccggctacttttttgtatttttaatagagacagggtttcgccatgttgcccaagctggacttgaactcctgggctcaagcgatcccactgccccggcctcctgaagtgctaggattacaggcatgagccaccatacctggtctatttttttctgttgttgctgtttttataatagccattctaatggatgtgaagggatattttgttgtgtgtgtttttttttcatttattatctttttatttcaatagaaagaaaggggtgtataatcaatttgacatagataattctagtagataatatcaatgtcattttaagtccattctgaaaactccttgtggttttgatatccatgtctttaaagcaccccagtacatgacagtctgtggccaaagttgaggaccagcatttagacctctgaatccagggaagacttttctttgtgtagctcaggctgggctaggtgtgccctgtggagaatgtagttcatttccagctcacgggtacttgggccaccccctcgctccggccttctctggtcaacagtcttttgtctctagggctaagacagtgcctgtccctgaaaagtggaccactcctcaagagataaaacaaaagatccaactcctccaccagaagtcagagtttgtggagaagagcacaaagtacttctcaggtagatgggcttgggagaagattggaggtgcatgctcacttcctccctaagatccacatagcccagagcccctcacttccctcctcttcccctggtcttgctgacctgccttcaacctctcctccatctgtccctggctgagggacctaactccagcttctctctgctccctttcccacattttagaaaccctgcgttcagaaatggaaatgttcaatggtgagtccagcggtaatggtgtgtgctggcctggggttgttgcagtgttcccttgtgctgttgacttgaggggccctatttagaagacaaaaaaaaaaaccaaacacctggagcaaaggtaggagaaaggtcatggcaggccccccaggctctgtgcgtgactcattgactgagttgactcattagaccacagtccccaacatggcctgggttcctgggaggaacgggattatacccaacatagcatgcagggccctaagcagggggttccttgtctttccttgttgtcaggacagtgtaatttagcccctcttaatgctaatgctcaggatttttttccctatctgatttttctccgtagttccggagctgattggcgctcaggcacatgctggtaagtgcccagatcaaggcaagtggccctggcctgctggatccctgtgctctcccctaccacgttccagaagaactaccctgtccctgtttcctgcaggtggggagaaccctgtagggatgttgcccatggacccctacctaggtattcaaattttctttgcagttaatgtgattctggatgcagaaaccgcttaccccaacctcatcttctctgatgatctgaagagtgttagacttggaaacaagtgggagaggctgcctgatggcccgcaaagatttgacagctgtatcattgttctgggctctccgagtttcctctctggccgccgttactgggaggtggaggttggagacaagacagcatggatcctgggagcctgcaagacatccataagcaggaaagggaacatgactctgtcgccagagaatggctactgggtggtgataatgatgaaggaaaatgagtaccaggcgtccagcgttcccccgacccgcctgctaataaaggagcctcccaagcgtgtgggcatcttcgtggactacagagttggaagcatctccttttacaatgtgacagccagatcccacatctatacattcgccagctgctctttctctgggccccttcaacctatcttcagccctgggacacgtgatggagggaagaacacagctcctctgactatctgtccagtgggtggtcaggggcctgactgaatgcccaacactgcatctctcttcctgcttctggccttgtatcttgcattcacactcaatagtcacggaatgccgactaggtgctagctgctatgggaaatgcaaaaataacaaaatagttactgtgcccacggagcctacccgattatagcagaggtaagttaggaacgaacatgttagtcaatccgggtgaagacatgtactgatgacacaccatggatttcagaggaggaagtacggagtcgttgcataatccgcccctggtgggtggcactctcaggtgctcctgaacagaagatttggccctcattttccctcagaaccccacggcaaggatatatgtccccttgttctctctgcttctgtcttgaggatatgggaagcctagagaaacgcaagcagactggattgggatagaagtatttgtgtacctggattaatgaactatgattttttttttttttttttgagaccaaatcttgctctgtggcccaggctggagtgcagtggcacgatctcagctcactgcaacctccacctcccaggttcaagcgattctcctgcctcagcctcctgagcagctgggattacaggtgcgtgccaccacaccaggctggttttcttgtatttttagtagagacgggggtttcaccatgttagccaggctggtctcgaactcctgacctcaggtgatccacccgcctcagcctcccaaagtgctgggattacaggcatgagccactgtgcccggcctatgattcttttttttttttttttttgagacaaagttttgctcttgtcacccaggctggagtgcagtggtgcaatcttggctcgcaacctccgcctcccaggttcaagagattctcctgcctcagcctccgaagtagctgggattacaggcgcccgccaccatgcccggctaattttttgcatttttagtagacatgaggtttcatcatgttggccaggccggtctcaaactcctgacctcaggtgatgcacccacctcagcctcccaaagtgcagggattacaggcatgagccaccatgccgggccatgattcttaagagaattgactgggcctcatgaataaaaaaattagaaaatctggtcatttgcatttgtcactcaatcactgtggaatcccatttcccgactgcatttcaggaagcagatgggactactgtatggaaaaacatttggcatgtattccaagtgtcagattattctgtcttggtttgtatgggaaaatctgcgggttgtggaatattaggttctacttcacacacatcccgtgcatttgtccttcatttaaagagatgtaaaggggccgggcatggtgactcacatctgtaatctcagcattttgggaggcaaaggcgggtggatcgcctgagcccagggattgagaccagctgggcaatgtggcgaaaacccgtctctacaaaaaatacaaaaattagccatagggatgggggtgggaggatggcttgagcgcaggagatcgaggctgcagcagtgaactgagactgcactacggcaatccagcctgggcaacagagtgagtccctgtctccaaaaagtggatgtaagaagaaaaaaatcaaatgaagattaaattccaaactcctatgccaactcctctgtcttcactactagagtgtagattggactcagatactccatggctatgatgagagcaggtaaacttgctgggctttcctccacgagttttattctataagagtaatccacatcccaggacagttcacatgacctacggcttagctgttccctgcggtgggtcatgtcttattcccgattctcccttgttataagcttttcatgaatatctttgtgtatattttccaccacctcaccatatacatatttttttctcctgtgttattcctaaaatggttcctgaatgtgaaatatctgataatgcttcctacgggttgccataccatcctttgcaaagatttttaaaatatttcatgcccaaagcaatgactgccatttaaaatttttttgctgatttaatagggatgtaatgaggccttacttctgttttatttcattacctgttaatgaggctgtgaatttttccatgtgaatttctgctttttgcttcattctatggaaattgtacagttcctttgaatacttgctatttggaatctacatattgaacttcgtgttttgctatacttcttcatacatgttttaggctgggtgcggtggctcacgcctgcaatcccaacactttgggagccggaggtgggcagatcgcttgca

SEQ ID NO: 17294 - DNA, 27241 bp, Human
tacattgtttgtcttgactcttttctgagtttttctgacattcattttctgtttgtcttaaggttatcctttacctttgcttctcttaactttttccttttgttgatccactgttttcctatgagctaccaaaaaatgtaattcagagctctgtagtctaacagtcacatttccttaaaatatggccgttttaaaaattttaaacataattgtaataccattatataatttctcttagggaaaaaataattcaaaagactgacttttcagtaatgcaaagctttggctacaacatgaaggtcaaagctgcaattaataaccctgatacttcaacatttttattttgaaaaaccctctaaaggatttgatttgtaaaaatatgtgtgaaaatttagagggtccaccaccatttacatagcatctcagccgccattctgtctggcatttataagacatatcaaagaaactttcatctgaagaagtccacttattctcgtctttattaatcttaaagcttaagtagtttacatagtggatcttgtctagaactattaatagtttctttggtgtattttctcaaattcatctttcttggtgtgcaaaaacatcttcctgtaactccagccacctcttatagcatttctgtgtcttttaaaacttgattatatctattttttaaaatccagtctaaatctttcttgcctgcaactttttttatacttcctttgccactgtatttgtccattgtatccttgctttaatctatcattggtgaaattgatcctgtaatagacttgtaactactggatattgtctggttttactgttaaagtttcacatattaagctaccagtgctgagtgtattggtgatcaaaaaatagaaaatttaagcaatgcctcatagaattctgtaccaaacaacttcagatttacctctgtatgtagttgtgattataaaattgtttcactgaagatgttatgtatatctttcaactaatattttatgacaatcgtgatataaaagatttggaaattcttatgtgacagtttctgaggtacaacaataatgatttaagaaagaaaacaatttcatctagaaacacgtcttgggggatcataatcagaacataaatttaccaggtgatttgggctattcttgtgaaaagtttacaggaaactgtgtaaccaagatctcattttcatttttacctgttttgtgctctagatgtgctgtagccctgagcattaaatgagtactgatggatgctgatttggggagttcccttctttaaatcacctgtatttcctgtacctaggttttttcttgggagggctcctattcctgtactgaccagagttagttctccttactttaaaagactagatatgaagtaaacactgcctgatgtaggatggtcagtaagaaggcaattagttgtataacttaaatttgggcagcaatccttaaaactataggaaatgacttatttttcttattcacatctatcttcacctcaaattgattttgctgtataaaggtctcagctattatgtttggtcttatatcttacattaggtacttgaaacctaagcttcatttacttgtgattttacttggttctttctgatagtgataataggtctcattttccaaagcacagtacaactgattcatctttgacttgctgaccttgatttttttgtttttagtcttctggaacttaagcatcatactatagggtgtatttttattcttctaaaagaagaaacccatctatatttttactgaaattttgatgtactcagacatctaacctttcaatttacatgtttttaaactcagtatgaaagtccctttaatagttaagctttagcatgaaatactactttttaaatatctatatgcaggctctgcatacatcaggaatctgtttaagatatgtaataaattccttgtaagtttgagatcttaaatgttttttttttaaatcaacatgatgcataagtttttttttcttaaaaaaacggcatctgcttaaagggatttatgactaaaattgcttatttttctacagagttgtctgctggttctcagcttgaagaagattctgcagtccttattgatcctttttcttggcgttaccattttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggtgagttaactcaacagatgcttctaatttcttttacattgtagtgcctatttacctatatctttgactctaattctgtagtctgatgacattgagttgatcaagcatttttaaacttttgagaacacttactttatttggaaggtaattgtttttgagcattttaaaccagggctttacattaatatattctgcctagattacttctggccacaaagctatcatccactgagattatcttgttggtttttggcatcaatatgttcttcttaatcatatatttaagcaggttttttttgtctgctttgttgaattgttttaagtattttttttgcagtcaatgtgctctgccattcaggatgctagatttcagctctccatctgtcttgattgctgatttgtatgtagtaaagatgtattcttgaacaattctctttttttccttatctgtggctacagggaaagagttaatgtagagccctggtgtttgtttcagtatgtttcatattttagattagttcattcttccttttttaatttccctttaacacaaactctcatactatgactgaaatttttcatcattttttttctccttttccacaactttcttaaacatacttcaaaactcactttttattatcccatgttacatctgtccctttagagacttggacaaatcaactactacagtatcctgctctgtgttcctcataaacaaattctttttctgagttaggcttagacttctgaaatagtcatttgaaaagaaaatctaattctcctttgctttaattatcacatctggcaaaatgggaactttttcaaaatgcccttttaaatatgttgtcctttctctttcaactttttcagtgttactcattctgactttttttcccccaatatatggtgcagttgacttaaagtcattgttatagcaccccactagcttgatctataatctgtgaccgtccattttttcctgatgtgctctacttaactggaacaagttgctgccatgaaattgatttgatggttactgttacagggtttttctttacagtaacatctggaagggtcattttcttttcatagctaatcctttgataagcattttttagtaaatgagtatggatttttttttagtagactaaatcataccattgtttttaatattctgttaaagagtattaccagtcactccctttccttgtgtttggatctcagtatttttgtcttttaatctttaatctgtaccaaagtaaattaacataaatgctaaatttaggtttatttaaacatttaagaagatgtattttcattaagaaatacaaccccagactcacaaaagccagcaaattttaattggtatatgttttgggtgttaccttttcctaaatttgttggctctactaaatatatcatggaattcattttagtttctgatcagcactaaactttaaattttaggtcccgtgtgaattcatagaatgaaaaggtccattaaacactggtgactccaattttttctgcgttatttcttgcctgtttataaggaaataatagcagaaatgtcagtatgaccaatattctcagaaagggtctctaaattctgaggaaaatagatagttacaagtgtctcaaatgagagtgatgtgaagggacttaaaaaatcttcgctactggagtcattaagctgttgggacatcatgaacacaatggaaccatgagaggacttcgagaaaagtttctgtttttatgtatgattatgcttttttccttcaaattttgctactttctagttcctgaagaaggctaataacttaaatggatctaaattaacaaaagagcagtttttacatattttgatgaaactatggattcaagagtaagatacactaccctagtgcaagaggtacttttagcctgtaaaaatgcttaggtcctagctagttttggtattctgtcaaaatactgagtacatttgagaactattttagaggccttttgtttaattctgtggtttaaatgtgtaaattggaccaactttaagaagtttaaacacatggattatctgaatttctagttttctagttgctttactatgttttttacgtatatgcattatattgaaaaaatctttactcactttagcagtggaccctctataaccgctatagaaatgaccttagagaaaatttctgtgatggaagtagataatgaaaaatttttaaacatttaatcctgctctctggtattgctgcataacttggaaaatctgttctttttacttagtggtattgttaaatagtctacatgatcaaaaattcttactgtgaagtaagaaacttaagttgaaaataatttgtcatggagtgtcattatttttaggtgacttaaagtgatggtggtgtttttatttctttataggtcattttaggtcatcaaattgcttttcttttcttttctttttttctttttttttttgagacggagtttcacttttgttgcccaggctgtaatgagtgcaatggtgcgatctcggctcaccgcaacctccgcctcccaggttcaagcaattctcctgcttcagccttccgagtagctgggattacaggcatgcgccaccacgcccagctaattttatatttttagagccagggtttctccatgttggtcaggctggtcttgaactcctgacctcaggtgattcactgccttggcctcccaaagtcctgggattacaggtgtgagccatcgcacccagtcatcagattgcttttctatgcaatctcaagctttctcagcttcctttcacttaaagaaaattacccactacagcactttggctgtcttgtcacttgagtttatattaagttatacttttttctgccattctgtaagtgcttcccaaattcttttttttctctctataaggtatctcagatacatcaaggtgaatgtagttttcctacagaaatgtctgaatttaaaaagtgcacgaatcctttattaatctgattttacaggagttacctcagtgtagagtccagggatatatatttttataaaactctttcacttagtccccaccgtaaaccaaccagtaatagatcagtagtacagattagtcattggatgagtttgggaggtatgtgattgattttttgatcttggccttccttttttcactttgaaagaccagacacacttttcccctaagtttgaacctttaaacaacgtggaggattggatataatttctgttcagctatgtaccctttctagctcctatgaaatagaagcatgcgtagtaggataacatttatttctctcccacaacttaagaatattttaagtaaaatctgaatatttttagttcagagaattgtaagtcgttaattggtatttgtttaattaatcctttttttttttttttttttttttttttttttttttgagaaggtttctcgctctgtgtcccaggctggagtacagtggcgtgatcttggctcactgcatcctctgcctttcgggttcaagcaattctcctgcctcagcatcccaggtagctgggattacaggcatacatcaccatgcccagctaatttttttgtatttttagtagagacgggtttcaccatgttagccaggctggtctctaactcctggcctcaggtgatccgcctgccccggcctcccaaagtgctgggattacaagtatgagccaccacgcccagccaaggcttctaaattttgtgaacttacctgtggctcctctgacttagagccatttttattttattttattttattttatgtttttgagaaagggtcttttgctttgtagcccacgctgaagtgcgcttaggtgttcgcagctcattgcactctctaccacccaggctcaagtgacgcatgtaccaccaccacatctggcgtttttttcttgatagagatcgggtttcactgtgttgcccaggctggtctcaaactcctgggctcaagtaatctgcctgctttggcctcccagagtgctgggatcgtatgcgtgagccactgcacccggcccttacaagccattttaaaactggtccccaagaaggcagtggtccattactttccagttgaaactttagatatcccaaatagctgatgattagagagccagctggagagatcttgagttccttagctattagccattattttaaaaagataatctagctttgagagacctggaaatagtagtttatagcttccaacattttaaggaaggtaccattctatttggatgagttccattttagtttacaggattttatttttatttatttatttatttttgagacagtttcactcttgcccagactggagtgcaatggtgtgatcttggctcactgcaacctctgcctcccaggttcaagctattctcctgccttagcctcccaagtagctggaattacaggcacctgccaccatgcctggctaatttttgtatttttaataaagacagcgtttcaccatgttggccaggctggtcttgaactcctgacctcagttgatgctcccaccttggccttccaaagtgctgggactgcaggcctgagccaccgcacctggcctttcacaggattttagataattttactagagcataggaatgtacctaaactgttgtcaggtaaatataaaccagttttttttttttttttttaggagctcatttataaaataccaatccgcagctttttgaaagcacgtatcttgtaatttggtaccttggtaccttactctaatttagttcagctctcagtgagacatccccctttaaaaacacatcgcctgaccatgttttatattccaaatataattgtattgggtagtgtgggtgttacagaaattacctcaatttgtgggagtttgtgaaacatcaataatagttgtaaagcaggaattgtaaaacaagactgctttataatcagtgtaataatagttcttttttttttttttttagcacattccatgtgcctggcaagggtctgataagcagtttacctttattgactcatttgcttttcacaacaaccctatgagactcttgtcccagtgaatttaaataacacggaccaaagattcacatctttgtaatttgggagtgaacctaggcagtctaatagcagagcccactttttgtaacttctctttcttacattgcctaaaaagttaactcatttatatctgcatttttttcctaaagaaatttatttgaataaaataagagttacttcaatttaaagtaaaccataaaagagtaaatagtgaaagaatgtcatgtttcccaccctaaatttggaaagaggcactccttaaatttgcttattttggggaaatacaaagggagcataatattttgataaatgggattcgttttctagaaaagccattcctgttgaatcatgttagcattttatggtaatgctaatcatggtgtatttttcattcactgtgtatttagtaggtagtaaacctggaacatcctcaaaagctggatgtgattaaagttttagtttttgtttttgtttttgttttgttttgttttgttttgagacggagtctttgtcatccaggctggagtgcagtggcgcagtctcagctcactggaatctccgccttttgggttcaagagattctgctgcctcagccttccaagtagctgggactacaggcgtgtgccaccacgcccggctaaattttgtattttttgtagagatggggtttcgccatgttggctaggctggtttcaaactcctggtctcaaatgatccatccatctcagcctcccaaagtgttgggattataggcatgagccaccatgctcggcctaaaagattctattttaactaattgttcacatttatagtatatagtttctagaaaagtagatataaacatggatgttttattcagagtgctataaagtagcatacaatgaatacttcagtttggtccacagtaaaaattaataagccttgctgatctcaaggttagttactactcttgatctttattaactctatatcttttccctgtcaaatatcttaagtatgttgacaagttaatccagtttttccaagaatgtgcatagcgtatttgagggcaggatcaagcctcaaggattcagagaaatggttttaaattaaatcaatgtgatttagtgaatgggcaggtgtttgtacagcctatgatactgcatagacattaatatcctagagtttgaatggttcagatgaaaatatttcagctttatttttgttaattctactaatttactttgctgcaggagtggagtcaacatatcaatggagcaagtcacagtcgtcgatgccagcttcttcttgaaatgtaggagtttgaaatacctttaaaacatccttatcgtgaatcagaatcagccattattggtttttgggagttcatcatttacttgtaatatccacaatgttaatatcacatagtggtactgtatggacaatactatttacaagtaaaatgtttagatctggaaatttcatattgaatattagatgcagtaataatattttgttatttaacatttctaggatacatatatattggtcattatacaaattggtgatttttactagacatagtgaaagatagtatttgatatgtagagtggattaaacagtagcatttttaataatacatgctctaaaaatgtaaaagatacggaaaagagggtaggttattaaaagattctaattcattgtccagcaaaatccttggtgatgaattttttttttttttttgcttttgagatctttggttttgagttcaggctgctaccatgaaatggaattcctaaagaaactccctgcttaagcagcacacagtgcccattgttcactggagttggaattttcacatatgcctaactctgttggggctattctttctttctaatgtcacaactcaactgtgctcttggtattaatattggagaaggaaaatctgtgctctgttcttgtttctatgtaacccacatttctaattctttgtgcggcacttcctccttacaatttaacaaatagaggaaaaacttaatttcaacattatctgcatttgcaagcaatacaaaacaagtttattctcgtggattattttgaagttctgaaatttttcttttgaaatatctattggaaatgctttaaaactatgtttctaacacttagactctcagataactttactaataaatgatctctattttagaggccaaacaaggctgttttgtgaaaaggacagttttattttaaagttaattttctggtctttttaaagctacccagaatggaatcctgacaatgatacaggacacacaatgtaagttaaattttttaagctaccatttgtaaaggagatcaatgtaaggaattcaggtttcactttcaacatttcataaacaaagtattttcagaatttctttactgaaaatgagactttgataaaattcactttggttaacaatttttagaatatatattatgtagtaatttgtattcttttattgttaatgtagactttgacctagttacttcacagatactctgaaagattgaagtggttgtggtcatatattggggtgctttaacatttaatcttaattctttccaatggacctctttattatgatttatattttatgtcttcactttactaggggtgatccattcatgttgcagcagtctacaaatccagcaccaggaattctgggacctccacctccctcatttcatcttgggggaccagcagttggaccaagaggaaatctgggtaattatataaaattcatgttacttttccctacagagccgttactgaaaatttttctttttatttatttatttgagatggggttttgctcttatcgcccaggctggagtgcaatggcacgatctcgactcactgcaacctctgcctcctgggtgcaagcagttctcctgcttcagcctaccgagtagctgggattacaggtgcccaccaccacgcccagctaattttcgtatttttagtagagacggggtttcaccgcgttggccagactagtctcgaactcttggcctcaggtggactacccgcctcagcctccaaagtgctaggattgcaggtgcgagccactgtgccaggccgcaaattttacttatttattttagacagattctcactccgtcactcaggctagagtgtaacggtgcaatctctgctcactgcaacccctgcctcccgggttaaagctattctcatgcttcagcctctcctgagtaactgggattacaagtatgtgccaccacacccagctaatttttatatttttggtagaggcaggggtttcgcggtgttgcccaggctggtctcaaacacctggcctcaaatgatctgctcagcctcccaaagtgctgggattacaggtttgagtcaccacacccggccccattctgaaaattaaaggcaatgattataggtgaaagaaggctcattcaaatattacacagaaaaaacattgcatgaaaagtgatggtaatcatatatttgtaagagcttttcatttgtgtttggaagatgcacgtttttcagtaaaattgcttctttaagcaagtatagtgattacaagactgaaaactttctcttcccataaaggtgctggaaatggaaacctgcaaggacctagacacatgcagaaaggcagagtggtcagtaatgaagcttttggttttactgtatttatgatttttgggaatatgatttgacctaaatccttactagttgagtatgtatcgtggtccttatgggaacattgctgtaatttgaaaacaatcacgtttttctatggctttgataacagttaaaactttaaattttgtatgcccatagtccagtgaggtcaccttaattcagcatcttggaagctttgctgtccagttacgcgtacaatatttaatttaaaaatcactacagagagtatgttttgacactttgaagtagtttaaccgtttggttatggtcagaaagaacttacccagtgacgtttgatatgtagctttaaaattctctagaatgttatgagttgttttacttacactctcctggttaattatagattataaaaagtcctaatgcgtaattggtttcatattgctttaaagagacttaattgcttggtttttttcccctaatggataggaaactagcagagttgttcacatcatggattttcaacgagggaaaaacttgagataccagctattacagctggtagaaccatttggagtcatttcaaatcatctgattctaaataaaattaatgaggtatgaattgaaatattggtattattcatttattcatgccactaatatatgttctgcaagaattaaatgattttgtattagaaaaataaaactcaaggtaatcttaagtttatcaaatgcagaatgtagtagaggaaaaggccagtagttgatgaatataatagggtactaatggattattagtaactataaattatgatccttaggtagtaattgtcattatactactataaaagttgtaaaaggaaaattctgtggaaagccatttcagatctataccaaaatgatggtttcaagtcattatttttagtccaattggcatagtaaatgataaagtaatgcagtagaaaattaatctgaggtggcctttgtaataaaatagcaaattggcaacactgttttttggggtttttttgtttctttgttttgggagtcggagtctcgctctgtcacccaggctggagtgcagtggcgcgatctcagctcactgcaaccttcgcctcctgtgttcaagcgattctcctacctcagcctcccaagtagctgggattacagccgcccactatcatgctcagctgatttttgtatttttagtagagatggggtttcaccatgttggccaggctggtctcgaagtcctgacctcaggtgatccacccgccttggcctcccaaagtgctgggattacaggcgtcggccattacacccggccaacatttttgttcgtttgtttttgttttgttttgtgtttgagtgtcactcggtcacctgggctggagtgcagtgaggttcactgcagcctccacctcccaggttcaagccattctcctgcctcagcctcctcccaagtagctgggactacagacgtccaccattacgcccagctaatttttgtatttttagtagagacggggtttcaccatgttggtcggccaggatggtcttgatctttcaacctcgtgatccgcctgcctcggcctcccgaagtgttgggattacaggcatgagatactgggcccagcctcttttgttttgtattttgattcttgaaagtattttctacttaatgattaaatatatctgaaaagatttggggcattgttattttttaggaaaaaaaatctttagttcaatgtgagaaagctgattggaaaaaacagagaaataactttttgtataatttcaggcatttattgaaatggcaaccacagaggatgctcaggccgcagtggattattacacaaccacaccagcgttagtatttggcaagccagtgagagttcatttatcccagaagtataaaagaataaaggtaatgtttatttttttcaagctgtatatcagtttaacaaatgattttaatagttattaactgtggttatttcaaattattgctaaggccaggtgtggtggctcacgcctgtaatcccagcaccttgggaggccaaggtcagaaggattatgtgaggcccaggagttccaggcaagcctgggcaacatagcaagacctcgtctctataaaaataaaacaattggtaaagactaggatgtttttaactgttaactaataattattgcacatttgtccttttgttgttgttatttattaaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggtaatatacataaggaagttttagagaagataatttattaaaatccttaagatttttcaatatggagctgggcgtcattcctcaacctgtaatcccagcagtttgggaggccaaggcaggcaaatcacctgaggtcaggagttcgagaccagcctggccagcatggtgaaatcgtatctctattaaaaatacaaaaattatccaggcgtgatgtgcctgtaatcccagctacttgggaggctgaggcaggagaattgcttaactggcagggggcggaggttgcagtgagctgagattgcaccactgcactccagcctgggcagcagagcgagactcccaactcaaaaaaaaaaatttgcttttttttttttttttttttttttttttaaagtatatccctatttttagtgatgaaatctggaggactagttgtttgcttttcttttcttttttttttttttgagacagggtctcaaaaattaatatttcatacttttttttcttgtatttaaaaaatatagagttagccagtcgcagtggctcacgcctgtaatcccagcactttgggaggcggaggcaggcagatcacgaggtcaggagattgagatcatcctggctaacacagtgaaaccccctctctcctaaaaatacaaaaaaattagctgggcgtggtggcgtgcgcctgttgtcccagctgttggggaggctgaggcaggagaatggcatgaacccgggaggcggagcttgcaatgactcgagattgtgccactgcacccatcctgggtgacagagcaagactccatctcaaaaaaaaaaatttagagttaggctggatgcattggctcatgcctgtaaatccctagacattgggaggctgaggccagagttgcccaggagtttgagaccgccctgacaacatattgaggccacatctgtacaaaaaaaaattttttttaaccaggcaaagtggcatgctcgtacagttttagctacgggagtctgaagtcaggtggaacacttaacccaggagtccaaggtttgtagtgggctatgattgtgccactgtacttcagcataggcagtggagtgagaccctgtctcaaaaaggaaataaggatgaggagaacatcttttttgtttttctttttttgttttaaacacttctgtaattcagcattgcaagtttgtgttcttccagacttttatttttcttacactattttaatatcttaagcttattacttttttttttttttttttttttgagacagagtctcgctctgtcaccccggctgtagtgcagtggtgcaatctcagcttactgcaagttctgcctccccggttcatggcattctcctgcctcagcttccccagtagctgggaccacaggcacccgccaccacgcctggctaatttttttttttttttttttgtatttttactagagacgggtttcaccatccacaggatggtctcgatcccctgaccttgtgatccgcccgtctcggcctcccaaagtgctgggattacaggctgagccaccgcgcccagccagcttattacttttttgcagagtgtatatagatggcttagtatttggcactaaagtgattcttggggattttgtaaatctgacaggttggttttttggtttttggttttttctgagatggagtcttgctctgtcgcccagtctagagtgcagtggtgccatcttggcttgctataaactccgcctcctgggttcaagcagttctcctatgtcagccttccaagtagctggtactacagtaggcacactccaccaggcccagctgatttttgcatttgtagtagagatggggtttcaccatactggtcaggctgttctcggaattcctgacctcaggtgagccacccgccttggcctcccaaagtgttgggattacaggtgtgagccactgcgcccagccctgatattcagtgaatttttaactctgtgctaaagattaaaatttttagccgggtgtggttgctgtcacctgtaatcccagcactttgtgaggccaaagcaggaggattgcctgagtccaggagcccgagaccagtctaggcaacatggcgaaactgcacctctacaaaaaatacaaaaattagccaggcattggtggtgcatgcctgtagacctagctactggggggctaaggtgggaggatcagttgggcccagtacatcaacgcttcagcaagccaggattgcgccactgcattccagcctgggtgacacagtgagaccctgtctcaaaaaaagtaatgaaaattttctaaccagtaggtagaatacataataaggttttatacaattttgtaaaatataatgtgctttgtggtttcttttctttctttttaaggcttttattgagatggagacaagagaagatgcaatggcaatggttgaccattgtttgaaaaaagccctttggtttcaggggagatgtgtgaaggttgacctgtctgagaaatataaaaaactggttctgagggtatgtagtatttgatttgtcatcatttaacagcttgtttttacatatttaaagccacaacattcttttaaacatttttgtatgctaaaaatacaggattattgaaacctattgaaataagttattgaaagagaacaacctttttttctggtctttaatggcagaagtttttaaacgagtcttccctaaaggacaccttcattgctcttatctgtttaagtttttaatagcgttctgctaccagaatgttttattttccacttctctgttggtatggtcatgatgaatgtctgtaggcagcttaggttctcaaataaggttacgggaattgaataagctgagttgattatagggattgtctccaattattaattcactggataattgtgtattctgcaaatgtgttaacttctgcaaaacttttgtcttttagattccaaacagaggcattgatttactgaaaaaagataaatcccggtaatttcattttgtttttcatatgtgtgagtatattcaactttactttttcagacaacaaattaattgtggtgtgtccttttgatttcagaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtaaagaaagatacattgatttgttttaatagaacattagatcagatcagtatttcaagttatttacctaagcaggatcagatagaattatatgatttaaatcagaaaataaatcagatatgaaccagaatataaacatttaaatctaaactctgcaataaataattaaataagacattttattatagtgggcaaaaaacatcagctcaaagaggaaacttttcagtaaaaatgagggagaaagactcaaaatatatgtgcttctgtattgtagtggtgtagtggtagcatataggtaggcagccttatagtgtagctttgaaaaaaaaaatacaggacgtgagtttgcagtaagttaactgacccaacatagttaaaacttttgccactcattcaaaaattattgaataatttttcctatttgagaaatgttggcctggtcagataccttagtatcctttaaaacaattttatttgaacaagtaagtcatttagaagccatgtataaagtgaatataaatataaaaatacacacatgctataaagaagagtaaacaaaggacccacattgagctgactgcctagcttaaggagtagggcattaaaatgcctttgaggcaaactttttatgttaaatggctcataaaatgtcggagtcaggcgggcccagtggctcacgcctgtaatcccagcactttgggaggcccagcagatcagttgaggccaggagttcaagaccaacatggtgaaaccccgtctctactaaaaatatgaaaattagccgggcgtggtggcacatacctgtagcagctacttggaaggctgagacaggagaattgcttgaatctgggaggcagaagttgcagttagccaagatcacatcactgtactccagcctgggtgacaagagcaagactgtctcaagaaaaaaaaaaagtagagcgaaatgagatttttgccatcctattccatattccattggttccttttatgcaacattcaactcaaaaccaatatttacctcagtttttatttgatggcttggtcaaataacttcattaatttttctcactagagctgatcattatgtttacatttgtaaatgctaataattactgatgtttatggcatttaatgccatacgtttttctaagtttaaatttattaatttaatcctcacagtaaccatatgcatctcatactgtgatctccagtccataaatgaggaaaattgaagtatggagaagttaaataatcccatactgcttataagacacagagccaaaatttaaacttgggcagtcattcttcagagcatgattgttttttttttttttttttttggagacggagtcttgctctgttgcccaggctggagtgcggtggtgtgatctcagctaactgcaacctccacctcccaggttcaagttctgctgcctcagcctcccaagtagctgggattacaggtgtccaccaccacacgaggctaattcttgtatttttagtagaaacgaggtttcgccatgttggcctggctggtattgaactcctgagatctcagggtgatccgcccacctcagcctcccaaagtgctggaattacaggtgtgagccaccatgcctggcccagagcttggttttttagccattacactgtttgagtatttgctctaaagagtaggtatttgcagtatactgtcttagaaaggatattgctcaacttttaccaaatcaagttttttacacattgcctagcagcattgtagtctcagaaaagataaaatatgaatattcctatctcatttaacttctgctctttgtgtgaggcagaccttccattttttagttttaaaataagctaaattatttttcaaattatcagtaattttttggaagaaaggaagaagttactattttgagccaatgaataaagacaaagacgcggccgggcacggtggctcacgcctgtaatcctagcactttgggaggccgaggtgggtggatcacgaggtcaggagatcgagaccatcctggctaacacagtgaaaccccgtctctactaaaattacaaaaaaaattagccgggcgtggtggcgtgcgcctgtagtcccagctactcgggaggctgaggcaggagaatggcgtgaaccagggaggcggaggttgcagtgagccgagatcgcgccactgcaccccagcctggtcgacagagcaagactccgtctcaaaaaaaaaaaggcaaagacgctatccgtttcccttcaagtaaagcagacagaagggatgctgcaggataattgttgcagagtaaatttgtctttcttaacagcgtcgttttccagggagtatggaaggttttgtcactctagatgaggttggtgatgaggaagattcggaacttcagaaacttcgtaaatcgggcatggcatttaaatctggtgacaaaaatgatgatggtttggttgaaattaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtgagatttaagtctttgttcttcaccttcctcactctcctcaaaacaaactcttaggttttaaaataagattttaaagttggtcttacataagctgtgatagcattttaaatttgctttgtttctatggggaacaatttataaatcttaattgatatattttcctctcatgcatgtctctgattttgtattattttctgttgttattccacaatgtgttcccttttttcgtaaaatttcttgcaagttacacgcttttgttttgcttttctgtgttgtttttctgtattatatttctttttttaagaatacagttaggtgagacctcaaacatcaattaggtaaaagcaaaatatggttcggtttttgttttttatcttaggctgtattggacttctcaaaaacatgttgtttcatttaaattatgttgacaggtgaaattgtgaatactaaataaaatcttcagtttaatttgtaagaatgtatgtttgtatttctaggtatagactatgtgatacctaaaacagggttttactgtaagctgtgttcactcttttatacaaatgaagaagttgcaaagaatactcattgcagcagccttcctcattatcagaaattaaaggtaaggttgaatgtaaaacagttcttttgtgaaaacttaacaagttatggaaataagtggggtatataagtaaaatgtgtatagtgttctctctagactcagtgcagtgctttctcctgaagataactttttatttacttttttttttttttttaaagacagtttctctcttgttgcccaggttggattgcaatggtgcaatcttggctcactgcaacctctacctcctgggttcaagcaattttcctgcctcagcctcccaagtagctgagattacaggcatgcaccaccacacccagctaatttttgtatttttagtagaaatggggtttcaccatgttggctagcctggctggtcttgaactcctgacctcaggtgatccacccacctcagcctcccaaagtgctgggattacaggcatgagccaccgcgcctggccttttctttctttattgatgggttatcaaaacatctgttgaacctcttgtcatagtttacccttgctacataacaatttagtgttttctaaccatattataaattctgtggtagaattaaacttattcaagtattctcagattgttgttgggctgtactttctctaatttgaaagatgctgggagtctgaatactaaaagtggcatgaccattcatattaaaataatttttaatattgacattattattgacacttcagttatttttatgaccaaaagtatataaagatcaaaagcataaatacataaaccacaacatcactaaagaataattcctattgagatatattgaaatttgtttttgtaattatcagcttctttggactacctattgaaatagtgactgaaacttaaaagtagttgctaaacaagtcaattatagataccttggtttttcacactgctttataataagttaactatagttactcagtcattagatatgttctctgttgactaaatggatgaatgtaatctttaattttggaaataattcaagttcttggctgtgtgtcacttctgtttttttttttttttttaaatgtaactgctctttgccacctatatgtcttttaccatcctgtatatgaagaaagaattgtggctatttgcaatggtagcagcaatgtagtacaaattattttattttatttttttgagacagttttgctcttgttgcccaaggctgaagtgcaatggcgcgattttggctcaccccaacccccgcctcccaggttcaagccattctcttgcctcagcctcctgagtatctgggattacaggcatgcgccaccatgcccagctaattttgtatttttagtggaaatggggtttctccatgttggtcagactggtcttgaactcccagcttcagatgatcctcccacctcagcctcccaaaatgctgggattacaggcctgagccatagtgcccgccctggtacaaatatttttatctgctttgattttaagctgtttggggtcaaaaactatatgtattgtcgagaagaatatggaaataatataaaagattgctaggtgcttcttgtggctccttttattatttccttatattttatttattttttttttatttgagacagaattttgctcttgttccccaagctggagtgcaatggcacaatctcagctcactgcaacctctgcgtcccgggttcaagcaattctcctgcctcaggctcccgagtagctggtattacaggcgtgtgccacttcgcctggctaattttttgtatttttagtagaaacggggtttcaccatgttagccaggctggtcttgaacttctgacctcaggtgatcgcctgcctcagcctcccaaagtgctgggattacaggcgtgagccatcatgcccggcctattatttccttttattaaaaaaaaaaaaaaaactttgtcaccttcatcaagaaactgttaagcattacagtaacttgctaatggtaaattgatactttcctaactggatgtttgtggggtgattttttgttgttgttgtttttctttaaaagatataatggcttttaattcttactattttgcattaactatataaagttgaaattccaatgagatggaaagaagctttggacattttaggttagattttttaatatgtcttttgtactttcattagtgtcttaatggagctcccgtgtctagaaactctagcagtcacaggtttaatggcaggggtcagcaagctacactcgtggctcagtcatctgtttttgtaaggttttattagaacccacagccataatcatttaagtgtcatctatagttgttttagtttataattgagtgcaggattgagtagttgtaacaaagactgaatggcccaatgagtctaaaatatttactgctggccttgcaagaaaatgtttgttcaggtgatttaatgagtagtgcattgaggccagatgtgatagctcttgcctgtaatcccagcactttgggaggcggggacaggcagatcacctgagatcaggagtttgagaccagcctggccaacacggtgaaaaccccgtctctaccaaaagtacaaaaaaattaactgggcttggtggcgggtgcctgtaatcccagctgcttgggaggctgaggcaggagaatcacttgaacctgggaggtggaggttgcagttagccgagatcacgacactgcactccagcctgggcaacagagcaaaactctccctcaaaaaaaaaagaataaaagtgcatgtcatttaaacccatagttcttgaatagtgtcagttcagtgtgactgtggtctttgttttctcatctctaaaaattagggttaattataacatttgaaatacccattttataccttttaccattttttccccgtgccttattgtaatgtcctgaaagtttttgtgtgctaatgaggattaactaattgttgaaaatattgacaaaattatagtttaagtccctaaacttggatataggatatttgattttggaattaatccattttgctgcatttctcttaggtgacttaatggctgtaattctctttctttatagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccattatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaacgtatttgtcagttgtggtttttattcgctcttaaactttgtgcatgctttaacaatttattacttttaaatctagagtgaattctaaagactgccgctaaagatctgagttttaaaaatgttgttgctggtggatttcttgttcctgttacataactaaaagtgaggccatttgtggtttttaaaaaccttatgaattaaaaatgctacaggtgaacaaacagaagcttatgtttagagagattgatgacttaacagtacaattggaagtaatacggatgagcaagaattagttctgcagcttttcaaaataattacgtagagactcttggtatattggattatctgttgtaaacaatttttttttcttccctgacacagggtctcactctgtcacccagactggagtgcagtggcacagttctctgcaacctcagcctttgggctcaaatgaccctcctacctcagtctcctgagtagctgggactacaggctcatgccactatacctggctagtttttggtttttttgtatagatggggctttgccatgttgcccaggttgatcttgaattcctgggcccaagtgatctgctcgcttcagcctcccaaagtgctgggactgtaggcatgagccaccatccctggccaagaaacaaagttttaatttcaaaaaaatctacaaaaacaggataggcattgtctttcaaatgttcagaccccagtttattaaaggatacttcaaatagttggctaaattttatgatctctcccgttgaaaagtaggtgatgattttaatgtgacatgcacaaaaaatccttgccagtttacttctgcaatttaattttagcctttactaattacccacttctgtttaattccaatttttaacagcaggtacataaagcattatgtgcacaatggagttcttcagtgtttcctttcagtgatggctttttcatagcttcaactttgttggatttagcaagttgaaggaaagaatgctatgtttttaatacctacatttgagagcatttagaaatcagaaattataataagctgttagtgataaatctgtaacagcccttcgattacgagaaaacctctttttagtaggaatgtttccactcatgtttgctgtaaagtttaagaacatttttcctacggctatgtcagcccttagtttaatcttacattatcctacaaaagtgaatgaaacttctagaagtaccttgagtttgttttacagttcttttttattgaccgattgctagtaaatttgggatctgagagtgtcctttataagactttaattggatagctgtaatattgctttgagtattccaaaaataagttcatttgaaatgttattcaagaatatgaatttccaaccatagtgtgtgtgcatcagtacctctagagatttatttatttattattatttatttttttttttgagactgtgtcgcccaggctggagtgcagtggaatgatgttggctgaattctcctgcctcagcctcccaggtagctgggactacaggtgcataactgccatgcccagctaatttttcttagtagaggcggggtttcaccatgttgaccaggctgggctcaaactcctgacctcaagtaatctacctggcctcccaaagttttgggattacaggcatgagccaccacacccagtccctccagtgattttaagtggtaacatcctgaggagctttttaggaatagccattatttgaattcgctaaggacaggttcccctgccacctttttttaaggtgatggggactggaaaaggaaatagtaaactattgaatgttgtggcatgtagtaaggttatacagggagaagagtgtactgaaattgtttactttagctttgttcacagtggattttttttcagccttaagattgtgacaaaagcagctcatggtatgtaatagaaatctgctgggacactgc

SEQ ID NO: 17295 - DNA, 110402 bp, Human
aaaaaaaaagaaagaaagaaaatgaattctgaaatgtaaaagacttaaatataagaaataaagtaataaccatcatgcaaaaaaataggagactgtatatacaatatctggataaatatacctcataccctaaaaatagaaaagagctcttatagattgacaaaacaacaaacatgttaatagaaaaaaatgagtaagagaagtgaacaagcagtttacagaagatcaaattaattggtcaatagacttaagaaaaatggttaagtttattagtagtcagggaaatgaatcaatgaatattgattgttggcagaaaaaaaagtgaaaaaaaacccttctattgctaatagaggtacgtgggaaaaaggattatcttaccttagaggtatgatttttttcccccataatgttgctaatgtgatggcacaaatggtttccattcagtgagaaacatgttgtaatggaaacttcgtttatttgcacttggaatgctattgtgtgacatacatagcccttagtagcactgtggctttagaccactcacataaattcttgaagcctcattttcctcattgtgagatggagataaccagccttagctgactgctttcctctggggttgaataacagatcttgtgtatgccaggtctttgcaaatgatataatgtgatttacagaatattaggataggccatgagcttttcaataccagagtccaagaacaaattacataaacgtgtatatagaaggaaaatctactaagtgtaacttgcagtaaagaagagctttgtaaagaaggcttgatgtcttagttactttcattattggatctcagttttctgagcacagaacaacgctctccagtagaacttactgcagtgatgatgttctgtgatctgtatgctttccagtactagtcacatgtagtcgttgaacacttggcatgtgttagtgcagcagaggatctgatttatcgaattttaatttaactttcagttttaaaggctgcatgtggacagtaccatattggacaggaaacctaggctgcacacacttactaaattataatttgaggcagcttacaaccagatgccaaagaaattacaatcagaggtaggtgcagtttatatttgccaagactaaaatcgatatttaaaaaaatgtagtttgatgaactcaagatctgaataagtaaactattaacagaagatattcaatttgaggaaggaatttattcaaagactatagaagttgaacatttagacttctcagccggaagtccagacatgctggcctaggtgctttcccagatcagcttttgctttctttgtagattccttgctgccagtgcagtattcttcactcctcccaggttgtagccctggctcctctcttttctctgttttgattccctgctatgagcttcagtttattcttctacaaaatggatcaaatatctatcttcaaggaacctttactcttctgacattctaggaactttaaggagctagctgatttttcatggactgcatttcaggggtgtcgctcatgtggtgatttagggatcaagatgagaaaggattttgtagccaggagtctcatcctccatgtcaaaatgtctttccatagcatcaatcagtgggtggcctttttgaggtctgggagccttggtctgccctgacctttgcctacttgatctgagatatttttcagttgaagatcccacattcaactttgcatatttccatttattttatcatcaagccaaaccattttaaggctaaatattttttaaaaactactctgcaagctcatgttgtagctgccgtaggcttacttttcttctcatagtttctactgtgctttgtgtaagatagttggaaactgtcattatttaagaagaaaacaaagagcttactattttacaaagagcaaagacattgattgttgatatatattttcctgaagttttacacatctttttgtctttttctttttagagtcctgtgaagataaatcagattagcttggatgaaagtggagagcacatgggtgtgtgttcagaggatggcaaggtatggcaaagatgtggtcatgcagagagttctgtggcgccagccccaggtgatcggaacagcaccttgcttactatataactgcattaagacaatcttgattattctttctgagtattgaacttgcttctgattggtcataattgaagtaaaatatattttgcacaaatgtgccttaggaaaagtaattacaagaatgtcaataatgtaactagtattaagctgattaacagctgtggcagggtgacgtgtcaccttaatcattactaccgtgccacttctgcttcagtgactagtctgcagttcctgcaagacagtagtttaatgtctttctgccataaatccacaaaattggattttgtgggcatgatttctgtgggccagtggttttcattttcacacacaagttatgaatgtttctcttgaattatagaatcttttgataagcaatcatagtttatcagaagaataaagtgtcttacaatggccacattaaataaatgtaaaatcaatatatgtacagttttctaaaaacctggcgcctacttcctcgaccaaggacatacatcatttgtgcagtgtataactaacaattatcagtgcttcttgctgatgttgagctgtgacatttaatggttgtggtgattgattttccacttataagaatgtcttttttgtttttaagtcgatggaaatcttttctaatgttggtttgcaatgataaaatcctaatgcacagtgtatttaagctacttttctaaaataacagtttgagagagtgcattaagaatcattatagatctttacatattccttactgagtaaagcagatttcctaatctaattttgtatttattgtgtgccctaaattcagtgggccattaagatgggtaaattaaaaacagtatacccggtgtaaaagagatatacccatttaatctgttaacaaaaagcaacatgaagtctcttgacatacaagaatgcattttatatatctaagcctaatgttgcccaaagagtcttttgaaacagtaattggaacactagtgcttttcaaaaagcactgtcaaattttacagtactttcagaaattctgagattgtcatgattatcagagagagatgaaggaggagttggtttgtgcagaaatggagaagaattatccacaccgctgaaacattttttgtgttcatgtatttgtaaagaaagataatcttcattttgttttcttaaaggtgagaaattccttttgggctgtaatcagtttaaccgaactaatttgttgaaagatagtactcatttttattaaaaattggaaacgaatttttactaaatacttcatctaggaattttcagagctttaaatgttgaagaattgttatttaatgcaccaaagtggaatatgttagctactccatctggtggataagatgaacctcagattatctcatggtacccttcttgtcaaacacctttggtttcctattttggtaaaatttatagctgcctattttagtgtggaaccatgatatatttttggaaataatcttcccgtatttttattaacattggtagaattgaaagtaaatcttttagtacacataattacatgtaagctacccccttaccatgggttagtcagtattgtgaaaattgagaagctagtatagaatgatctggtaaagtggttggtgatgataaaaatataaagacattacacaaacacattccagatatctaaatctaatgcatctttaaataggttttgtgggtattttttcctttcttcagtgtgttaaggttcctagataaataattatttattagggttatttcaaggataacctttgatatttgcattcagttttcaagtcataattccagcagttgtttaaaatttacaccgtttattcagctggtgctcattttcaatcttttttttgtcatgacttttctgcagttctacattttgagacacacatatcgtatgtgtgcgtgtgtgtgtgtgtgtgttcagtttcagtttactggcatatgtttctagaaaacttttaggataagtacatacaaggtttattttgggatttcttgcatatgttgctttcatatgtaaactatagtataaaattctgggttggaatattttttctcaaaattttggagatgttgctcccttttttctgacatttatttgtgtagacatgtctgaaaccagcctacttttgttcttttctaaaacctttacaattttttttttggtcctgccttggaacttggactaataataataattacaacaagaacaacaacagtaataaatggtctgtgtaattcagtttgctaagttatgtctagttctggtctcttttcattaattttttctggagtaccgtcagtccttttgatccatacactgaagtattgttttcatttcagaaaagtttagttcggttataattttgatgattgcctcagttgcatttgttttcatttcttcaaagaaattcagtaatataaagctgaaggcaatatcgcttagaggctaggagcatagctctgtattccagctgcctgggctggcattcccacttggtgtgtgaagttgggcatgttgctggcctggcagtgcctccctctccccatcttggcagtgggaggcccctgaggagtgttgtgaggtgcaggggatatggtaagctgtcagttatgtattaattgtttttattgctaaccattcatttttaatccattgcagtctggcctcttcctgtctcccattattgtacctgaacttttcaaggcaagagggtgaatgattaagcactatttacccttctcctccttttggcaatacataggttgtatagaaaattgttcattcatattgtgtgacgtctcacacatatactttgctttctcatttttagccttttatttctgtgtagtcagggagagttcctctacttgtttattcccttctctgattcacttttcttccaaagtcagttttgtgtcttactgcttcctggagtagatttttattgcattttgcatttttaatttgtctgaaatctttcccaattctgttttcatatcagcctgatatatatttaattttttaaaaattagaactttttggccagtgcagtggctcacgcctgtaatcccagcactttgggaggccgaagcgggcagatcacggggtcaggaaatcgagaccatcctgactaacacggtgaaaccccatctctactaaaaatacaaaaaattagccgggtgtggcggcgggcacctgtagtcccagctactcgggaggctgaggcaggagaatggtgtgaatccgggaggcagagcttgcagtgagctgagatcacgccactgcactccagcctgggtgacagagtgagactccatctcaaaaaaagaaaataaaaatataaataaataaataaacaaaaattactactttttatatgccatagagtgtcagatgggtgttgtctagtggttagcagtggaattatcctgtcacttcttagctgtgtgatgtctgctaagttatttatacctctctctacctcagcccatttcctcccctgtaaaatggggataataacagtacctacttaattattaggaggattaaatgagttaatatatgtaaattacttggaatagaacctagaacagaaaaatcacttagtaattgtgagctattattataatcattgtcgtcatcttcctgtttttctgctccaggttcttagaggtctgatcttcttgttgtggttgccaaacagttttctagttttttctttggtttctggttaatattaagatatttcttaaagcatggtttttctccctttgaatctttggaatgttctgcaggacttttttaatagaccttggctatgtttttgtttgatttgtttatccattccagaacaggcagatctcttcctcaacctgggttagcaaacagattcaatgtctaacttgcccttgttactgttttgggtattttagaatccccttagttcagcaacagggaccctaaaatgagctcagtttcccgtaactaaatgaaggcagctccctggggggaactagaggcttctgtcatcactctctggtctctgttagtcagcctgggtggagagtatgaaaaccagcaatcttgactgccagagtccctttagctaccactggaggtataatgacagttcacatgtccaccctattctgatttttaatgtgttgtttggaagcagaagtttgagagaggctgttacaagggaagtctaactgggaaggtcatatagtactctggccacctccgtcctcatttctctgcatcagggctgttgcccagtgttctggttggcaaatacatagagtttcatgctaaagtggagaatgattacatcccttactgtttcatgagggtaggtttcctctatttcgggtaacaaaacatgtaccacatacttctaaggtactcacatggctctctggtttgtagctaatgagaattctcccaggactttgcaggagcttggttctatggctcattgttaggaattttctctttttcttcattaggtatttttttttagcaggttcagggtagttgttagggctactacaggagataccgttttcaaaagggtcctctctcgtaacctttaattatgtgattcttatctcagatgagctcttcccaaaagcggagggattccctttacagataagtgtgattttcacagacaaaatggcaaaataaataaagagggagagagaggggaaataaatgagaattgttttggattttattatctttagtagtataacgtgtgagcagctagtttggcatgtcatagtagtgaaatgaaccaaaacattgaagattttacaaatcacccttgtgctgatactgacaaagcttatgagatttgtctcgtgaagttatatgttttttatattgaaatagaatataagaacacttgaggaaaatgttgctcagttaaacatagtaatagaaactgaccagagagttctattcttgatttgccaccttcagcagttactcctccagcccctactgtgggtatgacagtgacatttttgcttctggcgaattcttaaggatagtgatgtgtatcggtgcctgtttactatgaacttgtttgattttgttctcttttttgtttattcctctttatcactatactcttatgccttcaatatgcatttttaatttttgaagggacatttatcctcagcaattcctaatttaattttcagcattacatccacagtcccagtatttatccacacatttactgatctgtcagtctttttctacaggcttatgcatcatttgtttacatctcatatacttttctgcataatagaaatcactttttttctaaaatttctttattccatctataaggcagaaggaagtttatccatttgaatgaataatcagcttcatttaatttcaatttctgtcatagagtgtccttaattcaaagtctgatattcatgttcttttcagtttggcacatatttaaggcttttgaatgtttttttgttgttgttctattctactcttcttacactttaggtaaaaagatatctttcttttttgcaaatttcagtttatcctatataaagatagcatgtagaagaataggatttagaaaatccgggttctggttctaactcttctgcttatgatttttatgaccttaggcaagtcatttttctatagaatcatcagttcaacaggcataatggtatttgctcttagacctagcagttttgctatgaggaccaaatgaggaacagcaaaacattgccaattgtgcagacttcaaaaatatcatttcgcctcaccagaaagtttgagtttgtttgttcagggtgggatttggccattagtttccaggaattttaactgtacaggtgtgtttgagaaccactaaggtaaagcatgttgacacatttagggatgtaagttagtagcagtagtatgagatttagcacaagaccatgcagtacatgaccttattgtactgaaaagaaatagattaagttaggagaagttcagcttgctagttgagcaggtattcatactgaggtagcttcatcaaggtggccatttgttgattcactccattaagattcccatgattcaggaacctccttcttttcacctgattttcttagatttgttggggtccatcaagttaaacttccccaggtaaagtgaaaccctgaatgcagtgctttccttttgtgctttttagccattattttataagatgtttgttatattatcctatgcctatatatttccataaaagtaatgactttataccctctgaacaatgagcagcaggtgatgggggggacatatgtgtatttgccatgtgaagaatacatttcaaggccagcctcaggaaaaatgaaattccttctgttttacattatattatctcctgtttgtagaacccaaataacaaacttggcacaagtatataaaaacagtagttacaaaatgagtggatggtccccaaaactttaacttttaatgcatgaatctatttcccaaaattataacataagtgaatttcctgcttggggcttgaaagaatgaaccactcagaacttaccaagattaaaataagaagaaattgaaagtttaagtagtcctatatttatttttcaaatagaatttataattggaaaccttttcacaaagaaactatcttagtccatttgtgttgccataacaaaataccttagactgggtagtttataaataacagaaatttatttctcacagttctgaaggctgggaagtctgatttcaaggtgccagcatttggcatctggtgagggctgctctccttgcttccaagatggcgccttgttattgtaacttcacatggcagaagggatgaattatgtgtccctgtgtggcagaaggcagaagagcaaaaggactagctagtcacctcaagctatagctagttaccccaagctttcttataagggcaccaatctcacctatgagggctccaccttcataatttaatcactcactaaaggccctacttcttaataccatcaccttggaggttaggtttcaacacagtgaatttggggagaacacatacattcagaccatagcaaagccatgagacctagatggcttcaccagtgaattcctacaaaagttaaagaagaataataccactatactagagactagaaagacagtgaacacattccaatgttgggaaatagttctcattggctctagtactatttgttagctccaagcatttgagatctcatggaattctcatgctgagagtataaataaccatcactttggaggttaggtttcaacgtaatgaatttgggggaacacaaacattcaaactttctcatggtgagagcataattaatttgaaaccactttgtgaaatggtttgcctattaaatgtgaacatgcacataacctatgactcagcaattccattccaaggtatacacccttcatgaatatgtatataagtccaccaaaagatttgcaaagcatgttcttagcagcagtattcatgatagccccaatctggaaacaacctaagtggtcatcaatggaagatggatatgtgaattgtgatatattcatacatgaaataatacccagcagtggcaaagaaccaacctctactatatccaacagtgtggctaaatctcacaaagaaaatgttaaataatgaatgaaataaatcagtgaaatagaatatgattccttacttacaaaattctaacaccagcacaacttatccatgccagtagctttgagggtagtgattagttggagggtgttatttactggaaagggaaacaaaggagcttattggcttctatttcttgatcagagtgatggttacacggatatgttcgtgtcataaaaattcatcaaactataaatttatgatttgtattttttatagcatgtattttatatttcagttttgtttttgttttgttgttgttaagtaaagcactcagaaaatatactaagtatgaataaagtagcctggaacaactttaagggagacactgataagcaggaacttaaatctttcatttctgtattctcagtagatttagcataagttgtgagtgaagtgtggttcacctaatctcttaccacactgatctacatggttggtttattttatatatatgagagacactaaaaaaaaatctcccctttcctttaagggatgaaaaaatagttcctttagggacagcttatggaagtttataaaagaatagtaataacttgttcaaatctgtttcattgttttaatggcatgcatttaatacaatttgtggtgattgaagggaactctatccatggaatgcttatgaaagcttaattgcagcaaagtaccctcaacctgatgggattttcttttttcttttttctttttctttttctttttttttttttttgagacggagtctcactctgtcacccatgctggagtgcagtggcgcaatctcggctctctgcaacctctgcctcccaggttcaagcaattctcctatcatcctcctgagtagctgggactacagatgcacgccaccatgcctggctaattttcatatttttagtagagatggggtttcaccatattggtcagggtggtcttcaactcctgaccttaggtgatccacccacctcggcctctgcctctcaaagtgctgggattacaggcgtgagccaccgtacgtggctgatgggattgttttcattagatatttaatagaggtcacggggccttaaaattattaaatattctacttttcttattgatagtatgtgttcatactgactcagtagccttctctattgctgtcatggtgagctgatacaatccattttctttgtaggtgcaggtatttggactgtattctggagaagaatttcacgagacttttgactgtcccattaaagtaagtattcagcaagttttactttttctaagggttttctcaagtaaggcaatatggattacagtaatttgaacattaccacttctgtattaattttgtcagtaagtgtctgttcaacacttcagatgtactggatactatttagatgctgtgaaagaagacagaatgtgtattttgtgactgtgatctcagtctgtcttcaggggtattttattatagtgagtgagatcactcacacacacatacacacacacacgcacgcacacacacacacgatctgtggtaaaagactcaaagaggtaggaataatattaagcgttccaaagctgaaaggaatcacttttagctgttcttgtcagtgatggcttcattggtggagtgatgtttaacttggctttaataaatggagaaggactgatgagagaagctggctttccatgtggaagaacaacataatagaaatggagaggctagaaagttcaccttgtgttcaggaaatggcaaattgtccaatttatttggtacataaaagactgatttcacaagagaatgtgaaggaagattgggctggctttacattcaggctgaagaatttggactccatttggtagataactagaaattactaaatatttaagaacaaagtaaataaactgaactaagctttaagaaaattaatatggtgactgtatacagtattgattgaaggacagataagagtcaagaggactagttttagataaaaattatggtagttgaggtgtctattatagttgttgaaggaagaggtcatttatttttttcacctgtttattcaaacatttattgaccagcaggtaaaggagagatagggtctgatgtatgttttaaaaagttgaatttgccagagtggagggtgatttaaacaggagagtgattggggacaaaagacaatttagaagcctaatataatactctaggcagggcattacaggatctcaatgaaaagaatgatagtgagtgttcaagatggaaaggatgaaatttatttggacagcctgtgctaaatagacttagcgagccttagtgatggcttggatgagggtgatgaaagacggaagagctcagggtcagttcaggttctcgctttggggatggggtgtgggatgccatcagttgcagtagggtatgtttgagtaaggacatggctaggctagtttggtcctgagtttagataagtgtagtacatcaggtggggacgttacggaggttttagaaacatgaatatgggcctcaggatggagattggcccttaaacacaaacgtgataaccatagttgaataaggtgaagctatttttaaagatattatccaatttagagctgtagagtgagaagagaagactgatggtgaaattctggaacactctaacttgaatactcaggctgtggaagaaaaaacagcaaaggagtctaagaagaagcagttggagggactgtaaggaatcccgaagagtggtgtcagagaagccaggggagagagggtttctacaaggaggaagtggtcagcagtgtcgaatgcagtgtggagattaaatagggggaaggactgaaacaagggcattctatgtggtgattttgaagttactggtgaccttgctgaggactcttttcagagcaggagggtcactatacatgaaggaataaattggagatgaggaagtagaaacaatcagcagagactcttctttaaagaaatttagtaataaagaagagagatcatctggtagagagaggggccgtgtcctgggaaggtttttgccgaccatgttttggttcatggcaaaaaccagtaaagaggaaaagattaaaaataaagagaatgcttcttggagcagcactaagcaatgagatcaacagcttaggtagggaagataatcttggaagagtcctagaccctctgcctgtgaaacaggcatgaaggaagtggactgagcctagctattgcaagttagacagtgaaggaggagcacttgtgggcaatgaccctgatggctttattttcttacatctgaagggaagaaaagggtaacataatgtgtttgaggagcagaggagatgtttggaatcagtccctgatctacagttatgcattacgagagagctagggggagagtttaagaatgtgaaacaatagaatgtgtgaatccttcactactggtattgaggatggattaggaaagtgttgaagggaagaagggctaacctgggaggtaggagtgtttagagcaatgaaggatcatatgctaatccttaaaaatgacattgtaggaagaggaatctattccattgtaggagggaaatgtgtcaattaatacaagtataaaatatgtttaattgaaggtatatagaagtaaaattgtgtgagattttgtgtgtgtgtttacctaaaaaaaattctctatgttaaattagaaaaacacaaaattagttaagttggtgatttcatgggtggtttggggataaagagagaaggaggtggagtctatgcaagcttacagccacaacagatgagctccaaagatggaggtgcactgagtggagccacgagggcttttgttttcatcccctccccaagatgttaatgatgttatgtaatcataaagcccttgcaaatgaaggaaacagtaacaagggtggtggagcaaccttaagagaaacctgggtagcaaggggctggagaaagattggatgagtgggaagcagatgagaatcaggggaacaggttgtatctaaaaagctaagtcctgaacggttagctctttgggcctgtagctctgttctctctccattgatggggtcttggtgtaagtgggctaaacgtctgggaggctgcgttgccacttggtgccgtctatcattgagagtcatcttggacaaggagttagttggcttctttctgtttttttttttttgttttgttttctgtaaattgtatccagttagaaacagttgtgacatcttgctaccttgaccaacctcccttgacctcccttgctgcctctatacaggtgacatccacttataggggtcctcagccagaaactagaactgacttatcctactctttgagctttgacctggcttcagagaagaaatcttttcacgtaagaagaaaactcagatgtcatcagttgttgtaaaatatgatttgaatatattacttcctaccaaggtttcaggataatttttagatcatgctgcttgaactgtgtcaggggttttcattctgtgcattggccatgactcctaaaccagagttgggttctgtttctcttgtagattattgctgtgcacccacatttcgtgagatccagttgcaagcagtttgtgaccggagggaagaaggtaagtgctgtgtgtctctaccttgatatgtagccttgaggggtgttgtgtgcttactctgtaatttatccttaatgtttttatgtctggctattcattaggagaaattcgagaaagacaaatgtaatgaaatctgatgatcatcatctcttgggggagttgtggcttcagtgtttctcactacattgctttttttgttgagacggagtcttgctctgtcgcccaggatggagtgcagtggcgtgatcttggctcactgcagcctccgcctcctgggttcaagtggttctcctgcatcagcctcacgagtagctgggattacggatgcccactatcgtgcctggctaatttttgtatttttagtagagttggggttttgccatgtctctactaaagacatggcctggctggtcttgaactcttgacctcaggtgatctgctctcctcggcctcccaaagccctgggatgacaggcgtgagccactgcgcccagcctcttgctacatttctttgaagtagatataggacaagaaaataagagagctgttacatctagagctttgaaacattgcccctcccacaaaaaagaggcagcatttaaaaataacaaaagcacacttaaactactgattttttttttccgattttttttttccttgtagaaaatctcttgcgggccttgataaacttttagagcagttatggctactcttcgctgacatgttcatggcacattttattatctcagtgctatttaaaaaataagagattggactgggcataatggtggctcactcctatgattccaacattttgggaggccaaggtgggaggatcacttgaggctgggagtttgaaaccagcctgggcaacgagtgagaccgactctacaaaaaaatgaagaaattagctgcgtgtggtggtatgcctctagtcctagctattgaagaggctgaggtgggaggatcacttgaacctaggagtttgaggttgcagtgagctataattgtgccattgcactccagcctgggtgaaagagcaagaccctgtctcttaaaaaatgtaaagagaaataagagagaaaaactttcatatattaacatttttctgtttatagatgtagtaaattctcaaattaaagaatctgtctgcttatagaataagtcaaattagttttttttctgtttttattacttagagatattttaaagactatttttatactaaatgctatcaccatactggaactccgaatattatttactattcggtttggagccagtgaaaaggaagtagtctatagctatttctgtagtagtatagagctatggaatggctgctttgaggcccagctactgaatgcttttaaatgttttatgatacttatctgtcattttcccttggttcaatagttaatagaatgatagggcgggaaaaccttctggtcattacatgactcgttgtaatgagtggcaggttggtagatcctgattccattccacaacataaagccaagatcacgccagttctgatttctgttagagagcccctccttcccccatctcacagcccattgttattcttaggctgtagttgcattcaccttatgttaaaatgtccaggggactaattagtgggaattacagacctaatctcacattctctagcttaggtctgcagctgatccactcctgaaaaaataactaccttacttgtctttgtctttgtcagcctcaggaaagagtagcattaacattcctctcgtatttcttcactaaacactttttgggttaagaaattttgtgtatgattgtattagggttctctagagggagagaattaataggatagatgtgtgtgtgtgtatatatgtgtatatatatatatatatagtagtttattggggagtattaactcacaagatcacaaaatgaggtcccgcaataggccatctctgcaagcggaggagcaaggaagccagtctgagtcctaagctgaagaacttggagtctgatgttcaagggcaggaaacatccagcaagagagaaagatgtaggctgggaggctaagccagtctagtcttttcacgttcttctgcctgcttttattctggccatcctggccagattagctgattagattagattgtgcccatgcagattgagggtgggtctgcctctcccagtccaccaactcaaatgttaatctcctttgggcagcaccctcagacacacccaggagcaatactttgcatccttcaatccaatcaagttgacacttgttattaaccatcacagtgataatagcataagttcacatagctgaaatttaaacccaggtgttcttattaaaaactcagtaagaataaataatttttcttttttttcttttttgagacggagtcttgctctgttgcccaagttggggtgcagtggcatgatctcggctcactgcaacctccacctcccgagttgaaggaattctcctgcctcagcctcctgagtagctgggactacagatgcccaccaccctacccagctgatttttgtattgttagtagagatggggttttaccatgttggccaggctggtctcaaactcctgacttcaggtgatcagcccacctcggcctcccaaagcgttggtattacaggcatgagccaccatgcctggctgaataaagaattacattttatttaattctcactgggaatggtcactgctttttgttttaaatgacttaaaacaacaaacatttattatctcatacttagaaaattcaagagtggcttagctgttaggccctggctgaaggttgctcatgagggttcaattgggatattggttggagctgcttgaccggggctggaaggtcaggttctaagatgtctgctgccttcttaataatctgctatacacttaaaatattgataaatcactttggtttaaatatttccctagcatgttttgatgcagttttgattttcaatttccaatttcaagagttagagattttacagttgtcccctatttcttgaaggtattagaataaaagaacataccagagataatatgagtgttgatgtccatgtggtaggactgaagatttggaggagagattttgctgtgttggtttatgtttttttgtttttgtttttgttttttttgagacagagttttgctctgtcgcccaggctagagtgcagtggcgcgatctcggctcactgcaagctctgcctgccgggttcacgccattctcctccctcagcctcccgagtagctgggactacaggcgcctgccaccatgcctggctaatattttgtatttttagtagagacggggtttcactgtgttagccaggatggtcttgatctcctgaccttgtgatccatccgctcggccttccaaagtgctgggcttacaggcatgagccaccacgcccggcctgtgttctttaataatcagtgtattcgtgaagtttaataattgcttttctgctgcaagggatacctgtagtcttatcaagtttgccacattaattctgctgcatgagtgtcttgtctccctgtaggatgtctgggttaactgtcagtaacatattcttcatccttttacttagcatttgatatcatttgcagacatccgtagaaaggacagtgtgcatgcagcagtctgggtcagagtccattgagtagatccatgagcagtgcaggaacaacagagtaatctagcatctaattgttggtaagataacatgggaagagcttggaatttatagaaagttggacattgtgataagcaataagataagtagaattcaaaaaatgctgaacaggcagaacatcaggggtttggtttgtctctttggttgtcactgactacttgacaagctgttctatgttcagttttctatgagagagtaatttttttttcctattcagttctccaaaaatgcatctgttgacatctcgttccaagcatacagaaaaaaagtttatatgtatataacatgagagtaaaataaaaacagttaaggtcatctggtgaaaaattgaattaaaaatgattttattattaacttagacatttgggactaaaataatttaaaagaaaacatacactgaagagcttagtgtattgtatgtaaggcttagtatatggggcatgagaaaagcacatgtatgatattttaaagtgaggaatcccgtgattacccatgtcagtgtaagtaattggtattaagtcattatttttttagctgttttaaaatagttttattgatacataatttgcataccatgaggttcaccagatgatagtgtgctgtttagtcgtttttaatatatttacagtgctgtgtaaccatcaacgtaagctaattttagaacacttccgtcaccccaaaaagaaaccttgcacctattagcagtcactccccatcttccttcctcccctcctctcatccctaggcaaccactaatctattttctttctctataagttttcctattctggatatttcatataaatggaatcatgtaatatatggcctttgtgtctaacttctttccttatttttctaggtacatcaatgttgtggcatgtatccgtatttcattcctttttatgtccagatgatatttcattgtatagatctatcatgttttattcatccgtttgtcgcttgattgacatttggattgtttctactttttggctattatgaataatgctgctatgaacatttttgtacagctttttgtggctgtgtgttttcatttctcttgagtatggaattgttgaatcatatagtaactctatgttggacattttgaagaattgccaaaccgtttcccaaagtgattgttccattttacattctcatcagaaatatatgagggttttaattgtctacattctcaccaatattcattttattttctctttttgattataatcactctggtatgtgttaagtgatatctcattgtggttttgactttcttctaatgactgatgatgttgaccatgttttcctgtgcttattggccatttgcatatcttctttggagaaatgtttattcagattcttcgcctattttttaattgggtttttttaattatagagttataaacttcaaaaataaattctgggtagatattccttatcagatacatgattcgcaaatattttttcccagcctatgagttgtcttttcactttattgatggtatcctttgaggcacagaagtttgtaactttaataaagtcacatttatcttaatttttttgatacttgtgctattggtgttgtatctaagagatcactgcctgttgcctcttccaaggtcatgaagattaatgcttgtttcttttaagacttttgtattttttactcttaaattaggtgtacaatatattttgagttcattatgtatgatgtaagacaggagtccaaatttattcttttgcatgtgaatatccagttggcccagcatcactgttgcaaagactattcttttcccattgtgtgggccctttgtggaaaattggttaaccataaatgttagggtttatttctggattctgaattctaccaatctatatagctatctttatgccagtaccccttttaggtttcaaagccactaatttttctgtaattagttatgggatggcagatgaactacaaatgctcctcaatttacagttgaggttgtcctgataagcctattgtaagttaaaaatattgttaagtcaaaaatgcatttgatatacttaacctactgaacatcacatcttagcctagcctaccttaattgtagtcagaacactacagttaggcaaaatcatttaacacaaagcctattttataataaagcattgaatatataatgtaatttattgaagactgaaagtgaaaaatttaatcattgtataggtaccatcataaagttgaaaaatcattaagtcaaataatcataagtcaaagactgtctactcttaaaactttggtttggggttctttccctttaaaaagccattatatatcatcattctttaaggaaaacctgtttttattcccagtacaatcaaagcaccctagggtaatacaagcaaattatttccacttactacagaagatatatatatatatgaatgagatatatctatctatctgtatatatggaggggtgtgtgtgtgtgtgtgtgtgtgtatgacaaaacaagtcttttaaaagtgtgataatagtttgtgatttagaataatttatttaaaaaagccattataatttattttacttatgttaaaggctttagaaacatgtaactgtgtccgcaatttaatgacttgtaacatacaaactttgatttatttggatccattaaattttatcatgtaaatatgtatttactaagtactaaaaagtaccattttcttgataaactataatgatctgtttgcatatggttaaatggagattttcaaaatgtgtatcagcttggtgtggtttgcagaaatctccagagaatttcctttttctacatgttgtgtggtatgtacttgtaaagattatttatgcttcatgtttttgacattagcgtgttttgtttgttttgaaatagatttatttagttgaggtattttaggatgtatttttctaatttcattaagaaatatatctgatgttaaaaactaaaggcatttagaaggttacattaagaaaggaggacttgtgaaatgatcactttcattttgaaagtgttcgcaaatttttaggaggagctgctctttttgtaactgagttatagaggtttatatctttgaaaaatgagataactacattggctcagtagctacttcaatcctttcagctgcaattttaaactagcagcagaaactaggcagaacaattttgaaaagcccaacatttagcaaatggttataaccttgcaataatcatgttatagatatcaagatccctcctctgttgagaacaggtggcagatcacatagggggaaaagagaataaagacatatgtcagataactgagaggttatgactttctgcctttaagaaataatttaatcttcaaaaaattggagcaaagactagccaaatgaaggtgtaatgtggaataaagacattcttaacccttaagaacagtgatctctagactgacagccaaataaatcgttggaattatatgccaccttctacaaacaatgggttaaagtggcacagagactagaggaactaagtagaaaaatagaggaccactatgagatattcgtgaagtcataagaaaatttgagagagatgtctattaatatttaatagttctttaatcttattacaatttttgattcctataaaaattattaaagtaattagaacatacttttcaagtatgcaacatacattgcagaacatagcaatgtaacagaagaaaccctgaaactgtagtttgacagctatttccttttcaaagttctggcttcttaggtgttcagagatagctctttatccaccagggactaggactaggaggctatagttctgtctggcataaacttttattttaggttttcaaggtatcttcttagtagttgaatgccatagctggatttatggactccagtgcttgacacatgagcataaaaagcttattccatattctgttttgtttccatcttgaaaaaaaaaaaagagaaagcacatctcttaaaagtgccattggagagagctttcaaacacgtgaaccaatgaattttttttgtaagtgtaaccttcttgtgtagcaagaattttaatacaggagcatggcaaatgaagtttctattttagaaataaatctgtcaagtgaatgttgtctggatttttttttttaattgtccagctttccctgtcagcaggtaagctttagcttcataggacctttacttttgaacactgaaatacactttataataactggttctactactttgacaaatcattaaattgtcgcgatgctgtttgcagtggagttcatttttagaaatcagatagtcagctgtttggcgttacggtgggatagaatgaggggacctggccgcaggggcaagttgctttgtaagctggaaaatgtcagtcagcaaacaaggaaaggactggagtgaatgaaatgaggaaaatttgaaatggcaaattttacctgaaggacagagatggtagtgtcagccagcttctataagcttccagcagtggtctgcaaataataaattggattttgaatcctttttgagggaggattcaatatgggaagctttttataaaactgtaaatatttaaaaaattattattaagattgtttttaaattttatttcttttgcccatgttatcaacatttttatttttttctagctttattgaggtataattgacaaattaaaattttatattatatatatatataaaatatacatatatatatatttttgtatttttagtagagacggggtttcactatgttggccaggctggtctcaaactcctgacctcgtgatccgcctgcctcggcctcccaaagtgctaggattacaggcgtcagccaccatgcccagccaaattatacatatttaagttatacaatgatgatttgatatataccaaatgtatttagtatttattgtgaagtgattgccacgttcaagctaattaacattatcagttgcctcacatagttaccatttctttggggatgagaatacttaaaatccattggtaaattttaagtatttaatatggcattattaaatatagtaaccatagcgtacattagatccccgaatttattcatcttagaactgaaagtctgtgcccttttggccagcatctgccaatagctcccagtcccctggctacaaatctttttagaatctagataatccggtgagccttttcttaccactgccatccctaaacatgaagtgtaggagtgcttcctcgtgtgtttgttcatctttgggtcagattggagctggggttttggtggctagaagggttttgacattagcagttcctctctgtctcctgtccagtgtttggatctctaggatagtatttccgcaagttttcagatgcttgattgtagccttctacctgaaacttcttcccacattacttaccattgtagttttcaagtgaatcgtctgaacatttttaagaattaaaattaaggctccctagttaattcacagttacaccacaggcagccaccaatctaacggttgcacgttgaggcattgtaaatacatacctttatttattctaggtactgtgttgtaaattgtggtctcattcctagaaatgtatttcatgctgtcatcaatgtaccaaaattgattaaaaaccattgattagcaggaagtaaaacacaaatgtaaccttcacaagcatttttttagatatgaaaaaccaagcaataaaatagctctactgtttaaagtatttttcggtgagttttcctatgtatactaagctatctgaggctaaaaatagaaatataatgcttaaataaaaatcattttcagtcggaaaaacaggtgttcttcattgctgattgcttttttgatgtcaatatgtaggactcccagagtatttgaatggtatctacagcggtcagggtgggagagttgggtccatagcaacttcattttcctttatgattcccattgtctcatatccatcaaatgcctgttaaaaaatatacttttttctttaatgagttcagctaactttttcatatatttccatactgattgtagctttcccctgaactctgatgttaaaactaccatctctcttccttataaccatcttttgctccttgctgataatatcttcttttgcatatggagagtcctgtgcttattcttaagtattttgagcaaggactgcaagtgtcattgccagttcagaggtgttcattagatattcttgtgggatttaacatcagctgattcattaacacagaggttctctttctctcttttgctttaagagaaggctgtataaagcaaggggtcacaattgcagtcattgttagttggtgtcgtggtacaaactaaatcacagtcatttcacaggagtatttggtttgaatctgcttcctgaatacaactttgtgtcatgcttcatgttaggtgctgtgtgtacacaggatcttgatttcagaaatggtggtaggcttccaaaagcatatagataggatggtgtaggtagaatatagttaataagaccattagtcagaatagtgacttgacaggaaaatgagtgtatttgtatattcacatacaacactatggggtaaatttacagtcctttatttgtctttaagccttttggatccccctcgacctgtatggtttgtttgttttccttttaattttctaactcagtttcagccaattttcttgatatttgtaacagtgaaaattggtacaagctgtctaacaatagtgaattagctgtgtcagtgccctgcggccaaagatcaccaggagtaccccatatggttttaggaagatgttagaagaattgtaggatttaggctggtgtgaggtgattttggggaggtttaaggcatcagggctttgctctagattggatgctgtcatgaagcatgagtaattctacagctgggcattttgataaatcttatctagaaggagaaaagcctaagccaaagccaaagtcataactggtaaagaagcagcagtctgtcattttagccaaagtgggaggtgtttggtcattgccacgacttggaaaatgttcatgtcttgtttgcattcagacatgattatggagtggtcttgcttctgtcctggtccttcatggtcatggagtggcctcggctgatgttggttttgtgtgaaattgtttatattcatcaagagaacatcagagccctgctgtgggtgccaggctagcttctggttgtcagcttttctctttctcagttggaataaataaaattctcaacatttgttagattgcttctgttgaggtacttttctaaaatatatgtatggtctgattatccttttctgtagaaataaaattatgtatgtagatgtattcatggaaggctgtacaccaaattattaacaatatttgtgtctgggcaggattatgaatgttctttctgaccttcattggcttttatttacttttttgtagtaagcatgcattatttttataataataaaaagtaaaggaatgtttagagtaatctcaattattttagatcttgttttaacttatcactgtacatcatatgaaattccctacattattgatgtctattcttagctcagtgttattgaatagttgcataatattctatcttatggatctatttgattttcttaaccattcttctgtctttggacctttaggttatatccagtgtttggctgtcataaatcatgatgtggtgaaccttgaaatctttggcctttcatctgttcctctgaatgttttcctaccattgattcttaggattggaattactgaatcaaaggttatgataattttttaggcatttaatatgtgttgccaagtaaaattgtattccagaaaacttacaccagtttacatcagctatgtgtgagtacctattttaccacatgctcattgccaatctgatatataaagatactccatttttctattttatagtatatttgaatttttagtgattttgaacatttttatttattagctagttctgtagcttcctttgtgatttgtctgattgtattccttgctcagggcagcttttaatattaccatagaagccaggacaatgaaggctgtccacttgatatttactgtcagtttgagcacaaattattgctgcttactgaacagcctgcagccttttctccaattttggccaaatctggaataattattgttgttcccagggaggcattatataggagtctaaatgaggctttagagtagaccctgaagtgtgtagagaggatgaacatatgttaccatgtagatgtgagtctgccccaaaaccatcagttctgccacttccatgaaagctatcaatgctgaccagtgtgtccagttaatgccagtttttcatagagatggtaagaaagtggattataatgcttgaaattgggttcatttgactcattttcttctgcagatagtctcctgatttttttttttttcaacttttgggctttactttgtttttgtttttgtttttttgagacagactctcactctgttgccaggctggagtgcagtggcgcgatctcggctcactgcaatctctgcttcccaggttcaagtgattcttctgcctcagcctcccgagtagctgggactacaggcgtgcaccaccacgcccagctaatttttgtatttttagtagagacggagcttcaccatgttggccaggatgatctccatttcttgaccttgtgatccgcccacctcagcctcctgaagtgctgggattacaggcgtgagccactgcgcctggcctgttttactttgaattgtgtgaagggcttgttcaaatacataaacccgtgttttcaggtaactgtctgcattattcaagacttagcaattttgcatctctttttgatatactcactgtgcaaggattttcaccagtcatcagtgattgagattatatgtagttaaagttagagatatttgttcattgcagagaacattaattcaagtttaatcacccagtggatgacttttctgttatctctaccctgatgctgagggtgtttgaccttgggcccagcccggaaaatgtatcctcagatagctgcaaactgaaaaacagactcaacgtgtttggtatgaacagccagctctattaaatctgtgggatccatatggaagattttttttaagtggtaaaattacttagaaagtgtcctagtcatttctgaaatcgcacttgtaattatgtgcttgcatttgcagcaattgcagattagtagtctaaataggggactacctcacatgctggcttgattgccaagcccacataggtgtgtaggtagatactgcataggtgggtaggtagatctttatctagctgtcatctctagttttttaatgcaaagaaagctgctcctaaatggcacgtccgttgtttaacttattttgttttcatggaagctttgcttggatttcttggttgctgaattgatcgttaccttatgttgatacagtgttttttaaatttcagagcattggtctgtctatataggtttcgcagaattaactgcaagggcatgtccaaagtctgtgttgctaatgcaggaacggaaaaccaaataccacatgttctcatttgtaagtgggagctaaatgatgagaacacatggatacatagaggggaacaacacacactggggcctattggaggatggaggatgggagaagggagaggatcagaaaaaataactaatggatagtaggcttaatacctgggtgacaaaataatctgtacaacaaacccctgtggcacgagtttacctacataacaaacctgcacataaacccctgaaattaaaatacaagttaaaaaaaaaagtctgtgttgcataggaatggtgtttactaaaatattgtttgtaagcaagtggcatttgagtgggctctaggaacccttgtgcacagaggttttccgtcgtaccaacattttgtctatactgaactggttttaaacatgttaaattcagataaaggagattgaagcattataacttgttcagaaaataaccactgaatttaaggaaataatatatttgggaagttctctttttcttcccacatgtttatattctatcttgatggacacagtagagctgttggtggtgtttagagaagctgcgtgtttgaaactttggcactaagcctaagcacgaagcaaaacaaagacacttacctgctccatatgggttcctggtcattcattcctgcctccttcagggttcaagaccccatttgccatcagtagccagccaccatcctaggtcttctccacactcactcatatttttctcacttgccttcttgacttttaaaattttgctcatgatcttttctaatcttgaatatttaaatccttttgtaacaagactttcccattgttatcccctttgtttatttttattgagacagttttatttgctgggttttactattctctgtttctctattttattacctggatcttctgcaccttcctgacgtagcacaggtcctcctttgtgaaatatttgttttcttcaagccccttggttctccccgtgggaacacacatggtatctaagccttgaccctcggctgaagcccctgctgaatcttgcccactttcttgtctgcctcaaagctagcagtgtggtcagtatttaggaagcctgaaggagccaagtgatttatcaacttgaaagatcacaaggtgattaaaacagggccaatgatactcttttcaactccatcagggaagagtgagtgacaagtaatgatgggcgttaggtgaccagaatcggggacttcattacagcctgataagaatcttgccacacatgtgggagattctgggctccatgtccttataccactctgtagagtaggaaagcactagatagatttatcagcacaaaacagaggagaataaagtatattgctgaggatgtgagggctcatattgaaatataagtattgagagtgctgactgccagaatgtggatttatgggaaataaagccctaaaatactttttccaacaaaaaaatagacctcttggaaacagcttttcctctctatgtacttagctcccattgagcttaaattgctcttagtattgtgataatgacaattcaatattacagggtatggaagatgaaccaaataaattaaccagctgcttttaagcgtagtttttttcaatggcttaccccataaaatgctttgtagaacattcgtgctcagtaggtctgtgggcagttttatgactggaaggaaaaaatggatattattaaatgtcagtgaagtacaggcaggtagttttgaggtagttaaattagtatagaatgtttgtaagaaaaggagttcatgttttcttaaatcaccaaagcaaagctttccttggcattcttgtcagaaaatatgtttctgcttgaaattcacagagattaggataaaaaagccaatggagagtggatcatttggccattctcccttctgtatgaaactctatgtcaaatcaaagcaaatcctgcatgagagtttcagagatatagaaatgactccataattactagcaggcatttaaggttttatactatgtaggataggaaaagtggactcatgagtgaagaataaagtagggtggagaggaaaggcagaaataaatgttcgacggggccaggcaggtaacatcaaggagagaagcaggccacatgcgagagagcctggagaagtaggcgctgtggcaatccagagagccttctgcaggcctgcagacacatttcagaaattaccgttcaggccaaacgtgtggccagttcgtgtctctgaaataaaagagctgcaattacttaaacctaatagaggaaggctaaccttaaaagcagctttcaaatttttggcaagttgtgcacaaattctatctgctggccttcagcaaagggaaatagactgacattacatgcctggatatgggatccatagaagtgagccctttctaaaagcaaggctgtgttgattgtgtgaattagtcattgggttctttaaatttttgagattggagtagattccattgtgttcaaaatattttaggagtattactaactgtaaagataggctgagtaactgaaacgttttgggaaatcgtgtagctcctcctgtagcaaacacattgtgtgtatggtcagagaaggaaagaattaagactagtagactcggatagcctacttagtatttaatatttattatgcctatgggtctagcaaagtataagatatgatccttttccccaatgcactggttggggaaatgcaaggtaaacacaccaatctcagtgaacaagatttaatagttagttgtgcagtgagaaaaccagtgtgaccataaaacatatacagaaccaataaattgggggaaaattatttgacttacaaaagaattctcttaaatgatgactttccttagtatgtttatgatgacctactttatttagtatttccttagtatgtttatgatgacctactttatttacagatattttcttatttttcatccacaaaatataaagtgatagggacttaggctatttgaaaaacataagaaaataacgtgaatcctgtcaaaacttgtaatattaattagttaaaatttgtttcatttacagaggttaatttttagcccccctccatttttgagcacacatcagttgcatagaatggcatgtgcctgtctgcattgtagaaatgtcattgggagaagcttctttgctcttttaattgcatgtcagagcagggtccacaaggtttttgggactcaatcctgagatggcctggattcagaattcgtctgtccttcctttgcctcctcccctctgctggaagtttttagtttcttgttttgggaggtagagtaggaggcaaaaggaggccagagttctgccacctctgcttcctcccatagctcggagcacaccaagtataacagaaagggtccattggagtgagcttgcattttggtaggaactgcaacaagatttaattaacagttttctgaagaagttaatgttttatttgaaaagtatatacagtttatgtaaattcattctaatacatgttcaatatgcctcaaacattacttctttaagttccagtgaatttttatttatttatttatttattttgagacagagttttgctcttgttgcccaggctggagtgcaatggcacaatcttggctcactgcaacctcctcctcctaggttcaagcgattctcctgcctcaccccctggagtagctgggattacaggtgccggccaccatgcttggctaatttttttgtatttttagtagagacggggtttcaccgtgttggccaggctggtctcaaactcccgacctcaggtgatccacccacctcggcctcccaaaatgctgggattacaggcatgagccgctgcacccaatctccagtgaatttttgatattactttgttgtttcattttaactattcccctaagttttcctgattgtaaaaataagagaatggattttcattcccattaatgtattaacataaaaaattcatatatttagtgcagaataattataaaataaaaataatataaaatttcagcacgcatttatcgaattaggattactttgtcatgtatcttttagattttataatatatgtgaatacacattcacattttattttaaggacattgtattgaatactattttgtcatctgcttttttatttaatatgccctcatagctttttctgttaatgaagatacatgcataaaataataatggatacatactcattgtgtgtgctccatcgtattatgctccgtcattcctcagttgttagtccatttctggctgttataaatagctctacatgcatctttactaacttgtctgatcatttcttagcgtaagtttctaggtagcaacttcctggtgtcattttttttaaaagctttgagtccatgatgccaaatgatcctccagaaagacggtgtccaagaccgcagttcagtagtttgaagatacctctttctctgcacatactccactgtaccccccaccccacatacccatgcctgatcatatcattttgattcgtctttatcagttcattctttttccttcatctatcaattctagaaacattgctgtattgttttgagtgttgattttataaaatgttttactatctgtctggatgaatccattcctccccctaaattacttaattttttaaaaattcctgttattctctcattttttaaaatgaatttttagcattttttgaatttctagaaataatccctttggatttttttggacttgcattaaaattataggttaatttaatgagacttaagctctttagtgagaattggagtcttactatccatgaataatgtgcctttctgtttattgagttctcctttcgtatccctcaatgaaatgtttttgttttgttgtgtagcgacatgtcatgttcattattaacttttaaatctagattttccttttttttacaactttgattgtatcccataaagtttaggtttatagtatttctcattttcaaagtactctggttaccatatgaattcctcttttacccaaagattgagaatgttttttgtaccatttttgttttgtattgttctttctctcattcttcgttattaatttcttaattttgttgttacatgagaattatgatgataagaattagattttacttttaagttcttttgttttttttgaatgtcttgttattcatatggagtcacaagttggggattactccctggataatttgtattcttttaaatgcaggatttttccataggtgcctgccttttgtcagagtgcctgctttccttcctacctgggacagctacagtgctggctacatgcttggggacccaaccctttgtgtttcagagtaagactggccactccccttcgttcctgccccattacactgagtgtagggggtgttgtggcattctagtacctgcctgacttcccaggcaggctttttctgggggaatgagttaaatcatggccttcactggagtcttattattagcatattttacataatttttagcttaaaatttggagcatatttaactttttcaacacaggtgcagactgttctcctcttagtactacattggtcatttctaggtgggaattggtgagggaaaggaattcgatgctgtgtcccaccctgctgttctcccggccatcctgccaacccttcattccagcaggtgattattgagcactcactgtgcttcacccatttcggacgatcacctccatcagatccaggccacagatagaagatagacattttgatcttatcaattcatcatgtttaattgttgtggccaggcgtggttgctcacacctgtaatcccagcacttcgggaggccaagaccggtggatcacctgaggtcaggagttcgagaccagtctggccaacatggtgaaaccccgtctctactaaaagtacaaaaattagccagacatggtggtgcatgcctgtaatcccagctacttgggaggctgaagcaggagaatcactagaacccaggaggtggaggttgcagtgagctgagatggtgccactgcactccagcctgggtaacagagtgagactccatctcaaaaataaataaataaaaataattgtttttagctgcctgtctttagtggggcataatcttctctgtagcaggaactgtatgctcagcctttctccccctttcctacatttctggggtctgttctctgttttctgcaaatgggaggaagaggctgaatcacagtctggggacactcccgaaggcctctaactgtgggggtaggaaggcatggtagtagtgacttctgaattggaacctgggataggagaggacagggtgggttagaaggtctctgagaatatatctgatgggaagatggggctaagtatggtcagaagaatccctgcctccagtctccctgtggaagttgtgaagtcacacaacttcaaactgtcatagcattttaaagtaactgtactttgcttacttgtgatgatggacatcatatttaattttagggattttattttgtgcttcctctgcctgtattagtctattgagaaagatatacaggaaatacaaataaaatgtgaatttactctctttcccctgttaacctgtttcccctgcctcttttggggtgggtagaggacataaaatatactaaggtagactgaaattgcttgtagtggtaggaattttagtaattctgttatggaatctgttgtcagcatttgctttgaaaggataaacatgtgtttcaggattgcataccttaagttacatactgtataaatgtcttttcttaaaggatttaaatggaatatgtcaagaaaaatatttattgtgttcttaataatgtatgacttcctagaattacatctttattaatcgtagaggtttttgaccagttatattttatattaaaatttatccagcaggttttttgaatgatagaatcttcccgttaaaataaagaccctagatactatgaaatttctaaagaagcttaattccaattttttttttattttgtgacatgaattactgttcaaaagtcattgttcaattatttgagtcaaatgaaaaacatagactgtttctattacagtttaatctgtgactaatatcttattttcagtgaaaaacttaaaagaggttttgatttcccaatttacaaaataaattagttcccggacaatcatttgaagaacttttgcgatacaaatcttttgattaactaatgtgcattattttccatgaatcttggtgttttggtgccaccttgtggcttggccttgtagtaacttcaacactcatccattttaaacaacttcctggggagaatatgatgtgctaggaattctttccaaggtacaaataacatactactgtaagtctacattaaagacgtcgagagtgacttgtttgttatttggtcacgaggataggtaaaactagtaagtaaagaacctgatacattattttcagtttctaagattctttgtttatgctttttgtccctagctgctactgtttgaacggtcttggatgaacagatggaagtctgctgttctgcatgaaggggaagggaacataaggagtgtgaagtggagaggccatctgattgcttgggccaataatatggtaaaaaatatgcctctgtcttcctaatgcttgttcagtggcagaagaatggccaacttgatagggctgtaatgaagggaaaagatgccacttgctgtggtggtgatttctaaagggtgtaaggacgattggtatcatacctaggaggttaaagaaattagattgcttttggctttcataatatagtaattcccaacatattctggaatctattttagagtaagaaacctgaggcatggagagtagccaagaaaatgaaaagctatcttaataattgaaggactgcattgggaatgggtcttgaaaatatcatttgcctgttggccaaaggcaagtaagagttgatatgaaacaagtgcagaatattgctgatttctcttttactcccagtataatcatagacagaagtatagacctgtctgtaagaaagtggatcgtaattttcagtgctgcattttaacttaaagtttacttgctatgaattggggctagtaggaagttttaaaaatggtctttttgacatctggcatatcttttgaaacatcaaggtataatttagtaaatcggttctattcagttttaaatggtagaaatctgcctagactctacctttttattctggacttttcttacttctcctgggtcacgatgaaggtaaaacaaagctgtggtctcttggttcatttttagttagctgcttgcctgatgttttcatttgagaactttaaaatgtcagatgtagttttctttatataggtggcttttcagactcaaagcctttctaaaaaacaaacttcatttttcatggtggaacgataaaattagaaatgttacttgtctgtcagtttggaaatgcagctattgatgtttgtacatttcatgtttctgttgggtttgagtcacccatgccatctaagaaaatctcctttgtccagaaagaagggtggaggtttccttgtggttttagttcccacagggtttgtgtggagcaggagcattttccttgcatgctcagtaaacactgctaatatttctccgtgctggttattggtagtatgtagcaggggctgttaataagttttctgttactttcctcctgagtagaggatgcttactgctgtattattttccagggtgtgaagatttttgacatcatctcaaagcaaagaatcaccaatgtgccccgggatgatataagtcttcgcccagacatgtatccctgcagcctctgctggaaggacaatgtgacactgattattggctgggggacttctgtcaaggtggttttgcttgtctttataataagtccgtgttgttatagatccactgagggtggtccaaaggactgtgagtcttgattggcttctaggacccaaatcttttcacttggatgttattgtgacgtgattaccatttaatgctcaaattatttcctgtgcataagttttaagatgtattctttcttttcccatggcatgtaaaactatttgtgaactttttcgtgttgagaatggtgctgtctttttcaatcttcttttaatttctcacatcccagctggccttagctatttacagaacatggggttagttttgttgtttagtcaggttttcttctctttattattcttttcattttcccttagctttgacccttcacttcttcattagagttattgatagtggagagagaaggttaaaattaaatcatcctgctgcttggtaataatttgatagagtagagacccagacttatcatcaataataagatttgggcatattttctgaagtttaattatctgacccttatgcgcctgggtaaatgaaatttagctgttctgtgaaagggggcccaaagctcattcacatttattttatgcctactagtgcttctgttatattagatacttcagagccaaaagttgtttccctttaaaaaatagacagcttaattcgaacaaaataaactaaaaattagtggaagtataaaaatggcatgagagagtatcccagcagtagtctcatggaagagctcaggctttgaggccagacagacctgggatcaagtccagcttctccattttcctttgggatcctctgtgagccttactgtcctcatctgcaaagtggtagtgctaattgttctcacatcacaagttttggggagaaataaatgagccaatgcatgtaaagagttttgcatagaatctgatgtaattgcttaataaatgttagctgtcattattatataaagttctagcaatgtcatgaaggggacgtagctatttaaaatgtactcttctctggaaagggaaagtggaaaattattaatgtaatgattgttattagcaaaacaaacattgttacacttcaggccctcccagccctcatgttgttatcattcaggttcttttttcttcatgtgttacatgaacacaacctgatttatatttagggtaacaggaaggaaactgtgcctatatcgtaggatggaaaaagggattccctgggctccctgtcccacgtgtgtggttactcatccaataaatttatattcttagtattttaaaaatcccttaaatggaccaggttgcttgttagttttaaagttctgattttcttttcttatggtgaaagacaaggaaaattagcctgtagaaatatgtaacaagtttactcattactcccagaaattctttctctggtatgctgaataatggccccaaggatagcaagccctaattcctagaacctataaatgtttctttatatgacaaaaaggtaaatattactttatttagcaaaagatatgattaagttaaggatcttgagatggggaattaacctacattatctgggtgggccctaaatgcaatcacgtttatctttatgagagggaggcagagggagatgctaacatggaagagaggaggagaaggcagtaccactgtggaggcagaaattggagtgaggtggtcagtgaatggtggcagccaccagaaagctggaggagacagcagattgtcccctagagcctccagaggaagtacagccttgccaacaccttgattttagcccagtgaacccaatttcagacttgtagcctgcggaactgtaacagatgtttaaaacaacatctctgttgttttaaaccaccaagtgtggcagtctgttatagcagccatgggaaacatataccctttctttatgcccaagttaagatccagcttctatacaatttttatgtcaaatatttcattttattggaggttccttttcttcaaactcagttctatatgttgagcacttctcagtgtagactcttagtgagttctgttgaaggaagaggagataaggacgtggtctttcttcagagggacagcaatcttgttggggagaagcaaccagaaacagtaaaataaagtgtgcaattggaccttaccatttacttcattcattcatttgcccaacaaacgtttaccaggtgcctgcagtgtgccaggcagtgttctagtgttgcagaacacaaatatacaaatgaatgagttccttcccttgggaaatttatgttctagtgaggaaggtggacaaaaacaagtaagtatagcatgttgaaggtggcaaataaaaaggagaacattttaacaggataataggaaaagggattggggtaggtaccatttaatatagggtggtccagggatggcctgtccaataactaatatgttgtttggtcagagatctggagagaaaagttatacagctctatgggggcctggggtaggaggtgttagcagaaggagcaggagtgcaaaaattcttgaagcaggagtgtgattggtgtgcttttgaggaacagcaaggaagctgtttgtgtcagagtgagtggagcagatgtggaggagagggatgtaagtgggggtcggggagggtgtggtggaggagcaggtgatgttggagcccaggggcccttgagaagtctttggcttttaatttgactgaggtaggaagccagcacagggctttgagctgttgtggagtcagttaagtgatctaacttgtattttggaaggatctctggttgctgtgtggagctaaacggcaaaggggcagtcaagaggggagaccaattaggctaccgcagtcatctccataaaaaataatgttgtctcaggtcagtgtaatgcagctggtgagaaatgaccagatcctggatatattttgatggtagactctgcagtatttgttgacagttggatgtggggtgtaagatcacagtcacctaacatactggaaggtgaaactaccttttgctgaaatgggaaagactgttgataaagcatgtttagagtgaaaaaggcaagagttggttttaggtgtgtctacttgagagatgcctgttatccacccatgtggagaagtggaggaagcagattagagttcatgggcaagaacccacctatcagtggtaaagggctcttacagtcattgatttgtgcttatgcaagacatgagcttaaggtagcacttacctattcacccacctttacctgccacttcctacctatgagacaggtgctgggtgagcccagaccacagagctgaggagtgcagtagagccatgcccagctaccagtagtgcaatgcatccttgttctcaagctgtggcatgaccagcgagataccagtcaggccttggtgtgaattccagctctggccaggcagtctggcatcactcacagagcctcagtgtcctcatctctggattaaacataataacattgtctttcaggggtgtctgagtgttggaagactgtcagccctcaagttctgtcaatgtctctcaaatctctgcacttcatcttcctgtcaagtctttttggtgctggttttaccccccctaaacctatcctaaacagtatagctagaataatctaagtgcaggtcagatgaggtcagtcccctccttgcccataggataactgatcataaacatgacttccaaggttctttgtgatctgcctctccgttactctccagcctcaactctgtccccttcttcccccatgcccttcatttctgtccgattgagcttccagttgaaggccctatgctgtcatatcaccgtgttctcctgtgttgtctctcctgcttcaacttacatgtcacttcttccaggaagtcttcctgccctagcaggagatgcccctgctctgtacttccctgtcacacttcagtaaagtgccttatttttgtgtctcccccactgcaccataatcttaagaaaataatgatatctatttcacaaaggccttaactcaggagcactgccagtaactgcccaaaaaagtgttcactaatattgccgatacatttgcttttttattatacttcaagccatttgaaagactgttcctcatgtacttatatcagcacattaaaacagttgtccatttggcattgtggaatgtgccattagatgatttagtagtttccctagtaagtgtgggaagaagagtggataacttataagctcaaaagtctaccagaagggaagaaaattggagaagtggacaggcagttatatgaaacggacaagagacaaatggcaaaaagcaatcaaggaagaagacagccggtcacttctatgtggaggcttctacctctgcagccatgggttcaagccccgcctgagggaaagtgggcactctgcattcactgagtcgctgcagtgttgctgggcagcaactcagtatactacgtatattaaaaaacaaaaccttacaaaagtttatgtacccattggtatcaattctacttctaggaatttatcctaagtaaacaaaagtcctaaagttttatatataagtatgttgattgcactattgcttacaatagatataaaaacaaaaaaatatgcccccaaagggggttgattaagtatagtacattcatgtaataaaaggcaatcatccctcagtgcctgtggggaattggttccaggacccctgtggatcctgggctcctctgatgcttatataaatgatgtaacatttgcatatataaaatgatgcggtatttgcatataacctatgcacatcctcctgtatactttaaatcatctgtagattacttataacacctgatacaatgcctacacatcactgcatttgcatagacttaatgaagtagttggtgtacagcaaggtcaagttttgctttttggaattttgtagaatttttttttttcctgaatatttctgatccttgtttggttaaatccatgaatgtagaattcatggatgcaaaacccatggatatggagggctcactgtattataacaactttacagaattatgttgtagaagaatctttaaataacatattgaattacttgtattaaattgttaggttaataaaagtagctttcataaaaaagaagattattaatggtgttctctttgtgctggaacaatgactaatgcttgttttcccctttgagtttttctatattttagaattttccataccatagttacagttaatggtagcagctataaaagaacactatgtaaaagaaaaaggaaaaatccctgatcactgacagaagttgtacttggattagtacttgacttcaggttcagtctcaccaggaaagctgaacttatgtgaatcaggctttattgaggaataaagttggtgaatataaatagtgattgctatatgtcatttacattaatttctgtcatttaagtcatagggtagattgtactccatctgcagtgctacaaggttaatttaacaaagataccatatactgaataaaatgttatgaagaattttccatcaaatgaataaaataacctgcgaacttattttccaggtgtgctcagtgaaggaacggcatgccagtgaaatgagggatttgccaagtcgatatgttgaaataggtatggctccaacacttgccttctgtggatgtaaaacttcattcaaaattttcgtcttcattaatctcacccagactgccatagtcttttgcctggatccctgcagcagcctcctaactggtttatcttcttccactgtgaattactgtcatctgctgtccccactgctgtcaaaatacagatcagatcttgtcatcatccttcagttcctccacatcgttctcagagtgcagatggaactcctcagtggatcacggggatctgtgttggcccctacccacctctccagctgtagcttatgccaagcttctccttggtctctgtgctgcagccacactgaccttttacctgtccatgcctctctttccccttgtctagcacagtatttggctagagtgttgctttccagggaaagcactgggaaagccactggacctccctgactgagtcaggtcttcccattttaggcactacagcactgcaggcctcctcccctttctagcacttgtcacgggttccagtgatcctgtgattatttgatacatttctgtcttttctacctgactgtcacctccttttgagcacacacagggtctgtttttgctcaccatttgtatcttgaggacctggcacaatacttgcacatagaaggtgcttaatattgagttgaatgaatcagtgactctgggaaacagctgttcaggagaagtatgccctggatgatgtaccatgacttttataatttagtttgaaaaaattattctgagaaaaaaaattgccatattatgagtcagctgaaaagttcatttgcccatttgcttggtggatgggtaatatcaatttgatgggttattctgccaaggtgaagttgaaataaattatttgcacatgattgtatttctgtaaatagaaagacatacattacccacatgactaatgtggttataacatttaaatctgggctattttgtacttgaagtcagaagttggtggtagagttttaatctttttttttaactttaggagtataactacatagttcagattgcttagtgtatggacagtaggtatatgaagaatgtagcagtgctgagaaaaactgaggaccaagataagagacaagatttatgactagactatatagataattgtttcaatatctttttcttctttccttgcctactagaaaataaaaagaaaaacaaaagcctctcaacatctcaatgcaatgtcctgagagattagtatttggatatttttaattgccagagaggtataaaaatgtagcaattgtaatcttctttccttagctgatacttattgatcatgtactaggtggagggcattgtgctgcttacataaactgcagtaactcactttatcctcacaggaactctttaagtgcaggtagtttgctttttattctatagatgaagaaattgaggcttaggaggtaaatgacttgtccaggatcttactactatagcgttaaaaatggatagaatctaactctacagaaccaccagaaagcttccagggaggcaaggaagtttgctgaagtgtgtgatcttgatgaggttacttaaccttcttgaccatccttttctcacctgttaaatggaggtgataatatctatcttttaggatgggtgtgggaattagacatggcataagaaatgtgcctaacatggtacttggcacacagtagatgctcactaaaccatgatggttattatcactatgcagactttcatcccaactctgtgactgctgatagctggctcagtggtggccctattagcctagaaccctgggatcacattattgcagtgtggttcatctgtactgtaatttacgtgaaatagaccatatgtggatactaacagtatcacattactgacattttactactatggttaatggttaagtaccattttttcccctcttaagagtaaacctttaagaatataagccatttccacagcaggaggcaaaatagtttggataagagtccttaagtaggataacagaaagggaaatattaggaggtctggattacaatttcctttagccctgaatagtgtgagccactgttctttggtaaatgaggtgaaaatggcattaagattaaagaaatacgtatggctgtacatttcttagaagccaattgtttataactctttctgttacaactcagactctcaaaaatagcacgaaagttattcctatcacataggctgttgatttattctgttaaatgaaaaataataataatataatgaagattaagcttcttggccaatcaccaacacatgaagagattctctatacatagggcttttgggacatcatattttctttcaaattgcattgttaaaaatagattatggtttgtgcctagcatccatgttttaacttcacttgcatctcttgtattctcacaggactccctgagcctctggtacttttcaccaaagtcttccatgatctctgtggtatggtagttggagagctgacatcatgatgttgggaaatgaaaccaatgtttgtgtgtcattttctgggagttttctgccaggggtagttgacttacatgcaaggaattaatgattgacttcttggtcttaatttcatgtggaattttgtttaattgagattaaacaactatatgagaatctatatagaatgacaagtcaggaagaaagggaagagaaaagaagggaaatcttttttactttcagtattgtctgtatcttcattgatcatatactgtggtcttagaatttagcacatcattcttttttcagtcttttaattgactgaaaaaacagtgacctgaaaattggtgatctgttttcatagtggaggagagttgtgagataattctttcctagatctaagtatctctctttatccacctgttaccattttgattcagctatatgggttacagtagtgggatctttgtgtgtgtgtgcccaggagtgatgtggtttcatctcttagtctgagtctcaatagaaatgatgacagctggcattcttcaaggtgtttttacttgaggatctaggtatgtatggttttctgttctgttatagatagttcagtataaatttctgtaataatctgttctgcattgaattttttttctaacattttgttatgaaattttcattaaagaaaagaactttgtagtgaatagaacctccaggattctgcagttaagattttactatatttgctttattacgtatctgttcatctattcattcctccttttgggagggatgtaacaactctttccccgctcagtagtgtagactcaggtttttgttgttaggagtggaattaatgaagtttctccataataagtaatggtaagaaatctgaagcacctgaagtaacaaatatatattgttccttatataacaaccaccaccaagcacagtgctgaatacattgcaaacagaaggtcatctaatcttcccagtatgcgagtgggtagcggctactatccccatggtgtaagtgaagaagctgatgttcagaagggttaggtaacctgctcaagattattcataaacaaggcagtttttgcacttaggtgtgcctagccgtaaagttgttgcttgtaatcatggtgtcacacagtgcttcccatgtttcctctacccagcccctggcctttgtttacagagtcttgttccagacattcagatacagaccactgcagaaatgctctagaatctgaagaccctttttctatatcagtgatgatagctgctcaccttttctaggaactgccagatgaaatggaaatgcagtagatttgtttttttattttggttcagagaaatatctcatttggagacttagaaattatattttcacttgctttatcctgagattgagagcttttcttcattgcttctcctccacatttttagataatttatagaacctgattgccttgggtgacctttggaattgtttctaaggaaagggaaccaaacttagattatgcttctttcagcccttttaaaaagaagaaaagcccttgtttgctattttttagtgtttagcttaagtttagttgatgcaacaaggtagttttatatttataaaataaagtgtaacatttggtttgaaccttgtgattagcaggtcattggcaatgcctttccttttcttttgtctaagcaatgtgctgtaatatactcactaaatattcctcatcagtgctgtttcaggagactaaaatttggtagatgagataatcctatcagcttagtgttgtcatttaattgacaatagtttgctgaatattgattataaaatacggaattaaattgcaaactaaatttgttttcagcagttttttatctgtgtgtactgttcggctcctgtctgatttgaatgtttttgttattttgtccattagccattcttttcaatttcacttcatgtatcagatcttctccataatttgctgatgtaaagcattgtgaagtcagttttactttaatgtgtctgcttcttagcacagcctgaagctgttgaagtgccgttatttccaaatgtattttcagtgataagtggtcatgctgacagaatgtctaaacttattgaaaagtctgtgggtattacatccagttgattataaaatactaatatctggtgactaaggggccagaatctcttgggaataagacactatctatcataaagggccctcaatgcattttcataaatgaatataagacaatgaagggtaattgttcttatttgtaaattgcttgacacacatttttgtttgtttctttaagaatcatagaagctaagatctatgggatgtcaccttatttaacttcaataaagaaatctgggtagcatttagctaatggacatttggggaccaataagggaataagaaatgggggaaaagaggcagtgcaagttctgtgtactgcagcgctttagcccttgcagcagcactgcaaattcaagagaggggctggggcaccctgactgcatgcagcagaatcaccagagagccctcacttctgttcttgccaactgcagtgtgctttgaatctaagcatctctgtattcttatattcttccccttcccctcctccttccccctaactccccccctccttctttcgatatagggtcttgctctttgcccaggctttagtgcagtggcataatcacgccttactgcaacctcagcctcctgggccaaagcgatcctcccacctcagccttctaagtagctgggactacaggcgtgcaccaccatgcctggctaattttttaattttttgtaaagatgtggtctccctttgttgcccatgctggtatcaaactgggctcaagaaatcctcccaccttggcctcccaacatgctgggattacaggcgtgagccaccatacccggccctgacttacattttctagagtgacttatggttgggaaaaataggacttcagattcctacttctcttatcttccacttaagtgactttagtcaagttacttaacccctctgagcctccttccctctctaaaataaccatagggtggttgtggtgaaaagcaatattgtatgtaaatatttagcatactgcctcacagcatagtaatgttcattaaatgggagctattattaatattagtattatatttagttacagtgagagagaaaaatagtggtttcttttaaaatcagaagatctgaaaattgtgttttataaaatttgtaatttaaagacaatttggggaagatgtaaataagggtttactgaatgattccgaggagattgataatgttttataattgcatttctcaataaaatgtatctataaacatatatgacagaggtacaagtaataaaaatattgatttaatgttgtctcataggtttgaatacacagataagaagtgagataacctagttgggaattattggaggatggttttttactttaaacaaattttgatttttatcctttgtaatctaatatccattagggttttaaacagttttttttttaaatgaaacgaagaggttgttttctctcatgttatccacaccatttctggcttaaggggcttatggtcatgattattgctgctgtttccaccctcatctgtacctcctcagaagctaaattttcttgcgctgtgctattttttgttttacacctgttcctgtttttgcacatagcatgtggtattttaattatctctttttttttttgagacagagtttcgctctgttgcctaggctggagtacagtggcacaatctcggctcactgtaatcgctgcctcccaggttcaagcaattctctgcctcagcctcccaagtagctgggattacaggcgcctgccaccacgcttggctaatttttgtatttttagtagagatggggtttcaccttcttggccaggctggtcttgagctcctgaccttgtgatccacctgccttggcctcccaaagtgctgggattacaagcgtgagccaccacacctggcctaattatttctttaaatattcagactcacaatctcctttaagttagggtcaggtcttagtcatcttgatgcatctagaagactgtctcgtgtaattgatactcagttactcttttttctttttttttgaggcagagtctcgctctatcacccaggctggtgtgcagtggcaggatctcagcttactacagcctctgcctcctgggtgctcgcgggttcaagcgattctcctgcctcagcctcccaagtagctggggctacaggcacgctgtcaccactgccagctaatttttatatgtttaatagaggcggggttttaccatggtggccaggctggtctcgaactcctgacctcaagtgatccgtccacctcggcctcccaaattgctgtgattaaaggcgtgagccaccgcacccagcctcagtcactcttcattgaattaagttgtaaccctcagagattatgagacccaaggaatgagaaagttctttcttgttaatttttataccaatcatatggcattcattatgcaactgatggtgtgtatgctatcgagggccagacactgttgatctatttgtgactctaaccctgaccccattgccctgggcaatgtaaggttgatgtattaaaacatgtataacagcaatatgtgaaaattttgtggttagaagattctgggaatgtagtggcagtggcagcataatttttcaaactacctagtcctcccataaaagcagaacaactaggtcacaaaaccaaaaacccacagacaacatttacaacaaaacttagtgacaaaggtagtcctgagagccccaagacacaaattaatgggaaaataaaacactgatcgctgcagggtgatatcagcatctgtgtgagagaaagcagaggggagcaagtggtcatctagcagacttgaggccaggggaactccaagatagccagttggcattcactggaaaggccaagaggctgctctgagaactgggcccaggacctgcagttaggtgtgagaggctgggcagcccagctacccctggcaactcacactgtggagcagccaggcctcctctctccactgaggagacactgctgggagcagaataaagcctgaatgagacagggacaatagaaacaaaagaaacaggtccagataacaccagggaggagctgagccaggaaatctcagaaagcaagctgccatatttttcatatcaaatggaaacagcagaagagggagctctaagagttcaataatggtcatttcacctaaaaagcaagcaacgttaaatccataataagttttaagaaaaagtgagtaagaagcagacataccagaaagacacacctacgcaatagattacaactgtaatttccagtttcagaggagctataagacatctttaaaaagtgatgtaagaaatcagaatttgaaaatctcaaattaggtgacaggcttcaggaagaattaataaataaaagctcatttcagaattgaagactgaacctgaaggaagacaagaacaaatagatgcaaagataatgttggtaagaggaatagaaggggagcaggaggaaaattgtaaaaatcacaaagcaataagaacaaaaagattaaggttaagtgataaatactgaagacaggcaaagataattcagtctaccaataaagagtccctgaggaaaaaataaaactagagaatgggacaaatactatagacaatgtcaagaaaaatttcatgaaaatgcagagaaacagaagttgaaattataaattaaaatagcacactgtgtatccgaaaatagtgacccataatgagcaacaccaagatatgttctaatgaaattattggactttaaagcgaaaaacttgggcatctagacctgcactgtcaaatgtgataaccattagccactgtagctgttaagtctttgtggtatggctagtgtggattgatttgtgctacatacagaattccaaagacagtctagaaataaaaggtaaaatatctcattaatcactttttatattattacatgttgaaataatattttaggtatgttatgtattattaaaatttcacctctttttttgaactctttatcgtggtgtagtccattcttgcattcctataaagaaattcctgagactggataatttataaagaaaagaggtttaattctcacagtcctgcaggctatacagtaagcatgatgctggcatctggttggcttctggggaggcctcaggaaacttaaatcatggtggaagacgaagtgggagaaggcacctcacatggccagggcaggagcaagaggcaggggtagatgccacacacttctaaaccaccagatcttgtgagaactcactgtcgtgaggacagtaccaagaggattgtgctaaaacagtcatgagaaatgaccattcatgagaaatccgttcccatgatctaatcatttcccaccaggcccctcgtccaacactggggattacagttcaacatgagatttgggcagggccacacatccaagctatagcacgtggctactgggaaattttaaattacatatgtcatttgtgttttggcccacattatatttccatggggcagctaatcaaggggcctctagcctcccttttggatgaggaccgtgtacagaatcgtattcatctcatcctcattctggatctagaagaccttgctgaatagaattttcctgtgaatatagtccttttgaacctctctttcttactctgctagaatctctgtcttttttcttgagttatttctagcatgtctaggaatgcttttatcctcctgaataaagcagaatgcagaagtccttccacctccatcaggaggaggaaggctgtgcctcagctgtaatgcccaccatagtataaggccatcatctaggtgaacatagcgcactccctgcagggcccgcgagctgagcctcagctggctttctagatgaccttgatctgaagtaaagccactgtcttttgtggctacctttaggaactctgcctgcatttttcactccaaaaaaaaaaaaacaaaaaccaaaaaaaaaaacaccctgtccagcttttgctccctgttttcatgtatttcctctctagcagaatttatgtttattttctttgtgatttatcttttccagataatcaggttgaaaatgagcttctgtagtattagaactgacagccacctgtattcaaactgagtctcctttaggagaacaaaatattttatttaaattaatagagtcatttttacgtggaatagaatagaattttagtgaaagtaaataaactgaaacttccattcgtccactgaaaatttgaaatataaagtctgtaattacttgaatatattttacaaagtcagtccataagcttttatatattttatgtgcattttttacaagaatatatattgtcattcaacatttctttctctaaatctatatgaagaatattccttataccttcatgttcattttgacaccactgtctgcagccagcccttctgggactcagcatcgctataaaagataaacagaatcttgttaaatctaaaagcaattatgtttcgctgcattagtaaagactaatggaaaaacaagacaccaccatttattctaaaatgtcttactttgtggcagaatggctgcagacatttccctaaatcagcaactcacattagaagtgagttcttttttgcatgatatcattaccagtgggtattaatggagatgaattgctgagtgggagagtactcgaaaccagataaatggccattattttggaattcttaatttgagaatcatgctgagtattactataattgcaattttgttttctataagagatttttgttggtataagggaattactttaacaaaaagaaagacataatttagtttcagttttatccaaatgttgattacttgcttacctgtgcgtctggaagtcttgacaatattattttcatgtaccacatcttttctttatgaataacatttttgtcagcttgtgatttagccactgcatatagtccgtgtccaaattattaattctcaattagcaaaatttggcaaggtttagtacttaacaagtaagcgtttattacaacatctggaattgagaagtgaaatagatatgtgcacctgcaatttttctttgttttgttttagaacacattggagtttctatcatgttcttaattagagaacaggaaattttctgtcttactcatacaagctattgtggactggggagttggcatgtagaggaggaaagatttgggtaggattatttcgtagtttctctgttctgtatcttggagctcattctcaagaaccaaggcctttgatgtatatttggttacctttaggagaaacactgacagtgtctgtcagtgagactaggcagcctatttggcatcccaagtggggagaatacctccttctcccaccccttcttttgtgattaggagacgttttcccttaggtgtctgtggcagacaagcacagcaaagcctgtgatttctgtgagaatctctgattctctgctcttcacccaagttgctggtaagggaactgtatgtgtagcatttcaaaaatggaatgtgatttagtaaaacagaatgcaagtccatttctaccagtcagagattagtaacctcaggagtgatgacaaccaaaacctcttgttaatatgtcttctaaaatgtgaaactgccatctctttcatcactgggtcctttgtggccccatactgtttaatatcatctgtacattccggctctcccctgctccctgcttcaccgcccacgtgcatgcacagcactgtgagcttctctagaaccttccgcagcctggttacgctagaaacactgtctctgcacatgtggtggaggttgaggtggttctccatataagctcttttgtgaacatttatcacaattaccactttaccaaaactattcttaagtatctggataaacacatttggttcaagcccacagagattaaggaaaaaatgtgttcctggcagaactgggaccagagcacttgcccttggacttccattgtatggtactttaattgaggacaaagcagatgaaatattatctttttataagtttatgttgctaactattacatctttttggtcatccacaattttattttggtgcgaaaattaaattgtgataacagctgcgtaaggaggatcattaaaggtcagcagagacaaggaacactaagtaatctgcaagggaaagaaagagggggacaaaggaaaattcagtatttcatctgtattatgaattttatttctactgtcattcctttctcttatagttgggaaatgttaaaatgacttgttcaagttcaatttagtggaagttataacccaaatttccttactcagcattcagtattggttccagtatgatacattgaggtcccctcattgggaaaagagtgtggaagttaactaaatctgcagctaataccacagaaccgtggagatgatctgaatgaagaaacttagaaaatgtggtgggtcagaacaagagtttactcccaaatgaatctgtgaagtgtagagtatgatttctggaaggatctctgtaataccactactgtatcagttagcttctgctctgaaacaagccactcccaatctcagtctcttaaaacaatgatcttttatattttatagcagctaataattagaatcatataataataatatgtgtacttctgagctttctgtcagatctttggggtccagtgcaattaaagtcacatacttcttaagtgatgcaatatgtcttcttgattttaaatggatttttttttaaaggaaagagaaatttattatttttctctagcctttatttcacttaagaaatactgatgtttcatcataaagtaatctgtatttatgcatctttttttaacttcaagttctttaaataatatccctcttctccaaaatagtgtttcataattacagataacattctttgtgacctttgtactactataatgccccaattgagaaaaacgaactcaggaattttaaaaaattattactgttactaataatggtttatatttctttttatgggtttcaaagcatcttcatgtagtctatgtcattttaaactacctaagcacagtgtcacccttgaccattcatgctgctattattgttggattcatttttgtttgtgatgggaatttgcaagtctactttcccacatattcgtttccaggattgatcgttgtgaagcacttgcagtgctgagttatgaaagtatgttcaacggtgtcccctttacgttagcttttaaaaaggggtccactagcattcacagtcattgtgtccctccagatgtgtgctgctgtttgcccctgttgatgatgactcctgtatcccttttgtttgcagtgtctcagtttgaaactgaattctacatcagtggacttgcacctctctgtgatcagcttgttgtactttcgtatgtaaaggagatttcagaaaaaacggtaattattttctccccagatacaaaggcatgtgggggttcacttttagcattacacccagatcaggttgttcatcagtagcatacgctataatctgagcagaactttctgacctataaaataaggttggcagagattaccctttagacctgacatatttactttccggaaactctactcattgcctgcctttgttcctattgctgagccaaaaaagagtcttttttttcgacctctcttggtatattagtcaaaaggaatgaaggattcctcttgctgaaaggggaagaaactaagctgacactgtgcattagcagaaatgacagcaatgaagttgatcagcagcaacaacaggggtccctgtggtcagagggaattacagaaagggcatttcattattttctttggtccagacatatttgtttacttcctagtgggctggtgattctaagtagcttgattatggctttgaaatggattgttgtgaaatctcagttatcagtgcaaataatggtacatcaaaatctgtggctaataaaaagcagcagatgatctaaattttgttgtgcgtgtctttggaagaagcttatatattgcccagtggatgggtatccacacccagtctccctttgaagctgaggacggccccattcccagcttgtctttattatgagagtccaggggtcctgccagcacaagaataggggtggcttcaaggcataaagaaggaaagcatactgtaaaggattttcttttggatgctgtatatagaagaaattgtaattgattctctagtcctttacagtaagtaggcaagtggactatccttgtttgtatcctttttttttttttaaatggcaagaaataaaatgggggagaaaaaccctgggagccctggttttgaagtggtagctgctcttgagcgtttctctgagcaagcacttgcattaggaagccatcactatagtaacctgaagctctgggtgcccatgttgctaggcaatgaaatgctatagacttaagtgaacactcagacctactaaaatcaatagggttggcttctagccctattgcaggacatcagtttgctattattttatttattttttgaaaataaaagcagtggctcctgggggagtaaatagaatgctttttgaggaggaatgcaggaaagattgagaatgtgattggaagaaataaagaagcagtaaaacgaaaaaggagaagcctaataaacaactgagcaaagaaagaaaggaaacctttgttaataaaagagtatttgaagggaataaatgccaaagataggccaacctcatagagcacgtagaaaatggactttttccagaagaagaagcgagggttttggagatgactggaacatgtttatgccagtgtatgtagatactcattttatagaacattaaagtacaccttaaatccttaaacacagaataaactcataaaattaaggcaaaaggaacaaagaggtaagctcccttccccctttattttttcatactgaaaaggtggtttagcgacattgaatacaatttgttttatatcattcagtattatcccccaaatagcccccagatatccacgtgatacctttcacgtacatgcatgttttcacatagttgcagggatagtcacatgctactctgcattgccctgttttcatgggcattattccattttccctgcgtatgtctgtgtacttgccaccatcattgtgtttagtggttgtgtactattccatctgcttggtacactttaatttattaaggtgttctcctagtattttacttttctttcattcattgataaagcacatgtgtgttagaaattgtgctgggcactggagatccaagatcaacaaaaccagatttctgctcttagggagttcacaggcaagggctgtttggccagggaacgaaagtataaaatgagattcacattgctgatgcttttcttatacatataaaagagccttttctatggtctagtgaagtgattttctttttattttgttcaaaatatttttttattttgctattctgattttgatatttttattgttacagtggtcaatttttaaatatatttcagttttctccattttttttcagttgtttcaaagtttagcaatttgtaatttctccacagatctgatagatttttcttcactagttgatcttttatagttgctattttatttttggaatgttttctgattgtaagtttcctgaggcctttcccaccatgcagaactgtgagtcagttaaacctctttcctttataaattacccagtcttgggtatttcttcataggagtgtgagaagaaactaatatgtatggctaactagaattaatttgtatgatatatagaaatgtaatttaaattaatgtttctctcttttcccccactaggaaagagaatactgtgccaggcctagactggacatcatccagccactttctgagacttgtgaagagatctcttctgatgctttgacagtcagaggctttcaggagaatgaatgtagagattatcatttaggtaagagatatgaaagatctggctgatatgcttttttaatgtttttttctcccccttcctacttgcaataaatggaatttaaattaaggtgctgaaagaatcttaagagaatacctgggtagactgtgtgtgctgaaaacaaggacatttggatgcagagatgttgcaaaacttgcataagctcctatagtaaaagggaaggctagagttcagaccaggacccgggggaggattgggccccttgttttttgttcttgtattttttctattgtcctaactatttaatgtgacacataatttaatgtcaagctgcatggctccgtggttgtcatatcactcccattttatgtgtcaggaaagttcgctctggggtggcagagaagttgtctttcttgtttgtaactgagtgctcagagcctgaaagacttctggcacattttaggtgttcagtgaatatttgttgagtggacagagaaatacacttagtcactgctcataaatacagggagaaccattaatatttagtcataccagagacatctgtgtttggctgttatcatacccttgtaaaatatattaatgaaaatagaacagttcagctttgtaggaatgctgtactactttaaacacaattgacatttgttgagaatattttcagttctcattgtggccaaaggaaatgaagaaatattctatatatgtttaaactttcttatatgaagaccctaatccattgaaaaacataagagtatattctagacttggcaaaaagcaactgtgattcacaactgaaagtgtccaatctaggtatttggctcagagcaaactctcctgcacacttagaaacccttcagaacaggttttataattgaattctgcaggaaaccctcagattggcattgtgcacaacatgctgaaatgatagattatgtccctagggcttgggcatctgtcatttatgccttaggtggccttgaccttgatgaggaggaaacatttatcgctgaccatggggtgtaattgttctgtaaaagtagaacaatgctgtaaatggccacaaataaaatttatatacagtagatgaattctaatatgcagtagacatagagaatttttaacactttttcagctgaagtcagagtgttgatgtattaaacgtagaattttaaactcaccttatttttttttcaagttttttagtatgtcattccctccctttctgtccttctccttccctctcttgctttttggtcaagtatttttacacttaaatatttttaaaagcactgaaatacgcttctgtcattctttaccctgtctcccacacttaccttccagcagagccaaacacacaacaaagatagacacattttctgttcgctcttgggttgggtaacctaaccaggtcctctgaaaccattgccaagttttctgctgttcagtcaccaagtcgttcctctcttttctcacctacagaatactctgaaggggaatcacttttttacatcgtgagtccgagagatgttgtagtggccaaggaacgagaccaagatgatcacattgactggctccttgaaaagaagaaatatgaagtacccttgattttacttctttgaaagtattgactcatctacagcatagagagagaagataaaatgtttttgtaataaatcttttatgtagtcaaagtagagtttcccaagccaaaaatatgtaggaagttaataactttctagtacccccttcagaaattagggaaccaaaagattgcaatggattgactggctttcctgttaagtgggggaggagttgggagtggagggaggaggtgagttagatctagactgttggaagtttcattttttgattttgttcaaagaaattagagatagtatttcagaagtgtctatttagatttaatgaaatcgtttattttatacttatcacatttttactcacttaggatggtttgaactatcagtttggatagaatgatgttgtccacttcattgaggtttggcttagattaatttgaatagataatgcccaatatcgcttaaaaaaaaagaaaaaaaccatttttcaactttaatagctacaaagttacgttcttagatgggcttatatactaatttaaaacaacatccacaacaaatagtctacgtatttgttgtactaagtttgtcaccatctgaaaggatttggaaaaaaattttttttttcatttataaactatttaaagtccaggtatcgatacctagttcataacccagtaattaccatgttactttaaatccagtagtttctcaaagaaataattgtatgttttaaatatttatgttaaagtagtatttgtaaactttccaaaataaaaacaaaatcagagatttttcaaagacttaattttagatatacataaacatgcgtatagttcacttttttattgaaacataagggaaaatgctcctttatcaatatgtcataaagatctagaagacagctgcctttttttgtatggagactaggagactttgttgtattttgatttgtgtctgaaatgtgattccattgtcctaatgaggaaatgaattcaaatggaagtgggagaagtcttcattttggttgactgcctttgagtttgaattcagtgaggttcattcaaccatagcattaacaattccaatgcttcaagcaaaagccatgggaaaatggagctttattcgtgtagtgcagaatgctaaaccataataactatagtgtttataacctcaatatctttctctcccaccttctcccattttccctccctccttttctgctttttttttttttttaaatcatccttatgtttggaataaaggaagcattgatggcagctgaaattagccaaaaaaatattaaaagacataagattctggtaagtgtgcaatttgttatttgaaacataattttatctttcaataagttatagtgagactgaaaataatttgaaaagaacaggtttttcctatcttttgagaatttattttaaactaattccctaacctatgagatcaaaatattttatcaaatcagtttctgcttgtaaacaagagacttgaacacctgctaggaggcagttttaggtaatttggaaactgtatctgtggaaaacactttaaatacagagctttctagttatgtgtatgaaagtttccctaaatcgtaggtaaaaatcacattatcacaaaatttatcaaaaaaagagaggtttcctaaaactgcattgctttggtgtttccataataacagactcaattgattttgttatggaaactaatctagagcatcaaatacatttttattacattttggactcaggaaaaatagaatgactgaaagcccctttccttgttaactgtgacagtgaatgtgcagatggagagcagaggaactcacatcctgcacatgtgaagggtccttggagaccatctagccgagttcccttttttacaggtgaaaactggaagctcagtcttttatgcctatttgggtttcagtacaaattctttctgcctacattttccctaccgtaaacttctctgtaaaactccacatgaaagcctgaattgtcaaagagtgcagaagcaaaataatttaggaataacaggagaatagaaaaccagagcatcttaaaaaaaaaaaaaatccagccaaaattgtggagaataagcaaggattctctagaaatggaagagaatgcattccggcccttagagtagttaacatatgtgaagaggcagagaggtgccacagcttggcctgcttggttatgtgggcagttgaaggcttttttttttttttttgagacggagtttcgctctcgttgcccaggctggagtgcaatggcacaatcttggttcaccgcaacctctgcctcctgggttcaagcgattctcctgcctcagcctcccgagtagctgggactacaggcatgcgccaccacacctggctaattttgtatttttagtagagacgggacttctccatgttggtcaggctggtcttgaactcccgacctcaggtgatcggcttgcctcggcctcccaaagtgctgctattatagacatgagccactgcacacagcagttgaggggtttactacataggtagcaaaggtcagatcctgaagtgccgttcgtaattaagagcttgcttctctcttggaacatctagaagtcaatttaagctttcagacatcagatttccctgttagaaagattctctgatggagatggggccagaggagggccagctgagatggagatcaatcaggaggcttcctaatccaggtggaaggtcatgagacttacacagaatcaataggattggagaggtgaagatagatggaagatacagtaaacttttaatctttgggatgtggtaactgactctgtgtggatgaaagaataagagtaaaaatctaggctgactcccaggctttgggcttgggcctctggtttggtgctgccatttactgattgatagagataccctgtggaaggagaagcaggattgggagaaatgatgaatcctattttaaacacattagttttaggaatctgtgggacatcgtagtggagcccaggaaagaaatttgggctgaaaagttgagtctcagtttctgcacaggacacattagggtcctattagcactactgactgtaacctgtttatactcttagcttgctttatgtaattatgcttgcttcttaagcatattcatatttaaatgtatttatattttcatacattttagagtgagtgtcatgaacagaggaccatgaatggaaccatcaggaatgctgtcattcaagggatgatgcatacatagtagatttggaacagccagagcaaggtcatttcatgggagctgagagaggagagaattccagggtaaagagaattaaatgcttgagtagtggaggtaagcaggtcagaagggtaagacgaggtcagctggtcagttgtacactggatttggtgatatgaaagtagtgaattttctgtatgtgtattatttattctgaacatgttgtagggagtgaaaagtgaataggagattataaagtacggttctgagtatagattatcaggttagctgtgaaggggaagagagtgaaggctgtagctgaggctgtagctggggctatggcatcctgggatgatggtagtttttgggtattttgtgtaagagaggcacttaaacatgcttatgctgagggaaaagaggtaaaatagagttgacataaaaggttgatataaaaggaagaggaggagtgcaggataagctccacagtggagaagcatggacgtgaggagaaaggttggaaggattgactctgaaaaggagacattctttctctgaaccttgatggaaagaacctgtgtagaattgttacgtgtgatctgtttccagaaaaataaggaagttagacactctttcttcacttctgttcctatagacttgaaatatgatttctcacatagtagttattaaagtaaaaatttaatatactaaaaatgatgggtattttgcttcactcttgaaatgggcatgtcctgtacattagtcctatacattagttatgaatagattatttttctcttagcatgatgtaatttcataccaaacatgcagagaagaaatgggctcctgccatttttttttttgccatccaagaaggtatttcttatgcacctttttgtacataaagtagaaatcaacacccaacgtttcttatatatatcaagcttaagcttctggtgaaaatacttttaggtgcaaatagtatatgagaagatgagtcatggggagatcaagcaagagctgtcctcccatgcctctggtgatgttggccaccccaaatcctttcagaacccaggtagaataagcgaataaacatgaatactctgaagccagtcacttccctgctttcagcccaatttcttctgtaaactgatgggtttgaatcacaggtttttctgagctcatatcaactttaatattccctatttcctttagtatgatagtcattatttcatttttcttataacttctcttcagacttggggtagaagaagtaggtagcttgcattctacagatgaaggcacaggaaacaattttatatacattaacagtgtggaattgttcgatcatgtttctaatatcgaatacctcctttatgaaaaaatgtcttaaagggggcagattaggagcctttaaaatactaacattatttactttttttaatgacctgacctgtgaattctaaaatgtatgaaaatataaatacatttaaatatgaatatgcttaagaagcaagtgtaattacataaagcaagctaagagtataaacaggttatagtcagtagagctaataggaccctaatgttatgccctgtgcagaaaccgagactcaacttttcagttgtttcagttaaattttgacatttcttcatttggctttctctaggatattggcttggcatatataaatcacctggtggagagaggagactatgacatagcagcacggtaatgatgacattttcacaattatttgttaatataaatagaattgagcattgctaacagtaaaaataagccattctttgcagttgacattttatttttgtacatctttctaacgagggtaatttttgaatattatttttaaattataatttttgaatattaatgattccaagcacagaatcagtttaatgtttattattttcccaactatttcatttttaccgaaggagaattttttttctcattattaatgagaaaggtatcaagaaccatgaaggatctcagactttacctatttacagtctaacaagttagcctgtcatttccctggttgctggcagaagacaagagactcccaggtcagagctaaaggactctgtgagcaatagtaccagccaaggtactgctacaacaatagtagtcaaatagagtgtcaacatttgccccgatccccaaaccccaattcccacaatgcaacagagggtgggcatggagatcctgcccatgcagtgggttgtgatacggaagaggacccctgagcttagggtatctgaatcttttctagtgaccaagaaccccatgtattagtccattctcacactgctaataaagatatactcgatactggataatttataaaggaaagaggtttagttgactcacagttcagcatggctgaggaggcctcagaaaacttacagtcatggcagaaggggaagcaaacgtgtcgttcttcacaaggcaggcaggaaggagaagaacaagagcccaatgaagggggaagctcctcataataccatcagagctcgtgagaactaactcactatcatgaaaacaggttgagggaaaccatccccatgattcaggtatctccacctggtcactcccatgatgtggggattaatgttaactacaattcaagatgagatttgggtggggacacggccaaaccctatcaccttgtctgccttttgtcctaaaggcgtcattttacctttattgtactgggcagtaagaaaccttccctttcctcaggagggagacactatttgtgtcgtctcatttctagagctgtttgctttataagcatccttggaagatagtccagaagaaagtgcctctgcttatgattcaaagagaattttcccaacctaaggatggcagttaaatagaagtgactagaccccaggatcctgggttgcagaggtctgtggtgggcagaacacataaatgttatgtagtggtgtgcaagtctgtgtgaggggttcccactggaactggcagtgcccgctgcatgactgcatggcagtcctggaagagtgccctcaagcctgcttctcgtctcctgaggttatttaagaaaatgtgtttctttgatgtgtaaagtaaggtttcattcatacataagcagtcctccaggttatatagtaggataggattctagttttctgaagtctgattttgtagtgcataatttaaagccatttagaaaggttctggcactttggggtatgacaagttttcttcaaggcaagaaaggtctcccgaaaccagcagtgctcctctgggtaaatgggaaacttagaacaggcagatagttgggaaagcccctagttatagtcttctgaagtgattcatctttatttataagcattttatattaacttttataagttgtgttaatttatgtatgcaaccaaatgagtaacagtaatatctttatgttcgttggtacttgagatagaaattcatcaaaactctgagaagagagatttctctaaacctctggggaaaatgtctacttattctgtctctgtttgttttttgtttttttaatatatactttctttctgcctgggatgtttttactgccagcaaatgccagaaaattcttgggaaaaatgcagcactctgggaatatgaagtttataaatttaaagaaattggacagcttaaggtaagcaaagccttatttttaactctcagtttctgcaagtagtatattaatattgcagtggaaacaaagataatagtactcagctcttttttaggacgtgattattatctcagatggaaagaaaaatcaaacttttagagacagtttcaaaatataagcctcgtgtaaaaaaaaatatataagattatatatttattacatatacaatgtgttcacttatctctttccaattctctctgtgtttagatgaagttttcatgctctttttaatgacttttgaaaataggtgtaatctcatccagtaggttataaagcataagactttttttagatttactgaataatattgtatttttcaagtaatattttacctgctgaaagacagatggaaaaaattgaccacctagctctaatgaataattttgatgtttctttttttaaatctttcaacttagtgcacaacatcctaatcaatcaataaagtattcctatatttgttttaaacatttaaaaatttttcagtatttgtggaccttttgaatgctctcttcaagttataaatatgctttaaaaattcccagttactcatcttgtcaaccgtgtgactcctcctgtctgccctgtaaatgttacacttctcattgggtttattggatggtttctggaggattttatccagtcgtgcctccctgtttactttaatggctgtgtaacttggaccttttttttgaatatcatgtgatggccgtttctccttgtatatactgctgatgatgataattcaagttaatataaatccattccttcccaaattcagtccttttccattgagtctgtgtttgtgatacacaatatacccattccccagagtgtattagctcaaagccactgttcttgattagaacatgttacacccctcctcattctgtttaatctccacttcttgtcatttttttcatgtcaataccaatcggggctcttctcttcccctgtggtaccattgccttaacttttgcctgagccatagcaaatgccttctgatagatctgtgggcagccctagcccagagttatctgcataaaaaataagtctggactctcacttccctaatacctgttgcttccctcctgcctatagaataaaatcagaattcctctcaagaccccacctccccttcctctccagcctcacctcccttcagtgacgccatctcgcatctctgggctcctctgacctccctgcacacagatgcatgttcatggctccacgcctttgctcatgctattccccctgccagatgtcctgcccctctcttattttttcctgagaaacccagggctttagtgggcatggttctcctctgctgctgcagcactgtgctgacccctctgttataacacttaccacacaatacagttattgtctgtttaattgtctgcatatctttcttctaggacttgtgagctccttggggatggtgaccttctctgtctgtccccagtaaaaagtgtggtgattggattgtagggcattatagggtcattgaacagtatttgtaaatttgacttttaacacagtactgaaaatatctgaagaacacaagatgtatttttcctaatttcaaaagatgattatgagttggtgaaggttggtaaactccagttgaaggaaggaaagatgaatagattacctgtactcctcgattacttaagaagtcgacttttttcatctctgtgactttctccctcctattatttagatttctattaactcatcaggaagaacagagagataaagattaacctaggcaatttttaaattcattcatacatgtatatacttttgaaaatatattataatttattgttagaaagtagttttcatttaaatcctgttcaaaacatttttttcagagtactgtattccctcacatttttaaagtaaaaatatactttatgttttctgcataattggaatgcagttttgttttttcatattttaatggacttttttttcccttttccttacctaggctattagtccttatttgccaagaggtgatccagttctgaaaccactcatctatgaaatgatcttacatgaatttttggagagtgattatgaggtatggtgttctgatgtggtcatatttacttgttctcgatgggaggtgttaggaaatctagaaaggaatacaatggagcaatgcctgtaaaggaaacagatttgtagtttgcatgtggcaggtgaaactgagctagagaaactccagtataactcatgtttatgtagacagtgaaaacacttagtccgtgtgcattttaaggaattccttaaagttaccttctttctagaactaaagaaaaagagctaagtgctattttgtagatttcataaatacaatagcagctgctattccatctttgatatcatcccagaagaaagagaattatgagtgttctgtgaaaatgatggagaagagtacaaacttcctttacaaatgctgaagtatgttataattttcctatttttaaagtaatgtaatttaagcatttaaaaaaatttattgtttttatgattctgttacagttattgcacatgattgaactcttattttttcatgaaacttttaaaaatcctttatcgtcaaagttaccctgttgatttcatatctggaacactttttattgagatggaaagaagcatgacttaaccttagagattgtagatgttttctcctgaatgttttaggatgtatgtctggtcagtactgttaaggaggttgtaaataatttgtttttattttcataagctcttataaatagttcatgttttaccttcccttattctcagcttaattatttaattttgaattaaattgtcacattatcagtcaaatagctgtgttccctaacaacacttttgatcacatattatgtggagagacattttgtgttgctaaacagagcactgaaggtcagattacaaaaaacaaactgtacttctctggaatattgacttgtcaatttttttctccctaaaaagacatgaagtaatattggaggtaaagatgcttcatgacttctttgtatggggtttctagtcatatgcctgtagctttgcctattaatttacgacccagcagagttaaacagttaagctttgtttaatattaacgacaaacatataagcatgttaaaaattggatgatttctgtggcatttcatttcatgagtactttctagacttttacttattatgataggtactgaggttttctataactttgctcattcaatcataacaggtcccttgttcctgtgtcctctaattagtaataatggccacagatagattttataaatatttcttgggtagcacatttattcaagggtacacaaagccagttgaacagagagaagcctaacatgaaatatgatagatgtttatttcagtttatggtggggtcatcatgcttttatcatacaagatgactggttattttgtctttattttgtgttcgaagttggcagtaccatgaggctgttgcatgatagggaaaagaaaaaatgaggccaaactttcttctttccctgagcattattattaatggtctaggggctactgtgagctgctggtattggggtagaaatctttacagactattttatcttatatagtcttaagaaaacagggctgtcacggtggctcacatctgtaatcccagcactttgagaggccaaggtgggaggattgcttgagcccaggagttcaaaaccagcctgggtaacatagtgagacctgtctataaaaaactaaaaattagctgagtgctgtgacatatgcctgtactctcagctattcaggaggctgaggtgggaggatcacttgaccctagaggctgaggctgcagtgagctgtgatcatgctactgcactccagcttaggtgacggagtgggaccctttctcacaaaaagaaagaaagaggctgtgtgtggtggctcacccctgtaatcccagcactttgggaggctgtgggaggctgaggcgggcggatcacaaggtcaggagatggagaccatcctggccaacatggttaaaccccgtctctactaaaaaaaaaaaaaatacaaaaattagccaggcatggtggcatgcacctgtagtcccagctatttgggaggctgaagcgagagacttgcttgagcctaggaggcggaggttgcagtgagccaagatagcgccactgaactccagcctgggcgacagagcgaaacaccacctgaaaaaaaaaaaaaaaaaaaaaaaaaaagagaggaagagagagagagaaaaacaaagaaagagggagagagagagaaagaaaaggaagggagggagggaagaaaggaaggacaaggaaggaaagacaaggaaagggaaacagagaaggaagaaaagaaagaaacttgatctgaaatattattttggttctacaaacattttaatgttctgattgaatccattcccaaatttctgaagtaaaatttcaatcatattaatatataagaagtttgtaatctaaatggaaaatatgtggtcttttgttctggtctcttgccatccttccaggggctactttggtagaaatcgggtggaactttaatgaaaactatattactgattcttttgcacttttcttaccaaatcctggtgcattacagaagcagcttctatcacattgttttcatttctaagtattatttaaacaaattcacagtagttcattaaagtattaatggagttatttaatagtaataatgtactattttttatataaaccaaaaagtgactgagacagatctcaatcgactttaaggtttattttgccaaggttagggacatacttggggaaaagaaacagggtctgtgtcctgtgctttttccaaagagattgttgaggacttcaaaatttaaaggggaaagagcaagcaggaggcaaaggagcaaatttaaaaaataaataaataaataagtagggggagagtaagcaatgaggcacttggtcacattccagtgatgctctgattagctcaggaaatctacgttttacatgtaaaaagagagaagtggggaaaaagtcaattatgcattcatctcttgctcagtagatctagctttgacatgagctaaaggaagcatgtgaaatgacagctctctgtttgggaacaaaaggaaggcaatttttgcatgactcagttcccttaactttccctttggcttagtgaattggaggtcctgagaatttattttcctttcacatttaataacgtggatgtttttaattctctttactgtcttatgaacatgtttttgttctaaacattgtcaaggatcagtaagtaaactgctctgtcatactttgagttataaaacatgaagtctaaagtcgggaatcagggagtagagactgagcaagatactggcccagaatcagctgtgggacggaaacaggatcaaatcggggaaccacaaaatttgagatctagagatagccaggataagagccaggggataagacttgagccaaagtctcaaattccaacataaaactggcattagaagccaaagtggaaggaggaccaagatggtgacttgttaaagatatagaatgctggacagtttcactgtgggagcagccctgtcccaagcagactgccacggtcagttgtgctggctatacagtgcacaactgcataaccagttgcacccagcagcccaggcctaagtgcattagaggactcttggtggtggggaaagtagctgacttgggtaatatctgtaagatgttaaagctgtcatccaaatgttacagttagtccagaatggggatggagcaagtccaacctaaactcttgtccatgcactttatagaaggaacaagatagctttcttagttgtacatttcgtaaaactaaggacagaagtagatggcacgacctgcctcccaggaatgctaaatggagatttattgtacaataatattccctgcaactcttcaccacacccagacccatagtctgaaaattgatgaaatatttattgaacaaacttttaatcatataattgtttggtctgttatgtgactaaaagtgaatacttttagggatggtttaaattgtttggtttgttttgagaatttaggagaaaccaaactcagtttctcatgctatactctcacaacacaacacttctgtgaccaaatatctgggtttttccgctacacaccaagaaagcaattagttctgcagtggacaccagctggatgtcctctaattcagttcattctgacactgtctacatgaagatagcatcagttcctgcaggctgagggctcaggcccacaagactgcccccacttcagacataccaatcacaagttataggctgtcacctgtacttccgactggtcaactataaactggaattcccactaccacctccttagatttgactcatttgctagagcagctcatagaactcaggggaacactttacttacatttactggtttattataaagaatattgcaaaggatacagatgaacagccaaatggattagatgcagagggcaaggtatgtgggaagaggcatggagcttccaggtcctctttgggtgcaccaccctccaggaacctccaggtgttcagctcttggggagccctccaaagccactccttttgggttttaatgaaagcttcattacttagacataattgatttaaacactgggccattggtgatcggtgtaaccttcagcccctctcccctccttggaggttgtggggcaggggtgggggtagggctgaaaagttccaaccctttaatcctgtctcagtctatcctgtgcccaaccccatccttaagttacctaggggctgctagccaccagtcagctcattagcatacaagaagacacatcattttagagattctaaggattttgagagttatatgccaggaaacagaaggaggaccaaatgtatatttcacaatatcacaactattattctgttgaatgagtgttctttttctgtttttcacctttggttagggttttgccacattgatccgagaatggcctggagatctgtataataattcagtcatagttcaagcagttcgggatcatttgaagaaagatagtcagaacaagactttacttaaaaccctggcagaattgtgagtatacttaagtgtttctttttccatatcagtctgtgttgaaaagtttttcatactttagatttggcaaactccaagtggagaagatgtattttataccattttcctacattccttcttagtaaaaacctctcataaacctcaaatgagtaggcgataaggacatgtgtgaaactgtacaattgcaatgtaatctgtttcccagagaagagaacccctaacgcacagcgcttgggagaggcagtggttaggaaacaaaagggtgccaagttttagatcactcaagcataacagtttcccaatgagcaaggctctggattctgctcttctagggtcttcaagtcagttaatttaatctctcaaatgtcaattccttatgggaaaattttaaactttaaaagagatgtcataatagaggactccctgaccctgagtcagggctcagaaaatggcagcttggttaatatttttcatatttcttgggcacattcagtgatgcaggctttgtgcgagacgcttatgatacagagatagataagatatgctctcaagtacttcgatctagggaaacaagaagtatactgcaggtctagccaagacgaccatccctgcatccacctctcctcagtgcccccatcacctcaggccactcctctcccttgttttttcttcttttgcccaaaaccaaaaaaggtataccaaaatgacctagaactctggacgtgttggattttccacaagaggaggttgtgtttatggcattctaagttgaaatgctaatcattttctcttggaaacgttgtcctgttagataccccttagagtctgcagcacgttcgtaatggaccaacagtacagcttcagttcagtgagctctcaagagctgacttagggacttaatgtgaaaaacattgtttcaatggaaaaacacatttcagttagacacagcccccttaaaatcagcttttggaatattagccatttgtcagctgaatactgcttgtaagaattggaacggatgtttctgttactaaaatgagaacttcatcctggatcctagtttctttgctgtatggatgtttgtaaaacttttgagactgagacccccaataaagaccatttttattacttgaatattgtgaattttcttaaattttggcaacatgagaggcaaagttctgagaaagaaatacttattggtcatgtatagttaaatcctattcaaaaataggaatattttttgaaataaagttaacttttctctctaaaggagtgtttccatttttaatattgtgaaccatgatctctctgtgtgtgttttaattagaactgttgatgaatattaatgtaaaaaatttgtattaccaggtacacctatgacaagaactatggcaatgctctggaaatatacttaacattaagacataaagacgtttttcagttgatccacaagcataatcttttcagttctatcaaggataaaattgttttattaatggattttgattcagaggtaatgtgctttttattttagtactgtcaattatttttactattccaaatatttaatacttagatatctatccaaatgctggattggtgaatgaatcacataacttggctttatgccgacaatctttagaacactctgaccctcgctagatgttgttattctagttgtttggcattcaggaatccttttcataatgtagttattctgtgaaagcaattcaaagttgatagagaacttttaaagttgtgtgtgtgcgcatataaagtaatttcttgctaaaacaattcatataatttatagaaacaaaccacgtatatactttgactcatttatccctcctaacctgttttccagaattttaaaattaagtgaacttccatcttgaccgacttattactattttatttcttggtgttcacgtatcccagcatgtggggtttcccctggtttgaggtgatgctcatgtccaggacatgtggaatgttattttattgtgtgacaaatttgaataacctaataataaatttacgccccctaatgagtggacccagccacagctcacattggcgcttgcaaagtgatgcaagctgtgtgtgtgtgtgtgtgtgtgtgtgtgtgtgtgtgtgtgtgtgtgtaaaagaaatctaattacaagtgctcatgacagaaataatgaggtttataaaacagtgttcttattcaaaaaattgaaattttagataaacctaaaagtagaaccctaaaggctccaaaaggattaatgcatttttcaattatattgtactgtatttagagatattgtgtgctctattaatctccaccaacttaaacttaatttagataggagctagagctacctctttttctcaaagatgctttagccctttttaaaatactgagtcaagtctttagggactacagatttacgaagaattacgtagctccaaggaagttcaggtagagcggctctgcttgtctggcagaggatgagatgcttatgtaaaaattaattacattttcctcatatctagtctcccctcatgcacccccttccattgttctccagagctcgttttgcatatgttcctgtggaaaaaagatgaatgagctgaaactaattgctattctagaatgtgatccagatgtaaggaatcagagtcttctggttagaagagaccttagggataatctactccaacaccctcgtatttcagagaacaaaagtaacatttggagcagacagctaggtcgtagcagagtctagaacagggcccccaggtgttccgtgtgaggctcagtctggtgtgctgctttccctcttcctcttgacataaactgtctagtttgtgtttcctgaatgataaaagtggctaaagtaaattctgaaagtccaaaagctttatgtcattatgaaacttcaggtatctcattctctttctgactcttattcccttctcctcataaaaccagctccttctgtctgtggagtctcatagggagactaggtcgaggttgaagtagctggaagaaaagctcattttcttgatatactggtaaagagatgctctccataactactgagagtctcatgagaaggtgtgaaggtatccgagacatcggagggcggggggctaggatatgggcagtcaagatgttttgtatttgggaagttatagcaaagcaccattttagtagtgtgcaaaacacataggcttcagattgagatgcatttgaaaatgcagttcttcacaaatgtcattttccataagagccattgtaaagccaagggcctccttaagtatacaaaataagccttccacctgtgaactgtggtaggtacactgcattgtgtttagtcttctcttcttaaataacggatttcattgactgtggcttttcttatatgtttcagaaagctgttgacatgcttttggacaatgaagataaaatttcagtgagtgtcatttgtttttatatgtgttaccagatgaacgtctgggactcctatagctgtgaagaagagagtttatcagataattttgtagctgtctttctgtcctcatgactccaccttgaaacttttcttttttatctagattaaaaaggtagtggaagaattggaagacagaccagagctacagcatgtggtgagcatggcagtctcctccttttgcccttttgattgaccagtgggtgaatcacctttcagtattggtgcgaggaggatactggagtgaattcttcaaggaggttaatattccagttggaggtttcaccacaaacaatgttctgtaattaccaaaatgcagcatatgctgtgaattcaaggtcagggattaattgtagatcaggcagttgaattttgacccacaattgaattgtgatggaaaaaagttaccaatctatctattatattactataatataaatatatgtaacataactatatatttaactataatgaatgtttttgtgttatgttgtgtctaggaataagcactctccctctgtagttgccattaaatataaccatggcatatatcacagtaaaggccagtatggcaccgcagatactgtaccaagttctcctgctaaggaaatgtcagacaaccattccatatccagaccacagagcgataaaagggcagagtctcatttcttttgtccctcaccatgacaatagctaattccatatttcttgtgtgctattggtggttgtgtaattaaggcctgttattctagatttctttggggggctacttcaattctctgcattgcatcatcatgagagtaaagcaggaatagttgttttctatgtcctttaaaagttatacaagagaaaacttagcacacttagggattatatcagtaggactatgggtatcagatacaataagtgcacttgtatctttgcccatctcattgcaccctaggaggaggcttagggaatagagcatttttttcaaaagtcagttttctgctttgaagcttttgaagactgcaggaagggaatgagaggcacctttttttctcttttgctcagatgctactgctgcattgttcatgattggaaatctcaagattatctgcttcccaagcaaggctccacattgctaaccaccttaggaattcatttataaagcagtgatttctgacttacttaagccaggagacaggattatgggcagtagctctctgtgcgacaatgtaatcagtgcaatggtgaagtggtggcacagcccacactaacatggctcatcttccctgccaggcaatgtcttgtttctatatatataaatttgactcagcattcatgtgacagggcctccctgtcctttttgcactctgggaaacagcaccacatatccccgctaacacactgaccccagtgccagtggactggcggtggtgttcatcagacctctgcctggcacatgagttcagtctactgcttgtactgctccgttttgccttaggaagaagtgaacaggaagcctgaagattggtttcttaaggtgcatgtgtccatggttaggcgtcattgtgactagattcaacagcaataacaaacatcagcgcatttacagtctcagctgcagggcggctggtgctctatgtctgttataaaccaatccacttggaaacagcaacccaaggtgttaatgctcgtgggattggtgattaagtcttcctgtcttcagtagattgtggggtttttgtttacatttaatattaactaaacattgaattgttttttgacttctgagtactgtattgatagacttaatcttgcctgtgaggagaaagtgaattactgatttcctgtgaagttaactttttttcagacagctaaggtaaggaatcagttttgaaaactgtttcagaacacctgcattcttcttgatttttactttgtatttttgtttttgatgttaccagtttaggcagcatttcatttgaagagtcaacaaagaggagatgcagaatgtatggaaatgagtttagtgcccgctacttgagtttttaagaatatgtgcttgtcccaggactctaccctcttttgtgtaaaataatttttatgatctgggaagaccactcatctttttatttctgagccaaagcagataccaatgatgatattgacaactactgtcattaacatttctgtagttcttagtgtatgctaagttcattggttctgagtgatttcgtaatggcaactcgtttaattgtcacagtaactcaataaaatttttgtagataaactgagtctcagagagattagtgacttgcctaaggtcacagttggtacgtggcagagtcaggttttggggcccttctagagaaattatcggaatcctttgctctcccaaagggttttcctttccacttctccatcacctagaggttttccctgaagactgcttctcccccaacctgtccatgggaggtgtttagagctaaaaatagcaatgttagccaggtattgcttttctcattttaatgggtcacggcttatcttttgttccttttagtatttgcataagcttttcaagagagaccaccataaggggcagcgttaccatgaaaaacagatcagtctttatgctgaatatgatcgaccaaacttacttccctttctccgagacagtacccattgcccacttgaaaaggtaaggcacagactccccgacttgtacactttggatgaagaggttgtcattgatggtaagttgtttgtctttcttctctttctatctctgttcatctgtccctttccagggggaagactgttgctctcaaagaagtaggtttttggctgggacattctgtcaagaaaaggagatctcattggattagactttggtgaagagctgaagcatttctgtgacaggtttaattggaagaacagcttaatccagggtctaggacttaatcaaccatcaggcaaaaatgatatattagaagtctcagtccatctcccaggatcagagtgacacctcagagtcaagagcctgggagggagacacagactgtcctaagccagaagcagttgctccagtcaggaatcaggtttgataaactgaggtcatagcttaggtcctgcatcctatcttctttaagtgtctaccctatgtttttctttgtttctcctacatcctacattccactataattatctgcttactagtctctgtctcctggaaattcttcaaagacaaggaatttgtcttactcattttggtaaatctagtacccaccacacattagacatttactaaatgtgtgttgcatcatgagtgagagaatgaatgaataaattatatacatgcaagatcctagttcgggctaaataaggactagtaagttttatgagactgctgtttcaaaataaactgaagtacttaactatatatgtgctaacaactgggcagcctaaaagccaacagtattatgtcctacagttctcaataccatctaccactaacatctacaaatgtgtgactaaatttggatggccagatacttttgaaagtcagctgtgtggaccaacaaaataaaaaacatatttgacccattagagatatgtgcaaagaagctggatgataacacagtttatgtacacttacaacttccgtgtatgcttccttagcccatgattattaaatgcattggagtactgtgaaccaatttagctcaatggatttttaaagtccacaattattgaaaaaaatcttgcctgcctgttaacttataaaacgacattagcattttatatttggggccctaagacattttctgaggacttaatttggaaattcattatcttactctaaaagtaaaaacagatactaccctcttctctcaacataggactttataacctggcaatagagtgagaatcttattctttgaacagtgctccttcatttgtttctcacttttcaagagaacattgtatatttcagagaggatgtggcagtctcctgaagtctcccattgacctctgagacagagaggtcacatgtgggtgattaacagcccttcccattccctaagcacaagatgcagaggcgccacccaggttccagtatctctatatctctcacacactttatgcccacctggtttaaagttttcgggtctagtagtactcagtggaagacaccctgcttcacccagtagggagcagcagaatgttgcagacctgcatgtgatgcttcctacacatatggcttgcttagagcatttgtgtagaccttgtagaatttttctctctggtccactggaaacaacatattgaatgtaaaagaactcagcacaagcatagtaaaaccaattatgttttagacacagttatttttaaaaatttatctcgtgtcccactgaaagagaattttgagcatggattagaggtggtaatggtgaaacagaccattataagataatcaagtagtaatccatatttttaggactccctaaatgggttttcatgtttcaggttactgagacttcttcataagagattatctgtttgtcaggatctattgtgggaaatctgtatatttgtagaaaacatagcactctaccctatcaggtacccaaagctgtcttaaaggagaggttcatgacagtattactaactcaagattctcactccgttttccttaaagtaagttctggttgggtgtggtagcccacacctctaatcccagcactttgggaagctgagggtgggaaaatagttttgggccaggagtttgagaccagcctggtgaacatagcaagactctgtctctacaaaaataaaaacattagtccagtgtagtggtacatgccagtcagtattcatagctactcaggaagctgagggaggaggaagtcttgagcccaagagtttgaggttacagtaagctatgattgcaccagtgcactccggcctaggcgagaaagcaaaactctctttaaataaataaaaaagaataataagaaagaattctgtatatactcagtcatcttagaaacaaatcccttttatgtttacatgtgacatgaaaagctatcgtatgtaccaatttgcgaatgacaaagtggatttctccaattaaacgcatcccaagcttgctagtaaagggcacggaatacctgtctgcctgttttgtataaagagcgactcatagaaaatgtgatctctttttctcctgaatatgaaattgagaactttgaaattataaagcctccctttccccaaagaaatttctgtctgcttccttagaatttagagattgttgagtcctattggtacaagaggattttttgttctttgtttctactttaaatgagaagtgtttaagctttcaaaggcatattcagaacccattgatccactgttgtttataatttacctctggcagaacactatatctttctaattttggttgtcttcctttactgggaagacactatatctttctaattttggttgtctttcctttggttgtcttcctttgccaacaattggctaattgttgagaggaggtgatttcagattggcaactgattgaaatcttcaagaatctaggttaaccttattttgaattgattgaaatcccacaatcaatagtatttggcccaaaactttggaaagatcctgacgtcacatcaaaagccctagttatagttatcaaaggccagagttcaggatttaaaatcaccacgactctgaaattcaaaaattaatcataaacttttatgaaattgtttgttctaaaggaaatacagagtttgtgggaatttataatatctacagcaatttttaaagataataaaaattatttgtatttcttttgtgctttataatgtatgttgtgccttcatgtatattgttttatttaatctctacaaaagtgcagttaggtggatagagtcgttttatacatgacaagccaagtcttagggagctggaaaaaagcctaaagtctagagctaataagttgagggaccaagacttagaacctggatgacttaattttaggctctgtattttttccactatgttggggaatcattttcaggtttaaaaagttaatggaaataagatatttcctagtattgcaagaatcatgaaagattattttttttaactgttaaactgtcctgtaatttacagatgtggtcatcaggcactggttttcattttgcaaatctgatttgcttgtgcctagagtggttaagagcagatcatcagttttatagttcagcagatttataccggaatttgtgatcgctctcatatctaatagtattcacaaggtggcagtatttctgaattcggaagaataaagctgagagatgccaagtttgcagattttcattaaagaaatttaaagagaagattggataaaagatgacgagatcaaggataggtagaaataattatttaatttacatttgataaggttcttattagttaccctcagttttctaacttcattctttaccttcatactaaatcagaaagaggagaattaaaatattatttttgcatcattttttactcaagttctattattattctgatttttcacttctattttcactgcattgtccgcgtgtgtgtgcgcgcacgcgcgcgcatgtgttgtgtgtgtctactttaaaaatcttagtttccctactgtttcctctagagggagcaccatggtccaggaacattcaagaatctaaatgctttctttttatactttactcaaaatttctagagatttctaaagtccattttctcatttgtgagaagaggataatttaagatactgttagaaactcatcatgaaacatctaaaattatgtgaaattgaaatttcagagactcaaattatctttgaacttggtgatactcatctgcttacattccgtgtcattcctaacttcagcttaccttcagacatttcttcccacatgacttcctttttgaaagtatatacaggatcttatagccttgctattctatggcatattctacagcaatggaaatgttttataatctactctgtcccacatagtagccaccaaccacatgtcacaattgagtatttgaaatctggctattgctaccaaggaactgaatttcaatttaatttaattttaatcaatttaaacttaaatagacacatagagcaagtggctgctgtcttggataactcagatgaggcttcaaactgcaaactcttttgtggtttgagactagcatgttcttaagcattctcatgtgcagaagaaaatgggtaatggttctgtctgaaatcttgaatggtattttaaagtgtgtaagtgaatttccaagtacagaattgattcatggataccttttaataataaattattttaagcagcataaatgcttatcattagtcagactatctttctctaaacattctccttattcagttgtattacagtgttctatttatctgtgaatggcagtcccactcaactataaactatctgtatcttaacacccagaacaaatctaggcactcagttggcttctcagtggttttttgtttgaatcccgtgtcctctgatgtatttgcactattttgctttattatttaacttcttacttatgttttttgtctctgcagtagtatcactgcaggagagtgaagagttggtaagaaagtttcatcatttacaatggtgattgacaggcaagaccatataggaataggtaaaccatatttttaatcaaaataaaggaagattttctcggtattagctaggattagattcaactgtgagtgataaaaatcccaaaataattgtggcttaacagagcaacagtttctttttctgtcacgtggaagtgttggtggagtggccctgctgagagcaccatgccgcggggtcagagaccggggctccttcctcttgttcgtccaccttgggtgaccttgacctcatgacgtaaggtagtgccatccaatagtggagagtcagggtaagggaagcatttcaggcaaggggacgcaatggagaggtgagcagaggcaggtgaagctgcacagaaattaagggctaggttgtggatgccttgtaagtcgtggtagagattctcagctttaagtctgagtggagcgatgcaatagaaagttttgtaggcagggtatgagataaggtttcccaggtgcactcattcatcatactgcacccggttcagatgccacttccccttgaagcttctcacaagaggaccacacagtttcagtgtccctcctctgtacacatggccctttgttcatgttactctaatcgtggaataatgcgttgtcacatctctgtcacttcctggaccctgagctcccgggggtggactcatgctgctaatgctcctactaagcctcctccattattctcttctttgttttcctcttacctataatcatcactaacatttttattattgtcatctttgcatctctatctaacctgaccctctagcacccagcacagagaatatagtaaatgtatcctgattaatttagaattagtaagtaatttatcaatatatagtaggtcttttttttttttttaagactaatggaaatgctctcatctgcatagttgctcctttttggatccttcttgatcatcaaaagtgttttttccttctcacctttgacagatccttgagcagagttctctttcagcccctgtgatctggcagtacaaatattcctagtaaattcaatcattcattcgttcattcatgcagcatgaattcatatttcccgagcttatggtatgcacaatactaggaaaagttcaaccatgagcaacattccttacatcttaatggagggaaacagagcttaaacaaatgactacagatttggaaggaagcagtgctgtaaggaaacctgaagtagtgtaaagagagaaagcttagtgggaaaggccctttcttttcatttggtgtcttgttttctactcttgctcatgaaatgttctgagtagcttcaaatatgttttaaattgaattgtgtagagtccagtacctctgagaggtaactgagtgcagctattctagggagatgtgttctttatttgtttgctttgttttatttttaaagaagctgtggaaaaattctttcaagtgtaagtttaaatgactttattactgtttgttcttatttggtcgcctatagtaacatttttaccctgctttaattgaaggctcttgagatctgtcaacagagaaactttgtagaagagacagtttatcttctgagtaagtagcttttattcattttggtccccataaactaagaaatgggatgacaacatgaagtaaattgtgtaagaaaggacataggttttagaccaacgtaacacagaatatgagcctatttttacaataatttaatatatgaaacagacttcacagcacagtaaagaaggaagagttgtttcataaatgttgaaataacatattggcaatgtataatcaacatatcaaaatttatcagtttatacctcacaacatagattaagttgtagatgagttgacaagttttttcattttctaaaaaattataatcagcttatattaccatcatattggtagaaaataaataatcacttttagaaatcacaccctaaataactagaggaaatgcaattgaataccatagttttggagaaggaggagagctttttaatataatctaggtgtcagtgttcctggtcttctggctcctacctccacatgagtcacaatttttgtaccatgcataccaagaaacaaaacttgtcatcttttcacattcttccaaaatgagccacgtgcatgacaacaatgtgggttgtactgaggattgcataatgtagcatataacataacattcatatttggtgtttctccattgtcacttccctgctgacctcagtagggtttttccgctttacgcctttcccttatacagcactcactctcattggcctctttgcctctgttgaaaaataatccaaatcctctattcccttttatgtgtatgcagattcatgggtgctcagccacaaacccagaactgtccagttatagcacctgcccttcttaggagaagtgcttttggggctgcattttgttacttcagcatgttcctggggttctaatcacaattttaggtagctcatcaattcactaattccaaacagtgttctccccaagaaatattttggtggaataaatttttgtcatattgtcttagaagcagtagaggacttattagggacatatagtctgattttataaaaacttgataatcctgtaaacatttttaaataactaaccatttttagagacataaactgtggaaataatatttgtaagaaacacaaaatgctgtggaaggggtatcaaatgggatatcatttcattcacaagccagcttttatcagttgataatggccgtgtgcagggggaaggattcaagatcctttactagttcctgcaagcccagagacaggggtaagggtgacaacctacaaccaggcagttgttgtccctccactgagtaaggctttcttacatgcactatattaaaaactcatggaaaactttaaactattaaaatgccataggtcagtgagcaaagtatgtaaagacaattagccaatagaaggcatggttgataaatactttcatctcatgagggttattgaaaggccttcccctgaacgtgggagagaagaaaatgaggaagccctctgatagttgagtttgcagttggcacaaagtgtatcagaaaagcagtatgcacagctacctcatgaggcagaatgactttagggcctttaaacattttaagtgtatctgcatgtgaaggtattgacctccagaatatatataagtctatcaaaagtaagtcagagtatgacagacctggcttcaaattcacagtgtactatttagtagctgtatgatcttagcaagctactaacatttctatttcctcttctataaaagaggaatattagtagaacatgcctcatagggttgtagtgatggttatatgatgtcatttatatgaggcacttaaatgagtactcagtacagagtaaatatccagtaaataggagatacttattttgctatgttatagacagtaaatgttggtgtcacatgagaaaatagccttgtcttagctttccacctatgtaaacaaattaagagatatgcaatttctttaaaaaaattattaaaataccttaaatgaactctttctcccatcttcaccccaccaaggccgaatgggtaatagccgaagtgccctgaagatgattatggaggaattacatgatgttgataaagcaatcgaatttgccaaggagcaagatgatggagagctgtgggaagatttgattttatattccattgacaaaccacgtaagcataaaagccatctctggttataacttttttttctctcagtgtaatcagttatgtctagattaaaaactatttcaagatacattgggttaaaaaaatggcagcgtacctacaataaaaataggccaggtgtgttgtaatgatttccaatactcctcctgtgctggaaaacctggagcctcatcactttgcattacctgcatgtgatgaagaacaggtggctacacagtttattaattgtgtccccatgaggcatatttttacctgctgcaagcaaattgaataaatgtcatctgggttgtgttggtgtgtttttttttgtttttagcttgtatatgggagtgtttatagtttaagtgtatagaccttaccagtcttttttggaaacatgtaactgttctggacattgatgatatttggatgtttgtgttgtagtatttagcctctttcctgcactatttttatcagtacaacacccagagtttgtatttgttggtcctcagcttgactgtttgcattgggtctcccattttggaaaggaaaaaacaaaagcagtcacctaacagaaacccaactcttttgaaaataactagcagtagtgatttgaaatttcctctttccttttttttttttttaagtttggtaggaagtctttgtgttcatgtaactaccttaatctgaaattgactttaataactatcctcttgacaatataaagaatctcacttgtaactagcaagataaagtagtagtttaaggatctcaagaggcaaagtgatgtggcagaacatatcataaacttgaggctggcctgagtgaatttgggcacattacttattagccgtgtgaccctggaaaaattaaacaccccatttcccttgtctgtaaaatggggacacagcattcctaccttgcacagtatttgaggaaagtgtatatgatacctgagccatagtcagttgtcaataaatattatttacacccatttgatgctaaaaactgtattttgaaggcaagtaatcatttgttcaactgttttaaaacagttcttatttactttctccttcatgtcttaaggagcgttagttcttggaagtttagaagattaattcttaagagtttagaaattcaaatggttttaacacttactttgaaggaaataattttttctttgagttacttttgatctaaaattgcattatatgcaaattatgtgcaaataaaattgcattataatgttgcttatatgttcattgttttatgtggtattttgtagcatttattactggcttgttaaacaacattggcacacatgttgacccaattctactgattcaccgtattaaggaaggaatggagatccccaatttgagagattccttggttaaaattctgcaagactacaatttgcaagtaagtatcctttcttggacaaatgagcatctgaattagttgacttagtactggataaatatttctagggtttatgttaggtatcagttaaaaactttcgattttatggttacattttatttaggcccagatatttagaaaactgttcaaatagagtaattagaaacatcacctttaaaattgcgttgtccagtaataccttaaaggccttaagaaggctatttgattctttagccatctccaattttcacttgtttttgagcagacattcttacatttgtatggttaatataacatggaatcgaggcgagtatgaaagcagttatagtggccattagatcgggccaccccaacatttttagggagaataagtattgtatccgtttgagggaattaacaaaaatgtttttcagtaaggtaataatttttcttgaagccattcagtagtctgttgcctgaaagctgttaaaatataggattttatttaaccttttgtctgttttctagaatagtgcaactttattatccttgttaaatcagaatttgtcataagaacagtggaactcattattttcatataaattattatactaattacaaagcatcttaatcttttccttaaaaagactctagcaattactatttttcaggatgctggtaacttctatagaacttgaattaaaacatttccttaaaaattcggactgttgttcttcctctaatttacttgaaaatgaggttttattaataatggatgaaattactttcctagaaacaatttttgcaggtaaagccaaaagaaaaggctattagctgaggagcattatgatgtgagatccattgggccaggattcaccatgcaggttgcaaagtagaggtctgcctgcactcagggtgacagccttaggtaagaggcagggtggaaaggagaagatattgcaggaacattggtggcatcaaaaacagatgtaagagatgaaagggatggcagagctgcagggacaagaggttgtgccagagagtgtgatgtcattaatgtttctgaagcggagtcatggtgtatacgtgttcaaaaagtgggatgatggtaaaggtcatttgtgtagaattagtagagaaactgaggccacagcctttctgagtcatcctaatggacatgaaggccaggaggaagaaacaaggtgctctaagccaggctccagcttctccacaggggacagtagtattaactggacaacacgactttaaaagtgaagaagtctaaagatgggggtgggggtgtgagagatcatgcagccttcactccggagagctttgtgggaaattgggttcatgggagagaaattggtattcgttaagccaaagaagtagattacctgttccgcaaaaagcttaacgatatataggcatatatttccagtgggatttggaggtttgcagatgacccaggagaaaggttattggaaggagaatgagaaagtcaagaaggaaataaaaatatgggaatgggttaataggcaaagagaggtgaggtgaggagctggcttttcatgccacgccctaggaatccagaaaggtgacgtccctgcctggggaagtcactaattttgaaggtcagattgggctttggtgaaagtgttttcagtatcagaacttataagcctctgagtgtgagtgagcttgataatgacctttacttcattgacccttaccaaccccaggcatgccaggatatgctctaggtttcaaatccacatttgatgagaagtcatttaggtgtctctgaacaaccctcccccaagggaagtagtaaataattatccctctgcctttcagctgtagtgcaagaagcttgcactaggttaaaagttgtgcctttctttttcgccagcctccgcaatgactgcaaaaccacatagtgcatccctatgactaggtcattcttccagagaaccaagctcatgggcaccactgtgatctcagtgttcattcatttttaataaataaatttgcatcattctgagtcagctggtaataaaaatgaaattattattagatgcaaaatgaatgcctaacataaaaatatctactaaagaagctactaaatattttttcttaattagagcttttccttaagatatgtaagtatgtagttcggtaatgtgttaaggaggttcagaattatttagctagtgggtccaaaaagctgtggttgcctgtgaatcccccaaccaaggggtggcttctcagagggtgagggagagatgaacagggaaggcagcagagcctgtggaagctgctgcatctggagtccccactggagctcaggcatcttgttggagaatgcagtcagaaaatgctctccgggggcaggtggttcaaagaattccaggcattatttttccctcacagataaagagtttaaaatatttttctgctctttttacataatgtattaatgaccgcttaatgtgtttcctttctctaggcaacctattagggttcactgtaaaaataaatctatccagagagcattttgcaatttccagaaggatttcacttgcatgtttttattttattctttttttattttgtattttataaaactatgttgtttttcacatactctcacctagcaaagtaaaaaattagcaaccctattcaatctgaaaatttgggagaaattttgcatgttcatcaatttccaggaatctggaagtgactgtgtgtgtgatggggctgggtgggacagtaaccccaggggctatcaagaaccattcagtaatgtagggatctatggtcagatgttggggaaatgttctcacagggcttctcagcaccttttcttgctggtatgcattgggaatctctaaagggagattgacaatagagtatacagcatttaaaacttgggcactgctttgggagatcattcattagccagttgttaattggaaaagcgggttagagaatgttgtgggaaaaacttgaaatgagtaactcttctgcttttagtttcacgttttctaaaatgtaacagctctcttcaaccgaaggttagcatcattaggtttgttagatgcctatgacatgacatagtttaaggaagtagtataatcaactacatcagcagtgtttaatttctttaactttctatgtttttatacccggctgccttgttagtgtaatcactgcacaaattttaaaagcttcatgaagtcagtaagatgcaagtggcatgtattgcacttcataagctttaaatgttcctaggcctgatttcaaggacaaatagcacttattttgatataacttccaaaacaatatggtatcaattatacttcagtttttatgtaaactgaccagtttccagtttatgctacaaatttctaatgtttttacattttctatttttaaaacattataaatttagcatgtagttgttgagcgtttatgtccatttttgtagttggaggcttttttcccttgagaatttcagcatctttgttcttaaagacttcttttgacggttttatttgacaaacatttaatcttcacaacacttctgtaggaaatatcatctttgttttacagatgagaaggttgtctctcagaaaagttaagtgatttgccagtctgggaaggtgatgaactgggtttgaacacagatcacagatcctctgactaaatctcatgccttttttaaatcagtgactacattaccttttacagccacaagtaatctctaaaaaatctgctaattagagtggggtcttagtttttttcattatgggtaacacctcttgggaaaagaaaatagcaagcatgtttaacttgcttctaaagaggtgtcatggtgcagtggaaatctcaccaggctaagcctcatgagtccctggtgtgagtctaacccttaaggaaagttgtagatgatcctgaagaagtcattgcacatccttggacctctgttttccccagaaaaataaaagggagcaggggctagattaaacgtccatcttagatgctttaggggctgcagacattcttaaggctaactggatctaaggcattgggtacaaagctgaattgcctttaggccaacacctgcctagttaggtttctctacatttctctctggagcaggatgttcagctttgggcactggtttgggtcacaggattacaaaactttcaaagatcactacagaaacttagcctttacaagatggacacaacactcaggagtttccactgtgatggaaactcctctggacttgtgttattgtggtgatcgacccccatatttgtatccttttacacttggcagaatcatgccacgtggttctcccagcaggccctcgcccctgctttgcagatgagaaagttgaagctagaagatgttgcatgatttgcccatgtcatgcagtagagccaggattccaagcctgtgcacttggtgctgctctgcctcctacaatttggcagttttaagttttcttttcatgggtaatgcttgccattactcttgcttttgatttatgttttattttgtctgtatctatgaccaagactagggttatgaagttttgtttttattttttatttttatttttttgagacggagtcttgctctgtcgccaggctggagtgcagtggcgtgatctcagctcactgcaaactccacctctctagttcaaacaattctcctgcatcagcctcctgagtagctgggattacagacacgtgccaccatacccagctaatttttgtatttttagtagagacagtttatccatgttggccaggatagtcttcatctcctgacctcatgatccgcctgcctcggcctcccaaagtgctggcatggcaggtgtgagccaccgcgcctggcctgtttttattttagttttttaaagatagataattctctccccagctaccaatctaagggaggcattgcccaacttccttttccaccaactttcaaaagtggtgcgaatgtggaatctctgcatattgaaaataaggtcaactcacctgatgagggagggaaaatccaccctgtactgttctttttcttgagatagaagctttgtagatgagatttgccactccctataattaggtttaactatttgtgaatgcttttgtttttaatccatgtataagacaaatatgtgccaaaactttttggtgctcatgctttcagttttacaattatgattctcatcctcctttctattctagcagtgtctgtgaagtgccttgaggtacttcatttatgttatctctggataaaaagggactatctacatagtgctgttgtgtggtcttccacatcatatcctgtgtatctctcactgctgggcccatttggtctctggagatgcattcattgtactggcagtttatgccagagtcacatacagaattggcatggaagacaaataggcaactgttgtcttttaaagagcggtggacatggtatttgcagacgtgggctcctgttctggctttgccattaacaagcctattgagactttggtaaggcacttcagctttctggagcttggcttcccagttagattaagccagtgtttgtgaagtctggctgcacaccagtatcatctggattcttgtatacgttacatagtttcaggcaaccagcccagatctgctgaatgagactctcttgggaaggactagggggcatgtccttaaaccaccttgatatttcttacacacctagtctggcactagtctatgtattgaaatttgagaaccttgagattagatgatctctaaaatatcttttgtttctaaagttcttaacagaggcgttttataaatatctctttacatattgaatacagctgcatatttaatgttaacttaatattttaatgtaagccttaatatttattttgggatctaataaagcagcttagatttttaggtataattggggtttatttttcacggttttttcttttgcctcaaaaatgacatttatttaaagaaaaaaaatgacaaattgtccatcccttgactcccttccctcccctgccctgttcctcccaactgccccttggattgaaccctggccggggctaggtagcaggacagcccttctcagatgaagtcagcaacactgatgggtgtcttcttaacagaggggctgtcagaggccttaatgtctcatggaatagttgttttcaaagtgccatatacttgatgacttataaacacatttattcagatatatgagtacctcctgtgtcagacagtatgttctgtgctaacagggcctccatttggtctcatagacctggggatgagcgagacacagccctttgttcatgctgctcatgatctaaattgatgtttctgggagaagtaaaatgccttaacacttccattttgttaaactacgcacaccatacacacagacacacacacatacacatatacacatgtacacacacagagacacacacatgtacacacacatacctcatccaaactgataaactgatttcagacatctccatgccttccaaagttattttcccaaatttgcatttgctgcagtccccatagtcctttatttcccatatctctattttgcaatccaaatgggataagaggaaataatggcttctttcttactaacctttttttgggcctacgtgggtttctttttgactctcagtatataagctcctaattttcttctaagagagagtttttgaatttatatgttcatgaaataaacttttaagaccaaatgagatttgttgttttccttttgaaattatttcagttttgccttatcacagcttttaggtgacataggtggcctgtgacaaccagctgtagcttttaaaattaatttggtacatccatactttgtgctattagaaatttaaatacaattgtgtttataagattgtttctgaactccaacataagaccttaggatctctttcccttcgtatttctctgcagttcatcatttttataagaatcccagccgaaagcaaagctttttcaagaagaattcaagtcccatagcattgtgacctaaaggaaggattagaaatgaggggaaaagtttctcagtctaccctgtgtcatattgggggcttttaaaaccaggtagctgtctgtcatttgcagttctaatgataagcattgcagtatgaacaaggcaatgtcagcaaaatgtttagtgttcgaagaatcttttaaaataaaaatttcagaaacttggcaacttttgatggcatttttcccatggccgctgtttctaatgaaccataataactttgctgatatacagttcttttattgctttataaaatctctatgggtctggtgttttgcttttggttgggattattatcaatgatgatgaactgcagagaaataaggagaaagggggaagataaggcaaatctaagttctcatgttgattttcaacagtcgtgttgtaaattcattcttatttaaatttacagtagcacaaaatataatatgtaacaggttgtttatagaagccatagctggttgacttcaaaatgacgaaaagggaagagtaaaggtcacgttgataaaatatgtaatttagaaaaacttagaactatggaaggaaacaaagtaatatcaagaaaacaagaatcctggagtaggatgtaagaagaaattgacccctagatttgaataatcttggaaaaatataggaaagtcctgtaaggaaaataaatctctgaaagataatattgtactttctaagctatgcctacaagtattttttgagatgaaaattaataccattatgaagttgaggaaagaaaagactggtttatcctcagtgaaattctttttgttttgttttgagacagggccttactttgttgcccaggctggagcatggcagtggtgcagtcacagctcactgtagccttgacctcccgggctcaagtgatcctttcacttcaacctctggagtagttggaactacaggcatgcgccactatgcctggctaattttttttattttaattctttgttgagacagggtctcactatgttgcccaggctgggcttgaactcctgggctcaagagatcctcctatcacagcctctcaaagtgctgggattataagtgtgagctaccacaaccatccgattgtcagtgatactctaataagagacataggttacaaagcaaaggttaataatggtgctgtttaatttaccaagtagagatatttcatagagatgtttcaaactagttttaagttctgaaagtgatatcagaggctgtccaacacagagaataagaaaccagggtaaaacaggaggaaacaggtgagaaagtttttagtgggttaaaaatgattgatctttgaaaggccagttagacatactttggaaaacaaaaactacttttggtgtgaaggaggacataatcttcaaaactgcatgcttataagcttctgtagtctataaaccttcaggaaacatcacaaaatgtatttgcaaattccataaagtttaagaaaaaggcacggggaaacaaccagcataaccgtaaaaaacaaagtccttgcagactaagttttcaacacctgaaataaacaaagaatacgagtttatatcaatatcttcgaaaactcagaagaactgtacaattttctaggaaaataataagttgtaaaagtttactcaagcaaatagaatagacctataatcattaactaaattacattggtagtcaaaatgtatagctacaataaaggcacttattccatagacagttttagagacaagttttatccttttaaaaaatagctggctggatacggtggttcatgcctgtaatctcgtcactttgggaggctgaggtgaacggatggcttgagctcagcagtttgagataagcctgagcaacatggtgaaaacctgtctgtactaaaaatacataaattagctgggcgtgatggctcatgcctgtggtcccagctacatgggaggctgaggcaggaggatcacttaagtgcaggaggtcaaggctgcagtgagttctgatcatgctactgtacttcagcctgggtggcagagcaagaccttgtcaaaaaaaattaattaaaaataataaaactaaataaaaagcagcttctgtgttacatttacttttccagataattgaatggaaaagttcctcagttccttatggaatgctagtgtaaccctaataccagcattacgtgagggcagtatgagaaaattatagccctatcttttttttaaaaacacaaatgcaaaaataatacataaatcaatagcaaattgaacttgaccatttatttaattgttaaaagtacatccatatcataaatgttattagttctccctaaaataatcatctgtatgttcaataaaattttaatcaaaatatccaaagaatttttcatggaaattaataaactggtcctaactcttaacataaaaattaagagtaagattattattcaagagggaagatatttttattagatatccaacttaatatgtgggagtataaaatgctatataaccactttggaaaactgtttgtcatttacttgaaaaattaaacatacacctactccatgacccaggaatttcactcctaggtatttactcaagagatgaaaatcagttccataaaaagatctgtacaagaatgtcctttggatttccttagtagccctaaactggacataacctcagcatgcattaacaggagagtgtacctcagggttgttgcctcttggtgacaaagtagatgccgtatcactaggctttacatccacacttcatatggcacatgcaggaagcaaggggttttttcctaatgaggctttgctttttgatttgaaagggctgctttcccaggcttgatgtttatcttgttgaccagatctatgttacatgagccccagccagctgtatatttcagctggacacacactaaatgaagttggagttgtgtttgaaaagaaggagcaggaatggtagagggcaagaaggtgtcagctgtgtctgtaatactttattttctggaatgagatctgaagcacgtgggaaaatattaacagatttgttaaatctaggtggtagggactgggtctttttttgttttcagttttttttaatatttcatattttaaaaagaaaaatagcacaaagtaatgaaagatagtgctcagatcaagagcagcagtgctcagtgccattctggtcatcgaaacctgagtaacagaagagtgtgcatgtgccctaagtatgtaaagaacatcacatttgcaagttagaagggagatggggaaggtgatgatagtctgtggttgcgaagataggctgggtaagatgaccttgaaacatagcagtcatccaaaatcatgagtgtgaaggtcaaaaagaggtgaggatgacctgcttacgccaactgctgtggcatctgacttttggccatcagtgtctttataaaaaagacactcatgggaaattccaagtatgaatttttgagggtgaaatgaatgtgaacaacagcacatttttcatgagtcactgatggagttgctactaggaatccatagtcaacataatgccttgtcctatgtctgatgttgaaagcaatacctgtagattgtagtacattataatcttgtactgtcttccttcacttatcacctttaattgcctacacattattacagatgttatagaataaatgattacattctatagaggatagtctcatattttgaaatacctgcctgggatcatataaatgaaacttaaaatgttttcctgtttttctgattgggagccttgaattttgaccaaatgaagtaggagatagcagtaagctgtatttgtgtactttcccctctcctggctgtttgcctctgaataatgaattttcctagaaaatgctatctgcaggcggacagattgtacctgtttagaaaaatgtaatcctgctgaggatatggctccttcctggtttgcatattttgctgttttcttttttagcttgtagacacagtggcctctgtctagactgctggccctgcctttctcttatataattcatgccatgggcctggagcacccacgagagtcagagccattttttaaaattgttttatctgagatgttgtggttgaaaccattactcttaagttttttatttttgtcttggaggctaagcagctttatatgtttgcttttaaatttatttaaagtttcctgacatccatatttcttagctatctttcttactgtatttgttatttttctcttctacctgtatgttttaatgcagtctgttaaaattttaatgtatttttttaaaaatccaaaaaaaattgattcctggtagaattttaaagaataaaacttcataggcagtttctcaattaatgtaggaatactaaaatcatgtaatttcctgttcatcaatactagaaatggcaggcatagaactttaatctagacattagttttgttttcctgaatattaatttgtctttgtataattaggggaaaaaggctttcggctggattcacccaaagccagtgctctttgggattttcagaggaacacgtggaccactgaggatagagggctgcagttggctgctcccttacttttcttccccagtggcatgaatttaaaacttatgaaagcaaaatgcccatctagcttgtcaagtcgagagtgacttcagtatgaagaaagccaaagtgccccctctaaacagtggcacttgcccgtgaaagacacatgcttctcagcctcagagctgggctgtggtgagacagcgctgtctgttaatgtgaacttctatgatgtgacatgtgtaactgcacataactgcgtatgataagacacatagggcccaaagggagaagccacaggcacagccccagagcgtctctgtccttcaggccttgagtttctccctctgaaaaagcagcaacaagttctggttaaaaaaaaataataataataaatgaaatgacatctggcttatgcacacctcctggagcctctcagtttcctactaatacctaagaaaacccagcaaagggtgggagctcacactgtgccccacagaatggacatgaaaggtaaagtgtcgcctgtccctgctgtgtccccacctaaaagcaggggaggatcttggaccccatcgtgcctccagttctgaaatacaacattggtaccagccagaaatgggcatcatcctccactgtgtgcttctgacttctgaggctgccaaagcattgtgatgtctcttgtcattctccaggcaggaagggaggaaatagtaaaaagcctgcaggggaataagaaaaatgtgtaaagaaacaaaagctataatgctgggatgaagaataaagaaaaggactcttatgagagaatatttgtattcatggtcatttttcaaacccctcccaggagtcaccaaatttgaaggttattatagtcagttaataccacacacacacacacacaccacattcatagcactatgctgaatggtttggattagatttggaaagaaaaagataggttgcatcctcaaggggatttaagacagagattgtatctgtttagtttattatctatacccagtaccctatacgtgatagggacccagtacttatttgtgcagtaaatagattaatttatgaaataaattgatgattttggaatagcaggttttcattctgggtaaagatctgaagaatggaatgaacacatgatgtaggagccaaagtctgcccaagaggatctgtataaggaagccctctaaagtagcaatagggttagttaatatagggccttctttgccagactttggaatttatgtttgattatacaaatgctacaggagcccgtgtatggttggaagaaatgatgaaatgacgcacagagtaatgagtggatcctggctggccaggtcagcctggcagtggtttggcaggaagagggtactgagggcaagagaatcagtgagtgccccttttgagtatttcaagcatgccagcttttggaatccccagtacagtgtcccttcacccctcagatttgagtctacttaagatggcttttcttttaaaatgtatgcattagattctgcttcgtgaaggctgcaagaagattctcgtagctgactctttgtccttactgaagaaaatgcaccgaactcaaatgaaaggtgttcttgttgatggtgggtaaaattgaaataatcatatggaaccacgtgccctgctttcagaaatggccaagcaggtataaacagggcataatccaaagtatgtgtgttttcttacagaggagaacatctgtgagtcgtgcctttcccctattcttccatcaggtaagaaggttttccccaaaaaaatcccaaacatgtattttaatgatgagtggaatcaaaattttggaattagccaactaccgtttataaaactatataactttcagaataacccagtggagagaagtgttgtggcttccatcctgctcagtggaatgctggtgctgccattgcttagagctgaggttctcaagctctagggtgagtcatcgtcacctggcaggcttattggaacccagatcgctgacccagtcagactccctagagtctctggttccaaacttccagggcaggaactgagaatgtatatttctaacaagttcccaggtaatgttgatgccactggttcaggggcccttcttttagaactgctagtctagggtaaaaacaaaatgaaaactaaccatcagcatttaaatttcaaggtagaagaaccatatacatgtctgggaaaaaaaatttataggtagcattcccttttctttagtgtttttctctgatatatggttctacatgcccaagtcatctcacatttcagtggaaacatacataatccctgccatctaattggaactgtgagtctttaaaagacataagcatttgtttatttctagttcttggcagatagatatatgtcttcatctgtaatgaaaagcaccttcttaaggtttattatgacagaagaaatttgcataattcaaaagcggaaactaacaaagcattgttaggatgctaacaaatgcttttcaaatataagttcagcataacaaagtactaaaagacctagttgacctcatgtttacttaggattaaaggattatttcatggggcagtccatgagaagttgttctacttaggttcttttctagaggaattagatttggatgtttaagtgcttctgttgaaaactgcatgggctcaggtgaagaagtgagcttccatagcatttcagacagtgttgcagcaaaaaggaaccacatacattcccactctacagttagatttaactccaaatttactctgctgatgacactaaatcttaccaaaaataagctggccacacagagcaggaacagatgaggggatctgcccaagcacaagtgcagtaaaatgcaaggtcaccacagcctgggcttgtaacccaggtccgcctctgagtcagtgtgtggtcttggcaaaggtagcaggtggactggcaaagcatttttatgaagccacagactcaacttcagctgtggtgtataatgattataggggttaggggcgcattggcacatacacttgctggttttcctacagttgtcctcaatgtagtctgggtaagtgacacagaggctaagcaagtaacctgtgaatcgcatagcaacatgattataatacctgttttgtgtctgatcataccacccctcaggaatgcttttgtaaataagccattctctaaaggcaccttattgctgaaaattaaactgcaactcgactttcagtcgggattggtttaaaatgatcttgcttgttgcattaagttctcctcctttctctgccctcctcgccagatgcagctaagcccttcagcgtggtggtcttccattgccggcacatgttccacaaggagtgcctgcccatgcccagcatggtgagttggcagcttggcacctatcaactagagggaaattaacacacttagaggaatgtgctttaaactgtaacccttcatccttatggctgtatgggttaaaaaaaaattacaatgtggatttatatcacataacaaaaattaatctagttttcaaatgtaaaaatatttagaaatgttctatgtactatagtaaacataaaagcatacccatttgaaggaattcattcaggcccagttgacagctgtcatgctgtagagatgagcaacaacagtagagagccattgtgtatcttatgtgtttctcagcctgatttgtgttccatgatgctatcatttttttagtgtcatattcctccaggtcacattagacgtattctgctgttgggtgtccttggagtcacagagtaacagctgatctagactaaatcctatgttaaccagaaataaactccagagaaaggagtgccatcctattacttcctctccaccccctgactaacgctaccttagtgtttctgaatatgagagtagaaaaagaagatcattttttaaatatgtgtttttaaattgcatttttagaactctgctgcacagttctgcaacatctgcagtgctaagaaccgtggaccaggaagtgcaattttggagatgaaaaaatagctcatttctccttgtcagtctccttgtcaccactctttttgagactgtttttgcaacaacaaaagcatttgttgacactcgtgctgttaagagatttgtttatgtttatattatactcaaaaacaatttcttcatctattcctgtactaatggtttctctttgcagttcacagagaatttggggctctcttcatgccttgaaattttggggtccatagtgaatattttgttatttatttgtttggctcattctttatatagtaatggaaacataagtctaggagttagaaatgaattttttagaccttagtaaaaccatttaaccataaaatggacaactgagaattctcccagctgcctgaaagcgtcaccaactgtggttatcctgcaagctgctacctgcaacttggacgttgtttccacgtgctctgctggctacgattcttgcattctgggtttggcttttttctgtgtcatcaactatggttatcctctaaataggcatttaatgaaacattgtacaaattgtcactcatttgatgacacctgggaataacattagcaggctgatgtcctgcaccattatgtttactaatcacatgttctgtgtgctgtgacgactgtcaaagagtatctggccatggcggacactcagcatttgttgattgaataaatgttagctcttctcattgtgaaggactcacttttactgggataaacaaatgcagttaagaattctggcacccttgtaaggaagaaaagagagttcaacaccttcgagtctgagcgcttgtggctagagtttgccaggagggaggaaaccagtgaccctgaaaactgagggtgcctcaggagcagtgggaccacctgatgctgaaggacggactaatgatgtttcctcttgccttctctggtgcctccattgccctcatggaacagagcatatcatagagggagaaaagtcaaacttgtaattgtgtcttacagttactggcttcatcttccttgggatatatggtcatcctctaatgagtgtaaaagtgcgcaaaacacatccttattgttcctgatctcttagtcccataaatgggaacaaatacagctttctgcttctttctttttggggaaaggacagggtgctagtgagtactgacagcatgccagctaccgaagtcacccagccattcccatgagcagcagttcatttaattgtcacagcgtcgccaggaagaagatctgataaacctaggtttacagataaagaaagcaaaatgtagagatgttgttgaggtcacagaggtgactgcctaacttcagagcagggcttctgatccctttaagaaattacagggccagccgggcatggtggctcacgcccgtaatcccagggctttgggaggccttggcaggtggatcacctgagatcgcacgttcgagaccagcctgaccaacatggagaaaccccatctctactaaaaacacaaattagccaggcgtggtggtacatgcctgtaatcccagctactcaggaggctgaggcaggagaatcacttgaccccaggagacgtaggttgtggtgagctgagatcgcgccattgcactccagcctgggcaacaagagcaaaactccgtctcaaaaaagaaaagaaaagaaaagaaatcatagggccaagttcaaaggaaatgcacagaacatatcttcacattagagttaagaattctctagcaaacaacagatttttttgttgttgttagtcacaaatacttagaactggaaggctctttgttattattgaatgtacccctcagccttctcagcatttccttatcccaagactagtgtgctttctgctacactgctagttttcagttttgttcttacccaattgttttttcttttcaacattaccaatttacagattcagtttattacatttacattaatcctcacttatgatttgagcaagctcatttccagaaaagtttactttaagatcatcaataggatttgctaatttcagtgaagtcattttgcttcaggggtaaattatcctagttaccaagtcctatttggacataaagaaaatcctacttatagaaaaggagaaaataattaaacagtcttcatttttaagtaactgatttaaaaggaaaataataaaatatgttcgtttatcatttcagaaattgctgtaacacactggaaaattcctgaacaatatagattttatcgttaataaaaaacactagctttcgttccttagaatgtcttttcttttgaataaacagtattgggtgatttattaaaggatattcaatcctttttacttttcatcaacctataagggcttaaatatggcaaaataatccaagtgttagtcaattatttttcatgtgtgactagcccaatttaaaatataggtaaaaaggaaacccattcccctcgttttggggaagaacatagttgcaaagtacacacttcataagctattctttttttttttttttttttttttttttttgagatggagtctcgttctgttgccttggctggagtgcagtgacatgatcttggctcactgcaacctccgcctcccaggttcaagtgattctcccgtctcagcttccggagtaggtgggagtacaggcacgcaccaccatgcccagctaattttttgtacttttggtagagatgaggtttcaccatgttgcccaagctggtctcgaactcctgagctcaggaatccgcccacctcggccttccgaagtgttaggattacaggcgtgagtcaccatgcccagccaagaaagctattcttgaagtgtaaaacagccaggtgcaaaattattttggagtactttagtttgcttttgtttttagccaaagggatttcatactggtttaattatgttcatccttgagaatttttgagaagtttccaacagatttgtagttcattttgctgttgttacaatgtaaagctatatatagttgacccttgaacaacacaggttggaactgcaaggatccacttatacatggattttcttctgcctctgccacccttgagacggcaagaccaggccctccccttcctcctccttctcagcctactcagtatgaagacgacagagatgaaacacttatgatgatccacttctacttaatgagtagtaaatatattttcttttccttatgattttcttactattttctttagcttgctttattataagaatatagcatataatataaataaaatataaaatatgtgttaatggtctatttatgtcaccagtaaggcttccagtccacagtagtctattagtagttaggttttgggggaattatacgtggatttttgactgcatggggtgtcagcacctcatcccccacattgttcaaggttctactgtattttaatattaaaaaccaaacatgcattgagtaattactatgtgttaggaattattagaagcactttgcttatactatttaattatattaatgtatccctatgaaattggtgttattaccatcatcgtcattttatggatgaagaaactgaagcacgtaaaggttaagtaacttgtccagggtcaggtagctgatagtggaacacctagctgaaattcaaacccatgcagttgccttcagagtgcctgatcttaactggtgcatatttgatttttttgttgttaaaacatacttatttgagctgttttggtcagtggatagaaagcaaaatccactcttagaatagaaagggatttattacaaagtgttaaatggcttacaaaatcattgatgggaatcaaagaaacaataagggagctttcaggcaattcacaaagccaccccacagaactgggctgcccagggaatcactgccccaccaccatcagatcatgggctgcacatagcagtgtcagttgtcacttttaagtaaacattggtaaataaaagtgtacacgttactcagtttctcctaaagccctttctcagtaacattaaatcgtgtgtatacatatgtgtgtgggagacatttctatgtgctaaatactacatcggttcattctggtttctattatcaggacacaggctactaaaaccaccaattttggtactaaactgtaacccattcctggcgctcttagctaaatgctgatttatgaaatctggaatgaagttccttcttttctcatgcagcacaggttttggagtcattaggatcaatgcaacattcatagtaaagataagacaggagcgagaatgagaaactcagcctgcaaaagcaggtctccaga

SEQ ID NO: 17296 - DNA, 251672 bp, Human
  misc_feature (1)...(251672): n = A,T,C or G
ctcagtataaccattacagccccaaaggcccctgtttgagggaggtgactcaaattcctggtttctgagcatagcctttttcattgaatgttgaccaagtggtggatttttttttatctctctgaaataaacctctgtttacttggagtgttataagtaggactcatccaaatttgctcagaactttcccactgttagcactaagagtcctgtgtcctggaaattccttaattcctaaggaaactggggcagatatttatcctagggaaataagagccaagcacatagaccaggtgttccaggtacctactgttttataataaagcattataaaagtgatcgactcataaaaactgttttgtttgctcacattctgcactctggctgggattagctgagtggttcttctgctggtcttgctgatggttgcttgtgtggctgcagccagccagtgaactgattggagaatgggctcagctgggacatcttggctgctctctctctctctctctctctctgcgtaatctcagggcctctccctttctgtatggcctctccttgttattttattttattttatttttgcagcagggtagctgaattagctgaatttcctatatggtgtcacaggaatccccagagggcaaaacttgcctggtttctaggttgggtgggtgggggggggactggaattaccatggcgtcactttcaccacatcttattgattaaagctggccatagcatcattctagaatcaaggtgaggggactacagggtgacacaagagtgaacaccaggtggcagctcgctgaggtctaccaatgtaacagtttcccccagaggtacagtaggatgctcacctggactcataggattcactgtgagtgaccacttctgacctctgtttgcagggcaccacctgacttcttctcctcacactctcagtgagaatggaatatgaatagtttgaccactggtcagagccaacaagagctctaggtgtagggcaggtttatccctattattcgtacttctcccaagcattaataagaataatagggatggtgagtccctgttaaggttgccaaaaggtttccaaggaagcaacaagttaggggggactgggtcttccatggttgatgcgaagctataagggacttgactgttccatgcaccatttcttgaagagtagtctattctaaggtttctgcccagcacaggaattttggagatgaccaaaacacatcgcctgtcttccggaagctgacctttctcaacgcggacctccccgccctgctaactcttgttttaaagtttaaacaagtgtcagcgatggtctctccccgctttgctctccacacgcctctctcctgcagctctgacttcgttggtttcccagccagggcccctcactgggctgtgagcctcctgagggtagggcgacctccataccttcttctgcaacacccagggtgtatggaggggcctctgttagctggaaacttttgggagcagcaagggaccagccccatcagctccacttcagagcagttccaatccagctggcttccacatccctagggttcttcccttttttgtctcccctatttctttttttgctggaaagaatcaggtcccctcactctccccaaatacaaactgcattaaaagaacccccgagctgcccctgggcccagggacttctgctaggcttggttccctttctcctctcgaaactcttctatcatcgaggagacaatctggcttctggcttttccctctctttttcttggcctctttctctttcttcccccgccccttctccccatgtcacagccagtcccgacgcatcccgcccccgctctgtcgctttaagctggtcccgccgccgcgccccgccctcacccctccgcgctccgcggctccccgccgcttctcccgctcctcccttgctcggccctctcctcctcctcccgctcctcctcccgctcctccgcgccgccgccagccccgctgcgcgctctgctcttcgcagctccccggacccgcagccatggccgacatcaagacgggcatcttcgccaagaacgtccagaagcgactcaaccgcgcgcaggaaaaggtcagcggcgggcggccggggctggggccggggacgccaggcgggggcttggccggagggcaccggctgcagctgtgcggggcccgagcctcggggtgcggcgcgctgcggagcggggccggggccagggacgctgggacgccctgccctcagctcggtgactgccgcaaggcgcgacccgggcgccgcggggagcgggtcgggaggacgcagcgccggggacccgcagaccctggccccggagacgccggatatgtccagctccggagccggccccgggttgccgctctcctggccccaagccaggcaacagaagtaggaggtgcggcagcttgcccgctgcgcccggagcagagcgcatctccctgcgctcgcatctccccgggccggctcccagcgcgcccgcaggcagctcgcggggacgcggcccgcagatcggggcgggagattgcagcagccttccttcttgcgggggattttgtggctacttaagtgcagcagacacgaacgatttaacagagaagccaccaaaaatctcccaggaccaatagggtaggatcgtgatcacacagtgctgtctggtgagttctggagttcaaaacagagatctagatatacacacttttaattttggtctatatgtttgtgtcccttttgactccagtgtccttctttagaaggtcaaaaataaatatgacctgaacctaatagttcctttctgcatatttctgcacaaagaaggaccttttattgcattttaaaaaatccagattgcacaaattgggttctctgttgttttgcaagtccctcagtaaattgcgcacagtaatttattttttttccccagagacgtgcatgaatgaaacccaggtccgtagcaagcacagcccaaagcaggtggaggggagttgtaccaggcaccaggcttgcctggcttccctggtgactgctgtatatgacggccctgaggtcttcatttgtgtcctgagcaaaggacatttcctttatattgtagcttgagcattgtacttgaaaatcaacaccggctaatgagccccatgattggtatcacttgaactgtgttctctttcacgtggcagtattttccgtccctaggatatggggtgtttagcgttttcctgttttactggaagtcagatttgccatgttgctcaggatggcaatgaatttccctcttcagacccaatctcaatctcaggctgcctcccagttccggctgaccatgagttgctgagcagagggggcactgatcccttttgtccccaggcccagaggcttggtggctgcctctagtccctccctccacacatgcacactctccatgcagtaagaggattgtatttcttttaatatctacccaagctcatcctgaactaaagtgatcctcctcctgcctctccctccgcagctgaattagcaaggctgcctgctgccttccaggcccgggttacttgtgcagaaagtagccagggatctgctggcttgggatctgggccaggttttgtcatcctttttccacacttcattttacccacttgtaggtactcctcctcctgccttccaagtaattacttgactcttcggtctgaggcttttcactgaatccactttccatctgtgaaggaatttagtgatatggtctgccttttcacatattgaattatttcttaatctaggtcaccagctgttaatatgctcaaaataaatgaaaagaaaacctaatctcttacggagcattcaagtcctgtgaattgtcaaaactcactttttcacgatcaaggtcaagtgtactttatgactgcagttgtggatggtggtcagtcttctatgggagcgggggtgagagaccctcttgggggtttcaagcgtcctattttcttcactggggaaaggtgctgatgaaaagtgcctgccgcacctagtatagaggttcaaacactaagaggctgagagtataggctcttccccagggtgagttctgcccccctttctgagtctgtgtagcatcaggatatgcttggcacaaagagaaaagggcatgttggcatccaggtaaagcagcccagcccaaatggaggctgctggagaaaggaaagcacagtatgttactgtcagaggctccattagacatatccccacgtgattccctctttctacacctttggcctcttcctcttctccagagaagactcttcatcccaataactatagaccatatatgtccctgagaccctttgcttcttgtttttacaaccaaattttcttaaaagagagtccactcccttgactttcttatcatctgtgcttcacctaaaagcttgcatatgtttaggctccaactgcatgtctgaaatcacttttagaggtgacatggctttttaggaattttaaatacgtttttttcttactgaaagtcagtgaagattcattggagaaaggctgaaatgtattagtcagcagaaaaaaaccacaaggctgaaatgtacatataagcagaaaaaaactccagcaaattacgaagcacataattctactactcggaaattttactaccatttgatatgtatctgagtagatctttttccatgtgtgtatgtatttatacaaccaaaacaggctcattgctgtatagttgaagacctgtttatttcacttcataattatgaacatccttctatacatgtacatattttccatcaatattttaaattattgaacactattggaatgtatggattatactgaatgccttatcttttgaatattcatttttccagtgtttctatatggaaatacaagtcagtgagcaaatttgtagggagaatgtttgcacacctctttaattatctccttagataaattcctagaagaagacttattgcatccaaggtttgcctatttttattatagctagattgccttccagaaaggtgtaccaatttacattctcatcagcagtccatgagacacttgccaactctggataataaaatttaaaacaatgtttagctatgtcattggataaaatttgttcatgattaatttcatttgtttgatttttaaaaagcaaacttttgtgcattcgtgtttttgttcttgaattgtgcttttatatttctgcccgttttctgtagcaattctgtcttgttattagtaagggcaaaaactttatcaagcctaagggttacaaccattctttcttccttttctatttacttttaaattgtttggtgatttctactgagaaaatgtttttgttgatgttttatgtatatctgcttacatctattggttggttttgtctggtttctcttttgcgtggttgaattagtcaggatcctgctacatgcaggtgtcagaaagctcaacccaaactggcttaaggaaaaaaggaatttaattgctaataataataatatctaacaatttatatatggttcttgtacatataaatttagattagcttttaatgaataaaagctatatattcacataagatatatgaatatcttacctatagtagcctatatacatattcttatacatatgtatatgtaaaagtatatgcagaccatatctttcctttagcttttttttttttttttttgagacagagtctcgctctgtcacccaggctggagtgcaatggcgcgatctcggctcactgcaagctccacctcctgggttcatgccattctcctgcctcagcctgcccagtagctgggactacaggtgcccaccaccacgcttggctaattttttatatttttagtagagatggggtttcaccgtgttagccaggatggtctcgatcttcctagtagctgggactacaggtgcctgccaccacgtccggctaatttttttttttttttgtatttttagtagagacggggtttcgccatgtttgccaggatggtctcaatctcctgacctcgttatctgcccgcctcagcctcccaaagtgctgggattataggtgcgagccaccgcgcccggcctccttcagcatttttacagaactctttggtataactctcagtggcccaaactgggccttgtgcctatctctggaagaaaaaacatctctgagagcaagggccaagaccacgggttggactggttgaattgggcctgagtcatgagccagtgcgaaagccaggaatgaagattcccctgaacgatatggactcttagtggaggaggtagggaacttagagtacagaatggggagtggacactgggtggcaaaataaatgatattcacagaggcgtccctgaaagaccttctccatcccaggtttatataaataatcacatatttaatatttgtttaacatttttatgtgtgcagttaaaaaatatgttagtaaaaacttatcatgaaaaattgtatatccttcgcctactttttgatggggttgtttttttcttgtaaatttgctgaagttccttttagattctggataattagccctttgtcagatggatagatagcaaaaattttctcccactctgatgatagtttcttttgctgtgcagaagctctttagtttaattagatcccatttgtcaattctggcttttgttgcaattgcttttggtgttttagtcatagagtctttgcccatgcctatgtcctgagtggtattgcctaggttttcttctagggtttttatggttttaggttttacatttaagtctttgatccatcttgagttaatttttgtataaggtgtaaggaaggggtccagtttctgttttctgcatatggctagccagttttccgagcaccatttagtaaatagggactcctttccccattgcttatttttgccagatttgtcaaagatcagatggctgtagatgtgtggtgttatttctgaggtctctgttctgttccattggtctatatatctgttttggtaccagtaccatgttgttttggttactgtagccttgtagtatagtttgaagtggggcttaaaacctaaatgatggggttcataggtgtagcaaaccaccattgcacatgtatacctatgtgacaaacctgcatattctgcacatgtatcccagaacttaaggtaaaatttaaaaaaaagaaagaaaaataacagtcccctgttcccctctcctcaacctacaatcttgttagaggcaatagtgctaaccatgagatttctcaaaaatatgcttatacagctatttcttgatctatcttttaatgtatggtgaagatatgtaaatttaacttttttatttctcctctagttcttcccccaattatacactgaacaaaaattgttattgcaaaagattacattttaaagattgaagtccaatttttattgaataaagtgcacaaatcttaagtgttcagcttcatgagtttctatgtatatggatatctgcatagctaccacccagataagtaacagaatgtttcttccatcccagttacctaccatttcttttgcctttcttgttctttgtctttttatgttcataccttttaaattactttactctcttttccctgatgagcacctttacatgtacttattggtaattttgatatcttcttttgtgaagtttcattaaagtctcttgccagtattttatttgggttgcttgtcttttttctgttgctgtttagttttctatgtattcaggatatgagttctttatcaggtggacatcttatattttcttccagacagtgccttgcttttttactttcttagtggtaccctttgatgagtggcagtttaaagttttcatgaagtcttatgtgaggattaagtttttcatgcagctttttgtttttcctggagttaataattgccttgcctttaaaaatttgcttattttttaaatgaactttaaaaagttgtttcttcttgcttcatcagatatgtcaaatgtttatcaatattattgttcgaggttcaatatatcaaataatgtaattgctcattttctcatcctggagatatcctttttggatgcctctgcccttttgtggtaatctgggctgatttttctgtagacctgttgcatacatgtcatcctgggtcttcttttgccagtgttggggttgaggaatggacctgaaatctcaagtatcctatattcccgggctttcaaacagtcccctgttgtcagtgttgtgcttcattcttaccttctatggtgtgtggtgtgtggtgggaccaggtcctaaccctgagtgtgtttgtgtgtgtaactgtgtggtgataattggttgctttttcattggttgttcctgtataggcacacttttttttttcttatagtttcctccattctgctgacttgtttccattctttcatcttttttagcatctgtaaaatgtatggaactcttgtattcactaatgctggctttcctgttcttgtccttgtatgttcataattttttattcctttactgtcgccttagttgggctttggaatgagatggaaataagcacatgcagtcagcctgccatgtttaacgaaatgcctttttatttaaatacttgatctctctgggatttatttttttattatttttatttatttatttttttgcccatcttcttctatttgtgaaatccagtggcatttatttggtcttaactctctttgacctctatacaatatttaaatcagtgaagcactgcctttaaacatttttttttttttttttaccatgactgtagtgagcaggatactcgggaggccgaggcagaagaatcgcttgaaccgggagggcagaggatgcagtgagccgcgattgtgccactgcactgcagcctgggcgacagagcgaactccatctcaaaaataatactaatactaatactaatactaataataataataagggagttagactatttaaattctaaggacctgcccagtttgatattctttgtgtcattttctctgtcccaagtgattattatataattgtcttaggtgcaatttttttttcatgcattacatcttccaaactaaattgtaggtacttgaggacaaggaccaaatatcttgcgaattgtatgtactcagtgacgatgtactgatttgcctttccatgtccttgcttgttaacctcccactcctgcaaacacattgtcttaaagaatccttccacaattctttctgtgacttttgtgaaattatcataagggtttcatcgtcatttgctttgtcattttgtgaaaatagtacagcaaatgtaattacccttatggattctatacatggtgggaatgctataaatattaggctgaatcatgtggaattgtcatatttgtgagtcaaacagtcaaatattggcagagtcatgtgcttcagtgcaatgttgattgagtgatatggtaagaaaacaatgttgtctccttccatctgtctggttgtgtgacatttggattctttttcgattgtcgctttgccgatgcctgcattttttgttctcaaggagaaatattgtggatggtgtgcatgtataaaaagaatgggcaaaggaagatcctcctctgtcaaggagatttgtactgtgaggcccagggcccatctgtagaagagtagtttatatggccacgtttacttccgaggacacttcagagaccaaatctctgagacatattggggtttctcttttttcagatcatctgaaatctcttttgttgcctgcatctatattttacaaagcttatgccttcttttccactagggttattttctctggctgtattagaaacttcaaaaattaaaaataataattatgggacattcttaacagagtagagtttccttcttctgccttttttattaatgcaaacatatatatactaatgtatccttctttctctaggaatgagtacaacagaaaataagaactgtaggaactcagattttaacattaataaaagttaccattctcctttaacacaagcatatttggttacatttgaaaactagcttttttaatagaccaaacaacttgtcatagctgagatatttgtataaacaatatggccccctttacttggtgtatgaaattagatcccatttctttaaatattcgaattaaatgatttctccttcctacccaattattatgaaaatctcttactcctcccaggggtccctgtctcttgtgataatttcaggaacccatggtgagtttcccttctttaaatgagtcaatggtttttactacagccttgtgagaaagggtccctaatgtgagtccagcattcggataccgttcttatccctggatgagcactgcagggaacaagagcacagtacggtgccctcaccagtgggtcttagggtggaggcaggagctggaagcctctctctcctgggttagactcagcttcagtatgtctgagctccacatatgtgagctctttacaaatgaatatccatgaatattatacaaaccattcccaaattatacaagccattctcaaatttacttgtgcatatacacatacaaattccccctcccccaagatttgctcatagtgcccgtgttccaaagttaggaaagattcaatatcctcacacattgtgcctagaattatctatttcattccactctactcttccacttttgagaaaattatctttgggacatactaaatttattctaagcccacaatttgaaaaacactaccctagaggacctctggtatccattcctgtaagttgactatcttttgggccattgcagttcatctaaggggatgtgtttgtgcgtgtgtgtgtgtgtgtgtgtgtgtgtgtatgtattcatacatacaaatatatagttacatatattacatacattcatatatatgactaaatttcaaacaggaaatattgtgaagtaccttaggagaaaataagtagagaagggaaagaatctttcttaaaatgatgcatttttctgatattttaaagtctggaaatttccaccttactgtccaaacacaattttaaaagactttctagccatttacactaggggccacctgcatagaacttctgagaaaataagtggcccagtgggctcctgtaaaagggacaaaagatgtaaagattccttgtgttgcagatataatttttcctacattctcagtaaatggctaacatttacataatggaaatgctgtcaccacagagtttaaggaatttacccatgaaagaatatagtaagaccatctatacagcatcatgcaaaattgaagtgataataatcacgattttctgagactgcatctatgggccacctttccacatggaaatgctgaaacatcattcttattgatttgagatctaaatttaagtgtactatttggctgtagatgtacttcctgaacacaaattgaccaaatctcttttgaggaatgatgtcgtataaagccatggataagatcttagttttgaaatatttgctatgtgataatcatatatcaattttgatcaccctgaacctacttagaacagatgtacaaaaacgagaaaaccaccattttggtcatttacatcttactctcatgcagttatttagttgaaagctgagttcataaatgggaagagcttgaatatataataatttaacaaattaataaatatatatatgatttttccctatctttacgtgcctataatgatttaataaaatatgcatagacccatgcataaatgcacttttatcaaggcacctaaaagttgttgagtaaaggatgttaaattcatatgctttattagttatctattctattgtcaagtcaatttggtagaattcatttatttagagccatttattgagaatctaatatgtggaaggcactttctagagactcataatatagcagttgacagagctgtcctggttgagcatacagagcagcaggagttgatagtgagataaacttttgcacacactactaagtacatagttattagttaaaaatagtaattttaacttatgtatgataaaaatacagttcagtttgtaactagggaactaatctagagtcagaggatttgaacacagttacttaaagtaggtagatttcaagctaagatcctaagaatgaattgtagccatcagacaagaggagtaagggtgtgctgattacaggagtcaggaagcattctatacctctgacactttgtccttactccttgagcataaataagaactgtagaatagagaattgactgcagacactggccttataaatgatctcttctctcatttggatatttaactaggcaaagtggaccctaattgggtccactgctgtggtagcagtccctcgtttgtgtgatcagatttttacccttacctgttgaagggtccttctggggcatagttgcccccttgacacagagccaggacactggttcagagctgacttgccctctgaactatctgtcatccaaaatccttttttacaacagcagtaaactccaacccagtatgctttcatggatttgttgagagaagggtctcttattttaaaccatcagaaatccaaaaaaaagaaagcccttatcaaattcttaagtgtcacccatctataaagatgcttttgtctttaaaagtcttaattgcatttggatgcctaacatttaatcaacatttaatcaattgcacgtgtgtgtgtgtgtgtgtgtgtgtgtgtgtgtgtgtgtgtgtatgtatgtatatatatagcatagatgcatagatggtccaaaccttgggaggatctcccaacttatggcagcactgcctagggtgttgaagaacagtgtaatacctttccctgtaattactctgtaattcctcaatatatgaaacatctgtgtaagacatcctgcttctttaacacacacacacagacacacacacacacacacacacacacatatatatatctccaatgaattggtatataatgtacacgggggtggggcagagagggaaggagggaaggagagagagagtgaacgagcgagagagaaatataattaaggctggcaacttgacttaattatgggtattgacttgattattttgcaggcagtggtcttggacttaggaataatcagcttcaggtgatttgcagcttggaaggaatcctaaattagggaagagaatctttcatagcagacaatcttttcctctatctgataatggttacaaacctttaaatagcgtagatggtccaaaccttgggaggatctcccaacttaatggcagcactcctaggatgttgaagaacagtctaatacctttctctgtaattactctgtaattctttaatatatgagacatttgtgtaagacatcctacttttttaacctacagattttataacacaatattttctctgagagtctctaggaaaatggtatccagagttctgtttccatccctttacaaaatgcttgtgaccatggggaccactggcattcctaaactataggttgagacctaagtccttgtagggctctcctggggatgtatattggcccatagttgttcctgttaagcatagacagtgaatccattgtaggtggagaaaatattttatgtgactttaatcttttaaaatttgttgaggctcattttatagtctagcatatggcctatcctggagaatcttccatgtacgcttgagaataactgttttttgctgttgttgggtagagtgttctatagatgtgtgttaggatgagttggtttgttttcttgttgatcttctatctagatgttctatccattattgaaactaaggtattggagtcttcagtattgttgttgaattgtctatttctttcttccgctctgtcagtttatccttcatgtattttagtgctcttttattaggtgcatagttacatttgttacgtctacttcatagattgaccttttgtcattattaaatgtccttctttgtctctagtagtaacttttgtcttaaagtccatttttatctgatacggttatagccattccagttttcttttggttactataatatttgcatgatgtatctttttttttatttaagagacagggtcttgctctgtcactcaggctggagtacaggcacgatcataactcactgcagcctcgaattcctggactcaagcaatcctcctgcctcagcctcctgagtagctgggactacaggcacttgccatcatgcctggcagcatgagatatctttttcatccttatactttcaacttatttgtgtctttgaatctaaatgttgtctctcatagacagtattttgttagattttttggatcaattttgccaatctctgccttttaattggagtattaagtctatttacattttacataattaactgaaaagacaggatttatgtttgtcatgtatatcttatttctctttgttgctttatttttcatgcctgcttttggtgttaaatagatattttcttgtgtggtcttttaattcccttgttgtttcttttacaaatagtttttgagttattttcttagtggttgccctgggattacagttaacatctacatttgtcacaatagaggtcagattaatactatctcaatttcaatagtatataacatttttctcctgtgtagctccattttctctcttttgttgtattgtgattgtcaaacaccttacatgtttatatattttatgttcgtcaacaagatttatagtaattgctttatgcaactctttttttttgagacagagtctcactctgtcacccaggctagagtgcagtggcatgatctcggctcactgtaagctctgcctcccggtttcatgccattctcctgcctcagcctcccgagtagctgggactacaggtgcatgccaccacgcgtggctaatttttttttttttttgtagagatggggtttcaccatgttagccaggatggtcttgatctcctgacctcatgatctgcccgcctcggcctcccaaagtgctgggattataggtgtgagccaccgcgcctggcctatgcaactcttttaaatcagatagaatcataatgagttataagcaataatgcatttatactgtcttttgcattaacctatgttgttactgcatatttcaaaaatatatttttcttatgaaatggactctgtttaataaacaattattaactcatttgctcattaaaaaataaagcaagatcatagtacgagatgtccagtgttactaacacatttattaagcataactccagctaaacataaagtaaagtaatataaggaactaattagtttttagccatagtataaataaagttacacttactgtctgctaactggtttggattattgaggaaatgtttcatactccccttagtagttttacaattccagttttttttttccattccatagttaggagctactaagtattacttatgatacctcaagatatatgcaacatcttataacttttttctgggtgcctgtaacttttatcaggttttcaaaaagatctgtgacttaaaaagcataaacaccaacaatgagtctaaagtattaagggactcttggcttaaatatttctgcaaaacttgaagagcaggaaggagaattaagtcatcagtgggtgacagagctgctggcacctgggcacccagcatggtttattcttggtttggttatggtccttgcccttgaagactcagattttctaggtccctcaggatttggcccaagtattgtgatagtttcaacataaatgcgtggtgcacgccttctgccactccaggttccttgtcacacatctctaaaataattattttgatctgttatttaagggataacaaaatttcttaaggtaattcagtttttgagtcaccacagcctatgactttttctagttgtccatttcatggcatctagagatctctgtttagaggtggcccaggtaaatgagaggaaccctctatcagaggtgaccaggggaagtctacatttatttccaacgtacattagatgatgccctgtagagtttgggtgtagatcagcccccttggggtaacacacattcctctcacaccttgcttccttaaattgaagtggaaaagactgtgcatgtatgttgttttgaagcttttataatgaggtatgaaatacatgtagtaagtagcaaaaatcttagccgtacagcttcatacatttttatatatgtaaaaattttatgtaaaatactaaatcaaaatctatatctacatctacattatctatatttatatctacttctatctgtatctatatcttatctatatctatcctgtgttactgctactcagatgaagtcacagggtaattccagaatccattagctcctccatgcctcttcccagctaatacctcctctcctctgctcacttcctactaccaggtagccactattctgattctaaccccatagattaatttcagttgttcttgaaccttgtataaatggaatcatatagtatatactcttatgaattttacttcttttgctcctcatcatgtattgagattcatccgtattgccatctgtaggagcagttccttctttttttattgataaattatattatagtgtacaatatcccacaatttatttacccattcttcacctgttaggcattttgtctgtttccagtattaggctatggtgaataaggcagctgaacacatcttatacatgtctattggtagaaaaaaccacttatttatcttgggttaatacctgagagtggaatgaatgattcattagggtaggccctctttagcttttagagatggtaccaaacagttttccaaagttgcatcaaatttatagtcctgtccacagttgtgagaatttagaaagcctatattttcatgttctaagtttgatttcgctgagttgtatttttttcactcctgcatccccatgggactcatatttgtttagtgataattgattttatctttatatatttcacacataatcgtagggacgtttctctcatgaactgtccacattttgtgtttgaatcaggtgggggagtggtcaccattttaaactcagactacgacttgcttgtgcagaggagatgtacacatggtgtctgtgtagatgattgggggaaggattgtgatacagctaatctcgtggtgtcagaggttctttggtgtgctatattctgcctcctgtcctctgggagcagtgtcctatgctcacatgagtggtattccctgcatgtatatgtggttcattaactcacgatctccatctttggctctagcagaggccagtggcatggcatgcacccactggctcaggctcaccttcattgctctgccatctggctgcactgacattgggctctgatccccagcccttgctacagaaccacgtggccactgctacagtagctaacctgctgtgtcttcactacatgagtattaagggcagctggggtaatctcaacttcaggtctccttagcctggctacactgtgcagctacaggatgtaactgtgccctaggctggtgagaggggcagcccaagaagtgatctttccagagtgttcagtggggcataaggactgtagctcccctctgaccctgacattatcctcacttctcagggaggagaggagaaaattggggtatattttcttccacttttgttactcttttttgcagaggggaaggctttcttcttccttctgttatatcctcctgtggcagagcttgccaggcaccatggatgaagggggcacgttcattccactttgggaaagagggctctatgagctggggcttccaggttttatctccctttttagacttaatgaagggtaatggaaaatttgcactcaaggtatcttaattcttgtgccaagtccagttagaataaagaattgggtgtttcccctgctaggctctgtgatgagcagtcccatatattaactcatttcaccctcgtagtgaacctatgaagtaggtgctattattatccctatcttacagatgaacagactgaagcacagagatgaatggttaggcaatttgcttgagactacttagctagttaagtatggaattgatctcggaagtctcatttgactttgcagtgcaatgttcttttcatcagttctggtgaagttattctgcaatattgagttgagagaatgtcaggtgtcatgtagtgtaggggagtaattccaagtggtctggcacctgaaaaggttttatgcctttacatttcattcattgctttacgtgtcattatacttatatcgctgggaccttccagttaccttctttttaactttggagagggttttctttaatatactggactttcctaaagtggggcaaactgatgtgataatcagctctttttggttgcacagtagttatatcccagcaacttaaactgctttaataaatctgatgcctaaggtcttgtgggatctgggaaagaggcacttctacctcggggccttagtgcctcgaaagatggtttggaaaaatcataaagaatgcttgagtatctgagttaatttcatttcttacaagatgaacatcttacaaaacctttacagctcatcttaagttgaacaccagaaataaagatgtgcctccaaatatgaccttacagactgagaaagatgagagcaaagcctggatgcatgtgctctaccaattggcaaagggccgatttctccaaagggcagatgtttcccaggccatcagagaactcatgcgtgttctatatctgcttcttagcaacttccatatgccaagaattctgatttccacttaatttaagcttacttcaatagctcaattttcatctttccaggtgcttttccagagctttccagttcagtcaattttacatgatccatcatggaaactgcaggattgtttgccaattgcaattcttttccttactatatgtcagagattgcaggttgcccccagtatcaattcctcccttttcatttagtaataaaattccaacttttgctgggatataactacccatatatgataaatgatagcatttcacagcatcatttgtggctagatgtgtcatgtggctaagctctcatcagtgggagatgtgcagaaggtgcatagaaaacttctaggtcttgatcctaaggggagaggtttgtgttccactgctgcctttccctttcccggtctttggatgtggatgtcatggtgggaggtggggctgtgacctttagactatggggtggactcctgccatgtcacatgttgagtacagcaggaatatgagcatggaggagcatgggtcctctgtactatggaactgctgtggcatcctgggttccttacactagcacagttgcatgaggaagcaggagacttctatatctacagaagctgctattttttttttttttggcttttattcctgcagctaaacctctgtcctaaggtttactttgaaccgtttgaaattgccatttttttgtgaaacaaaatttgtcaaatatcagcaatctcatacagttcaacttaagaatatactttcacttgtaaaaattgaattttgcacctactgtctgaggctgcatactgtggaagtggagagcattttatgaaaggttcagagatgattcaggcacggtggagaaatactctccgctcagaacagcggataatgagcaggtgcttgattgcttagaaattatcccgattatctgttaaaaagattgatctctttagttaagacctccttggaagcattgtcaggtacttttagtctaattggttggaaggcagccacctcaatacagagctttacaatttggcccctgggcagtatttctacttgaattgtgaggtgaaagttctacctgtattgggtcctatgccgtggtaggtatgatgatgctataaggggactatttggagttggccaagacgttttagaaagggtgactttggtaaaatataagctgaaatgctagaattacagaaagattttggtacaatttatttggaagcagttcagaatgatgggaagacctttggaatgagtcaattatggattcaaatcctgaccttctcacttctcagctgtgtggtcttggtcaagtctctctgaaccaatgtttcgactttagcaaaatgcagaaaatgatgctttttttttaaggttgcagttagagtcagaactaatattttaagtactggcacggtatgtagtatttccatagaatgtaaatggtagctatttttattttctttggatttcaatgtctttctcaaggtggcaaattagggctatatttatatgcttttaaccttcctttagaatagatggcataaaagaggatctaagtgtataacccacatatctatttgaaccaaatggggaagcaccttgtttaaactttgaacacgtagtatataacacatatttcctttggtcacacccaagtgttctaaagaggtgtcccagaactgcagatggggacagaccatttgacatcatctactggctctcgggtaccctcatcttcaaccatggggaaagagacccactggaccttttgaaaaaccctgattccccttcctgcagagaaccatctttagataagaccaagatagaaagacatttcctctctcgctcttctttcatatggataatctatccatatcagtgtttctgaggccctttgagaaaactgtttaggctgtagaaaaggactgtattatgtgggtaagatgtaaaagacaccagccttgccctctattgaagctccaaagccccctgtgaaactccagtggcattttcacagtgatatttgtaaaaagacaaaaacaggccgggtgcggtggttcatgcctgtaatcccagcactttgggaggccgaggtgggtggatcacctgacatcaggagttcaagaccagcctgaccaacatggaaaatccccgtctgtactaaaaatacagaattagccgggtgtagtggcacatgcctataatcccagctacttgggaggctgaggcaggagaatcacttgaacctgggaggtggaggttgtagtgagccaagattgtgccactgcccaagagcaaaactccatctcaaaaaaaaaaaaaaaaaaaaaaaaagaagacaaaaaatcagtcttagcagtgtttattgaacttagaatgttagagctggaacagaagtgagcaatcagaggcgtgtccttagacctgggtcatttacttagtccacttattaagctgtgtagacagaccgtgtttgaggattaacacccaaaggttcatctcttttcctgtgatttagctatcttgtcagtaaaatcaaggttttaataattagctcctattactaacatttatggtatagggaattaatgaaaccttctgagtcccatgcaccggaaaaatatttgagacacctgcaggcaagatgaactaatgtaagcaggaaaagttaggtgtgaggacctgtggccagtgggtagaactcaactcttggtttaatttctgctgggctgctgcaaataacaggtgtggaattattgttccagccagggtacagaagccaaagtggtatttcctactgtggctctgccttccgcaatggagactgaaggtttagccattaaggctgtatgtagaggtgaatcagatattcacaatcttggagaacaaatatgatttcactgtccagataagagatgtttacgtcttgtaaaaaaaaattattgtggtaagaacacttaacatgagatttgccttcttaacaaattctgaagtgtacagtacagtattgttaactatagggtacagtgttggacagcagatctctggaacttattcatcttgctaagctgaaactttatgctcattgattagcaactccccatttccccccttgcatctcctggcagccatcattctactctttgattctatgaatttggctgttttagatacatcatatgaatggaattatgctgtatctgtctttctgtgatgagattctttcgcttagcttaatttcaagtttcatccatgttcttgcatattgctgaattttcttaaaggtggaatcacattccattttatgtatgtatcacatttcctttatccatttatctactgatggacatctggtttgtttacacctcttgtctattgtgaataatgccacagtgaatatgggaatactaatagcttttcaagattctgttttcagttcttttggataaatacccagagtgggattgctggatcattaaacttgatatttgatctaatgtctgggtaccattcacttctctgtttttcttcctttctattctctcattctgctgctctgtccttatactccttaactcttgtctctatgagctcataagttgaaattaaatgattttttttgtttgctatgttactaaatgttttacattcctttttatttatttatagggcaaatcaagatggatagacacatgtttaaaatgtgtctcttccaattacttgttatttggcaatggagtctccctaaatttcactttcctcatttgtaacatttgtaaaacacttaacttaaaggataactgaaagattagtagatagtgcaagtaaaagtctagcatagtgcctggaatatagtaagttctcaaaacatggtaggttctatttttttaataatccaagactagtgttttatacttttattagaataaaatgtcaacaaaattggctttttatttgtatgtgcccctctgtggatttgtgttttctgtaactcactgagtttcttttttcttttcttttcttttcttttcttttcttttcttttcttttcttttcttttcttttcttttcttttcttttcttttttcttttcttttcttttcttttcttttcttttcttttctttctttctttctttctttctttctttctttctttttttttttttttttttttttttttttgagagagcttagcttttgttgcccgggctggagtgcaatggtgcgattttggctcactacaacctctgcctcctaggttcaagcaattctcctgcctcagcctcccgagtagctgggattacaggcatgcgccaccacatccagctagttttgtatttttagtagagatggggtttctccacgttggtcaggctggtctcgaactcccgacctcaggtgaggtttacaggtgggatttacaggtgggatccctcaggtgggattacaggcatgagccaccgttctcagctgagtttcttttatattatgtgctttcctccttttactggtttttgaacagagtaagtttttgaaaaagcttatggactggatgaattaatgattattgagtgctgtctgtatgatctgtaactaaatttccatttttagaaatagatactttacaattgtgaatgtaatatatattcattaacacagcacctgcaatctattacccaggggtaaccactatttaaatgtatatatacaccttatacagtatggccccagctttgttaaaaaaaaagataaattttacaagttgagatcatacagaagatagccttagatccagatctttctgcttagcacctcttggttcggtccacttggagaatgtggtttttaatgggtgtaataaggatggaccattgtttggacccaattcttcactgactgcctttgtggaattcctgggatgtcctcaggctctctacagtgtgccaacagtttctgacaaaatgcctaaagtgcttcagccagtggtcactgtggctgagtttgggcaggaggatttctaggtataatcaagcatggtggggaggcttagcagatgcctttcagggtgacttcgagggcctttattggcacccaagttaaacagaaataaaaggaaacctccatcgaaggagagagcctgtgtttctccaaaaccagctctgctcttgccctcctgtgtgctgcgtgcatattcctgcttgtgctgactttgatactattagctggctctgaaaacagttcctatttatccgagtcgagcctgaacacagagagctgatttcagcaactggcccctccctccgccttgtgatcaaatgatcaccctcttctcacagtcatctcacctttccagcaaatgggattggggccaagagcccactgggcttttaccaaagctttgctttggcttaaaatatcgctctttgcctcatgatgatttatcattgactacgtaaagcacgttcatatagcaacaaaaagacactagctcatttaaactgcccgttgtgttgcttagaactctcatatctcctttgccctaattcttctgtaggaatattcctaatgtgggcttgcctaggggaaatggacaggttgaagaacatggtcattgcataatttcgattgctgatgtgtactgcacatgtgggttaaaaccatgaatcacaccacagatgacagtgtctgggggccaggccttccaccatcacttcttgcagccctcagccttctttctcctgtttgatgtcagtattgattattggtgtctgtagtgacaattattggcatcaatatattggaggattggggagatacacagcaaaggcaaaaactgttagcctttctcgtttcaagtctgagggttttcagggagctgaccaggataatagatgtgctacagaaccccaaaagcctagagaggggtcaaaatagtatgttaggaagacagggagctccccagtgaaaaaaggtggaagaagggggcagagaggagagataccttgccaggcaattgtttattgtctaagttaatcttcactggcagagagagcacgttgccttcagttttacccatgaggacaccaggagcagagagataaagggctggatggtcagagctgctgacagtgattgtgaagctgcacctgggaaagctgaccgggagccgtgctcagatactcacaatcctgaatgccacccaggctgtgtcttatgcacagcaacacccacgggtgctcttacaggggttctaagaagagccacagaaaatctctgaagggccaggcgtggtggctcttgcctgtaatcccagcactttgggaggtggaggcaagaagaacacttgagttaggggtttgagaccagcctggacaacacagtgagacctcatctctactaaaaattgaaatggaaaaaaatttaaaaaaagcagagaaataaaatcaatgtgacaaattaagaaaagaaaaagaaaatcactgacttatatcagccttttctccaagggggaagctaaaagaaaattctgtgttttaagtaattttcataaggctttgtaaatggagtttaacatcaggaattcatcccacaaagtcctgggtattggaagtctcaggtcctattttcagtgccttcagtggcctatgtaattcaaataaactgagaacattgtgcagggttccttgtcttcatccttatagcatctggaccccctgcactttcattttattgtgcagtcatagatatcgatgacttagcagatattaattaaaccattttccagtagtagaaacagagcctcttggtttcttttcctcaactgctttcctccacttactatactcctaccttgcttcaccgggggtcctgaggtccctgaaggggtctgtcaccctcctgctgttgaccactggagcctctttgatggtagcttgagaaatcataaagggtatttaccttttgcattcaaaatgtattatacattaatggacatgcaccatttatgtataaccaaatagacatttaactatgttagcattttgcatgttctgctttggaaatttagctaaagtggagctcgtaataagaaaatgaggtgatttgaagtgctggttagttgctttcatattgggtggatcttctatgaatatttgggacctttagaaattagtactgaaattgagaaattttcggttggtagaatttagggcatttctctgaatgtgtcatttctaagtcaccatctccattaaagaatgcttttctgagcctccttggatccctcaaagctaggtggttgtcatgggaattagtcacattttgaagagttgggcactgtaatgatgaaaaacatggggatttctcaaaggaattgaaaacaagtgttcaaacaaaaactcggacttgaatgttcacagcagcattatttataacagtcaaaggtagaaacaacacaaatgtccattcactgaggaaagataaataaaatgtgaaaattcatacagtgtaatgaatattatttagctttaaaaagggatgattggcctggcacggtggctcatacctgtaatcctagtgctttgggaggccaaagcatgaggattgcttgaggccgagagttcaagaccagcctgggcaacatagcaagaccctgtctctacaaaaaagtttaaaaaattagccaggagtggtggcatttgcctgtggccccagctactcaggagactgaggcaggaggatggcttcagcctaggaatttgaagctgtaatgagctgagattgcactactgcattctgtcctgggcgacaaagtgagaccctgtctcacaaaaaaaaaaaaaaaaaaaaagagaatgacgttctgagacgtgccacagtatggatgaatgtagaaaacatgctaagtgaaaggagtggtcaccaaaggccacataatgtattgtagatattccacctatatgaaatagctagaataggcaaatccataaagacagaaagcagattagtgtttgccaggaaatgtggagagggaggaatagggactcactgcctaatgaatacagggttcttttttgggatgatgaaaatattccggaactagacagtggtgacggttgcacaacagtgtgaatgcactaaatacccctgagttacacatttaaaaagggttacaatggtgaatttcatgttatttgaatctcaccacaatttttttaaaaagcaaaaagcaaaaaacaaatccctaaaccaaagataccccaaaacctaaagcatggggactgggcttgtactgacctagtacaagacctaggtttgagtcccagctctcccatttacttactgtgcaggcttgcacgagttccacaatctctctgagcactcatttcttgatttgtaatgtaaggacacgagcgttttctacaccacacagttgtgaggagtaagtgaggtcatgcatatgagggatggccatagactcgcactgaggggctttctttcctacgagtttagacttctagcactcaaaataacattataaaggccaggtgcggtggctcacgcctgtaatgccagcactttgggaggcgggtgaatcacctgaggtcagaagtttgagactagcctggccaacatagtgaaaccctgtctctacttaaaatatttaaaaaaaaaatagctgggcatggtggtgggcacctgtaatcccagctactcgggaggctgaggcaggagaattgcttgaactgaggaggcggagactgcagtgagccgagatcgtgccattgcactcctgcttggggacaagagtgaaacttcgtttcaagaaaaagaaaaaaagaaaaagaaaaaacgaaaagaaaaccattataagtctccagtgaatattggatcaaaattctaaaaatcaaaagaaatattaaatggactctaccttacattttcacagagaaccaaatgtgacctccacaaaagccttagaaagttccagaagtctctgctgaaggttctcaaaaaggggcccaaaggcaaagtacattgactaatatacagcagaatgttctagagatgctttccatctcatctcttttccatcatttcatgtgtcatggcagtgtagccccctaaaaacccctttcttcctcttgctttctctctcaatacccaaactttagcccatgttcccctcgtcccctcacctttcctctcttgtccccttctcccaccctttctgctctgagtggctctgcctccttactgcataacagtttatcctctgtctaggcctttctggttctgtagccatacttattatgggatcagtaccccaaaaggcttcagacttcactgaagaaaagctaattgctttatctttgccacagaaatttgtgtttatgtgataaatatccttcattaatctttactaacttccaaatgaatcacctgttaatcctttgtcatttttatgaaggatggagggaataaaaatgatagtctactttgactaatcacattgtacctccaaataaagaaaactattaggaaaaaaaaatgaaggaaaatgctgttcttagagacagcctgagaagaaaagggtgagaaaaaagaactttgaatcggccatcatttgctttagatgacaaagtcagtcctcctgaggcagaggggagattgaagagggaacatagttcatttggtgtagagcttttataacagggtagattcctggtaataataataagagctgggtctttggatgaaggactcttccagttctcaggaaccttaggaggtagttattgaggaagctgaggctccatgggatgaagtaatctattctactcatgtgagcaacacatggctgagccaggatcccaacctaggcccgtagactcatcccaagctctcaactgccctgtgcagggctggggcagtgtgtgctcgtcctcattcttgcatatctcctttctctaccccacatcagcacacaagcattgcccagtccacagacatgctgggcttgccgaagttgcagaggctctgggctgggggataggagggtttatcaccttgtcctttgctcttgttgcaatctgtcctgccatcattggatagtcaaaattcgtctgcctgcacaatgtatgattattcgttttctagatctgttgctatgcattgtttctgtgtgtgccttgttggagatagtgcaaaaatctcctatttacaaagatcttagagcacaggtgaatgaggaccactcatcttccccagatgtggttttcacaaatgaccacatcatcccatttcagacaggcacaatcacacttgtgtgtctattttttgaagcttcctggaaattctctcaacatcttaatcagtataggatataattctcctactgtaattatttctgacatgtaacctaaattctttctgctccaccctgcattcactgaagagaaaggacatcacgtttgttgaattacacagtcacatgtttgtcagatttgtcaaaatgtgcatctcttttcttatttttgcttccaggatgagagcacggtctgaatacagtttagctggattggtagcattgtccactctgggacctagcaatcctttgaggcctcagggaagtgtcacataaatgaccagactgcatgagcagggagggctgagctgtgatgcttggtctactggatctgacaagcccttggcatgctgggtttcagaacctccatggaagactgatatggaggcctggctcttcttctgcacactccatgtaactccatttgcatagtctaggggcgttagaaaccaaccactgttttaagccaccatggaagcatgtacgttcgtagctgtagcttgtacctagctaactaccaaatatggttcgggtgctaggaaggatctggcacccatggagtccaaaggaggttgagagaatagaaaagcatttcaaagctggttcatgtagcctctttctttgctttgaaattctgagaaatgaggattgtgtttcttaatgtgatttttatgtgatattttctggcttgattttaactttttattttggcataatttttttttttttttttttgagacagagtctcactctgtcaccaggctggaatgcagtggcttgatcttggctcactgcaacctccacctcccaggttcaggggattcctctgtctcagcctcctgagtagtagggattacaggcgcatgccaccatgcccagctaatttttgtatttttagcagagatggggtttcgccatgttgcccaggctggtcttgaactcctgacctcaagtgatccacctgccataaagtaggttcaatatttgcaatgaggaaatagatatggtactattttctcatctctggacctgattcaggtgttgtcagttgtgctctttacaacatcatatccttttagtttaatctcaggcaactttcagccttccattgggccgggatattgactttttgaagacgatacaccagtaattttggagaatgtgtcttaatttgggcagtctgtttcctcaggataccatgatttaggctacacaatttcagtgggaataccacagaagagaagcagtgttcttggtgcatcatttcagggtgtcacgtcaaggtattgaaaactgtggtaggcagaataatgtactctcaaagatgtctacatcctgatttccggaattttttaatatcttgccttacctgacaaaagagactttgtagatgtagttcagttcaggatcttgagatggggagattattctggattactggggtaggctcactgtaaccacagggattgctataaaagcaagaaggaggcaagtgagtcagagaaggagatgcgaccatgaagcagaggtcagagtgatgcagggccatgcgccaaggaatatgggcagccttcagaaactagaaaaggcaatggaaggatgctcctttagagcttccagaaggagcacagccctgccgacagctcgatgttagcctggtaagactcatttcaaacttctgacccccagaacaaatagtttgtgttgtttccagccacaaagtttgtggtagttgttataacagctgtgggaaacagacacagaaatcaatttagaaagctgggctactgagctgaggtggaggaggctctgagagagggctgccacgtggtcagggtgggcctctgtggaccttgggacaaggtgtctcatcccccttattggcgtctgtggtgctgcccactgttgggctgtagagtgtctgggctgtcctcagatggcttgtgcttaacatcctccattatcaatggcatagacagggtgagatgaccaggttgaaggacttttatttgctgccttccttagggcgtttagatccacatagaaaatttgctaatggttttgcattgatacccacaggtagttatggttttgcttttgggatctgagcaatacacaggccttcggtagttttctggggttctttataggatcttataatgagggagtagagaaggtgaggagagtgcttgctcacctcaaatattatataaattatgtttgctttcttcttgagagctgccagcaatctgattagtccatattgcaaaagtgaaaacagacactcagagagcttgagtcactcagacaaagttacacagtggagctgggatttccaggcagatctttagcattttgaggtcctagtctttccattccattaccttacctctgaaaaatacgactatgttaatactttgaatccagcaagcatttactgagcagaactgtgctatagatactgggagggcttgaaagaataagaaaatgaataaggcatagtttggattttcaaatatcataaatttaattattagaatacagctttgagtgtcctagatcatgaaaaaagtaaccgtttgagcttaaaggccccttcacaaaatggaacttggattaagcaaagagaaaaaataatttaagtgtgaaataagacagaggtctttggccttatctcccaagggaggttgcttttaatgagatgctattttaacagatctggagaaagaagtgtagtcagacacctgcttcttgggaatgagggcttccaattagtatcagagtgaattctcgggacaactgttgcagtagcgaagaagggccagccatggtggctgtggatgaggccttgacatttggatgcctggacattctctcttgatttctattacagaaggacaggtttatggctgggcacagctggtaaggtggcactgctcactgacaatgggaaaggctgttttggagcaggagaggagatccactggataacaaggacctcaggagagttcggcgtctctgtgctaatgagcttcaaggaaaagatgtgaactggcataatgagcaatcatttgtaatcgtcttttgagtacagtttcctgcttggcagaagacaagctgtatctgtggctcactgccagcatgggtaatgtttgtggtagtacctgtcactttataacagtgtcttaatgtcttatgcaaattaccttataacaaagattgaataaagaacacccagccaaagctaactcatgaatgcagataccaaatctcatatagaaacactgacaaactgaatttaaaagggcactgaaagaattaacctctgtaaccaggtaggagttgtctcttcggtgcaaggatggtttaatatttagcatatcatttaatatgttaggttgaacaatagaaaattaccatactttctaggtaaaaaatggtcaaagattgacattttcctatggttcaacataaaagtgtagccaatcagtaagtaataatctcaatagatatatagaagttatgataaagttcaccactcattcctgttttaaaaataaaaccttttttatggtaaaaatattaatattaatcttacgagaacatcagagtatgctgacactgaagtcattgtatttaaaaatcgggaatatgaagaggattccaccattaaatactattttttaatgttaatctggaatttctgggtaactcaaagaggcatggaatggaaggaatattataacaggaatgtgacatgataaacagatacaaagaaaaatttaaatatttgcttaaaactcatgattggcctagattgttctcaaaagaagcaataaaaataatttagaaaggtatgggaaaggtaagattaattaataataaaataaatgcatttaaagtgggatttttatcttttatttttttaaactatcacaaataaaaatgtattttaaaaaccttgttacctcttggcgaggactgaatccaaaggccactctcaaattgttgtttgggagtggtccttaaagatgcttacaacttttgattcagtgattccactcttaggaatatattataagaaaataaaaagatacaacgatattttatatcacagtgctctgtatgaggagactcataacagtggactgttggaatactattggaaagtaggggctttgttaattcatttatactaaaactatttattattttactattaaaataatatttacaatacataaatatttaaaatatttcaaatttaatattaatgataaaatattaatacaagtgcatgctacagaacaaatacagaccaaatacagaccaaatttgatgtataagaacatagcaatttatgtagatgtaatatgtagatatatatttaccgttgaccctttaacaatgtggcggttaggggtgccaaccccgcaatgcagtaaaaaatctacgtgtaatttttgactccccaaaaacttaattactaatagcctactgttaactggaaaccttaacgatagtacaaacagttgattagcatatattttgtatgtaatgtgtattatatgctgcattcttacagtaaagtaagctagtgaaaagaaaatgttaagaaaaccgtaaggaagagaaaatatatttactattcattaagtggaattggatgatcataaaggtcttcatcctcaacatcttcacgttgagtaggctgaggaggatgaggaagaagaggggttggtcctactgtcctataggtggcagaggtggaagaaagtccatggaccagtgcagttgaaatctgtgttgttcaagggtcaacggtatatagaaacaatgaagttcatgtccctgcattgctaaaagcagaaatcacatagaccacattctctccacaactcaaagaattagaaaataattgaaaaggtttatcacaatttacttgaaaaattagaaagatttatgttaagtaacttaagtcaaagagaggaaatcaaagctacatttaggcactatatagaaattaatgacattgagcacgttacacactaaagtcatgggagacaagcaaagctatattcagggaaaaagcagttgttttaaatgcttttatgttatacaggaaaagataaaattaaagaaaatgagtgtctacttaagaagccaggaaaacccaatctaaggacaggaggagaaaggaatatcaagattacaagcagaaatcaaggaatgagacaataaaataataccaaaaaattaatcagttaaagtacaaattaattctttgaaaaggctaataaaataaacataactaagatgacaaatcaagaacagaagctggaagccacatcaagaaaatacggaattagaaacaggctgataaacctataaaatataaattataaattggaaaattttggtgaaaggaagtagaccttgtgttgtaagatattaaaacattgcatcacgcctgtaatcccagcactttgggagcccgaggcaggtggatcacgaggtcaggagttcgagaccagcctggccaacatggcgaaaccccatctctactaaaaatacaaaaaattagccaggcatggtagcaggcacctgtaatcccagctacttgggaggctgaggcaggagaattgcttgaacctgggaggcagaggttgcagtgagctgagatcatgccactgcgctgagatcatgccactgcactccagtccaggtgacagagtaagactcagtcttaaaaacaaacaacaacaacaacaacaacaaaagaacaacaacaacaacaaaaaacattgcaaacacaagtaatgacttaaacagactaacttaacaacttgctttcactaaaaggaagttgaccttatcttgttggatattaaaatattacaaatataaatagacaaatcagtggaaaattatggaaagttaaaacataaagtcaaaggtatgtaagaatcattcaataaatctatttgggccaacaactcatcatttgaagaaaaaatgaccccagctttattctatatgctctatacaaaaataagttcatagctaagatgaagactaatgtgaggaagataaaataaatgttctcagaggataagggtgggcacatgcagggactgaggaaagggaactctttctgagccaggtgccaaggcagatactacacctgaaaagattgccagattccaccccatagaaacacaaaacaagaatacaagttaccataaacaagatggaaagataaagctattttcaaattttaagatatctcagcatatggtattagtattttccattgagttgtgatgggtggggttttttaagactggctaagcctattagacattaatgtcacatcctgtgagtatcattggtatttggtaggagtaatttttgcctctgcttgtgagagttgataaaaatctattttcattgtggaaaaaaataaaaagataattcacctcagcatggggaatgtatacagtatttaattctgcttaagaaatctcagacagtgaattacctcagagcatatctcttgaattaaaatattcatatttgactgtataacatatgttttaccttgaagtcctagttgcagagctgattcagaggcatctaggtcaaatacatgatcttctgatgtcagtgattcattataacccttttcctgttcctcttatggggcaaatattcagtagagggcaattatttaacataatataactttcatgatgacagattcctgttaaatggaaatacaatcatatatacaaatctgcatgagttgtatgaattcatatgtcataatcaaatggatgactatgaatctgaaacttttattatttattgtatgaaaaccatgggctgttttttttccctgcccttttagtttactttaatggttgacaagaactatgtgtgctttttgatagtcagctcagaggtttatcctgactcaaaatggagtagcatacatgaaatgatgtaaaatcaaaatgttcacttattcaatgactatttgttgcattgttgctatgggccgggcggcaggggactttgttctgtaagagttagtgggaaactgttgaagccagagagaactatgatcagatgcatgtgtttgagaggtcatttggacactggagtagagaatgggctgaaaacagagagataaatgcataggccagaaggccatctacctcagggtgctggcagtggcctgaaggtggtggatggaatggagggtccactgggaggtagaattggtgagatttgtcatgtgggagtgggcaagaggtatggtaaaggacagttttagatttctggtttgaaaaaataaataaagaggaagaggctcagaatcccatcctttctcatctttcccttcccgtcacgtttcatttttgtttgattgtgtttgactgcatcaggcaaacatgaaattatagaattacaacatgaaagcacaagttggggcatgtttataatgtagggtcccagtttaagatttgggtgtgaataatccactctgccctctccctttcatgtcctcccacctctcagtagtgtctcaacatacaaaacttttaccctctactgcctatacttcttgcctgataggactaataattccccgggctcctgatttctgtctgaagagccaatcctgtgtgtgcccaggctggaactgagacaagaggctggaggaagcccactgttggctcctagaagctggttgcttgtaagcaaactctacccctccatagacttattccttctctcccacagggcaagtaataactcctgtttcccggccactttcaaacctttcacaccagtagctgttctctcacacttgctcacatccaagctaaagttggagttttctcagtttggagatttctcaaagaaattaaacagagctactatttgacccagcaatcttattactgggtatataccccagtgaaaataaatcaccctaccaaaaagacacatgcacccatatgttcatcacagcactattcataatagcaaagacatggaatcaatccaggtgtctattaatggtcgattggataaatgtggtacagatacactatggaatactatgcaggtatagaaaagaatgaaataatatcttttgcagcaacatggatgcagctggaggccaataccctaaagggattaatgcaggaacagaaaaccaaatactgcatgttctcacatataagtgggagctaagcactgagcacacattggcatgaagatgggagcagtagacgctgggaactactagaggtgggggtaggagcttgggttgaaaaattaccaaatgggtactgtgtcactacctgggtgatgggtacagtcatatcccaaaccttagcatcaagcaatatacccatgtaaaaaacctgtacatgtaacccctgaatctaaaattaaaaatgagataaaaaaataaagttggacttttctggacaccctgattgatatttgtcctaaaactcctttgggaggattcttgcacttctccacaacctctactctgtattcgggcttcactggccattgtgataccctttatctatgagagaaacatggcagggactatcctcctggctatagagcccttcagcccagactgcagacatatctttttcatacagcctaatttcagcatgacctttgtcttcccagcacctcccacctgtacagcactaccccatgtacctgggcccctaatctgcctcctgctgagggaaagggggagctgtgatatgtggaggagaggaagggaagacacacaggagtgaagccctggggagcagtttgcttgtgtccccaaagcaggggcggggcagcgtcgttgtgtatcaccagggcaaccagggcacaactcccctctgtccctccctggtcatggagctcagagccctggccattagcagactcctgtccctgttttcctctagcaagtttctctcatggagggcaaaggctgtttgtgttctttctggtacatttcacatgtaatgtacaccacagcagtggcctaagcatccgtcttaaaattctttcccccccttgtttttttacttccatctaatctctgccttagatttctttaaagggtttaattgcctttgcatcacctaagatcatcatttgaaaaaaatattgcttaaaaatttagaaataatttagaataagcagcactgatgtctttatcttgcttcctttaggggaaatttgggatgcagatttgtttgtttggcccatagtttttttttaaactatacatgtaaatatcaggagaatccacatagtagtctcgatttcatatttctctagaaaaatatgaaaatgtggtaatactggcttggctttccctcttgaaagcaaaccattggagtggaagagatgccaccccattcatacgtaccccttcttccccagatgaagccttggcagatcacctacatctactgagtctcaggtctcttaaccataaaacaggacaataaccaagacctcacaggttgttagtagatcacatggaatcaaagcaccttgcacaatgtctgataccaggtagggaagcagtcagtgtaggttgctgtcctccaaacagctggtatctagggttaggaggaaagggtgttttaggaaagtgtcttcgggacatcagtagaagttacttggaaggaacttggaattcactgggatcattcatgtatcttgtaatatggacctcgcagaaaccttgtcactctaaactcctttctttcttgccccacatccataacatcaataaatcatggcagctctactttcaggacatacctggaattcgatcgctcctcaccactctgacccagggcaccatcatctcttacctgattatggaactggtctcccagcttcgcttcctgcttcttcccgtgaccccctgcacccttactccacacgaccaccagcatgctaacgccaagagcttgtcaggcctcctctcaaagccccggttggctctccatgttgtccgggtaaacccaccgctctcgccatgtcctacaggccctcatcacctagctgcttgttccctctttgacctcatttcccaccaccctcccgccagctttgtctgttccttttctctcccgtctagcttccttcttataccctgagccttactatcatctcacgcactatgtgttttacttacttgtcttgttatttctctacccagttgaatgcaagctctgagtggggatttttgactgtgtgttcactactgtactactgtatccccagatccctgaacaggatgcagcatttcagtgggtgccccatacatgtttgttgatgaaggaatgaaagtgaatcaaagcaggaccgaatgtggcattcttctttgcaaagcaaagctatcaagtaatgcagcaaattaacatttgttatttttatagaggcagttagctcctgtgatggaactgagagcaataaagggaaaattacaggtcctttaatattttcatttgacttaatgtaagagccactcaggaacgctgcttgttaccctttggatgtaacctctgttaattcagccgggcttgctcccttgaaacgtacatttggtagggcacactgggagttgcttgagcttttgtttttttcttttctttttctttatcttattgtttttgaagactgccaaagaaaattagtagaaatgattctacactgaaagaatagtttctgcttcactagagtgaagtagatccttttacagatacaaaaataagtaaatgtttaccctattgttaagatgctttatggtttctcgcctataaaaagcctttcatttgtatcatgtagccaacatatttattatgcctctactgtgtgccaagtgctttgtaagatatagagagaagtagtgaaacaaagtacttgcattgttttactacttgagtaactttaattggatttcaattacaattggatcacttgcaatttagttggagagataatgcaggttcagaagaagttacaagaggaggtgtgtcagtacaataacagagccccagctttaacagcagttggggctagaatatgccgcaggttggccttggcttctcaaagcaatgctcctatttattcagctgtgaagcaggtattgctatttcctctttattgattagtgaaccgagatgcagggagtctcagtagctggcccaggatcaccaggtgagaccacacagtgggagaaactgatttttttttttttttttgagacggagtcttgctctgtctcccaggctggagtgcagtggcatgacctcagcacactgcaacatccaccacctgggttcaagaaattctcctgtctcagcctcccaagtagctgggactacaggtgcccaccaccatgcccggctaatttttatatttttagtagagacagggtttcaccatattggtcaggctggtttgagctcctgacctcaggtgatccacccaccttggcctcccgaagtgctgacattacaggcttgagccaacatgccgggcccagaaactgaattttaactgagatcactggacccaaggtcatttctttttctgatcaaacatggctcagaaggggccatggtagctgtgaagagggaatgatcataccttgcttgggataggcccccaaatctggccataaactggccccaaaactggccataaacaaaatctctgcagcactgtgacatgatcatgatggccatgacgcccacgctgaaggttgtgggtttacccagggtggaaaaccgcttaaaggcattcctgaatcacaaacaatagcatgagcgatctgtgccttaaggacatgtttctgctgcagataactagccagagcctatccctttgttttgccccatccctttgttttccataaggaatacttttagttaatctataatagaaactgtttatcactggcttactgtaaataaatatgtgggtaaatctctgttcatggctctaagctctgaaggctgtgagtcccctgatttcccattccacatgctatatttctgtgtgtgtgtctttaactcctctagcgctgctgggttagggtctccacgaccaagctggtctcagcaatatgtgcagcgaaagacatcagagaaatgtgaatggctttacacagacctcaagggatatagttggttccttgggacaagtgtcagggcagtgaacagaattagggaggtggtaaagatggcatgctgaggacagctgtaggcttgtccgcagtttggttatgtgtttattgttagtggtggagggatgataaggtttgggggaactttgcagaatcgttccacttttgggaccctttctaacttatgagagccgagtttatagaaaggagccatttggggccaggcgtggtggcttatgcctgtaatcttagcacattgggaggccaaggtgggtagatcacctgaggtcaggagttcaagaccagcctggccaacatggtaaaacctcatctttactaaaaatacaaaattagccgggcatggtggcgcacgcctggaattccagctactagggaggctgaggcaggagaatcacttgaacataggaggtagaggttgcagtgagctgagatcatgccattgcactctagcctgggtgacaagagaggaactccatctcaaaaaaaaaaaaaagaaaaagaaaaagaaaagaaaagaaaggaggcattgggcttccaagattcttaaattattctctcttggttgagaaagacagtttggcataatttatttatatttgaaaattcccttagctttagggaactggagagcttgccatgggaatcagaggagacctggtaacctagccctatgataatgatatttaccgcattctcctgaatataagacaactggtgagaagattccgtctcaaaatatccctcctgtttataaatgaacttttaaggctatactgcaaataggtgaatgtcaacttacaatattagtgtattaatttagtaacattttgaaatcgcttataatataaaattatatcttaccttcgaggtgggacatttttactcttacattttatgaaagttatattagtctttcacatgcatctatggccttgtggtcattgtcctcaatagagccaccttttgagttatcccacttagttttccagggaacttctgagagacaggactagctggatttcctaggctgactaggaattcttaagcctagctggggaaggtgaccgcacccacctttaaacacggagcttgtaactcagctcacacccaaccaatcaggtagtaaagagggctcactaaaatacaaattaggctaagagcaggaggtaaagaaatagtcaaatcatctatcatctgagagcacagggggagggacaatgattgggatataaaccccaggcattcgagccgggagtgggcaaccccctttgggtcccctcccattgtatgggagctctgttttcactctattaaagcttgcaactgcacactcttctggtctgtgtttgttctggctcaagctgagctttcactcaccatccaccactgctgaatgccgccatcacagacccgctgctgacttctacccctccagatctggcagggtgtgggctgtgctcctgatccagcgaggcatccgttgctgctcctgattgggctaaaggctcaccattgttcctgcacagctaagtgcctgggttcgtcctaatcaagctgaacactagtcgctgggttccacggttctcttctgtgatccacagcttctaatagagctataacactcaccgcatggctcaaggttccattccttggaatctgtgaggccaagaaccccgggtcagagaacaaaaggcccacctcatcttgggagctggaagaacaaagaccccccagtaacacttcaacactccatcaatgtcatttcagataaagcactctttgaagccctgtgtgatagtgtcccttgaaattttatttcgagcaacaagaactcattaagacagtttactgtttttatccattctgtgattgttggtgatttccacccactgaattgttttaagtgatctctaaaatcttgcctatgaggaggtccaacatttgcaattttgtgttcacaggtgccctttctgggcatataaaactggcattgattaaggatgtatcaggttggtgtgtttacgccaaactaaactttcacatactcaattaataattgagagctacgtaatatgaaatactgtgtcagcaatcaaatgcaaagcctgtattcttagagatataattttaataaaacctcatcttcaggttgggcagaaacagtattctacaaaattgttgtgatgaaataactagtggcaagaatacatgacattttatgtgaccattatggtttggatgcagctgttttgatgctcggggtaggttgacacagtctggaagccaagccattaaacattctgctatttaaaaaaattaccaactagtgtatgagacaggcaatcttatccaatatgtaagctttacagtcacatcaaccctgagatgaggattaaggtaaaagtaggaatgagagatggaatgaggaattcggtgggattcagagatgggtaagtgatggtgtgagaattagatgcaatctagaagtaaaattatacctcaccaagagttgagtgttgaccatattcatttattctagaaaaggatattgcttgttctttatgaagtgttctgctcacacttgcagtttttatggtctgaatctctgattatcttatttctactttaatgttggatagtcagacttcaatatcaattaaatttattagttgaaattggaatttgatcaataggaatatggtattttctattctaaagaatggactcacctacttttgtgagttttaattatatgattaaaatcataattattcttataatttcttgttaaattattatttcaattaattatatttgtttgactgtgtagtagtcagtggttgtttgggggcaggagagggtgtggaggagggtgtttgaacttcagatgcccattaagtattcaattaatttttaacaattatggcctcaatcctagtaaaatatatattcaagttagtattacaagtcttctttataatgatagtttggaagtaataataacatttagaatcaaagccagttctaataggttttctgaaaatatctgttttttccccccgattatctttttttttctaataaatacacataactcttaatccaatatggtgccccataattggagagttggttaggttcagaacagaggcagggatgtgagtagtgcatattggcaaaaattttaaaaaaggagttttacatcttgacaggctcattttgatgtggtgccattaacatgtctggcacatacagtagacatttagtaaattttagtgccctttgttttcccagatcagttcaccaagaaaggaaaagcagtatggtgattacacatatgcctggtgttctgaagctttcttatatctaggaaaccaagatttaatggagaagattcaagatgatatggatccccactatgtatggcttattgagagagcgatgcagaactaaagttgggagaaaaatactatttgggataagatggaagatattatcccatcttccatcttaattaatagtaattaataaggccaggcgtggtagctcacgcctgtaatcctagcattttgggaggccgagacagctgatcacttgagctcagaagtttgagaccagcctggacaacatggccaaaccccatctctagaaaaagatacaaaaacattagccaggtgaggtggcgcacacctgtagtccacctacttgggaggcagaggtggggggatcgcttgagcccaggaggtcgaggctgcagtgaaccgagatcacgccactgcattgcagcctgggtgaaaaagtaagaccctatctctctctcacacacacacgcgcacacacacacacacacacacacacacacacacacagtaattaataagctgtttaaagttcagcattttgaagctgtggagcctagctgatcacccacgattatagaggagattaatattagagtaaatactgtaggttagggttagagaatgagcaccgttggcagcacaattattatgacagttttcttttggaatggactgaagacattggcatacacatggtatgatgtttcagtatatcaaatcagggccattcttgcaccaccttcttgtactatttgaaggttttttccattatgtaagacatttgctaattaaatattttcttcaaagaattaagttcagaggacttacctttgcatttcccagccccctgtgaatatcttaggttataacatagtgctttctcgtttgcaaactttcattatttaactgtcaaaatctccccaaataccctttcaggtgatttcagtacaaaatgtgatccaaatatcagagagccttttattacctggacttaaataccacagataactcagggagtttaagctgacagtttctcctggaaccacctcttctgaagcacgtttagatcgatgtcaagattggtttttgctggcactaaatagtcacagctttgaaacctcctgacccacctgccccaggaaacattagcacccagagctgtttcctaatattaaaggtgctttgaagtacagtaaacagtgtcgactcagtgtccagatgagcatggccacagctccttgatttgtttattctcttcaggagcgaaaaaagttataaaattggtgagagccccacagtctcagattttaaccagatattgcacaggtactggtcattttattcattagcacactagagattcagaataggtgtggattttatgtgtgtgtgtgtgtgtgtgtgtgtgtatttacacaattcctaatatttgggtcaataatacttgggaccaaagtgtgtgataggagaaataatgcagacttcgaagttaggacaacctggtttctaatctagactctgctgaacaagccatgaaatctctctaaacctctgtttcttcatctgcaagttgaagataaaatagatctatcctgttggagatgaaagagaagacatgtaaagtgcttagcacagggtgcaggatagcacagatcatcaataaatagtcatgatgaggataatgatgagaagcagaactgggacctgtgtcccctacttggtgtggccgaatgtagactgtgtgtacctttgtgtttctggttggagccacctgctgtcacttgtactctgcatcagctctagacccctccttccatgtcagaccttgtatttttacatgaatgtgatatatatatatgagaaaagatcagtctatgttgcttagagctaactcactagcaattggccctttcatatcttgatttgttgcaaatgtgagttactgtttagagtagttttgaaattgagcagatgctgttgagttgatatattctgtgattggtaccacaaggtagaagaatctatgttattatagaaaatacaaaatttgagacaccactgtagttctgacagaaggcttgttttgctcagagaatgcccttttaaaaattctgatgagattgacatgtgacacaagaatggcagaatgttgataaggggttgaagctgggtaaacggtttgtgggggttctttatactgttctctttacttacgtgttcgttggaaaatttccacgatgaaaattttcatatttaaacaaatgctgggatggttgccttcctgttgaaatatttggaagtccaggcatattttagttccatgtctggacttcatgtggccatcttttaggtgtaatttaatgtagcatgccattatttgtaggataagattattttaaagggtgaaaaaggtgaaagctaaattcaaaagaaatgtgtgaaagttatctcagtgcaaagagatgaagcttagaaaaaaatctctcaggctagctgctacttcactatcccctggtttaaggattatgtaaatgaaatcttctgtgtatccacagctatgcatacatttatacttaatgttcccatcagaagaagtaatcagtgctgaagcattattgagatttagaaattctaccatataccacactcaaatggtgaaaaatgtttcaaaaatagcccttgctgcatttaaatagcctattaagagtagacaggaaaattccactggcacggtggaccgtgaggctattggacagatccatgtattaaaagcttaggctaaatttggctctgtggtgtgtaaaataacagcagaacctagtataaagcactttttctgcattgtttcctcaaagatccatatgtgtaaagggaatgtatttttcttaagccaggcttgtgtcgtcaggacctggtactacagatgacttgagcgcggctgtcaccatcaaatgacagcatcttcttactttgcaaaagcccctgtgagtgccctagttagcagagtttatgcatctccactccccactagctgggagctagtggccaagtcatattccctactgtatgtcctgccaactggagaaaggatacttgttcccttctttctcagagtaatggctaagggcatccacctcgagtcagacctgagtctggcactgcctcctaatagttttgaaacacatggccttgtagattctcagaatcctcactgtaaaaatggaataatagtggtatctatgccatggggttcttgtgaggggaaatgagatacttcttacttaactggcaccccgtaaataaacagttgtgtgaattgtgatgatgattatgatgatgaatcatggactgagaagtctgagggttggaacatgtagcttgctgtttcccaaggttggaaattgccacctttcttggttgtcatggagaattcagagatgaactttgtaattcttactcagaagggataggaaatttttgtttaaagcttgaagcacgtgggagaaatgtagacctgatggctatttgaaatacacatatgcccttgcacactggattcaagcccgatatttacataatggccattttatttaggtagaagttgcaagatttcagctccatctgctcaggtctctgctgaggcagtgatggaatcaggccgtgtgccccggagagtgcagagggaaaatttccaggaaggctgatgcctgggaatgttgattccctagttctctcgtcagaaactggccttccaaatctctaggaggttcttttccttttctgccacatgacgtgattcatgatcatatgccaagagtgacctaccagttcaggaatggcatatctctgcagggagctttgatttttggcagaataactgccttcaggggacatcccctcatggacggcattgtcagaaaaggacggtgttaggtggtagtaaatgactaacctcactgcggcgacatctcatgaacatgaccacatcttgaatgatattcaggcctcaaagcaatgacagccatgcagcagtgccacatttcttactaaacgaaaccatatcctactaaaacttcctactaccagggctccttgcagaaatagctgattctaggtgtgggtaggaaatgtataagatgcatctggaatagcttgttatcccctgaagcaaggaggctgtcaaagactacctggagtcacttcaaaaggacacagaggccaacatgaaggtgctcccagtagcctgaaatgctgcaataagagcatgaaaggacaatgactaaaatgaattgaaacaagtcaaatatataaaaacaaatgggctcttaatgaccttatttttttaaaaaaagaaatgcacatgtaaaaataaactggttataagcaagtcttttccatggatttagattgttgctaatcaaattctaaaccccggaaacacatgaccatcctgtctctctctaaccctgtcattatagagcagaactcagtaagttcagagatgtgtcaatggcaatggtagtagcagggttctttagggatatttttcaagagttgttactcactggaaggaagattataggacttggtgggtagtaagcagtgcaggggcttctggcccccctcactctgcctccagggcacccagtgcatggctgacacagctttatccctctctattgcagttttgttcagaatttgtttccctagtggactgtgagcttccctgggggcaggggctctgctttattttctttagtattcttattgtccaccacagtgcctggcacacaatagcatttaggaaataaatacctgatagaatatgtctatcctgtacagaggggttcatcctcaaaatgaatgcagaaggcttcactatgaatgtctacatgtaagtattgtctcaataaatcctttattctctcttgctttgaacaagtgttttcatattattatttcaagtttaagtattaaaaggtgtgtggcttgtgcttagttactgaaatactaaaaaaaattcactatttattgaatagctacttttcgctaggctttctattaggttctttgtatagcatattttatttgattgtcacgaacttatgaaatctctacttgaaagattgaagaataaagtctcagaggtgtcaagtatgttgccaaagtcactgaactaggaagtgggcaagcccaggtctgttgatttctaaagttatctgttctttttactacacagagatacagaaatgtaatcttgggctcttcatatgttttgagtgaaagggagctctgatgcatattatccttgaaaatgaataaacgggatggtggtgattcttttaaccttaatcttttattaaaataattccctattcccatcagtaataaaccatgagattgtcaatacattgttgactcttatgtgtggtgaaccattctaaactaaatttccccttagacaaaaatataataatgctaaagagaatttgaatctatggaccaaattgtgcttgagtgaaggatggtcttattcattttgacatccggccctgaataaataaggttgtttcaggctagagcttttcagacagtcacatattgcactgaatagaatcagcttttgactaggaccctgtgcgtccccgatgtgacttctgaggctaaagctttgctataagtatatgcatgcatgtctgtctgtctactcagccattctcaaactttttgatctcaggacctctttacaactcttaaaaacacctccaaagaattgtagtttattttggttatattcattagtatttcccatattagaaattaaaaacatttaaaacgtaatacacaagcacacatctcattagctgtcagtacaggatgtcatctatatgtcatggaatctttgaacaactctgccataaacttatgaaagaataagagtagttttgactctgttgatgcatggaaagctcttgggaacccctcaggggtgcctggacatgatctaataattcctgatctatatgcttttttatttctcctcttctatcttgaacccaccctagtcaggctttctacatgaccatggcacttaaactgctgtcaaggtcatcagtgacctccaccttgtttaattaagtggtcacttctccatctcttagaattatttggcacaatatatcatttacccatccttgaactattttcttcatttggcttccagggtactagactcaattcctttttagctggttcctttttatctctttgacttcttaatgttggagtttcccatggctcaggcttcgggcttcttttctttttttaatctatgttattcactctgtggggacatcattcaacctcatgtttttatataccaggcatgtatttccagcctcagcctctcttctgaacttgagatctgtgtatccagctgcctacttgacatctcttcttaggcatctaatagcatctcaaacttagtgcatgaaaaaatgagcaccccatctccgtcttctgcaaacctcttccccctatagtcgttttcacctcagcaaatcccatctttcaggttgctcagtccagaaacatggagtcattctcgaggccttctttcatgcttctcatctcgtccatcagccaagctcatctgcatcaaattctaaaatagatgtagaatgctaccatttttacacctccactactaccaacaccgtaacatcctgcctgagttactgcagagcctcttaaccgtcccttgtcctttccttgctccactagaatctcttcttcacacagccatcagtctgttcctgttaaaaggtgagtgaggctctatcgtgtcccaaacatatcagcaacttttcatgtcactcagaaagaaagccaaggttctttaaaaaggcccacaaaaccccatctgacctgatccctacttccattacctcttataacccttccctgccagttcccctctacccacactgacatccttgtgggacctctgggcttttgcacttacagtgtcatcgtcctagagtgcccgtccccatttatctggagggttcactctgttgtcgaccttagatcattattcaaatatcagcttctcaagtgaggccttcccttaatacccattttaagattgcaattcctccaacactctttcccccctttcctgctttatttttctccctggcacttttttttgccatttaatgtatgacgtattttaattattatttaaaataattgcctctcattttccaaccacagctgaacaatctattatgacagccatttcttttgtctgttcttctattgctcctcagccttgagtgtgcctggcacctactagagtattagtaaatatttgaagtgaatgaatgaatggaaagtagaccattttatgtcttcatgttgagaaataatttataaacatatcaaagaaatataataggcttaacccagtctaaactccaagtttttccagagtatgcaaaataaggtataattgaaaaaagtcttttgtaataagatgtgactttgatcaaaggaatgtcctaattttattctgaggttaaagtacagacttatacctacaaagttaggtgctttgggcataaatggattttgtggtagaggaacttcagtgtggggctctgctttgagaacaagtacaactattcctgacttctcagacccttatcgtcatcgtcatcatcatcatcatcatcatcatcatcatcatcatcatcatcccatatctcttggacttctcatcctcaggtcatagcactgatatggagggtgaatatcacaggctgaggaaagtgggccagctacaaatctggtccattcgtacagagcatcatgcctaatactcctggggtttggcgaccccaggcttgatatgggaggacgtccaacctggagagtgggccacaggggtttggtgatgtcaatagatgttgtgcaaaaagaggtgaagttcaagagaaactaatctgggaggtaatcagttaaagtttctgttttcccagggcctttattttgcgattgtgcattgtaaacccctaataaggagataaagaatgcagggttttacatgcttaatggaattcagagccttttgttcttgtagcatctcactgggggaattcaggaatataataatgaagctttactatttatatttgttaatttttttcatctttcctctggcctccaatattaggaagagaaaggcataaaaagtaagtagaaaagtcttataattaagcattttttcctagtttgggatcaaaatctaggagggtattttatttatgtaaaattgatgtagtgctctgatgagaatctgtaaatgtatgtgagcatcagaagtcgactggacattttggagattaacattttggagattcatcaatgtgtttatgtgacagtgctttttacctgagtgtttattcatgagtctgggactggtatgcattttctggcgaacattgtgtacattttcttgatcttttgtgtttctctttccctaggcataatttacacaaaaggtttggtgagagaggagctagctcaatgttacatttaggttatgtagggattaacatcaatacttcagatttggtacagatataaaagatgtcttcccatgatcaactttgattatttcattctcctctaaggaattattctgggagtacaacaattgacataaatgtcattgcacttgtgacacaactgttgcctcttttgtaagaagagttttggaccaggcatttcttaagtcttaggatattgagttatctcttaagatttcacttcataccaaccgatacctgaacataagtcaagataatatacactaacaattgtagctactgctctggagaagatagcctatacttgatgtatattacattgtaaagcaacttaggatttgtgggtttggaaatgaagccaacttgattggtttgtcacccatacctacgttgaagcttaaggatgctgatctgggaagaatggcactggaagggaaagcaaagccaacaggtggtagagagtctggccatgtttccactggaccaacatcccagtggagagtggccactggagacagccctggactggggccaagaatgggtgttttggtctctccccttgtcaaagacactgcacactacagaacagctagaaaccggtgatggacaccagcacagcaggtatggaaatctcttctgggtgttttgtggtctttctatctgtccttagttggcttagagttgtagttcttgcagtttggtctagggactcctggggcagcccaagaccctttcaggggctttgtgaggccagcattattttcataataacactaagatatgatttgctttcatcactctcattctcttacaagtgtacaatggagttttccagaagctgtatgacatgcaatatctcaacagattcaaagcagaagtaaataaaagaatctagctgttttttattaggctggagagtaaacagtaaagatatttgtaaaaatgtaagaaaaaaccattaaaatgtcataagatgttattatattgacatgtgatgagtttgttaggggtttctttaatttgttttttgtattttttagaaacagggtctcactctgtagctcaagctggagtgcagtggtgtgatcataactcactgcaacccaaactcctgggcttaagtgatcctcctgccttagcctcccaagtagctagaactgcaggcacatgccacagcatgtggttaatttaaaaaataattgttatcatagtgatgggggtcttgctatgttacccaggctgttctcaaactcctggcttcaaaaaatcttcccaccttggcctcccaaagggttgagattacagatgtgaggctctgcagttcacctattgtgagtttaaatgatgcaatatttaaaaaaaattttcgttaaaatctaatatgataaatactaacatatcacttgcataagccaaagttctttgggaattgttttctgcacatgtatttcccaaatattgcatgtatttttatttactaaatctaacaacataacttgctaagtccttgtatttgcagtaggttttagcacctgctgtttggggagagggtggagacactgcaattcttcttactgcctgttcagtgggtactggaaccaactttaataagtaattgcacacttgattattcttgatgtctttctttctgactttgcagtggtgggtatgattttctcctggaaaagtttgggggctactggaagggcatcacctataagcgtgtggcagtgtcaacaactgatttcagcccaatctctgtcatttatcactaagtacagtgtagtcgtgtgttgtcacttatagcagagcctgcacaggtgacgcagctattgtgtttgtttccaatgttaagcccttggtatttgctaagagggatgtagagatgacttccaagaggcttcacaggtattatcttgactcattcattcattcatttctcctttcctcttttatgttccgtcttccctcctcctttccttcctttcttcctgtcttctttctctttttccctcccttcctccttctctttctctcccttccttccttttttcttccttccttccctcccttgtgcccttccttcttttctcctttccttctcttcttccctccctctttctctttttttctttctttccttcctccctcccttctcctctctcaccacctccctattatttgttcaacagctgtttgctgcattcattctgtggtgtatgagacactatgttaagtgctggttttcaggagaaaacaaaaaaggtgatattcttgccttcaggaaacttggtcagtatccagaattctttgcagtcaacttacgctaatcaaactcgcaagggaataaagaatctaaaccacaatggtaatgtgctagttcagagtggggtggcattccagtggataccctttcttagcatctgcttatggagaagcgaagactcgtatgagaacttgtaactgacagggcgggggctggaactacagcctagggatgaagagggaggtcatgggagtaaggcgatttactccactgcatgcagtttggagacctggccacaggtgtacatttgtccacatgcttctcttgttattttgattttccaaattagtttttggatgtcatttgttcagcagtttttagaaaaattataataaagtagcatatcctctgcctatgcctgctacataaacatctatttctgaatttctgaattacacactggtacagttgacttgtatgtagactagaaaagaataaggtggttgaccagaaccccatataaatcctctttaagaaataataataatcactactagctatcaaaagcatatcatgagccctagatgtattatttcatttggtttctcggaacagcccggccaggtagatattatcatttcctttgtatagatgggaaaactaatttcaggaagcttaaatgacttgcccaaggtcacacaactgttgattagcagggtccggattctgactgtaagtccagctttgtaaccacatgcctagcacattgtccctgtgttagacatagtaaagacttaagtgagatctctcaggcatgagtctgggggttctgtctcgtttctttagcctgttttaaaaaaacataaaaatagaaaagaacaatgagcaacccccatgccctattcttttgcctttatctcctatattctgataaataagacaaagatcatgattatctggccatctaattcacacttttctccagttttctcctgaaaaccagcacttaacatacgatttcctggaaggcctcagatggttaattctaggaattctcgggtggctaagtatgaaaacaagaaaaataatgaagatagagcagcaatacattataatgaaaattgccatagtttagtatctgaggatattaaatcaaacatgaaggactgttgtgtggagaagggattattacttctgccctggggatataaactaagaggaccaataaaaagaattataagcatgagtcgtggagctcaatattaagaagttgttttgttttgtttgttcatttatttgttttttaattagacctttccaaagtaatatggactcctttgaaaggtttgaattctccagcaatgatggttacatcaaaggcatgttgcgaaggtgtttggttgtcaattgtgttctttatgtcctgtgatcttacatagcaccacatctcaataggtgttcaggaactctagtcactaggcagtctatcccagaggcttataaaatgtttgccaacttagaattcgaaggctccttttaagagagtaacttacagaagctaaataaaaactataacagtggtggaggaagttccagggggtgcctttgccaccatatccctaccaggttaggaaaggcagggcagccacttctctgcttggctctgatttcaggtgaattccccttaggaatagaatgaaagtgagtagcagagcctgggcagcgatcgagaggtggagatgaacaaagtggaaggagcatcaagacggctgtattagtccattttcatgctgctataaagaactgcccaagactgggtaatttgtaggagaaagaggtttaattgactcacagttcagcatggctggggaggcctcaggacacttataataatggtggaaggggaagtaaacatgtccttcttcacatgacagcaggaaggagaggtttaaatgaactttgtttgagaggtttgagtgaaatgttataaaaccatcagatcttatgagaactcactaactatcatgagaatagcatgagggtaactgcccccatgatgtaatcacctcccatgtggtccctcccccaacacatggggattacaatttaagatgagatttgggtggggacacagccaaaccaaataaatgtcctttggagacttcccttagaatccttgctttgacaatataatgctcattctccattttctacattcataaacattttgaaaattaatatttaattataccagtattaatgactgtattatctaggttaaaaaaattaaactgttatagataagactaaatattttttggtactatatccccagtgcccaatggagggtctatatagagtagagttgaaagtacgtatttgttcatgtttgaaagatgcaacaggaaacttgagatctgggtatacttacacttttccatcactgtgaaatgttttaatagtgattttttttttttttttttttttttagacagagtctcggtctgtcaccaggctggagtgcagtggcgcaatcttggctcactacaaactccacctcctgggttcaagtgatactcctgcctcagcctcctgagtagctgggactataggtgtgtgccaccatgcccagctaatttttgtatttttagtagagacggggtttcaccatgttgaccaggaaggtcttgatctcttcacctcgtgatctgcccgccccggcctcccaaagtgctaggattacaggtgtgagccacggcgcctggccttaatagtgatttttattaaggtaatagtattgaatgataaatttggaaggcctagaaaaaaatagaatagaagaataaaaatctcacccatcgtcctaccacatgaacataatgttgataatcactcctgttattcttttatttatccctaaatatttattcttgtaataagtgttctttgttacatttttcaggccacccgttttctctcccttgtaagtggcagaggctgtgtgaacagcagctgcaattgcaaatctcatttcagcttcctaaatcttgtaattagaggaaatcctaatgagggagcaatagtttggctgaaattctaattttcagtgttgttctgggtgttcatttgcatcttgaggatcctgctgtttgagaggggccgctggagagcatgactcatggtctgccggccagatgccgtggggagcagaagtctccagtggagaggttttgataaatcacctctcagttgtcttagttattgaatctgtaagtgtgcaatgggaataacagactgcttcatctctgtcgtctggcacatatgtgatgtcaaggaaaataagaatatatgtgataaagttggcatcactcgttgtgggaaatcaagatgattcagtaatgttgctagggttgttagctgactgttcaggatagcaaaaaacaaaattttacacctttgccttatacttaacatcaaaatccattccagaggcagcatggcattgtgtttgagcactgaaatctatgtagaacctggactccagtccaagctgtgccacttattagcaagtggtcaagttacttcacctctataggcctctatttcctcatctgtaaaatggggatgataatagtagctacttccttaggacagtcatgaaaattaaatgagttactacattagttactatttagaactataatctaaaacaatatttggcacaaagcaggttccatacaattgtttggtattattaagtgctttaaagcattaactatttttattgaaagaaaccatgaaataatcagaaggaaatataaattaatcagaaggaaaaataaattcagatcaggagagtctccctaagcatgcaatcagtgcaaaaaaccacagagggctgatagatttgactacatgaacattagaagtctgtattgtatatgtcaagaaagcaaagtataaattttagaatattgaaaagtaaataaagacacacaatagttacaacatgtctgaaaaacatggagttaataggctttaaacccaatatgctgtgacaccaaagctcacaccttggattcatgttatattttggttgtcattagcccatgttcaaaattatgcttgtgtgccactcataggagtgtatgtatgtgtatacatacatgtatgtatttctttcctgctttatccataaactgtttaagtcagtttacaataatacaaaaggtacaaaatagcaaaaattaaaaacaagaaaaaagaaaaagtagaaaccatgtaaggaggactgaggctgaaccagtttggccatgatggagagtgtgacatgggaagcccgagcagtgccacagcccagtgtccacaagccccagtctttgtaattacatcagggaggtacaaatatttttgatattgacaacagcagaaaatttcttttcagagccttcaaaagagagtacggactatgtaatgaatcggaatcttgacaccattttgtcaataacactaatcatgatgacatatttcattctctgggtgtaggagatgctaccacaccaaggcagggtacagtaaggcgctttttgctgttggggatgctgatattgtgctggagcttggaggccacggtcctgggcctgcttgtcttcagaggccatgctcacgcttcctctgccctctgtgttgggggtgggatggacactgcaggctgttcctatcccacactccctgttggttggcttcttggcttctggctgggattggccaatgagaggtcctgctgggagaccagagggtcagaggaagtgagaaaacaaggtcttcctcctgctcccacttcacattgggtggctgctttaccagcagcttcccatggactggcttctggtgccagcttctttcaggtgatcttggcccttgggctcattaataacatcacctcctccctgatcccttcagctcagatatgggaacagccttccacatttgctaatctttggaatacctgactcttccttattggcttttcagcccctgcatcccctgtacagtcgtgtgtggcataatgatgagggtaaaatgaggagaaatcgttaggcaattttattgttgtgtgagcatcatggattgtacttaagcagacctagatggtagcacctactgtacaccagggctgtatagcatagcctgttgctcctggggtacacacctgaaccatatgtttctgcactgaatactgtagataactgtaggacagtggtaaggatttgtgtatctaaacatagaaaaggcacaataaaaatatggtataaaagataaaaaatggtacacctggccaggtgtggtggctcacacctgtaatcccagcactttgggaggctgaagtgggcggatcacctgaggtcgggagtttgacaccagcctgaccaacatggagaaaccccgtctctactaaaaatacaaaattagccaggcatggtggcacatgcctgtaatcccagctacttgggaggctgaggcaggagaatcacttgaacctgggaggcagaggttgcggtgagctgagattgtgccattgcactccagcctgggcaagaagagcaaaactccatctcaaaaaaaaaaaaagataaacgtgtatagggtacttatcatgaatggagcttgcaggactggatgttgctctgggtgagcaatgagtgagtggtgagtgaatgtgaaggcctagggcagcacatgactgtagataataaacactgtacacttaagctatgctaaatttatcaaaatcatacttctctttcttcactataaccttagctcacagtaacattttactttataaacattttaatttttagaggttttttgtaataacagctccaaacaaacacattgtacacctgtacaaaaatattttctttctttatatccttattctataagcttttttctagttttaaatttatatataagtataaatatatatatttatatagaatatatatattttatagaatatatattttatagaatatatttatatagaatatatattttatagaatatattccatatattctatataaatatattctataaatattctatatataaatatatatattctatatatatagaatatatataaatatataaaaatatatatattctatatgtaaatatatattctatatataaatatatatattctatatataaatatatatttctatatataaatatatatattctatatataaatatatataaatatatatataaatatatatttaatatatatttataattatatatataattaatatataaaaatatataaataattatatataaatatatatattcatatataaaaatatatataaatatatatattcataaatatataaaaatatatatattcatatatactggatatatgaatggatatattcaatatatgaatatataattcgatacannnnnnnnnnnnnnnnnnnntatgaatatatatattctatatatatgaatatatatatattgaatatatatatattctatatatatattctatatatataaatatatatatatatataaatttttttgttaaaaactgagacgcacacacattagcctaggcctacacagggtcaggatcaccagtatcactgtcttccacctccacgccttgtcctactggaaggttttcagggcactaacatacatgcagctgtcatctcctaggacaacaatgccttcttttggaaggtacacctcctgaaggacctgcccaaggctgacttacagttatttttttttaatcgatgggaattcaccctaatgataagaagtatagtaaatacagaaaccagtaacctagccattttttatcactatcattatgttctgtacataattgcatatgcaagacttttatatgcctggtagcatagcaggtttgtttccaccagcatcaccacaaacacgtgggtaatgcattgtgccatgatatcgctatggctgcaacatcactaggtggtaagaatttttcagctccactacaatcttatgggagtaccattagatatttgatctgtctttgacacaaaacattattatgcggctcatgactgtactgtaaatccttgaagtggtttctgcttttctgattgatacaaacatcagaactcactaatccaggaggtttctggatgatcatatgttgtctcactaatctgcaaaataaaaaccaatgagaagcttgaagactggcctcaccatcaagtctgcattgctaatataggattcattacttagtttaaaattgttctttgtgctacttctttgagtattattttctcaccaaaagactgcatttaggttgagattgagtcttgccaacagacttggagtcctgggcctccaattccaggactcgttaaggcaacttccgggcaggttgcagtgttataatctacttgaacatccatttacactcagtacagtgttgtgtaagatttttgctgtcatgtgagaattaccatttagattgaaaaaatgaaattcatttgtttcagtaatttatttccaagaaacttatgacctgacaaatgtaacataattatgatattttggttttctgtttttatgaaaattgcttccatttctatgttaataagaaagaacatatacataatatctcaaaagacctattaatgccacttttttattgcctctaaggctgtggtcagcctaatcaaaatggtactcataaccaacctctcacacggattactctgtttatacctccccacctgtcaaaaccctggctgggatttgcttttcatcccaaaactttctgaattctaacttccttgaaaatttcttttaaaaaagtgttttcattttatatatatatatgttatatcaatttattataaaatggaagcagccctattccagccattatttttctttatgttcctttttttttctgtttcggttctactatgctttgcactaacggcaagtacttctatcaggtggttctgtttttcatatgtgagttggtgtttgttttctttagatacaaaggtataatcacacaaatacgatatttgtaatatagatagatatgaatacacatattaaaattctagctatcattagaaattatgtgtatagtaatttaaaaaatactttttatgattgtaaattgcatacttagtgttcctaatttgggggcatttcttttttttttttaaacagtagaaaaagataagatgagagtatttgtacaaaagtcatttctgggttttagactattactttaggtagcataaattatttctcaactttcatatgatgcaggttatatttatcagcaaaaatagatgagggttggattacattatcattttaaaagtgtaatgttaaaacatgtagcttctaatggcaatatagttacagctgaacagcatggactttgctgttggaggaacctggtttctgagtctcattctgacccagatgttaccttgtgcctctctaagcatcagtttttatataactcaataataatagcatctgtatcacccattatgtagagctgttacaaaatcattgagtttcctttgggcaattcttacatgtttatagacccgccagtgtcagggttcagctctcattaattccattcccttccattggtccctcctgcacacatggcctaatgcaaactagatgtcttgctgctgggcacaaggtgtggtaagtcagtcatggtcctggagttggtgtggatattaggcactgcctgcacttctgtgcctgccccttatgcctgtgacagacatcaataatcaaatacagcactcttcctgttgcatcaaggagcaacttcagaataattagtatagtcatagtaaccgtaataatgcctcttcaccagttcagcagccatgtgtgataacacttatttgcttcagaatttggggagatattagctcaaacccattacagagtagtcatagctttagaaggaaggattctttttttttggagacggagtctcgctttgccgcccaggctggagtgcagtggcacaatctcggcttactgcaacctccacctcccaggttcatgccatcctcctgcgtcagcctcctgagtagctgggactacaggcacccaccaccatgcccagctaattttttgtatttttagtagagacggggtttcaccattttagccaagatggtctcgatctcctgacctcgtgatccgcctgcctcggcctcctaaaggattctttacatattaggaagtatacattatgtaaatggtgtacctaaattggcttaatttgaatttgcacgtaataccccaacagtaataaggaaaaattggttttgttttaaagttagtgtttcttaaaagcttggggagcgtgaagacacttggaaaagttaaattggaatgacatttattaaatctgtaggattttaggggtattgccaatgaaatctagatcaaaataatatgtaacaggaaaatataaatatgaataatagaatatataaatattttcattcatacttggtatattgttacagctgccttattaattttaagtgctatcaaaattttcaatatagattcaaatggagagtcataataatcacatgggttgattattattattactatggaggttagaggaatgatgtaaacacaaaactcaatttcctggcttaaaaactattctaattattttcaatttgagcttttctgaatagtgcaaagcagctaaaacataagcttttcctgcagttgaaagcttaggttagtaacatccatttgatgacaacatatttctgcatgggcagaaaggtactcttacagaatatgatttgaaggattcatggatagcaatgcattgtgataatagttctatctttgtgtattgtattttatttttttaatttttattatactttaagttctagggtacatgtgcacaatgtgtaggtttgttacataggtatatatgtgccacgttggtttgctgcacccatcaactcgtcatttatattaggtatttctcctaatgctatccatcccccagcccccaacccctgacaggccctgctgtgtgatgttcccgccctgtgtccatgtgttctcattgttcagctcccacctatgggtgagaacatgcggtgtttggttttctgtccttgtgatagtttgctgagaatgatggtttccagctttatccatgtccctgcaaaggacatgaactcatcctttcttatggctgcatagtattccatggtatatatgtgccacattttctttatccagtctatcattgatgagcatttcggttggttccaagtctttgctattgtgaatagtgctacaataaacatacatgtgcatatgtctttatggtagaatgatttataatcctttgggtatatgtccagtaatgggattgctgggtcaaatggtatttctagttctagatccttgaggaattgccacactgtcttccacaatggctgaactaatttacacgcccaccaacagtgtaaaagcgttcctatttctccacatcctctccagcatctgttgttgcctgactttttaatgatcaccattctaactggcatgagatgatatctcattgtggttttgatttgcatttctctgatggtcagtgatgatgagcattttttcatgtgtctgttggctgcataaatgtcttcttttgagaagtgtctgttcatatcctttacccactttttgatgttttttttcttgtacatttgtttaacttctttgtagattctggatattagccctttgtcagatgggtagatcgcaaaaattttctcgcattctgtaggttgcctgttcactctgatgatagtttcttttgctgtgcagaagctctttagtttaattagatcccatttgtctattttggcttttgttgccattgctttttgtgttttagtcatgaactctttgcctatgcctatgtcctgaatggtattgcctaggttttcttctacggtttttatggtgttaggtccttgcatattttaataactaatgacttgggaggctgaggcagaaggatctcttgagctaggagtttgaggccagcctgggtaacacagagagattgtctcaaaacaaaaaaaaacaataaacaagacaaaagaagacattaatgagtttcaagagattttgagctccttgatagcctgacaacattaggatgagatgcttttgtctcaaggtgcttttcccaaaatcattactattgtttttggtcatagcagttaagaagttttacctctaaataggtagaaaatactacaaaagcaaacaggtccctgaaataaaacaaaagcaaaaataaaaaacagagagtaagggaaaggagcaggtggtgggggacttaggaagaaagttttgaaaaaacacatttcttctaaaggtggtccctgttaatattttcatatgaagatatcttttctttgatttttaaatggaaagtgatagttttgtaaatgttgcattgactattatttcagtgtttttagcctagtagcattttctcttttaaatggaactgttttacaaaaagctgataaaactaggggaaaagataagaatgggtgatgactggttgaaagagagggatgggttgaaggaggtgaaggacccggaactcttgcagctcagcctccctttgctttcatctcccactgacgtgggaattgtgacctccccacccacccccactgaattgtgacctccccaccccccaaattcatatgttgaaaccctaacccctagcacctcagaatgtgactgtattcagagctagggccctgaaagaggtgattaagttaaaatgaggtcattaggatgggcactaatccaacataattagtgtccttataaaaagagattaggatttagactttactcagaaactatgaaagagcacgtgcacagaaaaaaagaccatgtgaagaggtatctagggagtagccacctgcaagccaaggagaaaccatcctgaggaaacagttgatggcacctcgatctcagacttccagtctgcagaactgtgagaaagtacatgtttgtgttttaagccacccagtctgtggtattttgttattgacagccctagcaaaccattatacacacttcttagcttaagaagcatagctcatgaaaacaggggcttggaataatatggcttgaaactctaaataaaattataataaatcatattaaattatttaaaggaatcatttatgtggacaaagtaggattcatcccaggaaggttcttttctttttttttttttttgagacggagtctcgctctgtcacccaggctggagtgcagtggcacgatctcggctcactgcaaactctgcctcccgggttcacgccattctcctgcctcagcctcccgagtagctgggactacaggcacccgccaccacgcccggctaattttttgtatttttagtagagacagggtttcaccgtgttagccaggatggtctcgatctcctgacctcgtgatccacccacctcagcctcccagagtgctgggattacaggtgtgagccactgcgcccggccggttcttttctttttatggtatgcatttatagataaaacttatgttcaccttgataaggttttttcaccacttcgacctacaaatagccattcttaattcagaaggatgcctgagaacagaggcagtatattaagtattgggaaggagacactttatttcctgtagatggtaattcactttccatctattaggtaataggagtgagctgaatatctgaggatttggatcatcccagcatctttgagggtctcctggttttgtgctgtcctttgttcatgatggtggccctgaggcatggcttgttccccatggtctttgggcaccagctctctggtccccaggtccacatgctcagtaccttctcttctcacctgtgctctgttcctcttacctcaccaccagccctcttaccaggtccaggtggccaccaccttgccacttgaggacttttctctgcagctgcttttctgtcaggctgttccacagccctcccatctctcacactgccctgcaagtgggtcacagtctgtatagtccctgatccctgcttgacgtgtgcaggggttctgtcacctcatctccactttagtccctgggtgatggtgatggagccccagacccatcatctgaaactacacagcatctaaaccctagttatgcccttgctttcacataatttgtggagatattttacttcaactacacatttaattaaaaatgctagggatttgttctaattcaatagagaaactgtgaaagaatagttaaggagaataaccctaaagaattatttcattattgtaaaaagttggaagcgacccaagtgtttgtcaagaagggaatgattgatcacaccagttggggtctattcatggggtaacatattatggagtgactaagatgcttgaaaaatgtgtggtgaggtgataacattcttaggatgtaatttgaaggaaaacatgattccagaagtgtaaaaataaataagtaatcgcagtaaaagaacataagaaaatatgtcaaatgctaatggtggtgtttgctggtctttgagataagaaatatttcttttctttagactttccatgttttggtaacagagcacttatatctaaatcagaattattcctaacacttttgggataatttttgttttcaaatatgattcatttaaaagtaatgtgtattattgctcttctcaaggtattttaaagtcatggatcatatgtaaatctttcattccccaaatatttactgagcccccaagagaaagactgtagctcacagctattcagatcctgggggccagattcttagactcaaaacccaattatagtactttttggttgtatgacttttggaaagttacttaagtcaggcctttccttttgtggagctcatagcctcctaggaaattgaggtgtgaatactcaccaaataccatagaatgaaataatttaatcatgatgtgtttattaaggcatctgacttagtaggttctcaaatagaatttgagaatagtatttgagaataagtgattgaaataaataaatgaaaaagaattggtttagagagtcttctccttacagaagactggttggttctatgggggcatttatgtgtgcaattaataggctgcccctgggtgaaccatggaaagtagttatccattcactcattcattcattcattcattcattcattcatcattcagtgcttaacaagtatctgcatgtgtagtgataggcctgaaaaatctctttctaatgccttttctttagaaaacacattttaattcaaataggaaaacataacatgcttaacaattggtttcccaactgggtgcaaatgtagttgacttcaaggtactagggttgaattcaggtactcgtggctatgctcagtaaggagaacttacagaaacattcaggtaagctgtatctgagactaatgatggcttggaattctgtttcaagttaagctttacccctttaaagaagaggaaaaataagtatgaagacacactccttgcattgctgatttttgtttgtttattcctttagctgcaatattcttaataatggcacatcacaaataaaagatgcttttggtttttttttctttctcttacattttcactccccttttctccatacccctctcctctccctcccctcttctccctctttttgtgctcaaatcatgattcctttgagtattttgttacaatcccaatattgcctcagaggctgagactgtgagtcttaccagcccctctggacttaggattcctcaacttttgcctcggatctgtcactttcatggtgtgaaaggcctttaagtctttcttcccttctctgctgtgccagtagctgataatacatatttatgaactagcgattccttcttgatgctgtcaaagtattataaacgacatcaccccaatttaagacgtgctttaaaattaattgatttaattagaaaaggaaactctaaagcagttagcatggcctctccctgtcagacaactagctgcttagtgctgccagacaatgatgactttctcttttgaatgtcaggtttattggaaagaatagaaagtgtcaatgtgttttgcttaggattaaacaaaccatttttttttctttctctgtctagggaggttgctctgtgcttaccttgctgacttttttcatttttctcttttagcctcacgtttccttccatgaaatgacttttttcttcctctccttcatttccacctatctcacttccccaccttgttttctacttggccctcatctgaagtcccaccgtttttggaaaagtcttctgtcttagtcagcctcggctgccataacaaaaaaaaaaaaacatatagactgggtggtttaagtaacaacacttttttttttttcttacaagtccaagatcaaggtgccaggagattctgggtctagtgagaagcctcttcttgcttttgcagatggccaccttcttgctgtgttctcttatggcagagagaggaaacgctggtgtctgttcctctccttataaggacgttaatctcattatgggggcttcatcccaaggacctcatctaaacctatttgcctcccagaggccccatctccaagtaccatggcattgaagattagggtttcaacatatgaatttcgctgggacacaaacattcagttctcagcaccctccttcatctgaaccggaagtggttccacctttctccttcattgagggttcaatcaagtgccagtcatgaagctctgtggttttatttttctctcctctgcttctctctaaacaggataagctcaggaatgccagcatttcgccctctttctgttgtgcagtgcctagcacaatgcttgacacatgttggcactctgcttcttgactgagtcagtgactgatgcatgacccattgtgctggtacctctgggctgtacatatgacactttctggaggataagacagggctagcagtctaacctcatgagaggaaccaggtattgctcatttagcttggaatgttgataactattaaacagtcatgctttcagggctggaggggaacttcgtggttcgttattcaacacctacctatttccaaataggaaagatgaatataggagaggttcagtgacttgctgagatctcacatggcagtggccatatgcctgccctgttagtttaaccacatgcctgctgtgggtcttggttactggcctgcaaatactgacatttaagtgcttcaggaaaggctaagcatctgttgatgcttcattaaagataacttttcctagtgaaagagttaacttgctttaattgaaagcatgggtttttaaagtttcctgatagcccaagtttgagagaacaagtaataaatataacatatcatttagccaatggcagaggtatcacattctgattctagaaaataaaatagccagacttcagcctcaccccagaccaaggaaatcagcatccctgaggatgggcctagtgcatcagtattttttcgaagctacccaggtgattgtgctgtgctgcagctagccttgggaaccaccctaggagtggtactcaattcaaaactgttgggaatgaggtaggctgcaaacaacacaaaataaaacaaacaaacatgcattgtgctactggcttggatttagaacaagttctcttcttgaacagacataacccatctagcagtgctgtctggatgagaggaatgtggcccaagtcacgttgtgctactgataatactgcaaagatgtcagagctttactttctaaattcttgtgccagctagcttgcactgtgtaacaaaccatcccaaaacttagtggctgaaaacaacaaatgtttatcatttctctcaattccatgggccaggtgggaattctcctggtctgggctgtctcagctaatatcaactgaggttgcaagtttctggggctggatggactgataggtggttgattcgctattggctggggcggttgggatgagatggctgtgtgtactgcatcatctaacaaactagcctgggtttgtccacagagaggagggcccaggattcttaagcaaaagaaagtataatcatgagtagggacttttcaagcctccgcttgcctatagtttgttaaattctcattggccacagaaaatcacttggctaatttcaaattcaagggtggagagatagccttcacctcttcatgggaggagctgaagggtcacactgcgaagcagactgcatacaggaaatgaaagattttgtgggcctttttgtaaccacagtataccaatgagcagaattccatatgaaacagaagaattatctgtggatgccacttttgttttatcatattgctttgtgcttcaagtggactggttaggtgatcccagccactaatccatgtatacaggcgccataggtgtcagctgcaagaggagcatgatgggatctcctgacctgagatgatccacaaactcggcatactgaagcaggaataggttatcgaaagcacagatctggaattctagtcccagttctatcacttactaattatgcgacattaggccaattactccaacctataagcctcagttttctcatctgtaaaatgggactagtaatgtacctatattatagggtatttgtgaggcttaagtgaaataaagcatgcagcaccgtttttggcacagcataagtattcagtaagtgaagttgtgaaaattagacatccccaagtgtcagagagacaaggtggaacttccatttgtttctatatagtctgactcagggatccagctggtcatgtgagcctattgtcagtgagggctgactggggtgtattgctgggatccctggctccccattccatcgggaaacccagtgtgcctgactttcttccaggacattctgtagaaaccactgtctgttgttctccggcctaaaaattagatttacacctcatcgtccttcatctatattcaccttgtgcgggtgagctgtaaatgaggcagtcctttgactgctctgttatttgctgttgccataatcaggagagaagctgaagtaatacggctgggtaactggttgtgatttcagtagtgggcctgctgggtttgcccacaggccgtgttacaaaatgctggcagctggcaagctgcacactttgtgggtccctaggaacctgagaaggctggaaaacacatgaattatacagtttgacaacgtgaacatggaaagggcatgtcctttgtgactttagtttttcattaaatgaactgttcttggattcagaatctatatataaatttccttatgtctcactgtttcctgtttggtatgttgctgccagtatagattaaaaggagtgactacaagtagaagaatgcaaaataagcttctttatgcaggtctgtttcttatatacgtgccaattgcaaaaacaggagactgttattttctttcatcaattgtcactctagatgccttttgtccccatgttgactggcctgggtcaccggagtacagtgtgtcagcaggatgtgtctcaggacaaatgctgaaccagcatcagcgtctttctaaggcaactttcttcgagataggaaaattgttacataacatgttgttttatatctcttaaccaacaaacattccattaaaaggaaatgctttatgtctttcttaaccaggtgtttactaaccacctcctccctccttcccatcattattcctgtctttcccaccatcttgcagactaaaaatagcattaatcagtgtttaaaactgttcctcagatttaacgtttggcattggagacaactccttaggtccagaagagtttcaattctctgagcgagcaaagatgcagtataaaaccagacccctaattgcagagctgcattgccaaaggctctctctttggaatcccaagcaatggattttggccaggtgcactccacctgcttctgtcgcctgtgggtggtgcagaacccctggtatatggcagccccaaaccatcagtgcattgcccttgagctgtgtgttgtggaactagatcaagaaccatctgttatgtgctcttgattagatggactttctctagaaactgtgcttagagtgttcaggaagattctttactttagcactgaagtcaagatggagcattctgaaaattcataggcagctttgtggttactttgtcttgcggtttttacctcttaaatgtttcatggatctttctcttttttcctttcctgtatttttcttcatataacatgaaatacttttttttttttgatacagggcttcattatcacccgggctggagtgcaatcctcctacctcagcctcctgagtagctggggttacagcgtgtgccaccatgcgtggctaatttttttttatttttagtagagactgggttttgctatgttacccaggctggtctcaaactcctaggctcaggcaatccacctgcctcagcctcccaaagtgctgggatgaattactatttaaaattattttattcaattttttttaactgtctctcacaagagaatataaattccatggaggagggcctttgtcttgttcacagccgttatctccagagattacagcagggcctggtgtgttagtctgttctcatgctgctaataaagacataccagagactgggaaacttataaaggaaagagatttcattgactcacagttcagcatggctggggaggtctcaggaaacttacaatcatggccgaaggggaagcaaacacatcctgcttcacgtggcagcagcaaggagaagaatgagtgcccagtgaaggggaaagccccttatacaaccatcagaacttgtgagaactcactcactatcaatgagaacagggatagtgggaaaccgccctgatgattcaattatctccacctcatctctctcacaaaatgtgagggttgtgggagctacaattcaagatgagatttgggtggggacactgccaaaccacatcacctgggttaggaactactatacccatggctgtgataactactatagctgtgtcactttcatgtaatcacgtgtagtttaagtagttgtgggatgaatgagtggatatagctattcccgcgcctttgttcagtttctctttcttgcctgctgttttgtcccatgcttcccttgtttcccaccccaaatcagtcctctacacagctgtcctggaccatatcatccccttgtcctcctcaagggatccctgttgctcttgggaatttggtgttgtggtccgaagacaatgaactgaagcatagtattgttctacgctcatgcttctctttcttgcctctctttcattcattcatccaagtcaatttgcttaagcatatgtacgcccagatactgagcatggtacccaagagttagttttcccctcttgccatcctccgtccctcccactctggtagtccccagtgtctgttgttgccgtctttatgtctagcacataatggggatagcggtataccagacaaagccctttccctcatgaaacttacagtggaattgggaaacagataccaaatgaggaaacaactacataaataatgtagtgacatttgctgtgatgaaaaataaagcagagcagggggcagagagtgcaggagtggagggtggtgtgaatgatgtgctttctcctttgccagaagcaccttttcccttcccttctgcctgagtcgcccccagttatcctttaagaagaaggctgaaagccctccttgactgcgggactacagtgagtgagggccttcgctggtatctccccatatctggtgagtgagcccgtcaggcacactgggctttacacttacttcatttctgaaaccccatctcagctgtgagctcctgaaggcctgggcagtttctcattcattttttttcctcttatgcctagcagggtctggcatacagcaggtgtctaataacagtaaaattatgcaatgctcacatcagtgcttcggctagtattttctttaggggaaccaaaagatagcaggaattcgatcacatttttttaaaggttgggatgttcttttcaaggctgttttgttgaatagctttctttttcttttcaaattaaaacaattaattttatcttcttttgatttttatttttaatatttattttatttattccagttttattttagactcagggggtacatgtgcaggtttgttgcctgggtatattgtgtgatactgaggtttagggtacaatggattctgaacatagtacccaatagttagtttagcctcctccttccctcctccttccccacaagctctaggagtccccattgtctgttgttgccatctttatgtccatgtgtacccaatgctcagctcccacttataagtgagaacatgtggtatttggctttctcaataaattttttttctaatatctaaagtatatatgcttatagaacatttggaaaacactacaaattatgagaaaaaagtgggaaaacccataatttgatccctgttgactttaggcagtggaaacatacttgctcatagccttcagatctatctaatttttataattttcttattatcatacagaatttttcacatagtaaaatactgtgaatattttcctgtgtttatgaagattctggaaatgaatttattattaagcctagcattccttattataatattccttagaacctaacacatgggaattctttgaagatggggctgaagttaaattcctccagaggagatttttgtttgtcaaggccagcccttgcaggtaccatcaatgaggggactatgaattcatcagctcagaactgctttattatttatgaatgtatgtatttattatttttaaagacagggtctctctctgccacccaggctggagtatagtggcatgatcatagcttactgtagcctcaaactcctgggctcaagcaatcctcctacccacagctgggactacaggtgtaagcctccatgcttggctaatttttttttttttttttaaattgtgttagagacaggttctcactatgctacccaggctggtcttgaatacctggcctcaagtgattgttcactggtctcccaaagaactgcattaaatgaaattctccacttgagattctaactcttgccctgacatgggactgtggacctcaaatgccatggccaagttgtgctcaccacttcaaggaaagggtttctttccacttcccccaatagccaggtcaaaacaggcaacttttctttatgctctccttctggggacaggtataattctaattcaccatttacaggtaccttaattcacattgaaagtgtaaccccttggggtcttaaccttatgcaggttaaggttggggagaagagggtgtgcatctcctggtagacttctcactctggcttagccgtatctaaactttatatctgattggtcccaccagtgcagctgtcaaaacagtggaagatgccctctgggctaaagcctcccacaccattttattggccttgtggaattcctgactttctgctagctcagcaatgcattgaaaacaagcttatattttgtctggaaattttgagttggagagttgttctgggtttctagcccactcataatttaagaagtggaaatgccagtaatatatttaactaactatttttggatatttagtttgccattactgttttgctattataagtaaagtatttataatgaacattcttgtagtcttatctttgggcatatctttgattttttttaaagcatatttatagaagtaggattgctgggtcaataagtatagacattttaagggattttgataaatgctgccaaagtgtactccagaaaggctaaatcacattgtgacttcacaaaaacgctcatttactgattttagccttctatagaacatgattgtgaattcttctgagacatacacatggagcagacaggaaggcccaggatgcatttggagttacttgagtttcagatttacctggttatctgctgaatttgggaagccaccagaaatcataatgtgcacaaatccaagattcttcatgggcttcaaagggaaagaggcttgggtaggcttgatgaaaatgcccagaatgtggctctgtgcatcttcctggtgtcaggaagctagtcccagccaggcaggggaattggaggagtgtggacaatggaatgtgatgtggcagaaacgatgtagctggggctgcgggtcactaaggcccccagcaccttatgaggagtgctcttttggaggcagagtctagtgatgcttaaagagccccagctctttggttgtaaattctctaataagctcaatactcctaacaactctggtgaaaccaggaaatgatctgtcttttttatctgtagccaaaaccaaactcttttttagcctgcagggttggaggatgagactccaagcatgtgattccagccctgcccagagggctttgctgtgaaaaccaccaggctccaatgtgtatcaatttgagttttggagttttattttacagaaatcaaattttggcaatactcaaggccccatgaagtgtaatgaaagctcaggaggacaatatttaatctgaataaatatctgttgtccttccttgggtgcaggcttgttttgcaattaggactttagaattttaactcagtgtaatgtatatttaaatgcacactgcttgatgtgctttaaaatggcacgtgtaaaccctcagtaacctatttccagacatcgttttttattccgtgactatgtatatttgcatgtgtgttttaaaactacaaaatggttgtctgcagcccccttgggttcaggatgggtacactggaacagtgatgatccccagggccagagatggtctgggactctatcagccagagctcggcaggcaggaagcagagttcagcacagatggttcaagaggctttactgcatggagtgtttgtggaagtgtgggaagtgttaagggaatccacagtggagttgaggcccccaaagaccagtaacaatagcatgaagctataaccactgcaaggccggaagaggcaaggagagaaaatggtacaactggtcccagtgagatcagaagtcataaaggagaggtctccagacaggtatgaattgacctagggactgccagaaatagttcaaagcaggatggagcagggcctgacctttcctctcctgctggtgcctctcccactggcttacaggaagttaagatcaagggaacctgggtaatgcagtccattgggtccgttcccctgggcacagggaacagcagagattggatttggggctggcagaaggttgcatctttgtctctgggaggtctcaatgcacatgtatttcacagatagttttatttaattagttgtcacttgcatcatgaaagagcgatagagaaagagaagaggaggagatgagaaaactttagcttctacttggcagaacagggtcaaggtcatgaaccttctccaaagctcttcccttcccttatttgagcctggctgatattgaattatttacatagggaaattaatggtgctgatgtgtgcatcccagtaacctgacatacacctggcagggattataatgtagagattgtgtttgggcacaagtggtcttcaggaccctgattggagatgcaggtcagtaaacagaggaggaaaggaggctcacagagccttggtgacttattccaggtgatagagcttgcacttggtaaaatcaagacatctaattattagttcatgttgcttacttctgggtgttgtataaattgggtattaaattaaaataattactcctatggaatatgcatagggatttgcccatatctggcaaatgagagcagttctggtgctcatccaaatgatctgtgcagacctcctgcatcagaagcctgccagctggtccttatgccagccaggccaaggagctctgtttctgaagtgcagggggtcctggggtctggatctctatggtgtggcccagagttccctccaagtccatttggtacagattagtcttgcaggatactcatttttgacaaaagggttctcttgtcagaaaagaaaaattggagaacactgcattctgcatcttcctcttggagattcaaaatgtacttggcatattaagtctgtatgaagttttctggtttcctggataattttctttgagagtgaattatttaaatttacactttttatcttttgtttttccaactagttatgtaatcctttagtttggccttcaacactgaggacagtgtatgtccactccatattctaaattacaaaggaatttaggaatttaaaaggaagtgcatttcagttgctcttgcacccatgttaattcctgagtgtcatgcagacatttctttacttttccaattttctaacagtttgttgcttaacatttcataggcagcctacctgggatgtgcagccacggatgtttctctccctcattctttctgtttctcttttcctctctcctctttccttagcatccctttggctctccactcacatccctgggtccatgggccgtgggggaaggtatttgcactatttaggtcctgggcattcttggaggatgtgtagcccttcagactctttagacagacacttatacaaaatgaaagtttcttctctaatactggccacttttcgcagcataatttaaatatactgtatgctaacaaagtctggggactcctaataggaggtgaggagggaaaggaaaaaagaaagaaggcaataaatgatggggagagaaaacctgcatttacttcaactgtaaatgtgaaagaagcattgactattcttcctatttgcagatgatcagaacagggcagacatggtgccttgttcacagccacttgctgaggagggatttggttgctgattgttccttaggttttggaggaagaagtgaagattggttcattgttaatgatgctatggcacacaagatagagttaaagcctatttcttattttatgtaaaaagtcatcgtaggaaatctgacatagatttgcctgatgttaaaatcccctgcttgtaatctgagttgcttgaaacagtggtgctgaaatccaaaaccaggtgcagctcatctggtttcagttgttgtttccacatgaaagggcaggatcatccacaggggttttgagcaagccactgatggtttatcattttgggtcatggtcaggaatagcttcatggatgttactgtttcatttatgtgaagtttttgagtgtcactgagccagatattcaaatttaattcacatttttacgacaaaaatgtgaaaaatgtgactaatcagaatgattccacttcctgtggagatttgcggaatcatctttttatacaaatctaattgtgatggcttcattaaaatgcaaattaaactacaaacaaccgaaacccagccaaccatccaaaacacttaagcatttggaaatatttccgtcctctgcttaaatagacattggagacatagaaaggtgagtggtgggagagggaggagggatgataaattacctaatgggtacaatacacactatccaggtgatggttacactggaagcccagacatcaccactacgcagtatatccatgtaacaaaatgacacttatatacccaaaatctataaaaataattttaaaaaagaatgagggaaatgcgaaacagagatcatgcatgtattttaataaccagcatttgtggtgtatcgtgtgatcattacagcttcaatttgattatctgatctttgtctgcatcaacatcaaatgcccagaataatgacgttggttcctccatttacctgtagggcttgacattgagtttgtaatttagaacaggctttccaaactttagtgcacagatgaattgcatgggaatcttgttaaattgtggattgtactgtgcaatagggcctgagatactgcatttctagcaagctccctggtgaggctgatgctggtgtgaggacccactttaagtggcaaggatttaggggaggaaatgtaagggaatgaaaggatttcatccaataaagaatcagcatacttattgcttcatacattcatcaagatgactaacttattcttggaagctatgctataacaagagttggaagtgtttactcctttcggataaccaggatgttgtattgatcagacaacaacattctttcaatgttctaactaataaaatattaagtgttataaattatggctttaacagatacacaggagtggaataacaaaacctaaagttttagaaagcaaacatatctcgatcattttaaatagaaggcagagaaatacttccatattatttcatataataagatgtagaaccagtatatctggtgaatctaaagtaattatcttgtgagaatgcagtccatagagagaggttttgtcttagtaacatggttggtcatttttctgaaaacagtccagcttttttctacaccgatttttctaataccttacagcccctgtgctttacaccaagaccatatgtgggatttgatttccctgtggacatgaaataaggctcataggaagttagttgtttgttgttgtttagttttactatgcttagtcttttctaggtattagggtcaaaggttttgaatgaaactacctttttagcagggcagaaataactcatcacattttcagttttgtattctgaaggttgggcttcttgtctctgaagagctttggagtgggatgtagcatcctttctttattctcctttttcccaaaaattgttttgactattctgcatcttcttccttttcaggtgattttgagaattagcttgttaatttcttcaaaagagccagatcttatgtaccttgtctcttatgtacctatgaaattggttgtgattgccttgcattctcaatggaggaaaatcaacatcttaccaataatgatgaagctatgttgtgtaaacttttgtgataagtcttgcagtcattaaaaggggaaaacaacttctgcccttttgatacagcagctagaaataaattatttaggcagatagtgagggtaaaggagtcctcagcaaggcttcccttttaacaaaaaacaaagcccctaaatcattgcttttctaaaaacaatcagcctgaaaaattgagctgccaacatagataagcaagctggaagcttgcacaggtgaatgccggcagctgtgccaatagaaaagggctacctgagaaccaggcatgttcaacatggaggatccatcttctgtttctttgttaccacagtgaaaaagcagacaacatggcactggccacgtagacaactcaactgcgtaataaaagattagggtgaggcagccagcttgtttgtgcactatgcaaacggcacacctagtcctaaccagttcttcacgtgtgcaagtggcacaccttgtccaaccaatcttttgtgccctatgtaaatcagacactgccttctcaagctcatctataaaatctgcatttcactatggaccagaagacctgctcgggaccccctctctctgcagcagagagcttttctctttctttcgcctattaaacctcctctcttaacctcactccttgtgtgttcataaccttgatttccttggcatgggacaatgaaccttggatattaccccagatgaatgatgccacttcattttagatacctccagtcaaaggacatataaaaggaaaattaatcttgggaccccaaaatcactaagccaagggaagagtcaagttgggaactgtgtcaggcaaacttgcttccattttattcctaaataacatagctgtttaatacaaagataaaaaggctgcatacctccctcaaaatttgcccacaaggggccgggtgcagtggctcaagcctgtaatcccagcactttgggaggctgaggcaggcagatcacgaggtcaggagatcgagaccatcctggctaacatggtgaaaccccatctctactaaaaatacaaaaaaattagccgggtgtggtggtgggcacctgtagtcccagctaaacgggaggctgaggcaggagaatggcgtgaacccaggaggtggagcttgccgtgagcggagatcgcaccactgcactccagcctgggcgacagagcgagactctgtcacaaaaaaaaaaaaaaaaaaatttgcccacaaggaaattcctagtaggcaaaggacagacagaactcaaagtcatcaccctgaggctcacatgagacaaatgcgtatatctggttgcttccactgccctattgtttcactaagccagtgaaggcgtaagtgactatttctgtaagttgtatattcagtggaagtctaatcagaaactcaaaagaatgcaactgtttgtctcttctctacctatgatctagaagccctcttctccacctcaagttgttctgcctttccagaggaaccaatgtacatattacacatattgattgatgtctcatgtttccctaaaatgtatagaaccaagctgtgccccaaccaccttgggcacatgtcattaggacctcctaagcctgtgtcatagcttgtccttaaccttggcaaaataaactttctaagttgactgagacttgtctcagatattttgggttcacagctgaacacatcctactaaacactttttaataattatcctttgtcaactgcagggcttatgttcctgaaaagtgtgtgattggcagaccccattgttgtgggattagtatactcaggcttgcttagcatgcaagttgtttttggtctggtgaattgtaccagtttgtttctgcaccgtttctacaccgtaacgcacagtgatgcttttttaggagtgtgttggattgttttaattcattacttctcatagtttaagtgtacaaaggtagtggaagattttgagctaagaattttgagacccaaattctatttctagattctctgtggggagggttatgggaaaccagcaagggatttaggggcagtggaggctgctggggacatttttccccaggcctaaaagcaaggggagggagcttttatcaaagcatatggagaggagatgcaattattggggccacctgaaaggcaagaggatgagatggctgctggtggtggctggctgggagatagccaggggaaccagaaccccaggctctccctcctcccacctttgcccgcccttgcatctcttgctgatgcttaccattggttgagactagagggaagccagagggtctgggcaggatgcggttcttagggattagcttcctggagcacccagcagtgtggagaagggtggagaatggatctggaggggcaactggagagaatgcagcatagaagtgtctgccagtatttacagatggtgtaaatagctagtgaaatgcaattccagtatcacgttttacttatctatatgcaaggctggtaggtgtgttacccagggtcaccagaatagaattctatccttcccacccatctatcatgcagtcattcttatatcccaaacactgcatcgtaaaacatacccctccggatacccaaatagcaaacaagagaatgtgatgatattgcccaaagcacatactggtaacacaatatttctttgaagtcccaattttatttaaaaaattcctgcaggttttgtatccaactttttattataaaatatccatgttaatcatatgaacatggaaatttcagtttgagaagctcagattaaatctgaaacataggtctcctacaaaatagtgtttaattttttttttagaaattcacttcatgcagatcagactttaaaacagctgtgtaaagtggaaaatcaaagcacagatcaaagtatagaaatgtatacaaaaataattagtgcttcacaaattcattcatttgtctgtttattcatttgtgttgattgcctgttctgctggtgagaagtattttcagcttttggtacttccagagctggaagctgtgtgctctgacataggcagcctcagatagccagaaggggcagcatctctctgctaccttccgttaccctctgtccaggttctcaaggaaggttatgaaggcactcagagttccttcttgagcaatctttagaaaacgaccacgtggacaaactgaactgaaaatactgtgtccagccttcaactaggagtcattaccagaggaagtagggtttggttttttggtctattagcaatcatccccccctgtattttttaacttccattcaaacctgcaatgtatgtataatttgttttgtatcaggttatttttatttttggatcaataaacattaaatatagaaaccatcggtgaaattgcctttgtgatcacgcacatcctgctggatctgtttgaaatccttggtaattatgtcctggcagttggggcatattgcatgccttttgggggaccacttaagaacctgtggaattttggtggtacctcactctgagattgtgcagaacatctaccaatctgagattatgcagaatgttttttcaaaagttacgtaagtaccgtgtagcctatctctttttcttcatttatgatgtgtttgtgaggcaaattaccaaaaggcatcatttaataaaaacaggaagaaagtttgctcaaagaggatgggtggccctcctgatgtcactcagtggccccaggtaggactgcagtggaaattttggtgtgagaattctggtcacactattctttccaccaaaaccaaaccaaatcacaacagccccgcctctgccacaaacaaactgaactttcaaatagctttaagtcttgaaaataaaccttaagggggaaaaagcaagctgttcttggtgtaaagccggatccacccttattccccaagcccagattttcctgtacaggaagacaggtattagcagatctgatggagggatttggtcaggtttgaatggggtcacatggaaggattccatttcctgctgctacaaaagtctgctcaaatgtgagaaaccaccagtaaagatgatttctaggaatgtagaccaccactctaggctttcttggttgcattggcaacattgctggcacatgtatggttcttgaaattatagaattgctcaagagacacttaccgagctgcagaaagagagttgccagaaaataattctctaagcacagatgtttccatagactctacagtatccctttagctctaaaagatccatctgtatcatagaaagtcgaagatgtgagcttggccaaacacgtaagaatctcttaagaatctcttccattggatcaactggaagatctaagttccctgtcagacctttgatattgcaacttaaagtgaagatatgaagtcaaggagaaaagaaagaataaaccctcattaaacacttttcagatcaagctaggagcttttgcttgtgttctcacttagtcttcctagagttggtatcctcccatttctaaagatgaagaaactgaggctcaaccaagttaatcattttgcaaagtttatccagctctcaaaagtgatcaagtgaggcccagttttgtttgatattagcacttattttctttccacttgtacccatgaagtctcttaaaattcagtggttcttcaccttacagaaaccaggagacccttcctcccatcctgataaaaggcacagccgtattatattagccacaattccaggcaattcctggacatcttgggatctgttcatggaccccagatatagaacccagtatctagagaaaggccatggtcatttgtgttttcctgctgctcctatgggacaccttggtggcctgatccataatattcttacaaggaggggatgtcctctttggccttttgctcatcagaggctaattaggttcctctaagtgatgacagagtagggagaacatacattttgtataacttgcttcctctcctagggtatttgaattaatacaataacctattttgggagggagatgatgtcatatagtttccatttaacaaaagtatggatcaagcagttattacatttgagttcctgacaatatgatatggttagtcagagtagaatctaaaatagaggaaaatgacttaattgtcaaggggaaagtagaggagtgtggtcaccaggctgtgtttctttctctgctcctgtttttagggcattatagtatagtggttagaatcttaccagtttcctcattaattaatgagtaaaaaattaatcattgattgatacatcatgttcacattgtactttatgggtattgcgatttcttcctttttttctttaacagtattctttgagactctgtagatggatatatagtctttggtatttttcaaacagaatcgcctggatttttttgaatagagattcctgagattatttcccatggaacacattttgggaaacactattccagaaagatcatggtaaatcagaagggtagctgaaaaccaaatcctagccttacataaacttggttacataccagctgtatgacggagatcaattacttcacctctctaattttcagtgttctcatcagtaagatgaacacaatcatagtaacctaactcacaagattatcaggaggattaaatacatttttagatataggacacttagatctgtgcttgatatattgtaaatttccataggtcatagctaataaattagagaattatagatttagtaaagtgggcattttttataagaggaaaaaaagcaagaacatattctatctatcttcttcatctgtttcatacccatcatcacaagcagccccttcttgccttagggaacttacagctcccatttgaaatcctgggtagagttttgtggaatttctgttctacctgagtcaacatcttctttaatatttgtacagcaggtcagcgtttttttattttttatttttttgagatagggtcttgatctctcacccaggctgaagtgcagcgatgcaatcatagctcactgtagcctcaacctcctgggctcaagcaatcctcctgcctcagcctcccaagtagctgagaccacaagcacatgccaccatgcctggctatttttttttttttgtgggacagggtcttgctctgtcacctgggctggagtgcagtggcacgatctcggctcactgcaacctctgcctcctgggttcaagtgattcttctgcctcagcctcccaagtagctgggactataggcgtgcaccaacatgcctggctaatttttgtatttttagtagagacagggtttcaccatattggccaagctggtctcaaactcctgaccttgtgatccgcctgcctcagcctcccaaagtgctgggattacaggtgtgagctactgcacccggacaatttttcttttttaatttttgtagagatgaggtctcgccatgttgctcaggctggtctccaactcctgggctcaggcaattctcctggcatcgcctcccaaagtgttgggattataggaggtcagtttttacattgctaactcatcttttattggtctaatggataactgacatgaaaactgcctgaagaatctgtataaagcaatcaggaacagacccgttctgtggcgaatttcccaaatgtagaaccctctctggcttttgtggtcacgtatgtttacagcagctctgatgcaggatagattactaccagtgtggcagatgtaagctttctctcaaacatctggctggtagtatatggaggatccctttgcctagctaaggaacatgaggactaatttacatgatctaaagaggttggagattcattgcattattctgtgcaataatgacatgagacagtgctctgtttgtgaatggggccactggagaaggaaaatctggtgtttatccgagtctcatgggatgactcacaggctttagcagacttccactggattttggtataattattatactctgggttggatactgaggatatcaggttcatgaaaaagtaattctgggacaaggtgactcaatctggagggagagccagcaggcagcaactcctggagaagaggaccatcttggatgctaggactcaaatctttgccagatcaatattcctcaagctatttttccccaccaatatttttttttctcttgaagtcagaggactaaatgtcctgaaattgaaagggttaggaaggagagaagagagcagcattctgcaacatgataccttttcaggtagatgtgtgattggaaagcagccttggcgggtgcttactgcactgccttttagggcccttctcacttacctctgttcccatctagggactaaattttcttttttccctagttttctaattcgcagttgcctctgtcctttctccctagttttctaattcccagttgcctctgtcccacttaggataaacctactcatgtatgagacatgtaattactgtatgtcattctcaaccttttaaagtctgaaggccattcaaatgggacagaggctgtgaatattctctcttatctattcttgtttactttcccagaagtgtttcccagaattggcaggaaggctcatgccagcctcagaggctttgatgacgtgatggctaatgcactgttaaaatctactaaggtaagaagtagatgtcatagtggtatagaaataaatcccccagaggggaagctggaggacaatgtgaggaccttaaaggcccatgaaccacaccgaaggatgcatttctagtgtttcatcttagtcctctcacattagggcaaattaaatccacttccttaagtcctgacacacactcggaaagaggtcaaaggactagtaccctgaagtttgggaaacttacctcccctgatggcctctccagtcataagttatgggactttgtagtgttagggtgagcacaggataagaactcttgatggataggtgggtatatggactgatgaatgaatgaatcatctggacatgggcacaagtagaagaccacccctccatgtcctgttcagaagaggccatggccttctgatttagtttactcctgattaactacatggagaatgtacacattattttatgtgctcttctttttttttttttttttttttttaagaacagaaagtgtgaagagaaaggtgtctccttgttaaagaagactaattaaattgtgtgattttattcttgacttttagagtctggctcaaggaagcgtgagtcacccagagttgaaaatttgtctagttggagccctcatcaaatggatgaatgccactaaggcatcttggtggccaaccctgccatcattcttgtctcagtaacaagccatgcctggccttcaccttgaactgctttgtggcctgcagcctttcctctcgtcaactgccccatttctgattgtaggactagctttttttttttttttttttttttttttttgcttggggtcacaccttctcatagcttgacttttctttgatcttttcccctgattaacagaagttatttctgtgtggaatggaagattgtgaactttatctttgactttaaatgccaaccacttttttgaaagctgccaacacaatattccactcctaacttaaaatggtaagagaaggcaattaagatgaaatattccaagttaccatattcctgcttttccttcctatttacttttttacttgcctatgtcatgatgtcttttaggactagatcacaacttctgagcttggggtgagggttggaggaggagcacacatccctaacagaatatgtcagaatctcactgaaaggaagtggaatttgaaaagcttagtcaacatagtgtattattttgcatttgaaaaacagcagcactaaaagtaacaacaaaaatcttactgtttcaaaatactaacgtgtcaatgtagatgaaattgtctttgaagaaaaagattcaagtcttaaaccaaaatgcacgaggcactgaactttcttccttttgcctgtaggtggaagatgtgtcatgttgatgtcaaaatctgcatatcaaatacataaatacatagtaatcctcctgtaatatcaatagtgccacactgttcaggtttaattggtgttttcaacactgccaaaggagtggttaatgaaagaggtcatttaaattatcagctcactgtcaaatactcgtgacatagagcaaggcaaaagatgtttttagtcatctcagttctaggtttcactgtctttggtgtcttaagatcttttctatatagcagatcagtcttcccacctccattgaggctgctggagaaaaatcacaaaactgcttacatgtaggcaactgcacatcatggtctttgcctcagtggggcctagagtttcatgtaaaattcatgtcatgtgtttctggttctcatcttttccagttccacatctgaatcactcccctctcctggggacctttcccgtgacctcaccccagtgctgctcagcagatgatctggtcatttaccccacaggagagatggatctgctgtgtgtgcattccttccaatttggcctttacaaaggcaatcttccctgccttctcagaaatccttcatgtttctgaggaatggctgtgcctcttcctgagtaagatgggtcctttctggtgaatctgagttgccaccccctttgaaacttttcttactgtgtgacccccttatagctcttgcctcctctttgatcagttccctctggcctagaaacagggtcaagtattgctcctttgattcttcatgcccccaagttctggaaagagtacctacttgctcttctgattcctctcctcctatttgctcaatctactgtgatctgttttctgactgccattccactaatagcccttgggaaggatcccaggaaccttctggttcctaaatccagtggacactttcagggcttttggtttttaacttgcttgagttctctgtagcaattgaaactgtctcctttggtttctatgaatttgctcctggtttgaccatacctctgggtccccagtctcctgtcaaggattctcttcctctgcccgttcttcaaataatgatttttctggactgtcttcagctcacttctttctgaacctcatattttctctgggctttcttatacactctagtagctttactaccaccatactctggtgatttccaaagtataagtgtagctcagagcatctctcagaaccttggccatatcatgctatttaccatatctctacctggatgccacagagctgtctcaaaccctgcatgtccaaaatgatgtctaatttgtttgaaggaatcaatgcctactcagtctcccccaaagaaatctgaggtcatccttcactctgttctgtccttcatctttttcatcccataagccattatgtactgtgcattatgtttcttaaagactgatctgtttcctagctccggttctgtcgtttattgcttggactattaaaaagcctcttaactggtctcattattcctatcttgccttcttctaatctgtccctaacattgtcaccaaggaatgcagacctctccatgtggcttcctccagagaaacacttcattggctctccatggtctgtacaagaaaatcaaagttctgattcttactgcctaagcctttctgaaatctgtcctctgcctatcatgccacccttgtccactccagttccacacctcccaccctgggcttgaatactattgaaagatcacagtccctagaatgcagcctgttattcctgcagccccttagcccagtgtttgacacacagtctttagtaaatatgaagaggatttcttctttgctactgttcattgtgatttgcattcttcactagggaaaatgcctaatgtaatacatttattatggattctcagaatgtatttgaaatgtgacttagtctatttacctgtttgatgagtaagtctcttctctgagaccctaactattggtgaagctcatgtaacttctggaatggtgagcgcattaactctagcaacaaactatttaatttctaggaaactatgatgaaaactttttgtgaaaacaaatttttaatgcactttttgcctgctgatgtgagttttgggtcttcctggcagagcaagtttgatccttctttactgtgatggtccttccagtgtttgaggatggctgtgctcttttccttgggtcttttcttctccctgctaatataccaaatcatatcaagtgttcttctcatcacatagtatcaactatctttgcctttttgagagctcctttttttggctccagattttctgtgtatttgtgcgtttaccaacttgtccacctctggaagcgtccaggaccactttcctgatagctgttaagttttgttagtgcagactgagattacgttagatgctttggcagcaacatcactttgttggctcatattgacgatctgtttaagtcatcccttacttctacttaagggtggaaaccacccatccctaacacctgtcttgttgcattttggttgcaagttgagtaataaatctggtgcttgtatagttaagtttttgtcctaaattttatccttgttgaatttcatcttgttaaagaaggtcttttgtgaatcctgattctggtcatgtaacattttcaacattctccctggctttttctcagtataagcttatacattggtgaagttcagtggggttagataaaaataactataataataatagatattatttattgagcattaactatatgctggccatcatagcttagtatttccatgtgtatccttggtggttccatacaacactgtgaagtaggcactattaatatctttatcttacatgtgagccactcaatcagatataggtccctcatggttgcctctggaagtcttattttcagtttatattaatttgcttatcaatattttttgatgggaattttttttgctgggagtttttaaccagctactaatacatccacttaacttgtactaaaatctaatgtgtacatttcttacaaaaactttatagtatgttaaactcttgcgtatttatgttaatgaattttcttgttactttaaccattgagaaaactgtggaaaatatagaaagttataaagaagaaaataatgatcactcttaatcttatcacccagaaatagccactattaactttttaacatagttatagtctttttacatatatacataatttcatgtttcttatgtttatcaattcttccctagttataatgccctattcttccaaaaatgcagtgtattctgctccacctttcaaagaaaccctgctataagtgacaggagagtattagttaatacagtgattatgtgtccttttaatatttatgatactagattcctgcagcttctgaaaaataatacatttacaatggaaaatagcatatttcatattacttacatgtagtattggtttgtgaaatgaaattgagtgatattgtataattggtaatacatgtgtgaatctgtttacaattttatttaaaacatatatctttattaatgacagtgaaaaggaagaaatactagcacattttatgaacaactatttttagaatagaatacaaaatcatttttcgtttagaataattacttttgctccgaagaaaattgacctcttgaagaaatctgcatgaactctgacttattgggtaactactttgatacttaggtttatttattaatataacattataaatgtatcttggggaaaatatacgagctatgaaaatgtctagttaaaaaagggatgtgtattgtttattttgttatgcaggaaaatgagttcttgtattcctaaagtatattagttatcttccttctgccctactttttaaaggcagcaagtacaatttgttacttatgtcctgtgtcccaaagagactctatgctgtgtctttaacttatccttgatttgttatttgtggacctgccttgtctattccgctaaaatatacattttttaggatcaagtgttggggccttgttttttagtatttctgggtgacccgtgtttagcatggggccttgagtatcccatgatttctttgagtgtttattgagttgaagggagtatcagaagatggtgagacggaacttaccatcatcctggcttctaatactgtccctatgaagtagatcaagggtccccaaaccctgggcttcagactggtaccagtttgtggccggtgaggaacccagccactcagcaggaagtgagcagcaggtgagggagcattaccacccgagctccgcctcctgtcagatcagcagcggcattaggttctcataggagagcaaaccctagtgtgaactgcacatgcgagagatctaggtttcaagctccttatgagaatataatacctgatgttctgtcacagtctcccatcagccccagataggaccatttagttgcaagaaaacaagctcagggttcccactgattctacattatggtgagttgtataattatttcatgatatattacaatgtaataataataatagaaataaagtgcacaataaatgtagtgtgcttcagtcatcctgaaaccattccccccgccaccctctggtcagtggaaaaattgtcttccatgaaactggtccctggtgccaaaaagtttggggaccactgaagtggatgaatgctttagtcagacagctttggtctactgttcacaagcagttgagtaccaattatgcattcagcattgtgccagatgctttggacaaaaagacaaataaggcatagcttctgtctctaagtcacgcacagcctgctaaaggaaacagttatataaagaaataagtgcagtgtagcacaacacttgctcaaagccacacagcctgtgaggggcgggactgggattcagttttttttttttgttcaactccagagctgccaagccaagatgcttccagaacagaaaaattagaagtgctgatagttttgctctactcctcagagcaaaacaacagccttgctccattaacagaaaatgcacatctttctttgaaaacattattaaattaaaccattttgttttatttgcaaattaggtcctccaaaagctggggaaagctgatgagacaaaagacgaacagttcgaagaatatgtccagaacttcaaacggcaagaagtgagtccatttgtttagtttctggagtgggaaattgtttaaatgtgtttgtgtcttagtatgtaagtaaaatgcattaagattaaaaaaagactagatggagttggcactaacttgagagtaacacttgctaattctgtagaatttcctattgaagacggggaaagagccatagagagtaggttttggaatcccaggagataaagactctgctgtcctggactgctttagctttttataatattttagtttttgaaacagggtctcattcagattgcccaggttggcgtgcagtgacacaattttggctcacttcagcctcaacatccttggattcaggtgatcctcccacctcagcctcccaagtagctgggattacaggtgtacaccatcatatgtggctaattttgttgtgtttttagtagagatggggttttgccatgttgcccaggatagtcttgaactcctggactcgagcgatccacccacctaggcctcccaaagtgttgggattacaggtgtgagctaccaggcccggtctccgaccactgtaatacagatgacggatctataggaatgctggtgtttctgaagatttatatttcattgaacattagaaaagcagtagtttaacacttctggtaaaatgaccttaattgttgcatgcttcaagagcatgcattcgcaacagggattatactaatatcttccctaaggggctgaaaattggttcttggtgggtgaagaaaacctttttagtgtataaagcatagataaacatatcttagataagcagacatatagtatacttacggtattaaaattttacagggggtgtaattcagaaaaaaaagtcttaaaagactccttggggagatgacaatgaaaaagaggttgagaaacagattgtgatgtttgttcctttagtgtatgtgtttaacagacacgtggatatagaaactatttttaaactatgtcttgatctctaaggcttggataattggctagaatatctctctttaggtaacacacgtaagggctggggaggggaagataggagtggggccgtctgaggttagaagcctcaaatctagagatcgtcttagaggtggggtaggaagaaggcaggctgagaagggcttgggaaatggggtttgcgcattataaagtcagattatgtggggaacaatataaggacatggatttcttttcctgctgtcagtggagttaccagtgtccacagagggaattatagcctcagagatgacaccaataatgggaaatcatcacaggttttattttgctccctttgctcctgaccttggaggtttctttcttccatttgtgtatcagggttcctgctctttctctcaccaagacattctatttcttttcattaccaagagggattatacatttcagcaggtatggagccaggtagatcagttttgccaaaacgcattcctgaatgtctccagtttcatcccaagactaagtgttggcatgtgcgataggtagtcagtttaccatgaatgggatagcaaacgtgttatatctgaacatgagaaaagggagaggggagctagagaacaaaacagtaacggagagaaaaattgatcatggccaaatgaacaaatattacagagagctttggcttaataaaggtagaaaagagaattcctagagaaatgttggacttgggcccacagaataagtagtctcctagtctcctctaggagaagagggtcttcacatcaacttctgttctcatttggtgatttttcacacatctcctgcgtgtgggtagctctcaaatagatcattgtcttggattgcaggaacttcccatacacaaacttgtccatcagtgccctgtgactttgcaggcaatcccaaatgtctgctctaaaatattggatttagattgaagaagtgattcatgtttacagttttccctacctaaggattcacactgtacccttcgaaaccttgttttcctgtctggcatgtccccatggagctaattaattctttgctcttggagtttttctctatcacttttatggcactttaatgttgttagcaccctagaaggttaactttggaagcatcaggtttagtaatgcagtcatgccaggaagcactttgcattttccgattacagtgaattttcattgtttttttttttttcccagctttcttgactgccccaggtgaggattgttttttgttgaaggtactagagaaaagtgcaatttgattaaatcatcaactacattggcagaatgatttgtgccactagcagcagcagcatgtggtgactttaaactgctgtcctgctatctattttggtcactatatacaatactcatcttcaaatgttatggggcatagtatattagcacccatgcagactaccaccttagttctcccaagaaatattagcagattttaaaacgtgtgaaacttcaaaacttggggaaatttgaacaagtaattctatttcataagagtaaggcaaatagactgttaatatagggaatgttatttctcagggagtctcttgaccccatttggttcactttgaaaatatttttgcatctaaaatatctagcattttcctatcctcattttgatcttttttaattagaaaaagaaagtttataatcattatagtggagtgaggaaggagagtgccttacccctgtttgtatattaggagagacaaggagaaagggaaggaggatagaaggaagagaaggggagggatttattaattttcttttgaaacatattaaaggttgagaagtgtagctgaagactgattttattaatgctctacggagagaagaatcctcttacccccaatatgtattggtgatcaatttgcatgtgttgggtatgctgaaaaaggagtggtacttatgtagaaacattaacctagaaggaaggatctgccaagattatggttacatctgcaaggtctattattcttagtattaatgtgatggtgaatcagtactctgaagagacaaagcattatctaaaggctacatactctaaaggcattatctaatctaggaaacctagattccatattttttctacgagtatatatattttatatcccaaaagatactattgatagtataaaatgaaaccatatttggatttgtgcattgtattatagtcccctgaccacactcaagtagtgcttaataaagaagtagaccattctaggatgttctagaattattcaaacatttatgggggctcagttatcttgcttttagattccttttataaaatcataagatccttatagttattgatatattccttgcttgttcatgttggaaacaaaagtggcagaaaggtctgtgtttgaactctggcttggggcttttctttattttattccaactctaagttttccttttgatctcaaacttcttttccttcaacatggtttgtgtgagactgagagcatcgataaagggtctgtacatactttgttttgtccattggactcccaattgctgtagcttttgtggttcatgtttcataaactacttaattaaaacaaggagagcctggtgccatggtgcgtgcctgtagttccagctactcagcagggtgacgctggaggatcacttgagcccaggagtcctgggctgttgtgtgctatgctaattgggttcctgcactaatttcagcatcaatatggtgacctcccagtagcggggaaccacgaggttgcctaagtaggggtgaacctgcccaggttgaaaatggagcaggtcaaaactcctatgctgatcagtgctgggatcgtgcctgtaaacagccactgcactgcagtctgggcaacacagtgagacctcatttcgaaagagagaaagaaggaaagaaggaaggaaagaaagaaagaaggaaggaaggaaggaattaggagtagtacatcagggaatagaatgaactcttctacaaaaaacttggaattttccatgacaatgcatgctaaggagagcaaggattttagaaatccagcaggaagaacaaaatctgatttcatttcctcctcagagggcctttcttccccgttctatttttggtctcttatcaaagctgttaacaagtagcaaaattgactggtgtgaacatcacctgctttcagttctaccagttttctgctgacagatctgttaatgagcagaaaaaaaggtcccactgtggaaagaaggtccttggtttctctccctccttcctgctaataaactcgcccagtaagatgctgcacctgtggcaagtgtgctaattaaaagaagataccttgagggctggttgagcccagataaccaactatttggacacattttagtgagtgcaggtgggagcaccctcatccaggtcccatctaagaacaatagttcaaataaaggagagagagccttggttctccttctagcatctccataggcttccattccctcattgaaataccatagcagtgttgtgcagctcctccatggccacgactgagtgataggctaacttttgtgtaatatgaaccaaaaagagaagagaccctgggaccctgaaatcctctccagtggtgagaattcagaccagcctcccatgagttggatgctctagcagatgtttaaagctgggccacgtcctctccttagactgaactcacacctcctggacacagcgatcctgttttgctgcttttatgtttttatttccatgggagctagtgctttgcaagtaaacttaacaaatgcttgctaaacttgaagctgaactagtggcagaaattatcactttgagtgcattcctggagtacatttttatttctgggatggaagagatgttgtatatggtatgtatttttgcaagcggtttcgtgacatttttaagaacctagtatatgtacatataaatgactaaagagaaaaattttagaagttttaagaaagagtgtaaaataaaaatatactgccacagtatatatgttaatgtgtggataaaattttaatttacgataaattatacttaccttcagaagctttttgcaatttgcttgagcagataggcctagcatataccttagaacatttgtttttgccacagataaccatgatgtgaatatattaatgtatctacctttcattaaatattaatcttgaccttcttgtgagatagccactgccttgattaaatgtgatcccatcagatctgttttaaataatgatccaattctaaatggcagtatggagagcctcagttgccctacacagcatcctgtcaggttactagaccttctggattctgaataagaacctaagctggcaagttttgtgccctccagagcagtgtttttcaaacattagctgccttgaagttacctggaaggtgatggtacagcaggtcgcacccagcagcctgtgctgtaccaatgccttcaatgcaggtgatgtctgaggtgaggcctgagaatctgcatttctgacaagttcccaagtgatgccagtgatgctgatccagggacaacacattgaggactaatgcattgtatctactcatgcaagtttttacaagtgcttcctctggtttgtccttgaaacttctaatcctatgtttgatgtctatctttagtgtctataaatatggatataaatatggataaagatttggtggtcatgttctggattatctgtgatctgcatagatcaaatcaactaagatgatctgatatttaacaggcatgatttttgagtgtagtgatggaactcgcttcttccaaggttgtagagccgggaggctggatgccctgttaagaaatgaaagtccctgctcacaccttaatgagaaggagtttcatgaagctcttttaagatagtctggtgtaataggggaaattatagaaggcattagaactctggacttagggtcctgggaaaaaaattgattatctggaaaaccaggttcagcgaatacaaagccttggaaatgaaagtgtcttgtccagaagcagccgaggcaatgctggaagggaaatttatagcattaaatgcttgcattagaaacaaggaaaggtcttaaatcaataatctaatttcctacctcaagaaacttgaaagagaagaaaataaacccaaagcaagcagaaggaaggaaataaaaaaagaacagaaatcaatgaaactgaaaatggaaaacaatagagaaaaaaatgaaacaaaagtctgattctttggaaaaaagtcaataaaattaataaacctctagcaggactgacaacaagaaaaaagacacaaatcacccacatcagaaatgaaacaaaggatattactatagcctctgtagccatctaaaggataataagggaataatacaagcaactttatacttacagatttgacaaccacaggggatcaattcctttacaatcacaaaccactaaaacttaatcaaggtgaaatagacaatttgaatagtttaataattattaaagaaagtggatttgtgatttaaaatctgaaaaaaaatctccacaccctctgatagtttcactggataattctaacatttaaagagttgatatcaattttacataatctttttcagaaaatagaagaggagggagcacttctcaattgattttatgtgggctgtattaccttgataccaaaaccagacaacaatagtatgaaaaaaagaaaactgcagaccaatatgtctcatgaagttacatgtaagaatccttcaaatatcagcaaatgaaatctaacaatgtgtaaaaagaattatacaccttgaccaaataggatttattcaggatatgcgaggctggtttaacattccaaaatcaatcaatgtaatttaccatataaacaaggtaaggaaaaaaataatatgatcatataaattgatgtagaaaaaatttgtgacaaaattcagcacccactccacaataaaaatgcccagcaagttacgaatagaagagaattacctcattttggtaaagaacatctacaaagaaacctaacgtacagttaatatcataattaatggtaacagactgaatgcttttctccaaagattgaaaacaaggcaaggatgtccattctcgctaatgctatgcaatgtagaagtggaagtcctagccagtacaataaggaaaatgaaaggaaacaaaaggcgtatagctcataaagaaattacactcatttcgtctgcagatgacataattatgtacatagaaaatcccaagacgtcaacgaaaatactactctaacagataaatgagttcagtgaggtcacaagatataagatcaacacataaatatcaatcacatttctatatactcacaatgaacatgtggaaataaaaattaaaaacacaacttttataatcactccaaagaaaaagaaatatatatgtgtaaatttaacaaaacacatacaggatctatatgcttaaaattataaaatactgaaatcaaaaagaactaaatacttggaaagatgtactatattcatggatttgaagcctcaacacagtaaacatgttggttgtcaccaaattaaccaataggtttaatgcaatttcctgcaatttctacagcatgttttttatgaccatagataaacttattctaaaatttacgtggaaatgcacagaccctatcataattaaaacaatgacaaagacaaagtaggaggaaaaattcttttcaatattaaggcctaccacataggtgaaataatcaagacattgtattggcagagagatagacatgtagattaatagaacagaataggtaaccaagaaatagacccacacaaatatgctcaactggtttttgacaaaggtttaaaaacaattcagtggaagaaagataacctttcaacaaacggtgccatagtaactgggcatccataggccaaaaaactgaactttgacctaaaactaacccttatacaaaattaactgaaagtatatcaagaacttaaatataaaacataaagctttaaaacttttgggaaaaaataggagaaaatctttgggatctagggttaggtaaagagttcttagatttgctaccaaaagcacaatacaaaagaggaaaatgtgataaattggacctcatccaaattaaaaacttcctttgcaaaagagctgttaagagaatgaaaagacaagctatggactgggagaaaatatttgcaaactacatatccaagaaaggactagtatccagaatacgtaaaagaaacttaaaactccgtagtaaaaataagttaaacagttccattagaaaatgggcaaaatccatgaatagaggccgggtgcagtggctcacgcctgtaatcctagaactttgggaggccgaagtaggtggatcacttgaggtcaggagttcgaaaccaacctggttaacatggcaaaactccgtctctactgaaaaaaaaaaaaaaaaaaaaaaagccgggcatggtagtgggtgcttgcagtcccagctacttgcgaggctgaggtgagagaattgcttgaaccctggaggcggaggttgcagtgagctgagatgatgccactgcagtccagcctgggtgacggagtgagactctatctcagaaaaaaaaaaaaagaaaagaaaccatgaatatatattttattgcagtagatatgtggatggcaaagaagaatatgaaaagatttttaatacctatttagccatcggagaaatgcaaattaaaaccacacaagaaatcaccatccatctctcaggatggctaaaataaaaactagtgacaatgctaaatgctggcaaggatttggagaaactgaatcactcatacattgtgtgaaatgattcatagccactgtgggaaacagtttggctatttcttaaaaaattagacatgtataccatacaacccaaaaactgcactcttatgcatttatcccatagaaatgaaaatgtatgttctcacaaaaaaattgttcacaaatgcccttagcagctttatttatagtagctccaaattggcaacaccccagatgtccttcagggggtgaatagttaaacaaactgtagtatatccatactatggaatactagtaagcaatgaaaagaaaataactacggccacacaccaaagcctgcttgaatctccagggaattattctgagtgaaaaaatccaattctaaaaggttttatactgtgggattccacttatgtgactctttcggcatgacagaatttcagaaatggagtaaagtttggtggttgccaagagtgagtgatgggggtttggggtcgatgtggttataaaaaatcaatacaagggattcttgtcctgactggaaagttctgtatcctgactgtggtgatggatacatgaacctacacatgtggtaaaatcgcataaaactaaacacacacacacacacacacacacacacacacacacgcacaaatgagtacaggtaaaactgggagaagctgaataagatgggtaggttgcatctatgttgtgacattgtacaataattttgtaaaatgtcgctgtgaaggaagactgagtacaggatgcaaaggctccctctctctctctctctctctctctctctctctctctatatatatatatatatatacacacacacacacaactacatatatacacaactatatattatatataatagatgatatataagattgtgtatatatatacacaactatatatatatatacacacaagtaacacaactatatatatacacacacacacaactgcaaatgattccataattacatcattgaaacttcatttaaaatatatcccctttcataggcttacctagaaaaagcatactgcctcactgcctctgtcagaacaaacacacttgaaggcagaagccacagactcacattcttgccaagatgtgtcagggaacataaacaagctgagtaggcaaggtataaaacagtaaggagtggtgaggactgtgctgaattataggattcatgggacctaaagaagcagctgtcaactccagtgcacacgaatctcaggaggatgtgggccccatattgccacatcagattttcaagaaaagattaaattcatattgtaataaaagttcccaattttattttgtatattttaaatttagaagtaattttaaccttacaaaaagctataataatagtatacagaactgctgtgtaccattcacctagacttcccaattactgtatcattctatctatatatgaatgcttccatgcctccatgcctccaaccatctattcatccatccatccatccattagtatccaaaaacgacactatcctacacagcagtagttccttctgtcaaagtcagtgaattacctttgatcccgtattaccatctaatttgcagatccccaaattttgcctatgacaaaacttttgctatgcagaagactctgtgaaggggatgaaaagacaagttagaggcccagagaaaatgtttgcaacatatgccctaattgtgttttttaaagggcctgtatccaatccagggtcacctgttgcccctaattgtcaggtttcattagtttctttaaactaactctgttggaagagtgtttcagtgttttcttgcctttcatgatcttgacacttctgaggagtactgcccagtgtttatttgtagagtgtccctcactctggatttgcccgatacttttctcataattagcttcgtgttaataattagcttctgggaagattactacagaagaaagtgatgcccagtgtatgctgtcagaacacacatcatgttaatttgtgccactgctagtgatgctaacttttatcactttgtaatggcagagctcaacagatgatatgcaggtatctctagtaagataagatgatatctgccaggtatctctagtatagagttaatacataaatattttctctcttaaaattaataaatatttaataagtaatattaataaatattttgtggggatatagtttgagactgtacatgtcctgtttctcatcaaactgtcacctactagttttatccactagtgctacttctttaaatcagctgttactctgatgcttgctacatggtgaattattttgaattccttctaaacttattaattagcattctactcagtggtaaaatttttgagtattgtgacattgtacaatcatttcgcaaaatgttgttatctctgccctcactcctggtaaaaatttttctttcttaattaattaattatatcagcatgtacttatggattcctatgttattcactgggttataatacattactattcgtcattttggagtgcagttcctccaaatttagccagtggaagctcctaggagttgactcctttgtccttttgacagacctgcatcattctctgacaacatttttacctttttggtacaatatgtttcaggatcttgttgtgctttcccttgccaaaatagcttggaatcagttatttttccaagaaatcctggtttcttttggtggagactgggatttagaaaccaagatctgggttctaggtatattctttgtttctagggtatcatacttctaggccttctaagtggacaggatatatatgtgtgtatacacacacacaacacgtgtatatacaagtatttatacacacagacatctatattatctatctatctgaaaccgtgacccttccaactgcagttcagtgtctcctgctttatttgggctctcccccaccctctttttttttttttttagacagagtttcactcttgttgcccaggctggagtgcagaggtgcgatcgccactcactgcaacctctgccttctggtttcaagcgattctcctgcctcagcctcccgagtagctgggattacaggcgcccaccactacgcccggctaatttttgtatttttagtaaagatgggggtttcactatgttggccaggctggtctcgaactcctaaccttgtgatctgcctgtctcagcctcccaaaatgctggattacaggcgtgagccaccacgcctggctgggccttccccctttctagatttgtacttccctctttgagagtgagaaacctgctttcattatcttcaatatacgtatatttatttgtgcagtctcccttatgtaaccagcctcctgaccatgtgggccatctctttgtctcctgtgctgcaccagtccagggtcccctgctctctagctctctagctgtaggctgattcatacccacctacactttccccttctctcccctctggaggcctgctgaccaagaatctctgcccgcttagcaccgtagctgagttcccacttgctgatggtatgcctgctgcattctctctgccctcactccttgcaccatgccttctgagagtctccccgctatactcactcactctgcctgtgcatcacaggaagtatcccgcttgtttaaaatactggcacctaattcaatttcataatggagtctgtaaaataaatcaatgtcaatagaacaaatttgacccatgggctataacaatactaaacatacaaacattattacacatataagtgtactaaaggataagcattattaatgccccgaggaaaaggtaacagttaatatatggccatattaacttagcgagcagtttgctttttaggctttaataggatggcagttatcaatataaaatgtatggtttggttgcatttactctaaaagaattaaaatgtggttcttggtttttggaagtacaagatccttgcttgaggtctcttttttctccacctcatgcagtgaccccacagatcccaagcagctcattgtaaccagtgttactctacctcatcaggagtttcctatgatagctgtagtaatacatttcacagggtggtagatttggccttaattacccctgttccactgagggaaatctcagtagaattttcaatgtctggtgacatttcagcaaagagtgtacatgggaagcgcctactgaatgtcctggtctcagatacatagatacacagctaaattactatcatgtaagaaaactggataataaagaatgtactactgaagtatacagaggaagagagactcctgactgaggggatgggaatccctccaacagagaatgaaaattctgtagatcaagaaagcaacataggaatggggtggatgataatatttcctttcctttaatgaagtattaaaaaaaaagagatgatgcatggaggggtatgttctactcaatctgcacttttccaaaaatctctctaccttttttcatttgttaaaaaatgtatctggctccacatatacttttttgtttgtttgttttgagacagagtcttgctctgtcacccaggctggagtgaagtggcgctatctctgttcactgcaacctctgcccgccgggttcaagcgattctcctgcctcagcctcttgagtaggtgggattacaggtgcctgccaccacgcctgactaatttttgtgtttttggtagagacaggttttgccatgttggccaggctggtctcgaacctctgaccttaactgattcgacctgccttggcctcccaaagtgctgggattaccggtgtgagccaccacacccggcccacacatacatttttacacagaaaaatctctgacctcttgtctggggtagtttccttaagataccctcttaagaatatatatttacatgacttggagcaaattctacttgtttggaatttttctgtattcagtgcccactctataggacacaaattatttgtacctagagtttgctttgggctttctctcacattcatagtactaaatctttctttggccatccctaaggatttgatcacacttccccttttagtttttggcagagctcaactgcttatcagccaagtaaatggcttttctctttagggatcccgttaaggaggctgatttgaattaagatgctctgatgtaattaaaggcagaaaggaagttggtgcagtgaatagttggtggtctatgtctgatagtgtaattttgggactgaattgctggctttcaaactcttttccacttccctcactgcagctacttccatatgatttgactgcccttccttcccggatctgccatctccttatgttcaagtcccatcttctttaaggtcaactcacaaggaatattctagtggtattttccccatcccctcagtcaggagtctcttttcctctgtttacttcagtagtacgttatttgttatctagttttcttacatgatagtaatttagctgtgtatctatgttctcattcaattgtaaaatatttaaaggaagactcaacgtttagtcatttttacaaaccttcaatggcttctagtacttgctaggtgcctaataagtacatcccagttttgacttgcctgcttgtcacacttattctctgtatttaccctttgctttgcatattatgtgcctcactcgtttaatatcaaagccctctttttaaaaactctatgtaaactttatttatgactatacatgcaaaacatttataaatgaaactttgaagattgaagtcatcactatattaagaggataatatactatgactagggagagtttattcctggaatgtagatggtttgtttcccagatgaatacactttttttgataagttgatgtctaatagaatttaggccatataaatcataattccaacagaatgttttatagatatagttaaactgattctaagattatatgcatatacatatatatacatacacacatacggggagagacagagagagagagaaaggcaaaggagttataatagccaagatgattttttatttttttgatttttatttatttatttatttttcaacttcttagattcagagggttcatgggcacaattttattccttttatggctgcatagtattctgtggtgtatatgtaccacattttatttatttaatccacaactgataggtacctaggttaatttcataaatctgctgttgtcaatagtactgcaatgaacatgtgagtgcatttgtcaacacccctctttttatattgtcatttactatacctcttttatccattggagaatgcctgacatggcctgggcttgatcctaacctggactacagagactagagcaaagttttggtcactcctggttcaaaagctgccctagttccatgatgcccataggtatctgtggacacagttgtttcagtcttctaagaattttacatgcatttacaaacaataaaataaataattttaattatgcctaagaatgtttttcttgtctttaagtccaagttatgttcttcaatttgtacaattttaaaatatttttaatatactgggttttggagtaagactatatgggataatatttttaccagagagccttaatatatttaattgatatcaattaattggtatgagaaacttcttttgtaattatgagttttgttgcctgaattcatactggatttccattaatctttaaactcaataattgcgcagtattctataagtgaattggtgcatgtctgcatcgctggaaataaagtttacctagagatgctgtcttagtctgttttttgctgctgtagcagaataccacagagtgggtaatttataaagaaaggaaattcatttctcacagttctggaggctgggaagtccaaggatgtggtgccagcattggctctgccatctgatgaagaccatcccatggcagatgggtggaaagtagaagcaagttaacgtgacacagaggaaattgggttgaacttatcctttttatcagaagcccactcccatgataactagctcgctgccatgataatggcattaatccatttatgagcgtgaaacccgcatgacctaatcatctcttaaagatcctgcctctcaacactgttgcaatggtaattaaatttcaagatgagttttggcagggatgttcaaaccatagaattccttcctggtccctcaaaactcatgtccttctcacaattcaaaatacatttattccatcccaacagccccagaagtcttaacttattccaacatcaattcaaaagttcaaagtccagagtcctgtataaatcatatgtggatgagactgaatgcatgattcatcctgaggctaattcctttcagctgtgagcctgtgaaatcaaaacaagttatctacttataaaatacaatggtgggacaggcgtaggacagacattcccattctaaaggggctaaatagacaagaagaaagagataactggtcccaggtaagcccaaaacccaacagagaaaacattaaacgttaaagctggagaataatcacccttgactctatatcccatttaccggatacactgtggctggggttgggcccccatggcctcaggaagtcctgcccccgtgactttgctaggctcagttcacccagctttaatgggttggagttccatgctggtggccctacaagttctatgttttcactggcagccctgaccccagggctccactatacattgccctagtagagattctgtgacacctctgcttctgtggcaagtttctgcctgagttccaagctttttatgaaatcctttgaaatattatgggaggaagaagccatttcctcaaagttcttccattctgtgcacctgtagaattatcaccatgtggacactactaaggcttaccatttgtaacatgtggagcagtgggttgagctgctcttggggccacttgagccacagctgggctgggcaaagagtgctgcactgagaagtggggagcagagtcccttggttgtcctgggcagtgagcctgtggagggtggagggtgccccaggcctatctcccaaaactgttcagcccttctagagcgctgagactgtgatgagaggggcagcctagaaaattttcagaatgattgtggggtctttcattgtcttgatgaatagcacttggcttctttttgttcatattaatctctttaacaaatgatcacgtggctatacccttagcattgtctctctgacatgctttttattctttacatagtcaggctgtgaattttcaaatctttttgttctgtttcctttgaattataaattgcatatttaagtaatttcttttctctagcattccactatatgtagttgaaagtaaccacacagcaacctgaatgctttgctgcttagatatttcttccaccagagatccttgtgcatcactgtattagtccactctcacactgctataaagaactacctgagactgggtaatcataaagaaatgaggtttaattggctcatgattcctcaggctgaacaggaagcatggatggggggcactcaggaaacttacaattatggcagaaggtgaagaggaaggaggtacatcttacatggctgaagcaggaggaagagagtgaagggagaagtgctttatacttttaaacagccagatctcatgagaactcactcactattatgagaatggcaagaatggcaagggggaagtccacccccatgatccaatcacctcccaccaggttcctcctccaacacttgggtttacaatttgacatgaaatttgagtggggacactaatccaaaccatatcattccttctctggcctcccaaatctcatgtccttctcacattttaaaatacaataatttcttctcaacagtcccccaagtcttaactcatttcagcattaactcaaaagtccacagttcaaagtcttatctgagacaaagcaagacccttccacctatgagcctgtaaaaatagaaaacaagttaattacttccaagatacaatagagatacaggcattgggtaaatatatccattccaaaagggataaattgatcaaaaaaaggggctatgggccccatgcaagtctgaaacccagcaaggcagtcattaaatctgaagggtccaaaataatctcccttgaccccatgtctcatattcaggcgacactgacacaaggggtgggctcccaaggccttgggcagctctgcctctgtggctctgcagggcacagttcctgagactgctttcatcggctggtgttgagtgcctgcagcttttgcaggtgcagggtacaagctgtcagtggatctgccattgtggggtctggaggactgtggccctcttctcacagctccactaggcagttccccagtggggcatctgtgtaaggagtccaatcccatatttcttcttggcactgccctagtagaggttctccatgagagctttgctcctatagcaaaattctgcctggaccaggtgtttccatacatcctctgaaatctaggcagaggctcccatgcctcagctcttgccctctgcatacctacaggcataacactgtatggaagtcatcaagccttatagcttacatcctctggagcagtggtctgagacttctctggggcccttttaaccatgactggagctggagtggctgggatgcatggagcagtgtcccgaggctgctcagggcagtagggccctgggccagcccacagaaccattctttccttctaggcctcagggcctgtgatggaaggcgctgccaagaaggtctctgaaaaaaaatgccttcaaggcattttccccattgtcttggctcctttttacttatgcaaatttctgcagccaacttgaattcttctccagaaaatgggtttttcttttctaccacatggccaggctgcaaattttccaaacttttacagtctacttcccttttaaacataagttctagcttcaggtcatttctttgctcatgaatataagcataggctgctagaagcagccaggtgaaatcttgaacattttgctgcttagaaatttcttccaccagataccttaaatcatctctgtagggcaggggcacaatgcctgccatctctttgctaacaaattacacaaatgacctttgctccagttcctaataagttcctcatctccatctgagacctcctcagcctggacttcattgactatatcactatcagaattttggttacaacaatttaatgagtctctaggaagttccaaactttccctcatctttctgtcttcttctgagccctccacattcttccaacctctacccaatacccagttccaaagttacttccatatttgcaggtatctttatagcaatgccccactgcttggtgccaattattcatattatttcattctctcactgctatgaagaactacctgaaactgggtaatttataaagaaaagaggttaaattggttcacagttccacagtctgtacaggaagcatggatggggaggcctctggaaacttacaatcatggtggagggtgaaaaggaaggaggcatatcttacttgtctggagcaggaggaagagagtgaaggaggaagtgctacacacttttaaacaatcagatctcatgagaagtcactattatgagaatagcaagggggaagtccacccccatgatccagtcatctcccaacaggtccctcctccaacattggggattattgtttaacatgagatttgggtgtggacacaaatccacaccatatcaatcaccctcaatttctacattccataaagtccgctgggcatggacacaactcagctaaggtctttgttactgtataacaaggattcccttttcttcaggttccaatgccttgttcctcttttttgtctgagacatcaccagaatggcctttactgtccatatttttactatgattctggtcacaaccacctaagtaatctctaaggagatttaggtttttcctatagctctcctcttctgagccctcacgagaatcacccttaatgctctgttcacagccataaatgctctttttagcctgctccaaactcttccatcctctatccattacccaattctaaagcttcttctgcattttcaggtatttgttatagcaacagccccactttctggtataaattttccgtctcagtctgctgctacaatagaataccactgaccaggtaatttataaagaaaaatttatttctcacagtctggaggctatgaagaccaagggcgtggcatcagcatctgctcagacattggcagaaggacagaaggtgaaagcaagtacacaaaacggaaaagaagtcaggccaaactcatctttaataccaggagcccactcccatgataactaggccactcacatgataatggcattaatccattcatgaaggtgaagccatcatggcctaatcacctcataaaaatcctacctctcaacactgttacaacggcaattaaatttcaacatgagttttggcagggacattgaaaccatagcatatactcttagttgtagctgtaaatttctgcaggagttctttaatgttgaaaaccatcttattgtgtaaatattttccaaattttaaagtgtttcatcttagtattaacttttaaggaagtttttaggttatttgatagatgatatcatgtggaggcccatttaaaacaatagcaggtaactattgaggcatgaatttgctatggatttactgagtgtgttctgcatgccaggaattgatctagctattccagaaacttcagtgaacaagacagacaaaggtcgttgccattgtggatcttacattccaaaacagggaggcagacaataaatagagcacaattactaagtagattatactgtctgctagaaaatgatgagagctatagaaagaaaaccaagtaaggcaagaataagcagagcaaagggaatggtatttagaggcctggaggcagcaattttcaagttttgccttttgaagcaaaggggggtcaaagaccaagactatagctgggagaaggagtgagggtcaaaagaacattttcttaagaaggcagaaatatgtgaaagggactcatttagaccagaatgaaaatgtggtgattcatcagacaaagggaagaacagctgatctgttcccttgagtaggcaggaggagaaagtatctaatacacaactgaggaattgacttgagctaggagcaggacactttttttaaggtaacagagaataaattccctatacacaaatctttatcaaaaggattcttcattgactcaaggcattgtacaaggcactgaaagaaatgaacaatttagagaaaaatttctgttttggtcaagcttgtggtctagtgcacaaaagtcttctttcttttgaagcaattaaagtagtagggaaaagatacagaatctcttgatgatgtcactatacttccataattatgatatattttgatatcctagtttcatcacttgtcatttgtgcatgagtattctctcaacccaattggtattctttgaagaaatgatttctatacctttccacaatcccattttcagctagacttcccaggttcaatgggtgtctcctgttcgtttctgcaaaaatcatcaccctgtaaagctgttcacatagcttgctaaatagtatgaaattgttgtgtgattggctatgagattcttagtttaatttagatatagttgtattcattatatggcaaaaaacaagagaatgtggccactgagctcttagttaagactgccactctccttggtaatattattcttattggaaatatgtgttttgattacacaatcttgatttaaagtttttaaaatataagtataaacggctatgattgccaataaaattgacttctgtgggagggagcagatagtggaaacctgtaggtgtcaaaagaatgtaacggcccttgcttttcaaactgttctgcatttatctatagtctttctatttatttcatttccatcacatccaataaatctcctctttcctcactggcaagtaagtctgcctacttcatgggaattgtagggtgttgctgtccatggtgccagacaggaggaagaaaacaaaaacttgttacatttgtttaacttgtttatctgttaacctctttattcttatttattttatttcatcagtaagagcatctcttcagttctggcctatctaaatgaaaagccttaatttaagcggaactaaaaattgacccagtcaaattgcagatgtcacaggcattactgtgccatttcctatgaagcctgtccccagtttaagaaatcactcctagaggaagctcttcatgttatttctctgatggtttccttttatctgtcctattctgttacccgctttagttgcattttaccctacaatattaattaaccatgccaactagggagggtttagagtcccattcctcagcatttatttagagactaattccatatattttccacttccccttgtgaattaaactcattatttagtttggatgcatctgtctcaatgattcccaggttgactgtaccattctggtaatgggatgcagagaatgaggcatatctctcatccaagcccagggagactatcggaaatggttttgaacaactgcagaaatgagctgcagttggttttcagatttgcatgagttttattggttcccattgatggtgattctctcttataagtcaccttgtaagccccaacatggattttgccattggcatagcaatctaaaggaaggacatacactagaaggaatgtcttatggtgactgactgaaacctggaaccagacatatttttaagtgtctttttagggatctcatactagagctacatacacacttaagtgtccattaagtgacagacacagtgaaaaaaattaaagtttcccaataaccatcacctggaggctttttaaaatacagattcttgggtcctatttcagacttatgagtcaagtcacacatttgacttgtgtctctaaagagtcgttctatgatgttaaccacttggatataagcctgagattgcacacatataataaagataatggcttctttgattgcatatctgctggaatatgttcccaaacctgattagttataagaatcttccaaggggctttaacaatttccaaatttccaagccttatttgactggcttaggcaaaagcagtgacaaagtatttttatattgaagactttctacaaagggctttgacatttagaaagcgttttgtatattatctacttgattctcatggcaatccataattacaattctgttttacgtgagaaaactgagtatctgtcataaaaattttcattttggaaatgaacttattcttttttcctttagtattcatgctttcttgtttcctcaggcagtagtttatcatattccgttgatttttctcatatccattgttagttggttcttttacatctgcataaattgttcttgtatactctgggagcctctactactgcaatattcaaagctataaaataactttctgaaaaatataactgtgtctttgatacttaaaagtacaaatgaaaaaacaaggaagcattataaattcccaagtagcttgttttgggagggtttttcatcatgcatcttcctcatgaagatattcgtttgcagtatgacatgtagcagaacttcggtcaatcaagcatttatgaaacacataccctttgcataatttatcatttacaaagtgttagttgagtgataatagtgttatccagcatttcctgagtgcatgatatgtgccaggcactcagcagatactttatgtaactcgtctccctcaaccttcatgatagctctaggtggtgggtactgttatcatcctcatttaatagatgaggaatcggaggcctagagagattaagtaacttgccccaagttgcatggttagaagtggcagagctcagatttgaaggccaggaagtgtgatctcagagcccgtagacttaaccactctgtgatatgaatcacatggaataaactccatggaattatgggactttgagaaaaactagtgaacaattgatatctttattcacagatgaggactgtatcctgagagcatggagaatggtgcctttagttacattatcctcatttatcaacagttgcttcttgttgggcagctttatccttcatcatcctttacagcctggggcacagaggtgggagagcaggggtcaagctggtgggctcttgaggcggatcatagggctaaaataactcagcctgcctgaattccaattctggcttaccacctattagatgtgtgactttgggcaagttctcagcctctgtgcctctgttttctcataataatgtgccaaccatatgcaattattgtgaggagtatgagctaacagaattgtgaaacttagaaccatgcctggatcaaagtggccactcagtaggtgttagactttgtgattattttgccagatcaaaaactttcattgttacatcatggactgaattgtgttctcctcagagtcattagctgaattcctaatccccagtacctcagaatgtgactgttttgggacatagggccattaaggaggtgattaaggttaagtgaggtcatatatgtgagccttaatccagcaggactggtgtcctcataagaagagggagaggcaacagggacgcacgcacacagacaaaaagccacacgaggacacagcaagaaggtggtcatctgcaagccaaggagagaggccacggggggaaactgcacctaccaacaccttgatcttggactttcagcctccagaactgtgagaaagccacttggtctgtggttttgtgttgtggcagcccaagcaaactaatacagacatcataaatggcagtttcagaaacattctggctgttgattaggcctggagtaacgatagctaaggcccttccttctctaccatcagtgctctctgtgccttgacacagcagttgtttttctagtccttgtacgtgctgtctgatttggtcacgatagaatgttatagatagagctagcatctatacccacagcaggagacaccgaacagcaagtcacaggaggagttgctactggaagtggggctcctttaaagtcgcccttgatttttgggtcagctctccgtgcttctcccctaccagtatattaaatactgtgctctagctattaaggtaaaggctgaaaagattttaaataatgcccatgatgcaccttataagtcaagtctcctcacacacagagagaaaaacaactgagtggtttttcaagggtcacaaattcaaggcaataaagcagatcttccagctgtatccagtctgcatgctgtgatgatttgatggcggtttaacacactatgggttagcttttccagaagatccgaatggagatctgtataaactcaaaaaagttagttggcttaagggaaataaatggagagattgtacatatgattattagctagatttctaactttgttttgttgaagctagaaagtatgtgatcatcagtcttcagatcgtagatattcctggaattggtgacagggatagttggaaattgggccacgaatcttggataaaactgtggaaactgagatgttctctttgacatttctcttccttccatgcactccctgcctcatcatcccaggaatatgactgcaaatatccagtcttatttcatctttatcttgtatcttctgcattaatatctgtgaaaaaaagaaataaaagaagaggaattgttttatgaagtcagtgctgggttcttaatgacagacagctccaatagtgcacagagctcaaagcaaggaaacagaaatgtaaatttcagagaccctgggcgcttttacatcttcccatttaacagcacctgaacttttcatagggagagctctatttcttagtaagccaggagtgcctgtagtgctcagtggcctaatgtctttgatcataagtggattcaaatattatgttattagtcatctgttaatcaaggtgctgattatggcctcattaaatctcatctccttgataatctaattttcttctaagcttcaaaaatgatcagcaagtttattatcattgctttcaagattgagttaacctgtctgaactctgagaaattgagccagttttaattttgatatgttacttcagccattttcaagagaaaaatgtcatcaaaggccaaaaataataatgtaactctgggaatgtctataggcttatgatcacagatgagatgacaggactcacctttgtaaaattgcaactttatgaagttatgtctcctaagatccacctttcatgcagatgttagtactgctggctttccacctgagcccttttcaaaatgtcagcttacagtttctgagttggagaggcaacttaatgaaaaatttttccataccgtgtgtgatattttcttcctcttgtctttctttttctttttataacaaaagttacttataaacataagttagtgctacactgaccatatattaacaagccaattcaacaggccattgcctatttaacaggtattaaactcctattgctttgagatattttccagacctgcttaaccttaataataaaatccacagggtttgttttttcttgtgcatttggggccatagtgatgcacacccctgccccggggtgtcatgcacatggtagtaggtagtacatgggaatggtgcccctaaattgtgcagtggttgctgctgccctaagtttagttccttagaaatcattaattcattctatgaattttgtccacaactaaattaaattaatgcctcaactatggctcctttcttctgggcagaaataactgagttaaaggtaaactaacaaaattatacctttttaaagactcttgaagtcttggcatatgtatttactaatattaatatattgcagcgcttcagaatttagtgtatctaaacaaaaaacagcttgactcaataatttcccacacccgttgcaccttcatgcagttggatcttctctaaggaggagtattactaggcaattcagacaacttaattataatagactcccctgccctcctgttgccatgatccctgtgaccaggacatagaacaataatttcctgatgtcttgtagaaaatgatataaagaaacaagaagggaaaatacaggcatataatctcaagggtgtagaactttgttttctgcacacacatgtgcaatacataattcacggctgaattactaaaatgatactttacaaagggatttggaatcagcttcaaattcagtgaaatctgagcaatgttataagaatttgtttaatttcaaacatctgctattcctgcagaataacaatcttaaggaaattttattgtgcaataagttttgtacaggagaaactactttatggcatattgtaggtggaggatttttctccagagctttttacctttttgattaaggtagaattttagatgaaattcagtgtggctattactgagtgattcatgaaaccgaaatactcatggggaaaattaagaattttaataattggaaaagaagaaagtcatttaaatcagcctttagtttatctgcttaatttgaactcatttattaagcaattattgtacaattttgaactttgttccactcttatataaaaaatctcttctagatttcttatttcatttaaaaaaaaactctgcagtgtttcccttcgacaagatgaatccagtatatggattggagcctgaattatttcactttatttctactgaaggaaaaggcaattagttaattgtggggttaatttcacataactttgttccttgaacatttgagaaaagaatgcccttccctgctacttttttgctatttctggatattctgagcaatcctggtgactcataaccatcccttttcatggccggctctgtataactgagggaacacatccttctgggtgagaagtgagccttgcttaactcggtgtccctcacacatttccatggaaggaccatgactggtacagcagaatcctaaagcagacagctgaaagcagcagaaatctgtgaagttctgtgtttcatccccatgctatttttttatccgacttcttaagaggtggcttagtggttgtaaaataatggtttctcttccatttctttcccttcacctcaataaattgatgttccagacagatcttttagctttgttttgtggatgtatgtgccctagacaaaccactaaatgcccccagattctacaattatctagtttgagaaatgtggccttaatggattcaagccctcctaattgtaccttttagggcttttaggctttagattggtttgggtctatatttgtccaggtaaatttcagatattattctctcttaaattatctgaaatctgatgggacaaatgattctggagcttgcttctctctcagttccattctatctctttccgttgcttgaccaccacttgggcttccatttgtgaaccgttcagtttgtccttaatctttccagtttgatttttctgaaatgtttctgtaaatgcttttatttcttttctgttcactaattctattgggctttttattgttgtggttagatttcagcctctctccacatttcagcatttcctctgttgatggtgaatcattttactgggcagtttgggctaggttatgccatggtagcaacatctcagtggctttcaacaacagaggttagtttctcactcatgaaaatgcaggtggtggctgtgctctgtggtcccttcactctgggatccagattgaagaaacaaattctgtatggggagaggaaagaaatggcaggagcatgtgatggcttttatagcttcagcttgaaagtagcacatgttacttccacttaagtttcattgtctacagtcctacagccaagcctgatgtcgctgaggcaggaagtatgatctttctccaatgacagatctggtagggaggtgcagcacagattgacaataaaatctaccaaagccatattttttccactttttatgtactcagaatgtgacacaatgctctcatataatggatatttagtaggggaaagacccacttcttttgttgcgatatgcttttcttggtggtattgagaacttcatcctgacttctctgggtcctcttcatcgactgcttttactcaagtgtttatcatcagcattttctctttattctcctcttcctctctctggaaatagttttctactacactttgctgtttggaaccccaccatgatttgctttattttctctagctgatggaagtttgccatcacacaaactttctgcatgtttcaacaagggaatagaaaccttgagttttgatttaaaaccatgttgagacactagaaagggagtcaattgtttagcactttgatttctgctttgccattctgaatagaaccattctgtttgaagttcatacgtgccagcaaatggactcatcctaagcttttgtctggtagtaaccgggtttatagagctgcaaaaataacctgagcttaactcaaatacagaatacctcacctgagtgttacatagatttcaaggaaataatgccactatacctgcacaatgcaagtgttatatggaaaatatcctaattcagaatcccttttgccgtcaagcatagtcttaattatttcttgtcagtttatttgtattaatcattatctttaaatgtgatggacattttgtttttgtacttcaacactttgaatggctgttgcaatgctaaatgtaatatgccttgcagtgcaattgttttgttttttgcttatatattttagctcccccactagattataatgaggaaagagggtccccccaccaccactcttttgggcaaatactaacaatgtttgttaaattgaacatggctattgaagttgctgtcctattattgagctcaaggtggagtcctgtatgctagctctctgcaattttgttaaatgactatgcaattaaaatgcatgcatgttttaaatcgactttcagttgtagagtcatagcagctactgttggtgctcagacatatgcccctagtacctttttctgagcccacaagactgacgtgccagcattggcaactctttgcctgagggcttctctggtttctggagccctctctgcttctatatagatatattggggaattaatgtcccctaggagcagctctagaaacatagctgacaggagatattggataaacgcctcagcttcctcgcctttcagttagggtatctatagggtgtttcattgacactgtcttccagagttcccgagtggaactgaggtccagttgcccacagtggtaacttgcttgataacgctgtctgtatcagctatcttcccttctctgcctcacttctctactctcctattggcatttctttgactaactccaaattaaactatttgcagtctcatcctagtttcagagagtctcggagtttctaaaaaagtatccaaaccaaaacaggcattcatatgtcaacatttacaatttaacagtttctctatttcaatgcagtccaataaaaatataatgcaaactacatagtttagaattttctagtggctacatccttaaagtgaaaagaaagagatgaaattttaataatgtagtttaactcaatatacccaaaatattattgttttaacatgtaatctatataaaattaatgaggtttttctggtactcagtctctaaaatatgttgtataaaatacagttacactgtaaatggaaaatacccttacagtacatctcaattgcaagtactcaacagccatatgtggcttgtggctaccatgttagataatggtgatcacttccctgctattataacccatgtgtcaaaatctagaaatttgatagctcttgaattagaagatgtgtaatgaattgtattatctattagcaaaatcttgccttctccttttgctctttgaagtggaacaaaatttctataaatatctagactgatggacattattgccttgtttagtctgtgtccacatatttatgtttttttccaagaatgagcttctggcaatagtaactttgagacttaacacttcttacatgttttcatgcagaatatagactagatatttagcatctgtgcttgtgttttttaggcagagggtaccagacttcagcgagaactccgaggatatttagcagcaatcaaaggtaatgtgtatgagttgtttactgcatgttacttagcacaggttgttcttggaattcatgagtgacaggattgagtgttaattacaaagccatttggcttcctggcaagatggatgcttgaacacaggtgttccattccaccaccgccccccccgccccaaattcccattgaaatgataatcagaatatataaggaaaaaatatgtgtgcccttatgctggaaactagaaataaatgccacccacatgccagagatttccaggaaaatttcttagagtgagcttgagaccttgtttaagaaaagctgcagccggcttacctcctgagggagaccacatgccaagagtggagcactcacagacacgcacctaagccctctcactggaaggggcaagacatggtggcaaaggtaggtggaagatgatcagcaaacatggccctggactggctttgacttgtgtggattagcagcgcttgcatccctaccgacgtgcaatgcacaggcatggagaggccctagcatgagtttctggactcagccatgtaaggcaaggaaatgaggccactggaggagggagaagagagcaatagggaggtgggctcagcctgtgcctgctatccatcatcacgctgcctgccctgagtcacagccaagtgtgcccacggatatgatgtatcataaggcagattttgtggggaaagaatggatcatctgacaaggggtattgggaaaactggccaaacacttagaaaacagagtgaaattctcaacctcacgctttactccctccttcctaattccagatatagtaaagatgtaaatatgttgttgtactggactctattaacttcagtagggatggcaccagattcaaggggccgaagaagggacccagagtcagcaaacaagacacagggttttattagtgggaaacttacatacagagtgggcccagtcatggcagggctgggcaggagtattgcacagccaagtggtggcaggctgggcaggagaactacatccgtttgcaaaaagcaatgcagtttctgtaacatttttgcttagcatcctctacctaacaacctccacctggcaaccttcgtttaacccaaaacacatggcctcaatcccctgtatgactcaccttcaatgggacaggctcagggctcaggtgttccttgtagacaaggaattaatctctcggttggccactcccagattccttagctcagaactctgagcacatattcaggtgcatctaacatacagggtgattctcaggggatgcctaagttatcactgtcaggtgtgtctgctatgcatcgctgtgcaaagaaatgtgctaaagtactagaataaaatacagtacatttagtctctaggctgtagagaaggtctttataagggttacttgcaaggcagaaacccataaatctctccataaagatgaagagatttgatgtcgtaagtatgtaaaacttaatatgttttttaaaaacaccattttgacaacatagtgaaagtaaatcaagatataaagagctcagtgagtaaactaaatgaaggtcagttggttaaattaaaaatgggcagaaaactctaagggaaaattagccaaagtagaactatagatggatgataaacgcaaaaaagccttatcctcatgaataatcaaataatattaagtagcattgaaaagaagattttatcatttttcctccaaatgttcaaacacattacaaataaaatactgtcatatttagaattggtaaagctctgggaagtggactccattcatgtattgctgggaggatagcttttctggagagcatttggtaaaatcttttatttatttatttatttatttatttatttatttatttggtatgctttttaacataccagtttcattctaagaatttattctcacagttttaatgtggatgtatagaactgaatataaacatgttattaaataatgaaataataaaaatatcaataatttaaaaatggccaaaataataaaaattagcaaaattgatttttaaactaaaagatatttatgaattttatagtccaggcatatcattttaattctcatggcagctctataaggcaggtagttttattatcttcattttatagataagaaagtgagttacagccaggcacagtggctcacaccacctttaatccgagcactttgggaggctgaggcgagtggatcactttaggccaggagttcaagatgagcctgggcaacatggcaaaaccctactgaaaatacaaaaattagtcaggcgtggtggcgcatgcctgtagtcccagctactcaggaggcttaggcaggagaattgcttgaacccgggaggtgaaggttgcagtgagtggagatcatgccactgcactccagcctgggtgaaagagtgagaccctgttcaaaaaaaggaaaagaaaaagtgattttttaaaatagagtttaaatagctcatccaaggttgcatgccaaggaaacaacagggccagattgcatatttcgttctgtgtttctccagagccctggttttatctactgtcttttactgcctttgaactacgtgaccaatggtaaggcattggtttcacaagtcagagttcatctatacaatggaataatggcaacctactactattactttttcatgagcacttactatgtgttagagtctgtgctaagcattttaggcatattacctgtttctaacttcccaacatagccatattatcaatgtcattaacttgattttacatttgcaaagaagtaagtctcagagaatttaacttccacagtttgatggagctcatcattaattactcccaaatcaaccttaagtatttgtaacagttcagtcagaaaatagaagccactctaggtatttcttttattattgatttaggatttgaacacggaagtcatttcaagcacaggactttttctgggttagttgatttttttgaaaatgtggataagtttgttgaatgaaagagtgagttctctttcccaagtctatttgatttggtctatgctgcctctttggtgtggagcgtgctgcttatagagactggcataattcttttccttaatgtgatctagaagaattccctgaggatgaggcttgagctccagagaaaagctgggtgaagcatcagataagcctttctggcagacggcacctgcactccagggctagtggccacagctccatatgacggagaaaggaattctatcagcttttccccatcttgggtttgctgattgactatgttaacaagcgatgctccaaaaaagagatctctgcttaaattactttgtccacagctgattggaatgaatttttaaacaggctactactgagtttctcagagcccttaatatgctaaagtcaactcagaagtcctgtgggacaggcaggaattccaagttatttgactgcaggacccttctctcttctcaaagcctcgtgaagaatgaatattgttcctgggaacacattttgggttttgggaccaaacttgaaaacaaggtatatgcctgtgttagtccgttctcacgctgctaataaagtcatgcccccagactgggtaatttataaagaaaaagagggttaatggactcacagttccacatggctgcagaggcctcacaatcatggcaaaggcaaaggaggagcaaaggcatgtcttgcgtggcagcaggcaagggagagtatgtacaggggaactcccctttatcaaaccatcagatctcatgagacttattcactatcacgagaacagcacgggagaaacccgcccgcatgatcagttacttcccaccaggtccctcccacaacacatggagattattacagttcaagatgggatttgggtaaggaaacagagccaaaccatatcaatgccttaagtagatcataatttacattttcaaaggctttcatgggcaatttttcttgttttcccaaggacaactctggctcactaatcctgctataacacaggtagcatcagggcagcataggagaaagtgatatttggccctggagggtcatgggtcctggggcaattgtgggaaaatcattgagcctcttagttgctttgggttcctcatctattaaatgtttcagttctctcagaagcccctaaaggccccaaaactgggattctgtgaagttgggttaaatgaattctaatcattttattgtgactgatctctgggtggcttcccctctatgggtctttatgatttctgctgatgcttaggctttgtgaggcagatcttatgcttgcattcattttagcagcaaacatctctggagctccatttgtgcacctgacactgttctaggagagggagatgcagagatgaacaagacatagtgcctgcttgcaaggagctcacagcagagtgagaagacacttaaataaaaaggccagataggcatagtaatatgtattttaatagatacgtgcattgagtgccatcataacagaggacagattcacaccttaggagaggcaagagactggggcaggaatggttgttccaaggaacttacacttgaatgaacccaagaagtggggtcataggtggccatcaagtcattaggttttctagagaaagatagatttcagagggacattgcaggtggaagaaacaactgggccaggaagcagaaggaagcacgggttcttgagggaacaaacagagcagtgagatgcaagcagaaaactgagctggatgaaacatggaaaggcagcagcatttatataaagaagtgcttcatgtatcatatcatatggggattttattctatcaatagacaggagagtcattgttagagttattgtagacaagggaaaacgtcccatgatcagattagcattttagaaaaatagttattgtgattgtgtggaattcaggctagaagaagtgaaattgcatggagatttagtagaagtttagtccaatagttcaataatactattagctaacatttattgagcacttatatgctaggcactgagataagcattgacatgtctcagtttatgtaattttccctacaaccttgtggcaggtttatttattagtattttacctcttggaaaactgaggttatagatgattaataatttgcctaaaatcacatgaatcacatgtaatggaaccaagcttttaacaaaggctgattaattgcaaataatagtcttaattattttgttatgttgcctccaaaaatattttgtattgtgatggctgacagttggacatttgcttgtgccaactactttgctaaatcgtgttatgtggattaggttatctaatctaaatcgtaggtgatgagtatctaatccagggaagggcagtgggcagggaaggaaggggctagatttaagaatcaggtggaattggtgactcagctttgggaggatgaatctgggataacttctagtttttgaactggggcaactggatggcattcatgagaactgagaaaaggagttgaagcaggtttggacaagaaaattaagagtttgtttttgacatgtgaagtttgaggtattagtaagacatccaagtggagatgtccagtaggaatttagaattgggagtcactggcatgcaggtgcagcagaggccagacacagggatgatgaacatgccagatctttctctaaatggagcacagtgcacgtggtgtcattaatagttcttcatttatgtgtcttatgtgtaggcatgactaaggggtagggttgactattcttgagctacctcaccaactgcctattttattccaactcttgttcccatccttgctctccttaagaatctaagaaaaagatgcccactcttgctttcctttgaggcagctgctgtctttttacacagctctcgtctaagcaatgggacaaagctgctagatacttgcagtattttagacgttcttttaatggtttatcgctgctgcttgttatcatcgtaatttattttaactgatgttatttttaactaaaacacatactctcaggctatttaagcaaggagtacttataaagtagtgcaatctatgcaacaagtcttaaaggatgaaaatagaagctcacaaatttggctgcaaatgggaatagacaatgttatatgaaatgtcttggagaaggtccaaaattttgaagagagtgaagtggttcccatccagtagtaaaataataataattcttctgtatatgatgctgggcatttgtcttacagttttagaaatcactaatcttttaagaaaattttggatattgtatattattcaatctcggaggtagcatttagcaccttttctgctttgatgttccaaattactctgaagagaacttgtattttagcttttttcgcccatcatactctgtcagaagagtaatccctaaatccctaaaagctctgccagtctggagctaggcttgaagcctttcacctgtgtatccatcaaagtgcatcctatggagtagatgttctcaaaacaatttccatgtcaaaatggcttctgtccaaatgatccatcaccacttatccaccctgtaattagtagttcttttggctgctaatagacatatttactgcaacatcatgcttttagtcttgatgattaaaatcttatataattttattttaaggttatattcatgattttatttttcatcacaaagattatttggtctacagtgccaaatttctttttcttctcttaagacattgttaaaaacctatctacacagttgtgtatagtttccatcagacttaagacaaagatttaaagaaaatgccagaagttttttggcatctggattatagaagggggtccactagtgactaacgcttgttatgaatttgaggggtatatttcttgatagagatttgcttgtacttgggtgagggtgaatttggacacttggcataatgtagcttccacctcagtgttgaccatatcatgagagaacgcatccccccttgcttggattcagagtgcgatgggttggattcaggttttgtctcctatttgctgtcccttcacctgcacgactctgtttcatcagagtccccagagtcttgagtcatactgtttttttcctaccccagactctgcaagggcttcgtccgatggtggtcaagtctcttcagctcatgtaggcaggacacctcattgtcaagggcttcgtggaatgtgcccagcgatgctctgagggaagggagatgttggctgtgtctaaagagagcacaagtgctatgaaacaccaagttacatgtggacttttatacatactcctcaaggatgtacttctgtcatttcagacatcttttagtttgtccttttctctcacagttgaacccagaattagctacctccaatccagcaagaatgttgagttttcagtttaacaaatgatttttatcttaggattcactgaccttaagtttacaggatgtgttttttatttctcatgacagtgctctgattttcctctcctctccctgtttccagcccccttttatcccccgtagtgacaaaggccaagacatcaatgtggccaggtcccaccttccggctgtcggggagagtcttctgccggaggcgcatctccaagtccccagctcttcctggccccttgttttgctctcagccatgagctgtcttcgtggcttttcagtacattcattaacctttgtgcagggggtccttgggagagactaaaaggactgggtgatactttatgtcaccatgttgtgctcagaagcatatatctttaatgctattctttaatgttgcaaaccatagttttgcaacatatcaaatgtatccctaatgaaaattcagacccaaaggcttaggaaccctaaaatttctaagagttttgatttaaaacttcattcatagttttaaataatacagcagatcttcaaatagcattgtttcattcaacatcattttgttacaataatgatgagaaaaaaaaaaaaaatctcagccagggccactgtccgtatggaatttgtacactgagttttctctcggtactttgacttcctcccacgtcccaaagatatacaggtgaagtttactggcatgtcagtgagtgtgggtttgtaagtgcaccctgcgatgatatgcatcttgtccagggctggttcccatcttgtgctctgagcctctaggagaggatctggtcacccatgaccctaaactggagtaagtaagtaaataattatcttacttgtttttattaatcttccttaaatgtgtgtactgctctcatttatttcaatgttcaatattagaagtgttttgacatttagttagaagttttgtgatgtgtctgtgacgaaaaatatgtcctggtaacttaactcttatttatatgaattagccttgggtaaaattggtttcattattcatcgtatcaattaaagtcacactttgcaagaacctatagatgacattaagtaaggacttactatactggaaaatgacaaactttttttctttgttctttgtaaaaattttaggccacttaaaacttaaccatttaaccactttaaccgtgtttaccattttaggccacttaaccacttttgactgttatgccctataatcctattgatttttacttctagtcccttctaaaaatgctttatgccatgtatttaaattcatttaggactaattttagtttgagaactctgcagttttatggaccagtgttcttagcatctgataccacttggcaagtgatagcacacgtaataggacacactatgattattgtagttttcagagtaggatacttgttgatctttcccgagaccccatatctatcattatcaagtgaataatagaaaatgtgcaatgtgataagtcttagagaccctcaaagaaagatacaacagcagatacaagcagcagttgtgcctttatagtttttccttaaatgtttagcaagtacaatatttttctctcacttaagaaagtggaggaagggagaagagaatcctcactcatttctgtgtaacgggagttgtttctctccaacactaggcatgcaggaggcctccatgaagctcacagagtcgctgcatgaagtctatgagcctgactggtatgggcgggaagatgtgaaaatggttggtgaggtaagagctggggtggcttccatgaggctcccacgacccttgctcagtccacctgtcccctgacttgctctttccacttcacagtcttaatcatgaggcaagacagtgtgctcagaaggcactgtgcagttctgctgcctgatgattccaaacttagagtgaaaagtgaagatgggccaggtgcggtggctcatgcctgtaatcccaacactttgggaggacgaggcgggtgaattgcctgaggtcaggagttcaagatcagcctggccaaaatagtgaaacctcgtctccactaaaaatacaaaaaaattagccgggcatggtggcacacgcctgtaatctcagctactcaggaagctgaggcaggagaattgcttggacccaggaggtggaggttgcagtgagccaagatcgcaccactgtactccagcctgggcaacagagcaagactccatctcgaagaaaataaaagaaaagtgaagatgatcataaaaccacttgggtagagagcagtgttttaagattcctttttgcaaaataacaatatcatttttctgtcctcactacaagccttaacagcccatttctagcagacatggatcatggtgtgatttgtgttgtcccaacttcacccgttcatctcaatccccctattgactatgcctccccaaatgcagggacaggagttcagaagagcatccattccactttaataccagctagtccgttcacaaatcttcacttcacgaagacaagcacaaagtcagactgtgaaaaggaatttgacttcaggaaggctttggccctagacatgtcttaacacttgaaatcaggcttctggctgacaggagtgagcaagtgggttttgttctctggaaagcagaatggaccagagactgagtagcgctgtgtgacgttggaccagttctttgatcttcttaggctttagtttcctcatctacaaaataaaaaaaaaatgtatctactaataagacacttattgcctttgtgtggatgtcctctacctactcagtgtttggtacatattatgattactgatgtgagacaactgccagtcacagattgtctcacatccaagttctttgttaaaacgaagagcagttgtttgtcatgtcctctactccaggtgagttattgcagctcatttaggcacagacgacctaaatttgatgtggcagccagagctcaggggaaggtctgataggtgatgcactgaatgtctgtgcagccttggaaaacctgcgttaacagtggagtcctaggctgctccatggatattctgacaccctgacattgagcttcataatcttcttataactgagatgctaacagagatttatttatgaggaaagcatttgttggctcctttacatctttcaaaaactttcaggatgtagatttggccaaagcagaccgcacacattactttcagatgcaattattaagtaattgcatcttctcacatttcttcaattaaaacacagtatttcaacatcatgttgctaaatactttgtaaatttctaattagtggtataactaaaaattcatcacaaaaaaataatttttaaggaaataatagaaacttgtgttaataacttttcagaacaccatgttaccttctatgtgtggcaaaggtcactattgccatttcttttttaaaggaaatgactgttatcctaccttggttcttgcagctgcccggttttttggaatcctcagttgcacatgcaaacataggctcttgtgatgatgaagaaactgaatactgcatgttcagagggtctactcacgtcagcagttgagcctttctaaacagtggatttaaatgttttggtttgcatgaaattcttgaattgagatttgtaaaaattaggactacttttcaaagtgtgagaaagaaacaaaagcaaattttaaaagtgtgtgtgtgtgttttaacaagatgaaaacttatgtgtcacatagaggaatttaaaggtcggcagtccaggtgttgcatattggccccacaagtatgaggggcccaagtttgccatttttagcatgccttcacgggcaaggtgactctctgagcactggccatcagctctcatttctgcatgccagttagcaaggaggatgaagtctggaagacagcccactccttccctctttttcaggacacttcctgaaagtacatcccattgtctagaacacagccacatgaccacacctggttgcaaaggagtctgggaagtggagtctttatcctaggtggccaagggccgagctaaaatgggaggttcagttagtaggaaggaagaaagggtagagattggtgacaaatagcagactgtgtcaagagacctggaatgtgctagtgagagaaatgtgaagatgacattcttgagtacctgctatttgcctgaaattctgtgaagcactttacattgccaactcatataactgggggaattgaaattcagggaggtctagttccccaaagtcacacagctgggataaaaagtcctctggtgaggcagcctggtgtgatagtcatttcctgactttcatatcatggctttgagttcaaggagacaaatctgagttgaagcctgtgtctgtcatttatcaactttataaccttggccaagttatgtgacatctctgggcttcagtgtcctcttctgtattgtggaaataacaaagtcttttctcataaaacaatttttgagaatgccttaacatagtgacagtaggaatactagttgtaataatagtaatacctaatattcattgtacgtttaacataattgatactccataaatggtaagacctttcccaatatgactgtaacttttctgttttccctggggaggcttcagaaatgatttgttgtttgtttcagtggtggatttttttctgatttcatggagtgcgtcaaaagcaaactgtcttagtggaattattctcagtctcttagccccaaagtccatctatagggttatggggatcttttgaagtttctgcattctttagtaatttagaatcagaaatacagttttaatgagctgagctctgagctagcctgttttgttaactagaaccagtggccaaattgccttaaaattttattgcattattaaatgattctcatttttcccctagcatctcatatctgggaaagtattacttgtctaattttatagtttcagatttttttagaagtttggtgaaaggtatccaattaaaataattcagcagtggtctctttatttcttttagaaatgtgatgtgctgtgggaagacttccatcaaaaactcgtggatgggtccttgctaacactggatacctacctggggcaatttcctgacataaaggtattttactctgtgtctataaagggaaggattgagtggggtcatgtagttattgaaacatgggcaagagaagaattattacaagtcctcaaactgacatcaaagatagttggtaacttttcatttatttaagcgtgggatttttatgttgttcctatcagtttgaaaagaaacgtcattacagaaatcacatttcgcttttagtgaactgcttcagcttttattattctacagaagtctttttaaacctatagatataaaatcataaaccagagctaccaaaagttccaatcttctttataatcaaaacttttattatatagcatttgacagggatttccattagaataaccagtggtcacaaggaagtgagaaatttcattgtaaatatgagagcaaaacctgatctttccttctttactgtctattttgcatgcatttatagtgaacctggatagtttttctctcactgaaattttcaggttgaagttaaagtgttaagatataagcattttaaatacatttgcatctggacctaaaaatattgtgtctgaaacattgatcttatttgacccttgaatctattacagaggtaaatggacaagtgaaggattgaatattgtagatttggaattgactctggaggtaaagatggcttttaaactatcagggttggtatatggtaaatgaaactaaatggatctgactaaatgtgttagacctattgacaaaatgccacatagagcaaatccaaacagtagattttcgatgatgttaccatattaggcagcaaagtgctttactaagtagttgggcaaatgcaacctaattaacaggtgtgaattgggttttaaaaattctctgagaaattaaaaatttaaattgttaaaaattctgtaagaccatgtgcaccagggaacatgttttgagacatcttcagataattttgattagtcactcaatttttgccttgggatttgtaatgtttgtggagcagacagtctcacaatagtaatcacttcagagtactgtttattgcatggcaaattattttcaaaattattttatttaatttatattttgtactttattgcggtaagaacatatgacatgagatataccctttgacagattttgaactgcacaatacagtattgttatctgtaggcacagcagatctctagaacctattcatcttacgtaactgaaattttatacccattaattagcaactgtcattttccaactctctctagcccttggcaaccatcattctatgtattctttgcttctctgaggttgtttgtaggtctttggagaaatgtctattctagtccattgccgatttttaagtcagattattagttattttttctattgagctctgggtgttcctttgtatattttggaaattaactcctcatcaaacatgtggtttgcagatcttttctccatttctatagcttgcattttactcttgattgtttcttttgctgagcagaagctttttactttgatgcagttcctcttgtctatttttgcttttgttgcctatctttttggtgtcaagtccaagaaatcattgctaacaccaatgtttattttaaaacatcttcatttagaaaatgaagcttccccccccctcaacttttcttctaggagttttacagtttcagagcttacaattcaggtctttaatccatttttagttgatttttgtgtatggtataagataaaggtccaatttaattttttggcatgtaaatatccagttttcccagcaccatttattgaggagactgcctgttcccagttctgtattcttggcaccctttttgaagatcagttgactgaatatttgtggatttacttctgggctttatattctgtttcagaggtctgtataactgtctttatgccaggacaatgctgttttaattactgaggtttgtaacaaattttgaaataagaagtgtaatgcctctagctttatccttcttcttcaaagttgttttggctatttgggatcttttgtgcttccatgtgaattttagaattaaaaaaaaactttctgttaaaaattccattaagattttgatagggattgcattgaatctgtagatcactttgggtagtatgggtattttaacaatagtaagtctttcagtctgtgcacccaggatgccattccatttgtttgtgccttctttaatttatttttgaatattgtatagttttcagtgtataaatcctttcacttccacagttaggtttattcttaagtattttagtatcttggatgctattgtaattggtattgctctcgtaacttctttctcaggttgttaccagtgtatagaaaggcaactaataatttttttattatattttaagttctgggatgcatgtgcagaatgtgcaggtttgttacataggtatacgtgtgccatggtggtttgccgcacccatcaacgcatcatctgcattaggtatttctcctaaggctatccctcccctagccccccaccccccgacaggccccggtgtgtgatgttccactccgtgtccatgttttcattgttcagcccccacttatgagtgagaacatgaggtgttcagttttctgttcctgtgttagttggctgagaatgttggtttccagcttcatccatgtccctgcaaaggacatgaactcatccttttttatggcttcatagtattccatggtgtatatgtgccacattttctttatccagtctatcattgatgggcatttgggttggttccaagtctttgctgttgtgaatagcactgcaataaacatacgtgtgcatgtgtctttattgtagaatgagttataatcctttgggtatatacccagtaatgggattgctgcatcaaatggtatttctggttctagatccttgaggaattgccacactgtcttccagaatggttgaacgaatttacactcccaccaacagtgtaaaagcgttcctatttctccacatcctctccagcatctgttgtttcctgactttttattgatcgccattctaactggcatgagatggtatctcattgtggttttgatttgcatttctctaatgaccaatgatgatgagctttttttcatatgtttgttggctgcataaatgtcttcttttgagaagtgtctgttcatagcctttgcccactttttgatggggtcgtttggtttcttcttgtaaatttgtttaagttctttgtagattctggatattagccctttgtcagatagatagattgcaaaatttttctcctattctgtaggttgtctgtttactctgatgatagtttcttttgctgtgcagaagctctttagtttaattagaccccattcgtcaattttggcttttgttgcaattgcttttggtgttttagtcgtgcagtctttgcccatgcctatgtcctgaatggtattgcctaggttttcttctagggtttttatagttttaggtcttatgtttaagtctttaatctatcttgagttaatttttgtataaggtataaagaaggggtccagtttcagttttctgcatatagctagccagttttcccaacactatttattaaatagggaatcctttcctcattgcttgtttttgtcagatttgtcaaagatcagatggttgtagatgtatggcattatttctgaggcctctgttctgttccattggtctatatatctcttttggtaccggtacaatgctgttttggttacagtagccttgtagtatagtttgaagtcaggtagtatgatgaaagacaactaattactttatgttgattttgtatcctgcaactattcttatttgtttagtagttctggcagtttttttgtagagcctttcgggttttccatgtagaacctcatagtatctgccaacaggtacaattttacttcttcctttccaatctggatgaattttatttctctttcttgcctaattttttcgtttgaaaagaagtggtgagggtgggcatccttgtcttgtttctgatgtcagtggaaagctttcactttttcactactggatatgatgttaactgtaagcttttcatatatggcctttgatatgttggggtactttccctctatttctagtttgctgagcattttatcgtgaaaggataatgaattttatcaaatgcattttctacatctactgaaaggattatgcgattcttatctttcattctattaatgtggtgtatcacattaattgattctcatatgttaaaccattcttgcatcccaggaatgaatcctacttggtcatgatgggtgatccttttgatctgctgtcgaattcagtttgctggtattttgtagcggttttttgcatctatgttaatcacgaaactggtctgtagttttcttttcttgtggtgtctttgtctgactttgatatcagggacttagaaaatgaggtttgaagtgttctctcccctgcaatctttttggaagagcttgagaagaattggcattaattcttttttaaatgtttggtagaatttgccaatgaagctatctggtcttggttttgttgttgttgggaggtatttggttgcctattaaatctccttactacttaaagatgtgttcaaaccttccatttcttcatgattcagtcttcctaggttgtatgtatctagtaatttatctgtctcttctatattattcagtttgccagtatatactgttcatattagtctcttaacctttttatttctatggcatcagttgtaatatatcacctttcatttctgattttatttatgtgagtcttctatcttatttagtttagataaaagtttgttaattttatctgctcaaaaaaaaaaaaaactcatagttaccttgatttttcctgttgtttttctaatctttatttcacttatttccactctaatctttatctttcctttcttttgccaatttggggtttcatttgttcttttcttagttccttgagatgtagagttaggttgtttatttgagatctttccttttaatgtatgcgtttatcactaaaactttccacttagtacagctttttctgctacttgttttagttttcatttgtgctgagatactttttaatatccattttgatatctttttggacccattggtcgttcaaaattgtgttgtttaatttccacacatttgtgagtttttcagttttctttctgctattgatttctagtttattttattgtggttggaaaagatacctggtataatttcagtcttcttaaatttgttaagacttgttttgtgacccttcatactttctatactgaaaaatcttccatgtgcaacttaagaaatatgtgtattctgctgttgttggattgaatattctgtatatgtctgttaggtccatttgatagttgctcaggtctactgtttctttgttgatattgtgtctataattgaaattgtaattgaaattgtggttctatctataattgaaagaggggtattaaggttttgtattattattatattgccgtctgtttctttcttcagtttgtcattttgctttacatatatagatgctttatatttataattgctgtatcttcctgagggactgacctttttatcattacatgtccttccatttctcttgtgacagttttggaatttagatttattttgtctgataaggacagccatccctaatcttttctggttaccatttgcatggaatatctttttgcatctctttattttcagccaagtgtgttctataatctaaagtaaatctcttgtagacaataaatagttggatctttttttatttaaattcatttagccactctatgtcttttgactgggaatttaattaacttacatttaaagtaattattagtaggaaaggatttactgttaccattttgttcattgttttctgtttgtcttattgttcatttgttcctcttttcctctcttgctaatttctgttgtattttgttgtttctttgtattgatatgctttgatttttttgttttactttcgtgtaacttccatatgcatttttgtggttattacagaatttagataaaatattttataacagtctattttaagctaagaactaaattaacatcaatcacctataaaaactctatacttttattttcaccacatgtatactttatattgtcaaaatttgcatatatttatattgtgtttccataaatatattttttagttatagttatgcttagcgtttttgtctttttgacttttatactagaattgaaagtgatttacccaccactgttacagtaataaagtattctgtatttgtctatatatttacatttaccaacaaatgttatacttttttatgctattgtttgctgtttagtgtcctttaatttcatgttaaagaaatctgtttagcattttttataaggtaggcctaatggtgatgacctccttcagctttggtttgtctagcaatgtctttatctcttctttaagaatgcaagaaacaagtattcttgtttcacagttttttcgttctttcatcactttaaatacgtcatctgacgcccttctggcctgcttctgctaaaaatccactaatagtattacagagattcccttgtatgtgagcaagtcacttttctcttgctactttgaaattccatatttgtctttgacaattgattataatgtgtccctgtgtagacttttaggggttcattttatttggagtttttgggcttcctgaatttgaatgaacattttctttcccagttttgggaggttttcagtcattatttctttcaatagctttctgattatttttgtcttctccttctgggactcccataatgcataaattggtttatgtaatggtgtcccataaatcccttaaactgttttcactattttgcatttgtttttctttttgttcctctgaccaaatgattcttaatgacctgtctgagtttattgatccttttttctgcttgatctaatattctactgaacgcccccccagtgaatttttcagttcacttattgtatttttcagttctgtcatttctgtttgatattttctatatcactttgtttaatttctcactttgcggatacattattttcctgatctgagtgacagttactttgaattctctgtcaggcacatcatatatctccatttcattagggttgatatttgtaaatttattttgtttctttgtttgaaacatatttccctgtttttaaatttaccttggttctctatgttgatatcttcatattagacaaaacagccacctcttttaatctttgtggactagctccatataggagaagaccttcaccaatcatcccagtcatagattttggaagcctctcaaacttttgactattctgacagttttctttgttcttagcaccccctaggcatctagagaatgctgggtcatttcagtgctctgagacaagcaagactcattttctttggaagccattttcttgggaagcccccaaaggttgtatcgttggatgcttgttcaactctttccctgcatagatagaagcaggaaactgggtgttttttactgtttgtttgttttatccctcagttgaggggaggggctgtggcaactagttgtatggtaggccatactacttagaagtgtgtttttatttgcttatttgtttcctcctgcttgctctacactaacctagggagaggagccatggcaagtgcctgcattcatgttcaaacctctgtttattctctgtagaccccagggactagtgtatgctggacctgacagctatcccagacaggcaagtagaaggcactcccttgggtagaagtcagaaaagttgggatgctagatgtgctgtcctatttcttcactcttcactgagaagtaggtagctggaggttccctcttcattatatggcactgtgctagggatagcaagaatgtagctccccttttcctgcttgtttcaatgtggctggatttgcacttgccaagggttaaggagctattcaacgagtttctgggtgtcttacaaacaaaaattgattcctgtgttggtattaaatctgtatgtttgtggggaaggagagtccagggcttcctattcttccatcttgctaccatcacctttattgcatggtaatttaatctccttaaaagcaatacttaagaaatcagaagaggttaaattgtgtcttcctacctgaaaattccaaagcagcttacaacttgttcaaattattcatatgatatatgttcatagtatgacttagctaagcaaataaaggctgtgactaactagagaagcaaacatctgaaagttttttgagtttcaggaacaaaaacttagtatcattaataaaatgggaagatcttagttattgtactatatttagaaattggccacactgtctaggagcatgtaatttcagaatacaagcacatacagaattacgtttattgaaacacagaaagattaaaataaaattatgacagattatattggctggtcttctcagtttattccatgtcagaaagatgaagagctcaatataacttttccttgagcaattcttttattgaggtccatggttgaggtcatatacaaagatgatcctgcagtttctgaaccatgtagagatttggaaacaatatcatctagatcttttgctggatgccctgaaggtaaggtaaatatacgttaaggttttctatgtatcatggaaagaggctgaatctctctctctctgtctccctcaagccacatttaggaaactggagcatacatagaggctatcaaccaagatagataattgtgaagccatataacacaagtaacagttgaggaaatcaaaatgctattaacttgtaatagctatgctattaacttggaaaggagataatttggaattggaaagtgagaagatagctgtatttaatatttgaaagaagtttttctgtgaaaatggacttaagttattctgtctgcctttattcagtgaagggaagttagaagtagatatagactccatcactttataaaaatagtgttgagtgattatgtaatgaatgagctatgatggaaaggaagattaatcaacttacatttaaagtaattattagtagaatactcggtggagtattttacaaaaatactcagtggagaatttttaaagcatggaacacagttgacttccttgcctcctattgaaatcaacaggccatgtgcagttaaaacctcaggcaaatttccaaatatttacttgagcccatcagtgagggctatgaaggaccattcatgaggggatgatgtttaacttttccagctgtgattggcgggataccctgcgttatggtttctgttatgcagcattgacatctgaaatcactgttataataagagcctgcttgtcaccaacccaggcaggcttacagctgtgagcagttattgtaaaatatagtttggattctatcttggcagccatgcatgagcaactaagcatgtatttactgcagtgtaccaaaatgaattccaatttgggattattatggaagtttaaaaaatgtataataacttattttttaactatagaggttcagtgcacaatgagaaatctcaacaacttctttttctcttttcaagaaatgtaagttaaatttataatgtaatttaattaagtttcctattggatggttaaataagagaattatataattttccattaaaaaaagctaatgtgtgtcaaccttacccttatttaggagatttgggttttccccccaagtttcccaaatatcagataggtaaggaaataagattgatttatcttttctaaccccaaaatgtatgcatcaaaatgagtgatattcttcaaaatagtcatttctaccatggtaagctatccttgtaattgacttaaaaattacataagaaaatgagtcacattatttactttgcttcttgtttttgaacaaaaataagattacccagtgcactcttccatcttattctaagacttaaaagttattgattcatagatgctttcaaaaatcaaattcatcttcagagaatcaagatttgctacttggaagatattaaaggaatgccccaggctagaaggcaagtccataaggaagagctttataagagtttgcatatagttacgtaggccactgcttcaagggatagcctcctttgaaggtaacacatttttgctaaaagtaatgagccttgtcaccttataggcacatggtgttcaccatacctaattgaagggtttccactctactctgcctaggctaactcattgcatactttgagtgactgggtgtgtatctccatgctttctgctagtatactagttgtaagtggtaggtgcagggaaaatgaaagcaattagaaatagccaaagaggttaactgccccaacccacctctcaccagtcctgaagggtgtgtagaagaatagcatagagtgacaggttgtagttgactcataaagtctgtcagagaaatggtgggagctgttggaagaagcactaaccgagactgagaagcagggatgagattggatgaggtgagcaaagaacccgtggtgcaaattagagggaggaagttgctaaccctgcactcacatgaccctgagagtaaggggccttcttaaattttgtgccctgtctcacctgcctcaccctactcctggcgctggtcactggggccaacttctaattcagttcacttttgccacagacttgctgagcaatttcggacaaattagaggttatctcatgcagctccacatttcctaaaagtaaaatggagataatccctgaaacactcattctgtaggttgctagaaggatccatcagatgtgacaatgccttgtaagccataaccatttatattattgtgttttttttttctttttcctaccatatcaaattttttaaagcatctcctcctgggttagttcttatttttcaaatagctgggcataactggactacggggaagattttttttaaactgtagatatctagggcttgcctcagtctaattaaatcagaatctcttagtgtagggctcaggagtcaatatattttatgatacttccttattcgttctacttatttttacatttttctcatttatttgatgtataacaatttatttaattggcatataataattgttcatatttatggggcacgtagatacttctttattaatttatttcttagttgctgccttataatgtataatatacatctttaacatattaggtttaacttgaaatgatgtattacttcatgtattatttaagaacagtacaacagtacactttcagttcccacctcctttcctttgcactgttattgtcatacatttttcttttacatgttataaaccccacaatacattagttatgtttttttgctctgaatgatcagttaccttttcaagcaattaaaagtaggaaaacaaaatcttttatattttacattgatttttatcatttctggtactcatttttctgtgtagctccacttcatattaaaattcttatgctggcaatgaattccctcagcctttgtttgtctgaaaaaaaatatttcatcttcacttttgtaaatattttcattgggtgtggaattctgagttggcagatttcttttaacttttatttttcagtactgtaaatatatcatccaatgtgttctggtttgcatggtttctgaagattagcatcccgtaattcttacctttttattgtatgcttttcttttattcttgatgttaagtagtttgactatgatgtatttagatgtgtattgtttggtatttttcctttttggtattctctgagtttcttgcatctatactttgatgtcttcattatttaaaaaaaattttcagccattatctcttgaaatattgcttattattctctcatctctttttgagacctcaattatattatgttagaccattttatattacattgtaggtcttagatgctcaattctctgttttcttcaattctttttcctttttgtgttttaatggaaataatttattgtgacctgtcttcaagtacactatttatttcctcagctttttcgagtttagtaatgggcccactgaatcaatttttcctctctgataacatttttaaaatttctagtgtttccatttgatttctatttgaccattaacgtttctatatctcttctgaaattccccatctgattatctttgttgttgactttttcaaactagatactttaacatattagtcgtagtcattttaaaattcctgtttgttacttccaacatctgagtcatgtctgagtctgtctctgttgtttgctttaccttttctcatggattgttgtttttttgtttttgtgtattttgtaatttttgattgaatgccagacatcatgtataggatagtgagtactgaaataatatttatgtctggaaattggccagcctttttgtcaggccgttaatgtgagagttggaatcaattaatcaggacctgagctgcattgggtctttatttttgctattgttacttcagtgcaccgcagctttcaaattcctccagaattggactgctaatgccttgtacttatattttaatatctgtaatattttcaaattcttaggttgaagcctgacttgggggcccttaggtgctggagggtttctctcagtgtggctgctgcttattagattttagttgtctttgtatgcctgtagagacccctctgcagaaggggtctctctccttgcactgtcctcctccagtggtaggccactattgcttgttttttagtgttatagcttgtagtggagttagggctgtttttgttgttgttgttttgtttgtttgtttgtttgtttgtttgttttaaatcctttcccggccttgttttaggcaaagtcagcctcatatctgtggttggatttgagcgagagtttccttccctgcccaagttggagcagtccactacttgttgtaggagtcaggtcttgggcctaggaagcttttatgccccttgagactttttcttttacccttttgcctacagcaattatttttgcctaaaatctagaggtcagaaggctctccatctctaccagagccacattggttttacttttattgctccccgagaagcagtagatctttgcttgcacctgtgggtagaagggtttggtgccccctcctcaagcggcttaaagctttttgtttttgtggttgttgttgttgttgttgttaagaggaaatgttccatagaaatgagcagggctttacgcctatcccctagcagccatatatcacctcattctcatccacactgcaagggaatgtcttgttctcagactttctcatggcttccaatgttgacccatgggaaagagcttgcccattagcacaatctgtgcctttggccctgtgtctttggccaccagctattccaaatgacacattagtccaggggattctaatgaacaaagtattgagaatcacttgtaggaaaagagatttcttgggaagtaaatctgtttttatagaattgctgttggtgtgagtgttatcagaattataaaaccaaatctaacatagtttcccactatcttcagaatagaacatttaaagatttcgactagagaataatgagtatagttttgccttctctccctgaccaattctggattattttctggtctttgactgcaaactctgccctcagctgcttgtgattagcctaattattatcaaaagggaagatatttatctaatggcttcaacacaaaggattggaggtgttcatctgattttcaggagtcacttagctagtgaaactccagcccatcttgatctccagtcaagatcctcagcagctctggccaaggaaagcattttggcacctggctgtcaaagggagactcttatgtccatgcttctttcttagtgagtgcatttcctgttgacagaatcgcatcgccaagcgcagcaggaagctagtggactatgacagtgcccgccaccatctggaagctctgcagagctccaagaggaaggatgagagtcgaatctctaaggtagggattgagcccatggtgaataccactctccgtattttatgacctgttgcagctttactttttaaaattaaatgcctcctctataaaaggagattggaatctgaacagaatttaaactgaaacatagtgctttttattatttttaattaaaataaggcttttcattatattgtacagttcatatgggggatactgactcacacattttgatcagaataaactttgacctacaatgttgcgggatcaaagaaagtagtgtgtctgcacttccttagatggttgtggtccaccctcagtgctgaaatgcagatgcagatgggacaccaagctgaaattctcagaggtgacttttgattgtctgagagtacggatgtgtggatttgcataaaacaaattttctgttagaaaacattttttagtagctttcaccatgtatgtcagcaagttacagatgccgactaactgaagtcacctcctaactataccctcttcttccagtcatgccttttcctatgtgcctacacacagctgcctgaatggtctttctacatcgagatatgtttctcaactgcttaagtcttttaatggtttctattgcctctacaaaaaatactttatttcttagtacagcataaaagatcctcacaatttggctgtaactcacctgtccatcctgatcaactttcaagtctcctttcccctcctcgccttcttccataaacataccatgagccagaactacacatcagtttctgagcagttcacaataacaaatgcccttcatgagaggcctcctggataccaggcactctgttcaacacttcatctacattaactttccttaatactcaaaacaacctgtgaggtacacagtggtaaagcagtctgacaagttcacatggtaagctggaattccatttcaaggctttccacctttatgtattgtaatgtctttcttaccccctcctttagcaaacattttctgattctttaggattcagttaaaaaattaccttctctcttctctgcaccaccttccatatagcatgctctataacacattgtaagtcccttttgtaaatacatcctgtaatgtaattatttagactttccactaggctgggaatttcctggggatgcattcatgttcagtatccatagcagagctgtctacatggcaggcagctaacacatttttgtagaataaatgaatcagccagaaactgcaagagcaaccattgtaatcaatccggtttccagttttagggagtcttagtgtttcatgtttaattgaaaaacaaggatatgcttttaaccaaatactctccttctcaaaatatttccaagatgccataagactattcttattttacattaaatgatgctgttgtgtatagaaatggtctttcttagtgtaaacacatgttatgtttcattcctaggcagaagaagaatttcagaaagcacagaaagtgtttgaagagtttaacgttgacttacaagaagagttaccatcattatggtcaaggtaaaaatgtttctctatgggttgcacatgttccttttagaaattcaagatcagtgaatatcccttatcttgtctttattattactgtgacatttcaacactgtccagtgaaagtgttctttatctgcgctttccagtatggtagctacttgtcaccagtgggtattgattgcttggaatatggctaggattaaaaaggaggaactaaattttaaacttaatttattttgttctaatttatttatatttaaataaccacctgtggctagtagctgccatataggatgacacaattttagaccttgatctatttctcaagtggagacctaaatctcaattagaggcattaggaggactgcccttcatcttgaaacttaacaataatatcctttcagttcttggaggaacttcctttattccaagagctcatctagtcatctggcttagatggtaagcctctactttaagccctgacttttaaatctgaactgtatttgtattttaagcaccagatattcttacttacacgttactctgcatttctcgtggaattacgtgcattttgaaatagttgttctgtttttcctactcagtggtagaacaaagaagttgttggatgaaataggaccttatgatccttaatctctgtcagcatcctcatgctcccaccccaaattagccagagttgtgcttaaaataatgccacgttattttaaatcaggtcctctatttcttaacttccaactagatggatttgcctctaaagccttcctatatacaaattctagagcttctatttacccaccaaaattgtaagcattttgagggtctatactaaagtttgcccatttttgtgttcatcgctagtgtttttaatttttgccaataaaaggcactctgtgtttctctctgaactgaaatatctggatgaaattttggctagtttttacctcagtgtccagccatcacccaaagtccaacatgtgaaattatgtcattgttcatctgaatttactcattctctctacatctgcatttctttttctttttatttatttcattttattttattttattttatttttttggtgccattatttctgggttccgaaacctcaaagctttgcaattgttacctacaggaaaccaaagagccatcaaaataatcaatctatcattttttggtgtgggcttctggatcactctccctttctctggtcccactgtccccaccctaaccctcgtcatcctgttgtgtattatgatggtagtcttgcccttacatttctttctttgacctcttgctgtacaccttttctttcagaagctccaccttgacatctctgtggcctgcttaggacctcactgtatgtgcctaaagaagacctcttctctcccccagagaggatttaaacaacctgaatatatacaacttttagggatagagataaaacaaatatctatttatgatttgaatttatttagttattcacatttatttaaaatcacaaattatatgatgctatggcttttttttaaaaaatacagatattacttttttgctcttacatttcatggaatactttttttttttttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccttcatggaatacttttatccaaaatctttacatatatctttagcatcacttgtttttgtccttacttaagatactcatcatctcaactagtagttctccagagcttatcatcatcttcaacagctatttagttccaaacacaggttgtcatttacatacaattaagacagttatactttttatttcccctgtaaaggaattttttatgatttctaatgtaattgcttaatcgctttttaaactgatcttcaaaaagtcttgggtaccacagtgttcaaggctttcaattatgagataatacccctgggaaattgccagtgccaattatgaaactttggggaaattgccagaattgccaagagacagatatttattatttgccttaatatgtattgggtatataactaaggtttttctagtgatctctactacatccaaaactagcattgatgttatttcagtcttttgtgcccttcctaagttgtatttggttattcaaagtaaagtaattgttggagtgtctcgtagcgtgaaagactttgtagggacttaaaaacaaagggaatatctgagggataattttggaaagaaacctttccccttttctggtcatacgcagtataaatgtttcaatgcttttgaaatcaatctaatgtctcactctggcacttaggaaataacatcagtcaaaactagtttttcaatccagatcctgcctttcgatcaaaacctgacttaggccttcctttctatgtagcatatttcttaatgaaatccagattactcaaccataataattgtgtgcattgtgtatgctgtataccaaagatcattttttggaatactttctatttgctagctgtcattttatgtactttacatgtataacctctaatcattacaattacagatctctccatttcacagatgagaagctaaagatcatattaattaaataccttaccttaggttgttaagcttgtaaatcctaaaggtagcatttaaaaacactttggtgttttgttttgttttcatgtgaatcctgctgcttttatctagggcctctctttatctaaaatgagattgcatttagtcataatttttcaagttattccataaatacatatgttctttaacaagccatattactcaaccttgaaattgaaattagtattttgtatcttctttgcctcctatgaggaaatgcataatactgggtatgaagtaataaacatattacatgttagttattaatgcatcaaactatttataatccttcagaatgttgagtggaatgttctatatatgcctgtgaggttcaggttgactatatgttgttcaagttttctatttccttactatcttctgccttgttgaaagtgagatattgaagtctcccaccattattgggcttatttctgtcttcatttctgtcagcttttgcttaatgtattttagggctcttttgttaggtgtatatatgtttataacttgtatatcttcttgatggattgactgttttttctttataaactgtccttctttgtctctaataattttgactattttgtctgatattactatagccattcaagctctcttttcattactctttgcatggaatattattttttccatttttaaactttctacctatcttgaatttaaattgtgtctcttgtaggcagtatttagttggatcatttgtgtgtgcacatggtgtgtgttttatccattctgccagcctctgcctttcgattgctgtgctcagtccatttacctttatatagttaccaaaatgtaggcttttctgtctactattttggtaattgcttcgtgtgccttatgtcttttttgtttctctattcctccattactgccaagtgtagaaaactttcaaatttttggatttaaactgatcttcaaagattagtagttcatgagggagaaatggaactactgcttagagggggatgcaggttcaattttaaaaaaggaaatactagaatatgattgcaggttgtaaaggagcttatagattatatagatagagatgatagagtggtatcaccaagaaggaaggactctaaagagaattcttgaggtaaatcttgtaaaataagtaaagccaccatttagtgaaaaggatattctaggctgacatagagtatgaataaaggcctgtgggttgaagcagatatctgggttcatggaactttagtctaatgtaactcagggtcagagtgatagtgtctaggaggggcttgtggtgatgaagcaggagaaagatagggatcagatacatttatcatgcattcaacaaatatttattgaccacctactgtgtgtgaagaactctgttagatgttaaagattctgtactgaaagtttttgtttgcttggagcttatattgaaggacagggaaaggcagttatctttaaaagaaatgaaaaataagatatcagacaataagttcaatgcagaaaaaattttaaaaaacgataatttagtagagagtgacatgagatggtgtaactcagactatagtttggatgtttagggaagttgtccctcaaacagatagacaatatgtaaagaaaaggaaattttgggaagattgagtctggcttatatatgttgagttgaagaatcattaggaaattcaaaaagatatgtctattaagctaagtctaaagcttgaagagaggtttgggagtcattaccatatgggtggtaatgatgccatgagagttgatgaattagatggtcggatagatcaaatggcaagatgaggatcaaagcagaacctttgagagcactaatattttatggaatgtgcaaaagaagaggggactgtggaaaagccttccaaaaattaatcagagatgtagaaggagccatgacagagggatatctcaaaaaggcaagaatggagagaattttaaaaatgaggagtgccaggactatcatttacaatagaggtatcaagcagatgaggactaaagaggcatcacctttggtaaacgtccagaggggtttcagtagatgttgggatcagaagcttgattataggcattggagactccattggagatgaggaagcagcaacagtgtctgttattttgaggattctaactatgatgggcctgaggaattgtggcagctggtatagggaaattagagggcaaggggagctttctaaaaataacttttgtcattttgagaagatggcatagttgtggtaaaggtggaataatttaggactgaagatatgtggggcaaacaggggatcaggacaaggaggaagggtgttgataggactgaccagagagtgttgaggggtataccacagggcccaagcttgataaagcaggatgttcaacctgatcaagggtagtggcctggaagaaaagtgcattgatctcacagaggttttgaaagaagcaggtggaatggaaatgaatgaatgagggagctcatggcccaggaaattaggttagtgggtgggccactaatctgccccatttcagaggtgaaatagttgtgagtcatggcaagatccaagatgtcagaggccaatgcagaatgtgtataaatagaatgctggggtccctagttagagggctcatgttttggctggatagtcatagggttgttgagatctactgtgttagtgttaggatttggtgagggagagaggggaaaccatgaggcatgccattgtggattgtggttggggttgaggagtcttgctgagaggttgatattaagctttgaagaggtttaatatgagtgccattaatcctgaaatggagtgtaaatgagcttagaggatcagaagagagctaggaaaaaactcttcctcatactccatctccatagtaagtgaaggacagcaagggttgcctcctccactgcaagagggtctgcaggaagcactgacactcccctccagggaggcagatttccttagggcattgcgaaggggagagtgctcaggtctgcaatctgtagctgtgataagctcaacttaatttttcctttatttctgagaacaaagaaacatcttaataaagaaattaagttggttttgacagctaataagaagtgtcctgaggatgccacatttggggaaatggtgatgtctcagagtccctgtgcaaaatgaaacttttaagcagataatatcagaatcaagagcctggtatgctggtactctgtgtctgtatgttctttttttttttttttttttttttttttttttttgaggcggagtctcgctctgtcgcccaggctggagtgcagtggcgggatctcggctcactgcaagctccgcctcccgggttcacgccattctcctgcctcagcctcccgagtagctgggactacaggcgcctgccactacgcccggctaattttttgtatttttagtagagacggggtttcaccgttttagccgggatggtctcgatctcctgacctcgtgatccacccgcctcggcctcccaaagtgctgggattacaggcgtgagccaccgcgcccggccgtctgtatgttctactgctggttacattaagtttttacaagccagggtcacatcggaatatgctcttatagtggaatgagtgccaagtttcttcattcactggcttgtttgttcatttatggaatttattcatttactcatgcttgccgtgtactaggtgctagggctgtaatagtgaactagttaaaggcattcccctctttgcaggatctctgacttcataaattggagaaaatcactatcagttgtatcaaaaatgttggacactttatcctaattaaatacatgctagttaatttctaaattaaaaaacaaaatattagaaatagatgtttagttattctaaataagatatttctgatactataccattttctcaggataataattgatttgacaacttaagatatgctgtatatcagaaaacaaaattgaaatatagaagaatgggacttcttttttgtttttgcctaatgcatccaaagttaaatatgtttaatagaagtgccattacatattgataagaaaaacaatactaagaaataaaaaaatttgaataggtgattcacaaaagaaggaatacaaatgagcaataaataaatgaatgaaagtgttaactttaattgaagaaatataaacttcaaagtcagtgagatgctaacttttggctatcatatttataaaggttgtatgtaaggtaatgtaagggactataagtggcccagtctagtgcgaccagttgagcagtctgacggtgaacatcagtgcttatttggttcactccttttaccagcaaataccttcaagaaatctgtcctaaggaaatgaataagctgtgtacaaaaccttaatcatagatattcattagggttttatttaccatagaaaaaaattaataaaaataaaataatactctccagtgaagttcagcttacacacctcttccatctgtacccaccttctatttaaattggacacttctttctgcagcccaagtttgtcctcttaagcagatgtttgcagctgtcacagggcccattgctctcctctcttctcagtttctctgtttctgcccatatccactcacttttgatatgtaatcatgtatgccttcttgttgtaacttaacattcccatgtggttttataagctgcttatttctaatatatatatatacacatatatataaaatctgcttatttctcttacacacacacacacacacacacacacacacacatatttccattgtaagtataaatagagcagcccctctggatgcttctctaactggattgtacgttcctagagacatgttcacctaccactgtgcatgtacccagagttggataggtcctttgttgagtaattgaaggaagtaattgaaggaagaaaagtgttaagaattactgtcccagttgattggggccttggagaaggggtcatgagttgccactcaaagtaccccagaagacttctctgcaaacactgcgagtggggtccctctgcataatgtataggtagcctgtagggtctctccttgcctgtcaagctgctgccttaattagcttcctcaaatacaggtgcaagtgttctcctttgccctatctcagacacatctaggggttgcccactgcctgccaataaatattgtgcttcgtggtctggcaaggacctctgccccagagaaccatctgcttcctcactaggctttcctctcccaggctctggtctgatcttcctgggggcttaccatttcccaaacacactgtggaggattttctttattaatgaatagatgtctatatgcatgtgtatttgtatgcatatgaataggtatatgcacatgtatttatgaataagtatatgatcttttaaaatcaattaaaagaaaaatatatgaagtcagggtcacatgatcactgtaggtatagaaatttaagattaagtcaaatatgttagggatttaagtaaagataagccatagaagaagttaatctcattgctattatgaaggggcagcttatgttttcatttactcagtgatgacacgctcttatttttgatgagcagttagaattaatttacgggttttgtatttccttctatgaaacaaatttcagagtccaaacacataataataactagaccatttatagtttataaaagttaataatgaacttctcaaatcttgaaagcaagaaacagtaactaaaatataaataagttctcagggcgggggttccataagcgttgtctctgaatcagcagcatcagttatcacctagaaactcatcagaaatacaaattctcagtcttcatgttcagacctactagatcagaaacacacccttcaggtggttctcatgcacactaaagtttgagaatcactgtcttaaggcactgaattttaggagaggtcatgctctatgccaaaagatacttgtttttgttcattaacagatgaggaaatgttgggcttgctttgggttcagtattttatttagtccaaagttattcaaaatggtgtaaaagaaacctgggttttcatacatttcattgctattaaaattatttttactgactggtctttccctctctcttctttcctctttgtgtttccacatggcagacgagttggattttatgttaatactttcaaaaacgtctccagccttgaagccaagtttcataaggaaattgcggtggtgagtcatgacgataatttttgcatatggaatataaagtaaaggaaggtttattttggaagcaaatgaaatgggatagaattatccaaagaattcacccttttgtatgtttcttttagcagtgtgttattaccctcgataacatttctacggtttttcatagtgatcacatagttctttgtatcttttgaagattttgccacagttttacagtgttgtttcttttaccaggcagtttataaagttggaattcccagtggtattttaggctaatgaaaaattgctctcaaagtatttagataatcaactctgttgttgattgctttttgttgttgttgttcaaaagggtggagtcaatgtaaacagtaagcttttgttttctgccctgtactctggttaataaatatatacatatatatttagtttactcgtgtttcgtttgtttcagttttgacatagattttaaatttgaaccgtatacagaatttcagttatcctgaggccatccaagctatcataaaatttatagcttctcaataagcaatttctttcttggggagaatagcctgaattggcaccagaatgacatgtgactaatagacaagtggcctctgtccccttagctttgccacaaactgtatgaagtgatgacaaaactgggtgaccagcacgccgacaaggccttcaccatccaaggagcgcccaggtaggcccctgctcattggagcacctgtaatgtcctgcttgctaaaatttcttcaatctgtggaccagcctgtactattttatttatcctacaaaagtcccacaggagccttttcaccctagaagctgacactaattttatttttgtgcttttacatttatgtctggccttcagtgacccaactaggattcttcttcttgtcacaacagcattgactttctgcctctctgcctctctctgctttccatgaggcctgatagcaacagtgtgaaattttaatatataatgtatatgcttgttgtaatatataatttgttatgcacttaatattttctccggagaagaaaggaattcccaaagtttatgacagtttgtcttgattgttatcattgatgctgacgtctttcatgaatccattttgggaaaggaaagaggaagtaggtgagatctcatcttcctcttacctcctgactcttgatctggtgaacactgtgctgtttttgttttattgcacgttgcattatgagtatgccagtcaaataccccggagccccaatgatccataggtgacctgtctaccttgccagggttcggctgcacaccagctttctccagtgattctggaatcctttttattccatccttcgtagactttacgtactcagagattgaaggctagtgagctgggagtcagaagacccagctttcggttttctgattttgcagttaacttgctttgccttccttgagtaagttcaaaacctctctggttagaggtctcattttttttaattcaatagaaaaaaaaagatactattgaactacatggtttccaaggtaatatacagtcctgacattctatatttgccattttaatacaaacacttatttgcatacatttatgaaaacacacatagtcatacacatgaaccaacttctacatatgttaatgtttggatccctctagagattgttaattttcttattccctgctctttggattagccctacttataggttctgctatggtttctatactatgtaagcagtagtatatcttctctttctaagggaaagaatattgcctgaaagaatacataagagaggcagagttactgttttcagtatggttatttcagtatggggctaggcacgaaggaagaattggaatgggaatatcagaatgatatttgagtgttttaaaaatgaagtgcatgaaaaaatttagggttgttcccttacatggaaatgaaagggacaaattcatctgaaaattgtaatgttgccaaatgagatacagtgaagaaaaagcggggccatgaccacttaatgaatgttcctttcactttttttcaacattcctctgcagaatgaggtggtgagtgagctcagtggcatctctattaagcttagattggggctatgtttccatctgaggccatgattgctggcatatgaccccaatcatgtggcatgtctgtgttctcgctaaaggacccagtttcctcagccctttgaatatgtagaccatgctgctgtgtacatgctcttttattttggggtacagactctgtttcttcgagctgtagactttagaaattcttagagagtaggatgtgtcctgagtgcttcttagtcatcacatttgggctgttcccgagcgtctggccgcatgccaggaacatggtgggttcttagtaaacgaaactgaatcttgtctgattttgttgcacatttcaagatgcctgagttgagtagttatttataaggtctagaaagagaaataattagtgagtttatttccaaatgttattagaaagcacttctacaaaatccttactaacactatcctaaggttaccttttaatataaaagttacaattttcatagttttttatagattgtgacatggcaagattctcttgtaaatagaaagtgaaacgagtaaaatcaattcagcttatgtttggaagattcttgcagaacttgtttgaaagaacagagggcttgcattactaagacctgaattcagattcactaaatggctgggtgattttagagtttttatttttaacctatctatgccccactttactacttgtaaagtggggacaataaaacatggctactgtgaagacaaaagataatacatgaatgaggtctctgtagtgcaaataaatggtaccagttatcaccatcactgttgcaattaaccagaattaacctggaaggggagagcaggacaacagacagtacctgttaggcttctgggtttctctgaaatggaaaacccctgattagatgaatactgttcttgagaaggccccttgcccaatcccctgtgttcctctagtgattcgggtcctctccgcattgcaaagacaccatcaccgcctgaggagccttcacccctcccgagcccgacagcaagtccaaatcatacattagcacctgcgtctcccgcaccagcacggcctcggtcaccttcacaggtaggaagaggtcaaatatattgggggatagagctcatgatgagatgaaggtggccccatctaggataatcccacggtgccggggctttaagagaagtttccagttagggagactgagatgtgaggctttaggcattgtgattgtcatgaaggtatccacctgcttttcttatttgacttgatatttcctcacatgccctatattcaagttttttgggacttcttaccacgttctcggcatgctcaggcgagcatgctctctcttctcctatctcttgctacaaaactcttttctttcaatgctccatttaaatcctacctctgcatgaaaccttccctctcctagtggtttagagttggcaggtactgccaagaaaagcggttatgtttatatgtcatctcacattttttggtacacctggacattttttagtacacacacttgcatatgagtggccacttaataaaattgaattgaagaaataattgaagagaaacaataagggctgggcaaaggtaactgtagagagaaactaccacctttattctccctatgttgggtgaaaatgaaatttctgtagaaaaatttatagtccccagtccagttcaagctttcttgtacagatgctgcttgccttacaaaggggttgtgtcctgataaacccatcgtaagtagaaaatattgcaagttaaaatgcattaaatacacctaacctgttgagcatcatgacttagcccagcctaccttaaacgcgccgagaacgcttaacattagcctacagttagacaaagttatgtaacacaaagcctattttataaccgtgttgaatatcttgtgtaatttactgactatagtacactgtagaacataatagcagtcatttaccctcgtgatcacagggctaactgggaagtgtggttcactgccactgccccgcctcatgagagagtgttttcacacattctgctgaatgcctattgcttttacactttcctaaagtccaaaaaaatcatagattgaaccatcataagttgaggaccatctatatgtagttgaactaaggaaagtcttgggaagatacatgcattaaacagacctttaaagttttctacttttcaaaatccttgaatggaaagtgaaatgtaagctgcctatagtaggtctcaccaattcaaatgaaaagctgctttagttttgaaattttaatttatttccaaaatgagaaattattttcagtttagttcagaagagggtattgccctagtttaacctttaaagtatatgtgcctggccctacagctctgtgtattgtacttgagttgagatgaatggactcttatagcctcagttttgtttttgccttgaaccatggcttatcagggctcagagagcctcacaagtagacagcattctttacctgtatcagataggcttgctgctatatgcagatacaagtttcaatcagagctcaatctgtccatgtagctctgttcatgtgacctttcttcgtgtctgacacattgtctttggctggattaatgtttgtatttaatgcttcctagacaaggaaagggcctcctgtcccacctctacctaaagtcaccccgacaaaggaactgcagcaggagaacatcatcagtttctttgaggacaactttgttccagaaatcagtgtgacaacaccttcccaggtaagtgcctggttcagggctggtatgtccatgaaagtcccatggtggaaggactctcaggggctagccctaaagaaagtggcggttccagaaccaacaacataattttaattgtcattcaggcttgttttaattacttggttagtctgaagcattcttacatgggagatgtacggtatttgaaaattatcttttttttaattaagggtagtatatacttatagaaaattggaaaaatattgaaaagtgtaaaatgaataatttatcttatttttaaaaattgttttattgataccaaatattttacatatttatgggacacatgtatttgttatatgcataggatgtggaatgatcgagttagggtatttggggtatctatcaccttgagcatttatcatttctatgcattggtaacatttcaagtcgtctcttctagctactttgaaatacctaatacagtgttgctgactacagtcaccctaatctgctattgaatattggggcttatttgttcaatctaactgtatgtttgcatccactaaccaacctctctttatctcctccttccacccacacatccttctcagcctctggtatctattattctatcctctatctccatgagatcgattgtttctaagctcccatatattattaatttgtggcatctgtcttttctgtgcctggcttatttcacttaacataatgacctccagctccatccatgttattgcaaacaacattatttcattcttttttgattcagtagtgtgtgtgtgtctataccattgtgtgtctataccacattttctatatccatttgcccatcaatggacacttaggttgattctctatctttactgttatcaatagtgctgtgataaccatgcaagtgcaggtattcctttgatatacacatttcttttcttttggataagtacccaataatgggattgctggatcttatggtagttctatttttagtttttttgaggaatctccctactgttttctgtactagttgcaccaattctattcccaccaacactgtataagagttcctttttctccatatccttgccagcatctattatgttttgttcttttaataatagccattctaactggggtacgatgacatctcaatttggttttgatttggatttctctgatacttagtgatgctaagcatgtttttatatatctgttggccatttgtatgttttcttttgagaaatgtctatttatgtccttagcccactttttcatgggattatttgtttttttaattattgagttgagttccttgtacattctgaatattattcccttgttgaatgtctgtctgtaaatattttctcccattcaacaggttgtcttttcaccctatttattgtttcctttgtgtgcagatgccatttagtttaatatagcctcattttttctattattattatagttatctgtgcttttgaggtcttacccatgcaattttccttaaactgatgtcttgaggtgtttccctatgtccttttctagttgttttatagttttgggtcttatgtctaagcctttaattcatcttaagttgatttttatatatcaggagagacagggatccagttttatttttctgcatatagatatccaattttcccagcactatttattgaaggtgtcctttccccagtatatgttcttgatacctttactgaaaatgagttggctgtcaaaatgtggatttattactgggctttgtattttgttccattggtctacgtgtctatttttataccaatgtcatgctgttttggttactatagacttgtaatatgtttagaagtcaggtaatgtgatgcctccagctttgttcttgtagctcagaattgctttggctattttggctctttttttggtttcatacaaattttatgattttttctaattctgctgaaaatgttgttggtattttggtaggcgttgcattgtatctgtagattgctttgggcattatggttatttttacaatattaatttttctgatccttgtccttttaattttctttcatcagtattttgtagttttcctcatacagatctttcacttccttggctaaatttcttcctaggtattttattttgttgtagctgttgtaaatggtattgccatattgatttctttcccttctggctctttattggtgtacagaaatgctaccgatttttgtatgttgattttttttacatatcctgcaactttactgaacttatttatcaaatttaggaggttttttttgggtggattctttcattttttctagctataaggtcatactatcagcaaagaggaacaatttggcttcttcttatccaatttgaatgccttttatttctttatcttgcctgattgctctggctaggacttccagtgctatattgaatgggagaggtgaaagtgggcatccttatcttgttccttatcttgttcatagaagaaaggctttcagcttttctcccattcactatgatgctacctgtgcttttgtcatatatggcctttgttattttgaggtcagttccttctatttcctagttggttgagagttttcatcatgaagcagtgttgaattttatcaaatgctttttctcaatctattgagataatcatgtagatttgtgcttaattctgttgatgtgatatattaggtttattgttttgcataagttaaactatccttagatcccctgatataaatcccacttggtcgtggtgtgtcatctgtttgatgtgctgttggatttggtttgctagtattttgttaaggatttttgcatttatgtttatcatgaatatttgcttatagttttctttttgttgttggtgtttttgtttggttttggtattaagatagtgctggccttgtagaatgagttagggagagttctttcctcttcagttttttggaatagtttcaggaggactggtattgatagggttgggctgtgaattcaactaattctaggcttctgtttgttgggagacttctttatttttattttattatagattcaggggatacatgtggagttttgtaacatggagatattgcgtgatgctgaggtttgagcttctaatgatctcatcacccagatagtgaacatagtccctagtaggtagtattttacctttgcccacctccctccatccctccgcaatctttttgtgagaccaaacacacaaatgaggaagaggaatgactcaagtggtactactgcagtatactaccaaaccatggtgacatatatgtcattgtatgacatatatatgtgacatatatacacacacacatacaaaatgaccagaaaacaattaacattatgacagtcacaaaacttcacatattagtaatagccttgaaagaaaacagattaaattaaaagataaactgactaaataaacagatgcttttctcttgctgttcttaggattctgtcttttatttttgccttagtacatagtctgactgtaatatagcattgagaagacctttttgcattgtatctgtttaaggatatttgggcttcttatatctggatggctaggtctcttgctagacttgggatgttttcaacctaatacttcattaaatagattttctagcccatttgttctctcttggccctcaaggacacgaataattcaaatatttcattgcattatattgtcccaaatatcaggaaggctttgtccattcttttttatttatttttgtctcactgggttatttcaaagacctgtcttaaagttctgagatgctttcatctgtttgatctagcctctggttgaaacttccaaatgtgttttgtatttcagtcaacaaattcttcagttccagaatttctatttgtttcttttaaaaaatatctctttggtaaatttttcattcatatcctaaaatgtttttctgatttctttgtttttcaaaattttcttgtatctcactgagcttctttaaaagcaatattttgaattctttatcttgtttctttggaagtgtcatatttccttgctgttttatgattctgtttcattgtgttgatatctgtgcatctggtataacttccaatttccaatctggttgcttcttccaattctttgaaattggtttttgtaggggagggcttttctctgaagatgtatatatgttgttggttgggtcggacattttggctttgattttggccacatgtagtagtgtgatctttgtataatttatttggctgtaaatagtgtcagttgtacttgtgatttcctcaatgacttagggtgcatttgctagcagggggccagggtaaagttttgctgaggacaaggatgccaggttgaccagtctttgggccccagtggaggcagtggtagactgagcattgcttgtgcttggctccaatgtgggttacactagctccagtgttagtgagtccagacaggctgattcttgggctccaggtggcttgctcagatattggtagtggcagcagtaggttgagtgtgtggtcaggttctcaaatctctgggcagctgctgtgatgtgggtgatgtcagtagcggtggtggagtaacccacgggaacccaagtggtccactctggtgttggtgatagctatgacaggtggggtgtgccagtcccttggcctgctgctggtgcattctggtgggtgccacctgtggtagctttggcaggttgggctggcccaatctcagacccaggaggaatattcaggtgccaacagtggtagactgggctgggagatttccaggcccctgaacagcatgctgaagcactggggtgacaagattgatccaatagcttgtcctgaggtcaagctacattgacactggttgtgacatgctgggtagggtggtttccagcctgctgacaaaatgttcaggtgtaggaggcaccacactgccctgcggacctgctattagggaggtcaaagcctctcatggtgggagcagtgtagggaggtagctgtgggacacgtagtttccttgtgccttggtcccgctgcaacctgcagcagcagcagtgggatttgtccacaaagtgtctgcaagtgcctggcttcccctctccctctttggcctggtggtagcagcagtagcatcagccttggccccagggagggatgcagacctttggaagctaggctttcagaatggcacccactgcaactggggaaggtgggggcccctctaaggtggtgtagtataggcaggtagctgtgggtctgtggggagtgcagttttctcatttcttggttccacagcagccctcagaggtgcataggatttctcctagcagtacatgaaagtgcgaggcctctcctctcccttcttggcctggccatgacagtggcagtatctgccccagagcagaatgcagtccttttgggggcttagctcagaatgcctacaagctgcagccactcaggacatggttgcctatggggctccttgtgagttctctctctggaacaatgtctctgtgtggtccctaggcagctacccatgtaaatcttgaagcccatatcagttgaggggttctcccatagctagggttgtaaaaagatggtggtgggtatgtggagtcctgggaattctcacttatcttttcctcacatctgggagcttctcctggatcccagctgaggaaagccttgctgccctctccttgcttgctttcagtgcttcccatcacttctctgttgaatcccagtgttctctcttaggtgatctattcacagtgtgaacatctacttgctattttgcttccgctctgtggaagaagcatgtactagttttctttagtcggccatcttgagaatctcccagaataaagaattgtaggctgggcgcagtggctcacacctgtaatcccagcattttgggaggccaaggcgggcagatcacctgaagtcaggagttcgagacaagtctgaccaacaaggggaaaccctgtcgctactaaaaatacaaaaattagccgggcatggtggtgcatgcctgtaatcccagctactcggaaggctgaggcaggaggaggtgggaggcggaggttgcggtgaaccaagattgtgccgttgcactccagcctgggcaacgagagcaaaactccatctcaggaaaaaaaaaaaagaattttaataatcacttaaatcataccactctgacatgaccactagtgccctttggtctgtcttcttttagtcttcccaaatcactgagtatatatcaattttgcactataaaattgagactgtactatcatgtatttctgacctttctacttaattttattgagcatattttcatgtcataatattgtgtttgcaaaaacatatttgcccatagtattctctcagttggttgtaccaacccctgattattggccacaagttgcttccaacttttttgttgcttcaccagcacttcgataaacatctctttatatattatttcatgtttatgtcttctattgattcttagtagagataggaaatgaaattgaaagaggtgaataattttaagtcttttgtccttcaacaggggcatattatttacatgaattggcaaatgaaagtcagtgttcctactgattttgaatatacctgggttcacatatcccaccgcagctacttgcaggcctgttcctgctagtggctgttttttgtgtttttttttttaattgactcaagaattatcatgacttccagagctgcctctagtgtcactgaaactatctcttttttctacaagtaaaagaccatacagaagtcatggtgatactatttcttctcagtgttctcagggtctggaataatatttacattttacaagaggtgctaatgcagtactataattactgagtacatcaatcactacactatgcgtaatatgccgattataatcacatcatattaataatagcagagatggtgtattgataataatagggacctcagaaaataaaaactcagacacaatgcagtggcaaatcatgatttttcattcttttcaagcacacttatcaataggcaaaatgctttgagctattgttttctttcttctgttgtatgcataagatgctgagtttgataaaattaactggggcttgagatgtgatttagcagctcctttgagaatggtgtttatcggtgcatggccagattgtatgtctgtggataccgagatgccgccagggatagctgtcttagcgccaaaggatcttacccagcatctcccagttgtcctgggacaaacttgagcaattctaatttccaaagttgtacagtccctttgcatttgctactgcccagcttcattctctttgttcgctacatgaattttcgaactgggagtgttttaaggcaacaatacccttactcagttgctttgacctggaccctccaagagcatcctctcagttccatcacaaatagagactttggtcacctagaagccttgtgtgcttagctgaggacatccccatttggtagacaaggcaactgaagtagagacaacatgacatgcagactcattgtgaagtaaagatgaggttcagaagtgttctttctttttaaatgttttttctttgtatttgtaatttgctggctcataggtaaggacacttgatggtggggggaaaaaggatcaaagcacttttgaaaattacagatgccaggagagtcccctaagtacttaaaagagcattcgcttttgctggtactgttgagtgagagtgatgggaaaagttaagaactggggcagaggaagtgcctttccaaacagaagcatgttccagctgcagctcctgtgaggacactattcccgggtctgcttgcctaggctttgctagtgctttatgcataaccccaaggctgctgggaaaggaatgtgggagctttcagtgtctctccatcaatacctcttatatctcactggctgtgtgtcacatccttcagtcttccaggcaattttggaagaactaagcaccagagacattataggagtgcattttcgggggcacagccttatttatattgttttcttctaatctggggaggagtcagaaaggggtttctgccatttttctaaatctgaaaagcgacatggctctagcagctggaccacagagtatgacttggagtgtttccatggattaaatgaccatttgtctcatgtcaagatgtcaaaagcgggagtgaaacagggatttatatttctgtctgctttctggtttattgagtgacataatctggctttaattaaaaatatacagatgctgtctctccctgaagcatcttggcagtttcttcagtggcttgttcctctgtagctataaatagccattttatgttacttcagcccatccagcagtttctgatttggcaggtctgggatgaggtcaggaatctgcatttctgaggaaaatgctgctaatgctgctggtgttggcaccacactgtgggagccactgtttaaagttatcaggattccacatggcactaatcagtgaccattaacaaagcaccacagtgaattaatagatttattccagagaaatacccagctgagtcaagtgtgtgctatgactgaccattcataactgctcccttcaaaactagtgtgactcaaagtcttccatatttagggtagttggacacatacacatacacatgagtgcttataaccttagatgtgttgatcagattataggtcgagctacgtattataagtgaatgaactgtatcatccagacaataatgtatttgataatctacagataaatagataaaagagaataaataacaatacctgggaaaaatgagatgctaactgcaaggaagtacagcattgaaaactagacagctttgatgtacctgaaaaggttttctctgacacatatagcaatataggatgatccgtctacatttattttaatttttttaaatgagtcatttacatttagaagattgatctatgtccccagcttgctatttttatcatgcacttaatgggggaagaaaagcatttgtgttattcctgcccagaagctcaaaatgtaatgactgaaatgtacccagtctcagatggatttgtttgtctcctccaccaagcaccatcacggtgatgattctctcctgagtgtgtcctgggattgaagacagaaatccattagatctggagagccctctaatggcccaaactttaaatgtagcatagaattttttctggtaaatgttcttatctgcttgtagggagatgccccgtggttatgacccaatggtttacttgcttttctggttttgtgtttacaaaaacagatcttccaaaggtccaaaaaattgttccctatttttccatcctaagaacttagaaatccattctctctctttttctttcccttcctctttgtgtgtttgtgtccctacattattcttttaaaacagcattttccaaagcatgtttatgaggaaaactagtatcattagatgctttgaaaagggagtctctgtttacatgagactgaggggctacatcccttttgatttttcacagtttacatcggcatgtttaaggctctgaaaagttctgtaacaaagttccattcaactttgtttagggaagaatttctcagtctctccttcacccccaaaatatgctttcctaggaaatgggtgtttggtaaaacactttaagaaataaagatttaaaagatattttgtccctggaaatcaaatctattccatataaatatgattctaacaagagatcaagacaaaaaataaagcaatcatgtatgtgtgtatatacacacgtatatgtatatatacatgtgtatatacacatatatatacgtgtatataacgtatatatgtatatatacatgtgtatatatgtgtatatacacacgtatatatgtgtgcatgtgtatatatacatgtatatgcacacataaatatgtgtgtatgtgcaaggttatttctctctctttttcaattcttgtcctcagaaaatgttttggggccagacatggtgactcacatctgtaatctcaacactttgggaggccaaagcaggaggattgcttgaggccaggtgtttgggaccagtctaggcaacacagtgagaccctgtctctacaaaaaaaaaaaaaaatagctgggcatggcagtatgtgtctgtagtcccagctgctcagaaggctgagaggcaggtggatctcttgagcccaggaggtcgaggttacagtgagctatgatcacagtactgcattccagcctaggtgacaagagcgagaccctgtctcaaaaaaaaaaaaaagaaagtgttttggattggcttttcttctaacttgatgactggattttaaatccaatgttcaccctccctttaggattatggccctgagcaaatattttttgctggggacctcttccatataaaaagttggagtcacttgaaataagcttatcagcaacattctgatggccagtctcaggggtttccataagtgaaatgccaagctgaccaaaaagaacagtctcaccatcttaccactcaccctcctggaaacaggccccatcttcatgctcacaacacctttgtggataggagccctagagttccagaagcatataatcgaccgtacacatggagtagtgttggggagtgctccgaaggggagatatggcaaccaaagcccagtcctggtacaggctctcaggatgccctgaccagatggcactgcagctgcagctggtcccttctgccagaggaagacttaggaaactgtaagaaaggtgctcaaaagcatgacggtccccttagattcagggcttggggcagggtccctctttgccagagtctatctttgtgtccagtggcagagaggaagaaaatattgcctgtctcaggattttttcatagcagatacccccaactatttttcctaaatctttctccaactatgatattgcatattttctctgatcaaagatttcccctttacaaatccagaggaattatcccttgaacatccaagcttatttctccaagccctgcttatcacgccataggaatgcctaccatgctcccatgcagacatgagcacagcctttcaatcctgagtgttgggaccaattgagcaccattggcttttctacccttatgtctctgttttccagcctaatactgcatcttacttgttaagttcattaaatcatgctgttttccctagccaattgaactgaaatagaattcaacttgcagaatcagtccatgaaatggttttttcacccatgtaatcctgagaggccagcctgcagttatgaacatatgcatctctcacttactgggtatctgtaacctggttctaaataccacactggcttttcaacataacatatttctggaccagctgcctcttctttctcttgctatttttcaaagtaaacatgttaacattattttaagacagaaagaattagtaagatgaaaattagaaggaagaaaaaccacacagtgcatttcaagcccaaatttagtcagttcattgccctggtggattaccaacatcattgttccattccttgagcaggagtaaccaagcagtgcagtttatgtatcatctggtattctgaaaatgttttaaaatcattgggtcattaggcttcactatctttcaaggttctgactccagagctgctaacagtgcctaggctttttctgtctacagaacagggaaagctactaaatatctttctgcaaggtctcattcagtttaaccttgacatcaatcctgtgatttacatgtcattagtcctactttctagaagagcaaacctgccgtctttctgctgaaccttgcctctcctagtgcagaagtggaaagcagaatgctgtaggctatgtgtgacagcattgtaagcacccgaaagagagcagtaccgggcattcagtaaatgaacaaatcgatatcactctttctatccttagtatccaggatgcaggttctctagaactcgtttgagtgttgatattagcaaagttcttcaggttgttacatatcagtgcattattggtaaataccatgatatagtggtaggagggcctttactcaaccagtttagtcatctgtctttccactagtcagagtagaacctcattataagcataggccctatccctcttccttgctgactctattctcatgactgtcagcctttatactattagtcataatatatgtaaaagcaatgaacaaaacccacgtgctacactaggaatgattttgcagcctaccaacttgttctaataaaaaacaaagtcaaaacaaaacaaagtaggaaaacaatttcctagaaggtctagtttattgtgtgtcaactcattcctagagcatttcaggattatgtaaatataggtatgcacataaagcaaatgtgagagaacaatcgataggtctagattgtgagtaaagggatctgcattatactatccttttaattctctgttcagcagtctccccttatccacagtttcactttccatggtttcagttacccatggtcaaccatgatccaaaaatactacataacagtaagatatttggagagagcaagcgagcgagagactatattcacattcacactacattcacctttattacagtatattgttatcattgttctattttactgttagctgttgtcatcaatctcttactatgcctaattgataacttcaactttatcataggtatgtatgtataggaaaaaacatagtgtgtatagggttcagtactatctgtaccatttgtggtttcaggcatcccctggggatcttggaacataactcctccaaataaggaaggactagtatactacaataaactttgtggaacaaatacttggcaacatcattttaaatgactgaacgattttccattctaagactgcaatataaagcacttgaaccctgtccatgtgctatatgactcacattaactgtaatgtacccatctggagcaatcttgttataagcttctaaccacgaaggtaaactttcctaggccactgcttcattgtaattgttgatgaaatgctaaaactttactcactgttagaaattgtaaattgtgacttttacatgaaaggtatttctattacataaaagataacttctgattggccttgttcctaaagattttatttaacctctctgtcttaagcttcctactctacctcttttgcctcattgggaagtcacaagtgtccagcacaatacttaggatatagtaaaggttttcaaaatatgtttaatgaaagaataaaagatgaaaatctctagaagaagaaaagatgaaaatctctatgccctcatggtaatctggcttactataatactgtgttatgattaaagaaattttgtgtatgggtgtgtgtgtgtgtgtgtgtgtgtgtgtttatctgtctgtttgcatgcagccatgaggatgatttggagactatatgttttacttctaagtggtttttttgaggtgtttacagattttatacattttattcaaattctaaaggttaagatcctcagaaaatgtgttgtgtgtgtgctctggaggctagatttctgggtcaatcaaatacttgcaaactacctacagatgcatcactactaaatgttttatggctatagttatatattgaaatctcttttacctgatatgcttataaaaatgatgcccaaaaggatgcatagttaatgtaaaaaaatagtaaattacagagaagcaaaaagtaaaacttcaaaagtaaaagtctattccccagcaaaactcacttttactaattttgtgtgtaaaatgccacttttttccatttaaatagtaactgaaatgtggccgggcgtggtagctcatgcctgtactcccagcactttgggaggccaaggtgagcggatcacctgagattgggagttcaagaccaacctggctaacatggagaaattctgtctctactaaaaatacaaaattgactgggcatggtggcacatgcctgtaatcccagctacttgagaggcggaggcaggagaatcgcttgaacccaggaggcggaggttgcagtgagccaagattgtgccattgcactccaacctgggcaacaagagtgaaactccgtctcaaacaaacaaaaaaaaaaaatagtaaccaaaatgtatatttttggaaatgtgatcattctatgtcaggtttttaatttatgatttttagtacaaatataacaaaagtatttccatgtcaatttagtatttattttattattttaaatagcagcagagcactgtgttaagagaatgtgctatggtaggtttaacccatctcccactattagattttttttaatgttattagtaagctctattgatgtgtgattgatctacaataaactgtacatgtttacatatgcacatatttgatgagtttgcacatatgtatatactattaaaccattaccagaatcaagataatgaatatatgtcaccccaagaagtttagaagttttctgagccactttttaatttctcttgctcctccccattggcgccagcatctctaggcaaacactcatctttctgttgctatacattagtttgcattttctagaattttatataaatggaatcatatagtatcagaaagcatagtttttggattacgaaattcattaatgttgtagcacatatcattcctccttattgagtagtattccattgtatggatatatcacaagttatctgatggatgtttgagttgtttccaatttttgactattataaacaaaggcactataagcacttgtatacaaatatttgtgtgcatgcatgctttcatttctcttgggcgaatacctagggataaactagctagatcatatgttaggaataaatttaattttttaaaaaattgacagattttctgaagtgtttgtaccattttctattttcatcagcatcgcataagagttctagttcttccacatctttgccaacagttggcatggttaatgtattaggccattctcacatggctataaagaaatacctgagactgggtaatttataaagagaagagatttaattggcttatggttctgcaagctttacaggaagcatggcagcatttgcttctggggaggcctcagcgagcttttattcatggcaaaggcaaagcaagagcaggtgtctaacatggcaggagcaggaggaagagagagaggagggaggtgtaacacacttttaaacaaccagatctcttgacactcactcactatacagtaccaagggaggatggtgctaaaccattcatgaaaactccgcccccatgatccagtcacctcccaccagaccctacctctaacactgggataacaagttgacatgagatttgagtggggacacaaatccaaaccgtatcggttagtgtttttaattttagctattctagtaagtgatagtggtatttcattttgatttaatttgcatttcccaaatgactagtggtgttaagtattttttcatgtacttatttaacacccatatatcttctttggtgaagtgcctgttaaaaactttttctcgtgtatttattttttaactgagttttgggacctctttatccattctgtatacaactccctcattagataagatttgcaaatactgtctcccagcatgtggctttcttttcattctcttggcagtgtaatttggagagtagaaatgttttatttgatgaaatccaatttatccatttttttctggattatatatttcatgtaacatctaaaaggtctttgcctaacccaagataaaaatcgcaaggttttctcttaatattttttagaagttttattttcaggtgttacatttaggcctgtgaccaatttggagttaatttttttatgtggtacaaagtgtgtgttggaattcatttctttagaaatgaatattccattgttgaaaagtattcttactctactaaattgcctttgtacctttgtggaaaattagttgtacctttgtggaaaatcagacaaccaattatctatctatctaatatatatgtatataccatgtatatatgtgtatatatatatgtatataccatctatatatgtatatatatgtatataccgtgtgtgtgtgtgtatatatatatatatatatatgtatatatatggatatatttctggaccatgtgattatccattgatcttttagcttacctttgtgccagtagcatgctatattgattattgtcattttatgatatcttgaaatcagggtcagtagggttagtctttcaactttgttctttttcagagttgttttggctattctaggtcctttgaatttccatatgaacttcagaatcaactgtaagttgatattgtattatttcctgggctgctgtaccacaactgagtggcttaaatacaaaaccccccacaaaaaaattctctaacagttttggctgctagatgtctgagatcaaggtgtcagtagggacatgctctctctgaaggctctaggggagaatcaatcctttcttctctcctagcctctggtggttgctgaaagtccttggggttccttggcttgcagatacatcactccagtactccaatatgcaccttggtcatcacatggcattttccctgtgtgtctgtgggctctgtgtcttcacatggcattctccttgcgtctacatatccaaattttcctcttcttacagggccaccagtcattggattaggacccactctaatcaaaatctttattttattacattggttcagaccctgttgtcagttaaggacacacttacaggttccagataggcatgaaatttggggggtgggggaaaatactattcaaagcagtacagatattgaatcatgttgcaccgagtctatagatcaatgatatgtgagtcatctgacgcatagacgcagtatatctctccctttattaatggtcttctctaatttctctctgccatgttttacagtttgcaatgtacagacattatacatcttttgttggatttatccataagtattttatattgttattataaatcatgtttttaaatttgttttttctggttgttcacactattgtctataagtacaactggtttttgtatattgatgctgtgtctgcagctttgctaaactgaattattagtttctatagcttttttgtagattttattggatttttctatatatattatcatatcttttatgaataaagaaagtttacttctctctttgcaatctcggtgccttttatttatttttcctaccttatttcattcttgtaccaccagaataatattgagtaaaagtagtaaagcagtcacccttgtcttgatcttagaggaagagcatgtagtatttcacttttaaacatggtgtttgttacttgtaggttttattagatggcttttatcagattgaggaagtagccttttattcctacttaaagagttttaaacaggaattaatgtggattttctcaaatgctctgctgcatctgttaagatgatcatatgagttttctttatagtttgttaatatggtgaattatacttattggttttccaatggtaaaccatccatgaagtcctaggatgaaccccatttggtgatgatatgttatcctttttatctgtgtatcttttagtcagcttgctaaagctcggtctagaatttttacattcctgttcatggggaatattaatttataggttttttttaagaaaagggtttttatgatttaatactagggtaatggtattgaatgaattgaactgaaaatcaattgctggttaagtttgtgttggtattatttgttgcttaaaggtttgatagaattcatcggagaactcatctgggctctgttttgttgtgttttcttttgttttgatatatttctatataatagatatagagcagttcagggtatctatttttcttgagtgagatttttgtatttgtagtttgtgtttctcatgaaatctgtccatttcatctaaattgccaaatgtatttggagtacagtggttcatcatatttactattattttttgatatctctaatatctatgatgatgtttccctctctcattcctaatattggtaatctgcatccttgttcactctctctttttactccaattagactggctaaatgttgattaattttattgatcgtctcaaataactagcctgtggtcttattgattctctctttttcttgttctcactctgtcttttgttttctgtttcactgatttccactctaatctgtataatttccagtttctactttgggttttattgctctgtttatgttttttttttatattcagggtaaaaagaaggtgaggttaataatttcggacctttttgttttcttatatgggagtttagtgctataaattttccgtaagtactgctttagcagcatcccatacattttgatatattgttttcatttccattcaggtttccaatttccactttgatttcttttttgactcattgaattatttagaagagtattatttgtggattttgcagagatcattttggatgattaaaatatttgtggattttctagagaccattctgttaacaatttccaatttaattccagtgtagtcagagaccatactttatgtggcttgaatgtttttaaattagttgaaggcagaagtgattcagtgacagttttttccagctgggacacatggggtcttaaaacaaaggatagactaccagggagaggaggaaggctgtatctcacttgatgaagccactaggacaagagtggactgagtaagcatatggcagccaccttcatgctgtactctttaacagggcaagtttttattaaacttttaagttcaggggtacaagtgtaggtttgttgcataagataaacttgtgtcatgggcgtttgttgtacagatcacttcctcacccaagtattaagcctagtacccattagctattttttctgatcctctcccttctcctaccttccacttccaataggccccagtgtgtgttgtttccctttatgtgtccatgtgttctcaacctttagctctcacttgtgagaacatgtggtatttggtttgctgttcctgtgttagtttgctaaggacaatggcctccagttccatccatgtccttgcaaagaacatgatctcattctttttatggctgcatagtattccatggcgtgtgtgtgtgtgtatgtatatgatatatatatgatatatatgatatatatgatatatatgatatatgatatatatgatatatatgatatatatgatatatgatatatatgatatatgatatatatgatatatatatgatatatatgacagatatatgatatatatcatatatatgatatatatatgatatatctgtcatatatatcattttctttatccaggccttcattgataggtagttatgttgattccatgtctttgctgttgtgaatattgctgcgacaaacgcacaaatgcatgtgtctttataatagagttatactgggaactttagcattgtctctggtgtctgtgcaagaaagaggttccattgtgtttatttgttcatttgtttgtttgtttttggaaataaaatctcagataggacctttaaaaaagaattagttgagacctatttgatgacccagaatactgcttatcatgttacatttccatgtgcacttgaaaagaatatatattctgctgttgttggatagaatgttataagtgtaaattaggtcaaatttagtcacagtgttatctaaatcttttataccattgcttattttctctccatttgttctttcaattattgaatgaggaatattgaagtctttcctataaaagtgtgtgtgcttttttatttttctttacagctttcttggtttttgctttatgttgaagctctctaattgagtgcataaatgtttaggcaatgatcctctttatccatgacaatattctttgatttgagatctactttttttattgttaatgtaattactacagctttctttttgttagattggcatggtgcatcctttatatccttttactttgaacctatttgtgtctacatacttcaagttagtttcttatagacagtatctagttgggtcttgcttttttgtacaattagataatctctgccttttaattgcatgatttagactattttcatttaaggttattattcatatggtgaagtttaaatctagcacattgatcacttgttttccattgtctctctgttcatttaacccttccatttctgctttcttttgtattaattgaacattttttattctctttaattttctttatttacttattagctataacattgttttgtcattttagttgttactttagggttttagtgtacattttaatttatcacagtctaactttcaattatatgatgtcatttaaggtacagtataaaaatctaatgataatatactcacatttctccacttctgttttttatgcaatttttgtcattgattttagtttatctacgttttaaacttcacattattttgttattatttttgtataagcagccaattatctttttaaaagatttaaataataaaaactcacatatagttacctaggcagttactatttctggttctcctcctttgtgtagatgcatagttctgttatcatttttcccttgcctgaaagatatcttccacattagttgtagtgtgtatatgagggtgatgtattctttctgattttgtttgtctgaaaatcttcattgaatttttattttagaaagtattttcaaggggcatataattataagttggcagtttctttttctcagtactttgcctcactgtctttttgcttcattatttctggtgagaaatctactgctaccttcatgttgttcctctgttagtgaaatgtcttcttttctctggttctttttatgaatttatctttaacactgattagaaaattagattatgattggtccacatgtgcttcatgtgtctctcattctttttggactagcagctatgcaaggctctacttttcacggtgaatggcggaatacaaaccaaccaaccaaacatgcaagcacatttccagcctttgtttgcattacattaactaatatccattagctaaagcatgacatatggtcaaccccacgtaagggatggggaagtaaaatccatctatcacgaagccgtggcaaggctaggcatgccgattatgctcaaattgcacatctgcactggaagaggtccggtactttactgataaacttagatgtcccaagtagaagacacctcatgaaacatagtacagatgattataattggcaatgttttcctattggaagattttctcccactgtggtttccacagctggtctcctttcttaggagcacattccaagtcaccccttgtagatttctgatggtaaagcagtacttacaatcaagttcccaaaaagctaagaatgttgagaccataccatgtgtactctaattgtgatgaaggtgtacaggattcatttgtcttgttaaggaaaattacacttttctgtgtttcaacatgtggtgacagagttgtgagtacgttcctgcccttttaaaaaggaatactatataagctggcaaaatccttttgctatgtttgtagctttaccagaatattctttgacatgagtaccttaagggataattctcaagattaagagggcaaagctaagtagaagttgagcctgaaaaaaccagccacatattttgaaggcagtccaattggcattatggatatttgatgacagtaattttacatattcacatgttgtattagtccattttcacactgctataaagaattgcctgagactgagtcatttataaagaaaaaaaggtttcattgactcacagttccacatgactagggaggcctctggaaactttcaatcatggcagaaggttatggggaagcaaggcacatcttaaatggtggcaggagagagacagcaggggggaagtgccacactttaaaaccatcaactctcatgagaactcattcactattgtgagaacagcattggggaaactacccccatgatccagtcacctctcaccaggttcctcccttgaccaaacatggggattacaatctgaatgatatttgagtggggacacagagccaaactataatcacatgtatgcattgttgctaatggtaattaataacattagcttccatttccattttgagtatttcctagacattacgtacatgtgcatttatcatctttactactcatggtaatcctattaggtcttattaatcccattttattcatgaagaaaccgaggctcaaagaagctcaattaattggccagggagagacagctagcaagtggtaaaattggggtataaccacagattgatctcaatcaaagtctgagcatagcccattatagtctgatgcctcatttcatccttcatctctaaattcccatttgagcttccttaaggggattcattatgcttaaaaggaaataatgaatatattcccatgacctaaaattttatggagaacttgcagaactttgagaattcctctgcagatttttggggttcctaattaagaaacttgggtctggggcatcagttgacagcctggcaggcattggagtcagaggtaccaactacagtcttacctctgctacatggcagctgggggccatgacaatagatcaccattcagccaattctcttcattctcccaaatggagaattgctgccatctctccctcaattttttgtaaggattatatttgaaaaggcaggtacaatgcagtctggagaacatggcaagataaatgctttaaaggcaataaagtgttgtcaacattagattgcaccaaagtgtgttaacatgaggtaatgttcatatgtgtaaagttcttcgaacagtgcctatcatactccaagtataatatgtttactacattttaaaaatataatttttacctacataaaagttggggaaaaacaaagcttatgcagattttgaatagggaatcggttgatagttttgtgattgtaattagtaaagaaagtagagctctcagaagggcattatccttgtgaaatttttaaaaagtatatatggggagttactgtgctgcagaatagaaaatgcaaggctaatagcatgacatattagcagctttcttctgcaatgagtacggatatgctaaggaaagtatttaggttataccacctcgcttttctttatttttattttttttatttttgggggggaatggagccttggtccatcacccaggctggagtgcagtggcatgatctcagctcactgcaaccttcgtctcccaggttcaagcgattctcctgcctcagcctcccaagtagctgggactacggtcatgcaccaccatgcccaactaatttttcttttcttttttttttttttttttgtatttttagtagagacagggtttcaccatgttagccaggatggtctcaatctcttcacctcctgatctgcccacctcggcctcccaaagtgctgggattacaggcatgagccactgtgtctggccctcacttttcatacatttctcagtttttaatgtctgtgatgaatattaattagaataactcctattcttcaaaaatctgtctccaaaaatctgtttttatgtatactttacccattggtttgacgtttcaatttctaggcaacaaagtttttttaaaaagaattttatattgaatgctaaacacatgtaatttaaattgtatgaaaactgaccccaactcccttttctgtgatgtactttatgggactttgtcttagcctggccctttactgtgtaacttgagcctgggttatgctgacttcaagcccacattgttttcatgtattatgataccacaaataaatgaacaaatgataatgtttagtattatagatttttttgtattatcaaagcaggactttcgtcctgtgtcttatttggcttaccttctttctaatccaaaaatattattaatgggagctcattttgcagcaaatgttgggaggcatggctgtctctctcctctctccctcccgttcaccctcactcatacacatacacaattgaaactaacaatgctatggatgaagactggatcaaatgataaccaaatcaaggggtagggtaccagtgagggaatgaggccgttgggatgtggtcagcagtacacaatggcaccttccttttaaaattttagcttcccagaagaacatcagcagtattgctataatgagtccagatcttggcccattttatcgattgggtcatctgtaatttcttgatccaagttctctgagctgacagaggagactccttgcatcttggtatattaggatacatccttggaacattctctctgttgactggacttggagctagacaaaggacaagagctagagcctgggacacattccagggcaacttaggttatacttggccagagttagttatttccttctcactgcatttagctgagtgactgggtgcatatgggtgagccaccatgcttataaaagtgtgttttggagatactcaataataatattagagagagtatacatgggctatatcatggtcttatcagattcaagctaatacatgttttattttgttttgttgtttgctttaacagaatgaagtccctgaggtgaagaaagaggagactttgctggatctggactttgatcctttcaagcccgaggtgacacctgcaggttctgctggagtgacccactcacccatgtctcaggtatcaggtgctttttggatgtttggagatatttcataaacctcagtaagctcagtgtggtaaccaatgatccctatacctttcatgactactatctatttttatttttggttgacagatatttcctaataggaaagaggggtagaaaggggaccttatctatatcagttattctaagactcccatgccatcagctttctctacccatagagctggcataaccatacattcctgttttctcccccagagtaattgttaccagtgcccacgttgcactcagaactgttcaggtttacaggatacattttatggtttccctggatgaagctctttcttttggttttgggtttactcttcttgctcttttctctacttcccttcctcatactttgcaagttaaagtgtgtttgcaatgaccatgaaagcacgggccagcagaagccgttttcagtgttgatcgttctgaacttgatgatgctgtgttcatcctccccattgaagaagctcccctcctgtgatcatggttatggtttgatggagagtcgccttgcttccccaagcctttttgctcaccactccctcacactccatatttcttcctttcttatagtaactgtcattacattctctgtcagaggatactggtggtaggtgccataatgacctgtgggtaggtcctctgaaatatagttagtttacaactgtctgtgctaatagaaggaagttaactcaaaatttgacaaaacagaaactgtttatataagtactttgcatatggttggagccccacatatgaatttaggcaaatccaaagttgctagagtatgcttcaaatgaattagtacaagaatattgtaacattcaacctaggaattaagacctagcttgattccctggccttgaagccttcttggtatatcacagtaaactgctagggaataaatggctcaatatgaaccttaataaataaggattatgtctagtccatgcttttttctagaatgtgattgggcttctaaaggctttcctgttgtgcaatatgaacaataaatgtccaaggtgttaataaagtaagaaattaatagtctaaacactagccttgaagatgctttgcaaaaaacaaaagggtctcttaggtgaaagttccaggaagcctcctgtattaactctcttctagaagattcatgatgtgcattagaatattaaaggctgagaagttctgcaatttaaaaaaactgtttatatttgtttaacttagagtttcccaaatttgtttgaccacagaaatctatgttaactacacttttcttaatattcattggaatgttctctaaaacaatattttgagaaatgctaaagtattgtcaacaagtttgagggttccaccttggtgaccaagaaaagtacaaagtgaatgtacatataattgaatatacttccttctcagagatttctcattatatagacagcctgcagaattcacaggatttcctctgccttactctccatgcttctttttttttttttttctttgagatggagtcttactctgatgcccaggctggagtgcagtggtgcgatcttggctcactgcaagcttcacctccctggttcacgccattctcctgcctcagcctcccgagtagttgggactacaggcgcctgccaccacgactggataattttttgtatttttagtagaggtggggtttcaccatgtttgccaggatggtctcgatctcctgaccgcgtgatctgcccacctcggcctcccaaagtgctgggattacaggcatgagccaccatgcccggcccatgcttcatttcttttgtggcagatgcaaagtttctgcagtggatgctggaatgattagtgggtgagatttcatagcatttctgtctacaagtttgaatcaggagagaaacctcttttatgttaattcatgattacattaatccataaatcatgaaactgtgtgtggccttatgactaagagattcttcaaaattaaacaaaaatgaccttggtttaatcttcaaaagttttagttctgaaggacatatatcaccgcagtgacggcaagctgtgtgtgtccctgtgctcttcctcagggccaggtaataaaaccctctagcctcctggtggccataactgagtcattacactatagttgtcctgcagtccagctttgatcatacctctcctcttttgctaagaacaaaagtcttgactgaatgacaaaaaaagcatagcactgttaggtctgcctggtttctttcctcttcactcaaaatgacctcctttacccatcacctgaccccatgttttcaagtggtgttcttgctgctagcagaacacctcatcttgtgatctctgcagtatctgtgcacgctaacgcatcctttcatgatcctgaggactgataaacatgacatttcatatttcctgccttccttttaaagaaaataactggtgatgtgtgcattatacagagacatgcactagcttttatgatctttgattcttttttttttttttttttttttgagacggagtctcgctctgttgcccaggctggagtgcagtggcaggatctcggctcactgcaagctccgcctcccgggttcatgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccatgatctttgattcttaagtggctatgaagcaatgaaatgagaatcatctagataatcagaaaacatatattagatccatgtacaaaaaactgtggctttccatggagctgttctctcctgtcttagtcatcctacgagaaaatgctaagcaagagaccaggcaggctgcatggagatgcaaggcaggccatgcagagcggttagaatgggacccaaccaggtgggtgggtatcagaaccacagggcctgctttctataatacggagcccaaatgaggcctctgcaatctcaaccgaaaaccatcatatttttaaggtggcaatgccaggctctctagtttgctgttgacatttagtagttcaaaataagtgcataaacgtggatccattctagtcacaaagacatgggcataatcggatgtggctttagcagcaattctcaatcataaaggaaataagaaagagaagtcttccctgctcccctcacccatagtggaagccatttgaaccatctggcctcactccccgggattcataagctttataattaaaataccagtagtaagtgtaattcattcatgtcttagggggtgctctgccaatttgtatgattaccaattcattgagcagtgtgttatcatctaatttaacatattgaagaactatttttctggggctcatttaccattaagctggtcatcctacatcctcttgaatgagatgggaaggaaatagcattagcagtgattagggcctgcatttcctcaaagatgtgacaagctctaaaatttggacaccttgtttacttcattttaatgaggtgtgtgtgtgtgtgtgtgtgtgtgtgtgtgtgtgtattaaaataacctcatttgtgtttcaaatatagttttctactcacatagtgaaagttgagattgattagacctgtgctatccaaagctaagtgccatttaagcttatattaagtataatacaattatgtaaaatttaaaatgtggttttgttaccctagcacatttcaagtgctcaatagccacatgtgactggtggctaccatactggataagcacagatatggatcatttccttcaccaaaaaaagttttattgaacagtactgtacaaaatgcttaaaaaatgcttatgatttcaagaacttttgtcacctcagcatttttttatgttttagatttgtataactaacagtatttttgtttatttgctttcagacattgccctgggacctatggacggtaagccactaataactctgttttttcatgtatcttgatccccagaaatttggaaaccttgttatattttatttcatttgcaacagaaagaagacacatacatttaatgatgatatagtcccctagaatgatcattaggccactgaaagtcttgagcattatcagaaccggaagatgatggtgaaggaagagtacagtggaccagactcctgggtgaataatggtcaataatttgaataatggtcaagagtttggccctttgtttctttctgtggtggttggtggcaaaaggagctgttgcagtgaaggacacacacacttaaatagaagacaaggaaagtgtgaatgagaaaatggaagagatgggctacttggcacatggtaccattttaaaaaaaagtgattgtattcaatgaagcttgggttaataagaacttgagttttagagccagatagccctggattttagtccaaactctactactcataaccttgagactttgagcaattacttttttttttttttttttttaagacggagtctcgctgtttcattgagtgctggagtgcaatggcactgtctcggctcactgccagctccgcctcccgggttcacacccttctcctgcctcagcctcccaagtagctgggactacaggcacccgccaccgcgcccaactaatttttgtatttttagtagagatggggtttcaccgtgttagccaggatggtctcgatctgctgaccttgtgatctgcccgcctcggcctcccaaagtgctgggattacaggtgtgagccactgcggccagcctgagcaatttctaaaactctctaagcatcatttttttctcatttataaaataagggtaatgatgcctacctcggaaggttgtgtgaggtttaaataagataattgtaaagtatgtagcatggtgtctggtgtgtatcaataaaaggtagatgttattactgatgttttttcagctaatctgatgtgtaaggataactactccataatttagacttgggaaagtgtcacaaacagagctttgtggtggtctcattggtgctgtgaaattaggtgattggtcacacacctctacagcctcatatcccttggagcagggtctttgttttagaaaagccctggtgatgtggtcttaagaactcaacttaagttgtatgttttcttcttttattgtgaggcagaaaaaggaaagttcgatagatctagctattcatgggcaatgccacttctgaattgacattgccactttctttctcccttcaaaacaaaaagatgtctgtcccttccttctgcagttgcagggctcatactgcactctttaagatccttggagcatcaagggaagtgctcaagaagagagattaaaaatgtctattgaaaccaccaatgactaagttatatcttttctagtgaaaagttttactcatatattcacaaaaaggcatgcatggattgatgttcgagtcatttgaattctaacttcaactctgtgttaatttccttggagattaaaaagacaatgctattttttgttattccaatattttatatctttagtggaactgtaacacattttccttccctcgctgggagggtatggagagggtgaaggtatcgtctaaaaagagcttttgaacgtttcagaggacaaacttgctaggaatggtagcgatatcaaaatgcaaaacaacagctttctgaacatagttgctcacagctattaatcttctcaactttgcaagattttttcattatgtggagaaaatggctgctaatttgggggaatgacatcaagagaactctgcaggcagtcagactggttaatatcagaccattctccatctaaacacccatctcaaagacagagccaagtataggatgagtttggggaatattttcttctgatactgtgtcaaagtgtgtgctactgtgtaatttcttgacctctagtgcttgatcttattccgatgttctcaaacttgcttatgtgtttgaaacttagcatttcagagtctgctaaagcagaagtcatatactagccataaaacatccttgctgatgctagaaagtgaaagaggctttctttgtgtttcatttgtgccttttctatggtggtcttaaacaattttggaacaaaaatcattcctatcacaaaacaagttgtaaaatttgttcctaaaccagtaaaagctatagccttcagcagaatgttgactctagacagcataggattttattgtgttagtgaattttctctctcgccttattgttactattttctttacccatacagacaagcactgatttggtacagccggtaggtaaatatccagatcattctggatttttttggtatttgatatgcattacatacatagtatattttctagaatgaactgtttccccatggcattgctagtcatagatttaaaccttaagccaatgaatgtaatcactttccagtttggttttactggtgctactcgcctgaagagctttgtgtttctcatcaaatcttaccatgttctgtttcatcttttgtttttgttttttttcctttgctcttctgcatactttaaagactgactcttcagaaagtctttccttgtgtaacctgatcatggaggaaactccagacagtgggttggccgaagaaattcaaagatctcaaaatgatataggtgcatttacttggggccctgacgctagtacagacagggtcagccaagaagttacctcaggtgggtttggagaagactctgcatgtccctccgaaacagagcaagacataagattatccaccagcctgctttcgtctgctgactggcccactgtagctgaagagagtgagcatgccccggggccagcctttccaggtggaaatgaacaactgcccccaaagcctgcgccggaggctggagttgccattgctgcttgtgtggagatggagcagctgtatgacccacttgactcagacatgccagccatggacacagctggcctgttcaaagaaagtcatgaagatatgaagaagtcagatgaagaggaagagaaacagaagatggaagattctctgtgggcaggtgtggaggcgtgtcaaaaggtagacactggagctattgatatcaagacactagaaggtacagaggaatttgaagagaaagcatgtgaaaggacaggaaacagagtggtagaacttcttaataccataggaaaggaagaccataagaccttaaaaattaatgaagtggaaactagaaaagatctaagagcagggtataaggaaagtacaaacaccaatgaaaattattttgagaaaactgacctattagaaaaggacatggaaggaggagatatggcaaaagaacttagtgacagagaccaaggtctacatgatggaattcaaaaggtaatcaataattgtggaatgatagaaggctttggagccaaacctgccaatcacccagatatcttgaatccatctctccagacctactctgtatctaatattgaagatggcagccctgagggatgggatttgactagaaaagacataaagaaaaatgcaatagacactcccaaccatgatatgatattttacccagcacaagacagtacagatgctgaagaaattcagtgtgagactgtgttaaatgctcttgtaggtgacagggataaaaatcaggctgttttatcaataaaacttgaagtagaagctcagtctaggactgaccttaattattctctgggaagagatgcaaacagaagagatttatgttcatgtaaggcagaaagttcactaatagaagggtctgaaagaacagtaactgagaaccgtagtcatactgttaacttgccaagaattgcagagatagactcttggggaacagatccaggtcaaatctggcagccaagcctggattcagcaatgaataatttggatataacaggattctctggtataccagatggccaagcaagtggatttgccagttgtctggattctattaaccactggcctatcagagatacagaaggcttagataatagctggacacattcagatgtagttgagcacaaggaagaactgaaggtggacttactagcaggtgattgtagggaacaagccattgctagctgctgggaacaaagccaggagatagcaagaccattgattttggggacctcctggaatgctagcactgagagttctgctagttcccgagaccaggacatcaacaactcagatttatctgaagatgaaattgctaaccagagatatggattgttgtaccaagaaatagaggctgacaaagacgaggtacttaccctggtctgtagcatagactagccaaagacttctgtaggctctgtttttcctcatgtctgtcacctacttcattatccatcactatcttctaggaggcctgatctctctaacagattgtcatgtacttcttgaaatctgtgcaaaccaaacacaaataggttgaccaaaaaaaaaaaaaaaaagcagcagcatcaacaacaacaacaaaaagaacccaacaacatagacacatacacacaaagcagaatgattgtgttgggaattaatgacagtctatgttaccatctcattttctgagtttattctccctactttcacttttactatgcaggtactaaaaatgtgctaaaccaagagcagcacagactaatttactgttcctgaagtggttccactccaaaaagaacacacgaaatgtttcaacccaggcccactgaaactgtaaaatatcataattgctgttcatcaaaatgatgcattgtagaaacactggagaagtttcttctagattctatcaatggcctgaaaaacaagcaatttaactcctaatggcccttttctggaatcatcttctcattatagagaaagtgggttttggttggcaccaagcaataatgcagcagcaataattgtaaaattaacctttctttttttttttgtcagcctatttaaaatcatacagtgtggcctttgcatttcctaagttctttcatgcacagcaaccttttgtattattttaaaacttgtgatagtctttactttccaacttgtctaatggatatttactggtcctacaaaatgataatgaaaaataataacacaatctgattttcgtttctgtttaggcttctggtggttcatttaatggattcacacaggtaaggaatctgttttcttacaagatccatctgctgagaatgatgcacatttttttcaatgtggtttggttctctgtgccactagtatagcgtaatgattaagaatatcagcacaaaattggaccccactacttacagactgagtaatggaaacagaatagtagcaacattgtatgattattgtgaagattaaatgagctatgcaacagagtgtttagcccagcaggctagcacacactaagttctccctgactttagtttagcttttattaatatgattagctataccatgggcttctaccttctaccgattcctctactagaaattagaagttgttctgatctgagagatccactggattcagctgttctaaagaagagctaggattgttttgaactaatgagatggatctttagaaaatgtgagagggttttaggagcttccttctagagattcctataggagccacactgcacagagccttacctcttcagcagttctccaggaaggagctgttggaagatcagaaaccataggctggttgtgtccaataaggcagtatttttcttgagagtctgtgaaagagaaaccacaagatgaactgtcccattaggacagtgtatgtgtatgtcccaacaggtaggcaggtgtaacctgtgtaaaaggccggccacatggctctcaggctcctggatcagttctgacaacctcttcaatggagacctcagacaggcttgtctgtgatgcctgctttgtctcagaatgtcagacatgcacagtttctaataatttagcatttataattctctaaatatatattcataatatattcataaatagaattctgtatttaaaggtttcattattttcccatgttacctgtaaaaagataaaaacccactgatattcccacatccaaatacagatacacacaaatacaaagagacgttaatgcatctcttccatcttcagaaaattcctttgaaaggttatgataggctctgtcatcaatttctcattcttttcaggtttgtatttccatcagagttattaatgcacataattttaaaagtaacaacttttataagggcttttattttaaaacttcagaccaccatacactcccttcatttcctgtttcttagaggtaaatagtttcacttccttcaacaaattctctgtttccgccctatatgtgtgcatgggtttcttataatgctgcttcttgatttctaaagtattatctattgactcatctctctggaaggtgaagacttaaagtattttccacctcctacccacccaattcgccccctcttctgcttcctgcccttcctctgatagagttccatcaaagccatccaggcaatctgtggtaatgtaatagtgatgaaaatgctattaacagccaagtcatgaatttcacattttgtttcatgccaactttttgttttcctttgtggtaattataaaaaaattgtgggtctaatttatttgccttttgattgatatgcttagttttctaggtacttatcacatattcaaccccatactctatagttatacaaatctcctattttgctgaaaacactagacattcaatcagtttcatcttcttgaagaaattgcctatctgtcctcctctcctgggctgctgtgggctgaactgggtactctatgactgtgacttgctgtagagctgttctcactggctcttccatcctgttggtcatggggactgccttcacctctctttcctgtccttccactgttttctgatgcaagttttctcatttgtggtttaatcattcatttgggtggagcacaacctccagtagctttctgaaaaaagtgcatacacggaaggtgtatatttgtgacgttacacatctgaacatgtcctacatatatattaatatactggactgctagtttgggtattatattcgaagctgtaaatcattttcccttataattttacagccatcgctccactcaatcctaccacctagtgttgccttcaagaaactgtcattttgattcttgatattttgtaagaaacctgcttcctctcctcattctttctctctatctccctcctcctacctctttcatcttccttttctctctttctctctggaactttgtagcatcttctttttacttcagtgtttctgaaatgtttcaatgatgggctatggtctgagtctcttttcatccactgtataagcctttttaatctcaaaatttatgggttttggtttgggagaattttaaaaaaatatttcatggctttatctttttttttcctttgttctctcattccataacacttctctttttcatattttaacttcctgactagtattctattattgtttctttgctgtttccttttctctgttgtctttctctactttctctgccaactattctaacaggtttttcaccctataattttttcaatttccaataactctttttgtttactgcatatttattttccaatagcatcttcttcttgtgtcatgaatgattctcttccattatatctctgaaggtattaattatcattttgaattatttttgcaaaatctttgtttcttcctcttgcttaaccctttctattccatctctcttttatatttgagacttctcaaatgtttggtgatcttgactgaatattcatatttaaaagtgggatgctgaaaagctgactggaaccttgtacaggtagatagagttcattgactgtgggcattgttgcaggactttctggcttatcttttctgttggggagccactgaagtcagattctttaggcattttttttcctttgggctggccagatttcccagggaagatttattttgtctcctgtctgtgaagttcaagtctgactactagtgtaatggaggtgattggggaaaaaatgggagcagagtggcgagagaggggtgcatggtctcaatatttattatgtaagtactcagtgcttctaccttcctgatgtgcctgtgtgttccccagtccagggaccctgtttcagcctctatataattaatctcaagtcttctgctagggtaggcaaggatgttgcttggtgttcttagtaggtaagaatatcttgaggtctgatgactttgtaatagacttttactattcttctgttgttaccaccaccctcactcctgtttcctgtggctctttatgcttctaatttttcaccactgggagttctaaggaacaaatcggactgatttgcagcatttctagcatcaccttaggatacagatttctttgatctaccaagttactactctttcatctgctttccaatttcaacattttgttgtttctatctttcttctcattcttttcattcttataggttgatgccttaaaaatccctttattgttgtttagtttggattcaggaggtaacagaggcaactgcatgtgttcaaaacaccatcttcaaccaaaaggcactggctcatcttttccgttaggcatcccctgatgtcaatttcttcaggcattttgtttttttccttgagctggcagatttcccaggaaagacacctgggtctcctgtttggagggtgcaagcctggctaccaatgtaatgagagatgaagtttcctttagagattacttttcctttagatttcctccagcttgatttgtttaggtcaatgaacatattttatgaaatgttaacatatggttcatacataacccatagaaggaacacttaagtaatatagtgagattgaattcacaacatttaaaaagtttaaattttggagcttcaaccactaacttctgatttgatatcaacggccagaagagaagctgtggactaaagatgcccctgaagccagtggcctctgtttaatgactctcatagtattctgctagcagagacttatatttagaataactattattaaaacttacttttgcatgttttgacttaatgatttaaaataaaaggggacttgaacatgtttcaaataatatttattgaggccaggcatggtggctcccacctgtaatcctagcactctgggaggccaagctcggcagtttgcttgagcccagaaattcgagaccagcttgggcaacatgatgaaaccctgtctatacaaaaaaatgcaaaaattagccaggcgtggtgatgtgcgcctgtacttctagctactcaggaggctgaggtagatcgcctgagcccagggaggtggagaatgcggtgagcatgatcataccactatactccagcctggggaacagaggagaccctttctcaaaaaaaaattagatagatagagtgtcgatagatagatggatagatagatagatagatagatagatagatagatagatagatagatacgtaggcagacacaattgatggtagctgatttaaatatctttaaaaaacatcttctatttttatccttgattttcagccccaggatacttcattattcacaatgcagacagaccagagtatgatctgcaacttggtaagttgatttgggtttgtgctctcaggaagttgttagttatcactgaatgttctaaagctgatcattctaggctgtctagagtttgaatatccagaatgtggtttctggatcctgtacttttctagaaaacaggagagaatgtgtctgtaaaacctcagtgtgactttgcatttggttatttctattcacacaggcacagtgattccagcaaaaactagtctcctaatgatgaaccccagcagaacacagtgaatccattaaagacatgtatatttccatgtgaatataacttaagttccagtatttaaagtgaaattgtctcaagaattcatgcttcaaaataaatccttgtttgtttcttgaacgtgaaactaccccatttatcatctcatccctccactttgtgagaggtagaaagcagtaatgcatagtagagttgtgattcctaatttgataccaaatgagaagagagagaaaagcttagttaggggatgagtaagaaatagaaatagttactcctggcgttagagaagattcttaaaagatcagtgttgcagttatgatgggaaacatttttagcaacagcttaaagcttactagtaaagatgaatgaagagaccttaagagatatcacttttgagcatgtcattgctacacttcagaggatttgggctctttgaggactagttcatgagggttatttgtagcactatggttttctcatgggaatagtgcatacttatcctagctcctgcctttcatattggatgcttggaattgagattaaatagaatgatttcttttaaactattttaagtaaggaattctcttctggaaagtttgtcttcaaggctggtttgatatatttgcaaagacaggtgtgtctctcataccttgtcaatagattgtcacacttttgccttttgggcaaccagctgaaaggcagagtctctctggcctgcaaataaatatttaaatgtttcaaatacaaattatacttgtgttagtaatggagccagtgaagctcattcttcatgttcattggtgattctccagctgagtgatgaagatggagaacggaatttttaattatcaatcatgaatggtttatgagaaatggagaaataccagtataaaaggaaaggcaattggttataattaaactcacacctactacacggatgcaaaagattcaggtctagaattcagtggtttttaagtttcagtgaacctttccctgtcatccatggctggtcctaggagcttccatgcttgtctttctcttctgtttgtatgtattctctgaagcagacatcttgccccttctttccatggggaacttagctttgtcatgttcagcattgcaaatgctgctaaccttggtcctgccctctgatctaggaaatcacagtgaactgatgtctcccagtgagtcgtgattgtacacgatcttcccaggagcaagaaaacgccccagtgtttggctcattgactattctgagcgaggtagggggtgaagttggtaatcagctgtacatctcccagcctgcatcatacagccccgcaggacatcttttgagtacaggtttaaacccttttgaatcagtaactcttgctcggggctcagggttgcctctaaagccctttggagttctcactaaattagttctctcaggattggagaaactggatacaaggccacattggatgtgactagacttctgcccctgctgtcccaacccatctcctcttcctctgtattgacccgcctttcatcttatcacaaaggataccagaaaaggtgctgcaaggctacactcctcattttattctaaaggaataattggtttatggtcctcagagttaaaccattgtggcatctgctgccaccaatatctgtaaaggatgtacctcttctctgagtgtgtaatgactgctactgaagcaaacaataggaaatcattctcagcactccaaaataggtgtggcatgggatcaacccatttgcaatgtctttcaagggaggcatcttgtaggaaaaacagtgaaggtagggcacaattcccacaggactatattaaatctctccacaagcggttgctgacattttatctttgcttttccctctttcttgacaaaatacttacaattttacattatcttggaatagaaaggtggcctctatttctaaatttgggtagctgattttatatataaccatgcttcattgttactcatcatttagtgagctatactatcctcctggaatttaggttaagttgtaatgccatattgtaaaatttcatgtgttattgtcgtatgtgaaacatcttgtgacttgtggggaacataagcaatcctatgttctctttatactagaccacagctgcactgtcaaatttcaacaagcaaatgcaattgggctcatttataaaatcaccctagctatttattcttgccttataaaaaatgtcagaatttcttcagacttctaagaaacccagactctggtgcaaatattttttgcattttaagatatctttgcattttataaaatatatgatgttatatttctttggctcatgttttaaaacatctcttggcttctcatctggcttcgatcttacttcttccatagagtagactcagcttgcagtgaacagcatctgctcgtggatttcttggtgttttctcaaattacccttttatccttcattgtgaaggtcatttgataccaggctgtcatagcaaatcaccttgacttcccaaatggtaagatcattccctgagcacttacagtatctatttgctgttatgaaaacttgttccactatgaagataattcttttcaaacaataaaagtgaagtatttttccataaaggactcttgagagcatattagtgtgaattttatctcattcttccttaaaaattatgtcaggccacctcttaaagctgaaaaaagcccataaaaatcaaatgtctgcacacttgtctaccagtcccttgaatttattatgtccttttgaaaagaatagtcgtgtgatcctggcatgcataaaaatggaatgatttggtgggaaacataagacaaatactttgtgtatttgtccaacactaggctattcatattcattttgtattatctcagcataacttttccagcacttctctgtggaacttgccatgtgcactgactcagataaatgtacaggacaaatagaggtgcgttttgattgcttatggtgagttggatagaagttactgatttctccaatcacagcattaattagagacttcttactccactgggaaatcacttttaaactttttttagtttaagtgttctggtgatagaaaaggatcttatgagccctctaatggccattcatttagtgaaagaatcatactagataaatatgtttatttatattaataagaatggaaaaagaaggaatattttcagtatttgtagtaacatgcattggctgtggtgcttttaatggcttgctgttagtttatattgctaattttaaaactaaaaaggccttgatctaagagatgccagaagcctgattcagcatatatgtaattgaaatcaggatgatgtttatatgtcttgttgggacaaaaagacctcaccctgcctacacaattcagggggtataattgaaaccatggagaatactgccctgtggttctttaaacaactattatatgaaataaatgcattactaaggattttgttggagggagaaagggaaaaagggactgaacaggaatttacaacaaggcagtaaagtatctatgattgtagtagcaaatagccaggtagctgattctgttcttcccagccttggaagtggaacactagcttcatggtgacctgttgggtcaaatgaatgcattttagtctgactattagaatgactctttgatttttttggtgcaatgcatattcataaaactgaaaggccctggaactgtgtgccctgcgatttcttccttactccttcccactggcaagtaattgtgggtcctcctagaatcctttctctctgtctctgcctccgtctctgtctctatctctgtctctctctctctctctgtctctgtctctctctctctggaaaatagcagaacctcttatagctatcataggtaagtgggtagtcaaaatgttgcaagtaagtaaaatgggtaggtaaaatggtaagtcttgcctgacttcaagggaaatgacagtcttgatgatggtaaagcagaagcttaataagattttatttctagtcttttccattctctaaaagcctatgatggcaaatgggggcttttctccagcacggatttcatgaagctagttgcctatgggatgacaaagaaaatcttaattgtccagtattctgtaatgttatctatttacctgttgaatctttttcctctaaccctcaaaacaaacactccaaggctgaatctgaacaggctccacccacagagccaaaagcagaggagcctctggctgctgtcacacctgccgttggtctggaccttggaatggacactcgggctgaggagccagtggaggaggcagtggtgagcaccacctccctctcaccctccatctgcctcgctgccacagccatgctcatctcatgaccatatgcatcgctctcatctttgcctcacttgggccaaacatgctccatatctgtcgtagctcccaggttcaaatagccttcatgcctgttctctttcattttttattaaggaagatatccagataactgatcttatgatctaaagaaaactgtacatagccacaggtatagcacagtagaagggttgtagaacttgcgagtaatcagacctgttaatgctttgttctacctgtgacagctggagacgtgcctttattagggaacttgcatgtgataaacagaataataactttgttcattgtgtgtacatattgattacttacaatattagtttcataggttggttaaggtccaatgaggtgttgaaatcccatatcacaactccatgaatctgtaaggattcctatatgcaccaccatttgctcacaattaagtctgctgatgactcataataatacggaccttgaggatgttttgtttttgtgctgggatggggatccatttgtctgcctggaaacctgctcttaccctaatccatgcagccataaagaacaccacattgcaaactgggctgagctctgatatgtaccaagtagaattggacattgtaatacccatgaaagtgtagagtaccaaatacccatggcgagtgaaaagtcatttatttatgaaatgcagaaaaatgtcttccaacaatttcaatcagggtaccatttacccttcatagactgtacaaataggaaaaacaatttctctattaccaaaaataacattccctagattagatacctagagaaatgagtcttacttcatgtcgttggtgccttaagtcattttacagggaaaatggtaggtcatctgtcacatcaacagttcattaatcaagtagaaaaataaataatagtgcaagatagtaatggaaaatacttaaagctggactgaatctctcctagaggcattgcttgcagggactttagaccagggagtgctgtgtccagggccactcccagattcactggagatttcagcaagtccatgcagacagtgctttttcacttggtgtccaatggtgatctgtctactcaccttagctttaagattatttaaataacaaaggaagggaaaaatggagtttaatttttcgttactattataattaagaagataatttatttttaaaggaatgtggatgatgccagggagttaaaaagatattgatttaggttttgagggaaattgttttgattctgaaaaagctctcatcaaatccctattttgaacagcagcaccaacttcatcttcaccaatgttttaaaactagttcattgattttatgcccaagactattcagtgtaaggcttaatgccatcatgcccatgagcaggggcagcattggatgttgtgcaatagattggaaatgtggaatagacaagctactgtgttcaatacggctgaatgttgattctctatgatcccttctaagagtgtcatgttcatatacctcccacacccatcctcatttcaacaaaccgatctaagtaggcttttgtttttttcagaatccaggtttatggttttccagtggacaatattagtggccaccaattattaagtacctactatgtaatagctaatatatatatatatatatatatattcatatgtttgatcattgtttaaactaagggtaatatgaaaaatattcaacaccctgtggcacaggcaccaaccatcactcaaaccagcttccctcatgttgggtaagcagctgtttggaagaatgcttcattctgaaaataccttttctcctgaagctcacaggtgaactgtagagaatcaaaaattttgattccttgtaaaatataaggcaatttacagtctaatgaaggattcaggcacttcctgagatccacaggtgatgcaagaatcataggtgcagagctcacagtgtgatccacgctttccacagagaaaaaattcaagttcatttctccatatggactgaaaaataatagtaacaatgttaactaagaggagacagtttacagcaattcagtttgcctaatggtcatcagtagtggctgccttccatgtttttaacatggacatacttggatgaaatcaatttttcccctcgttctcccttctccttaggaaaatagaatcagataaaatgtatttttgtttcctaaagtagatttatagcttcttccttccggtcataataatctaacataatattagggttatatttctctggagaaaggtctattaggttgctagatacgtggtatttagttgtaaaaacaaaaatccacattgtgtccctagcattaattaattggctggctgtggttgtcgtcagtcagcgttgagttgacatgaccttttgaggtaatccctttcactactgaaatgtcaccataattattagttcaagttttgacagaatgcatttcacctgagatgaagtttgtgattgttctggttttttttgtttgtttggtttttgttttgtttttgtaaagaggcacgtataatttcaaacatgggaaattttaacggtgtttccaaaagaaacctagggcttttaagaaaagtttaattattacatttttgtttgttgttttatttctcatataggtagtattgtcttcagtttttcccaacaacatcaaattttactggtatgtctacaggatgcatttaaaaaaacaacactcttgtctttacttttccagatgtttctatgttatgtaaataatgaaaatatttgttagaaaaaaaatgatttggggccaggtgtggtggctcatgcctgtaatcccagcactttgggagggcaaggcaggcaaatcacatgaggtcaggagttcaagaccagcctggccaacatgatgaaaccccatctctacaaaaatacaaaaattagcctggcatgatggcaggtgcctgtaatcccagctacttgggaggctgaggcaggagaatcacttgaacccagaaggcagaggtgcagtgagctgagatcttaaccattgcactccaaccagggcgacagagtgagactctgtctcaaaaaaaaaaaaattcaatatgatttcaatattcgtttcaatatgtgttagagaatcaggttgtaaagcaggtaaagatgagcacagagccaattcataatgtattatttggttacaattaattatggttagatttttacccacatttattccatttttttctaaagaggccccttctaattttctctaaatttctgtcagtgcctgtattttgcttaaatgatgtgaattataccagtgttcttttttgcctattattttttcaaaataatgccgtgtaattaaatttagagttagcatagtttttagaacatataaatgtaaggaagactgtggtaaagacgttcttagaattgttggggaatcctggattatgaaacattattgacccattattctggggacaactttggtttttgctgtgttttgttttttaaaaattttaccactaaacttgtcaagaccaatttaaaccaacaaatatatacatatcagaattgccagactatagtctatcaacttcatcttgctagaatatttctgtctgaacagaatgcatgtgctcacttcctcttttactcagttgacagatatatttgagtcctctgtaggtgtcaggctctgttctggatctggagaatacagagatgtggtaaatagatatggctcctgcctcctagtttccacagactggtggttgagatgcacgttacacagaggttgaggtgtccttcagtgacactcatgttcacgggaaacagcatttgggttttatccttttgcagagtaaacatgagagctagcgtttcccctgtgcctctagatgtgatctctcagtatgtcagaagaagacattgaagatcagaggaagccaggaagcttgaattattgtctgcccttattaacatagaatgatcttccaactccaagggcttacactgaagcatgctttaagatgtcaagaaacatacatatggatttttcttttttttatgagaaccttggagatggatgttcctgtttacctttcttagaaaaaaaaatcacagaattggttattttctgagtttgattgtattcccattagcaaatagttacattttcaatgcccctcaaactaaataagtgtctgtttctctcttgttcatgataccaagcacacagcagagtgcataatccatgcccatcaaattctaagtcattgatttgttagttagttgacagtgcagtcttggggtccttaaaggggctgcagtttgatttcttaaagtacaaatatgtatatggtcattttccttctctttttttttcattcagatactttggctttttttatatttaggaaaagcaagccagttattatgatcaaaagcaatgtcagttttttcattctgccccacagctctgtgacacctaagccccacttacctcaaatataaaatggagttaataataatcaccttaaaagtttcccatgagggcttagaaataaaacatgttgtcagtttcaacatctgtcgtgcagaggttattagttaatgacagtttggtgatatcattattgttatcatcgtcatgaaaagttggtgagaagcaaataagcagaagcatgtgaaatatgtactctggggaggagaaagcagcagaggcaaagataacagccccctcttccagtgttgcctcatgtcagaaatggcaatggacccagtccctgttagatctccatcaacgcaaatttccatgtggttcccaaacaagctgtgtcccatcaaaattctttgtcctttctaagaagacttccccttttccaggcaccttcatactcagtgaatgaatagggaatttttctatcttcattgcccaggagatgtgagtattcagagaactggcagtgccctctcagctgcgtcctccttccatgtggttgtagaaggaaaaagaagggcagatgatctacaaacatgatacatccaaatctgatacaagtaactgaacctagatctttctctctgtctttgcaggaagtcatagggaagagataaaattagccaagaataaagtgaaagtaacaacacagtgatcagttcccccaacctcacagagcaggttgatctgggtttgtaggtggccatctctgaaatatggggccactgctgttttgagatgtggctgatattaagtattcattaaccacctaccaactgctagtagcggcatcttccctgccttctggagtgtgatttccaaagccccatctcaaacagggccaagtgagactttttaataaatgtcattgtttattcagagtgttgttataaatctatgtgaacatgaactcaggattcaggttgttcttccactattgaggagccatttttaggtgatagatgcccagtgacttttaagtattacttttggcatgtacttttcttctgaggtgaaattcacataaaataaaattaaccattttcaagtaacaattaactggcacttagtacattcacagtgttgtacagtcatcacctctatctcgttccaaaacattttcatcacctcaaatcacagccccatagccattaagcagtgactcccatcttcccctccccaggcccttggtacctgccaatgtgctatggatttatctattctagagagctgatataaatggaatcatacaacacatgattataagatggttttgtgtctgccttggtgtatactttttgtcacatactaaatctagagctttagcttgatatatttaatatgactagttatcattagcttcaggataagaaactcttattctgtcttctgaatatgtattgggcccaattcataatccctcattgaaaccattcctggtcatcaacacaattgggtagcctatgtaagaccagacccattcagatgttaaaaagacaactctgttgagataataaagccccaccccaatatgaagcccagtcccaccccagaaatcagaatttagacctacaagagccttacagatgtgttctacttactggctcactcctcttcccctacaggtggcagtgttgggatttgtttagtccatggataatatggaaccaaccccctagaccatgtgtgctgagttctcattcacttcttgcctgttcctgttctgtccatccctcacctgcacgatagaaaggcccttgcatgaatccctcctgctagccctccacagacatgagctggaccttaaacatgatcaggaaaaagtgcttgatttgagattagagatcccttccttttccccagcaagttgccttgtgttccagcatcggtgctcaagcagctcagatactgcctttgaggactactgtgtgtgtcctgaaatgaaggagtatgatcaaagagagtaaggtgatagtaaagaaggccatactgtgataagagatactagggagcagtagcattgtcatgcattctctcacagcagtcccgtgaaataggattatttaggcatcaggtccctcgttttacagattaagaaaacggacacaaagagattaattgattaaccaagatcacacatctagaaagtagtgacatgtgattcaaatcctggtattttaagccatagctgtctatctcctgactactccagatgcttttaaaaagaggaggttttataaaaatatatttatcaacacgtctcatatcacatctaactaaagccgttagggtcacaacttagggtccaagtggacacaaagacttcccacaacgaatgcttagacttgatggatgttcctggtttgtggctgaggagttgaaatgaaacagaaactctgtgcagcctcaaccttgagcttctcagagataatgtgtgtcctaatcctccactttggcggcaaagcaaatttcaaaggggatgtatttgaaagaccttgaattaggaatatggggaactaactgcatggtcaaccagtgaagtggccttagggaaatcattttaccctctgtgccagttttctcattcttcctttaagagggttgtacatgataacctcttcctgctcccccaaaatcaaaatgtattactttaaaaattccttgtagtaacaattctttgtagtaacaagagcaccctgtgtttatggcttttttccagcctctgtttgctaggccatcgggatgacatatcattgtggagtggcttttacttactaatgccatggccagttcaaaggctgtgaactcagaggttggcagtcaggccttccaagtgtgactttcagctgcctgcccctcctcaagcttcaggccccacactgccatctgggttgggtcccaggttgcacggtgagatatatgtcgtgcttgacagggtcaggtttgggagttttgccaacaaagtgtaatgacattcaggtgatttgcagatcactgtttctcagtctagtctctgggtatgtctggcagccttccctctgccttctgccaacctgagcctgggcctgcttaggagaaggcagtttgaggtgtaacagcaggcaccttacatatcattcaaagatgacatagccagccatagaaaaatgcttattgtaccataaatgtgtcttccttaagcaatctctttaacaaactatttgcaatccccattgaagctgtccacggcggctgctccaaaaactagtatgtgcttatctcctcatctctgagagagaacaatacatggtatttacgtttgcattaaaagataagtccccttttcctatccacttctcccctatgcgttgcggataaatcactaattaaaactttaaatactgatctgtattattattggatatactgacacaaacttaaaggccaaattaaccaaaaattcattaactttgggatctctgtagaagactttaatttttgaagaaagtgatggagctagttctaacagacgttgccatggcaacagtgctgcctgcagttgagttgctctgggacccggctgctgagggttcatgataggactgcaggcaataccaggagagcagattgaaaaagatgattgagctgaaggttgtgagggggacaccactaaattcctttattagaaaaaaagcgcataaatgtgtcaaatgaaatttgcggtatcaagtgccagctttgaaaggaacgctactagggaccgggggtaccatgagagagcttgcccctacagtcacactgaaggaaaattatgacctgaattgttttaaatatagttcacgtgaagagatttaccagtcaccagcctgtgccatagtccaatcatcttctatttggggccataatgaggatctggataccctacctacctcttgggcttttctttaaaatggattctgaagaaaatgctgtattttcattaaaatgccaaggaacttcagacaagtcaagagctcaagttggatctagaattagagatgggcaagaaaaggcaatggtgccctgcagccagaattcccgctgtatttattctcctttgttacttttccccatgagtttacacagctaggcccaaagggacttcctccagctccatagcaaattagtggaagagtcaaaactaaaacccaatctctagtctgtctctagtgctgcttctactttataatagttcctcccttctaaaatgagaacattgggccctatggtccttccagccatgggatcagattaatctctaacttgtgaacatagctatcaatgaaacttctaaatgttctcagttgtagttctgtagtgcaatggatcaactggtcatcttttccacttttccagcctgtacataacttaacgatgaaatccacaggacaaaaatgaaatctatagaacaaatacaggacaaaataatgtagaataataaagtaggcaaaagtaatgtagagaaattctttttttttttttttttgtgatggagtctcgctctgtcacccaggctgaagtgcagtggcgcaatctcggctcactgcaagctccacctcccagttcacaccattcccctgcctcagcctctctgagtagctgggactacaggcacccaccaccacgccgttgtatctttagtagagacagggtttgaccatgttagccaggatggtctcaatctcctgacctcgtgatccacccacctcggcctcccaaagtgctgggattacaagcgtgagccactgcgcccggcctaagtaatgtggagaaattctatcaaaccaaactcttcttgatatctttttattgtataatttgctattgattaagaggcattttgtgatatgtttgctttgatgcccagatagtatgtgtacatgaataaagaaaaaaaattataatctatgcatctcactttaaagagtagcattccaacaatttaagtgaatgtatcaactgtttataagaatacactcacattctttgtcaaacatcacttgggaaccaaagattatttaggaggtctcagaatttccgtggaactcccttacttgagagatgtgtggtcttcttggttatgggatggtgtgagaaaacacagaatttagagttagacaaactgtttcagtccttgtttactgactaggtgagttacttaaacttgaagtactagttaatttttcttgaaaatgggggaatatttaatagggttgttggaagaataatgtgtaataaatgtaaaccacctgagatacagtctggaaaattgtaaattcatgataaatatccatttccccctcagtctacagaatgtgcatatatcaaaactgtcaagcagaaacctgcttatgaatcagaatcagaattattattctccatctttggggtaaatcagtaagccttgaattcagtggtcctgtagtcaaatgtctctgtaagagcaaatgccaggaagatggctgttctctaactgtagtataaagtgttccatagccatggaagaatatcatttggctaaaatttaaaatatatatgtctttattctgtacttatggcttgtataatttaccttagtgtatatttaattttttgaatttttttaatttaaaatttttaaattttattttagatccagagggtacatgtgcaggtttattatatggttatattgtgcaatggtaagatttgggcttctattaaaccatcacccaaatagtgaactttatacccaatagataattttccaaccttcagcctcctctccgtctccacttttggagctccaatgcctattatttccatctttatgtcaatgtgtatccactggttagtttctactcaaaagtgagaacatgtggtgttctcacttttatagggagaaagagagagagagagagattttccctaatagattcctctctctctgtctctctctctctctatatagatagaaagctagctagctagatagatagatagttagatacagatatatctctatatctatctatctatagatagatatagagagagggagagagagtaattgctggatgctagatagatagatatagatagatatatctctatagctatctatctatgtctatatatttatacacacacacacacacacacacacacacacacacacacatatatatatatatatatatatatatatagagagagagagagagagagagagagaggagtctattagggaaaattggcttatgcaattacaaggcaaagtcccacgattggccatctgcaagctggggacagagagaaaccagtagcaaggctcagcctaagtctgaaagcttcaaaccagggaagctgacaatgaagctctgtgtgatgccaaaggcctgagaacccccaagaggccactggtgttaagtcccaaaaccttgagttttgggcagtaggagagaaagcaggcatccagcacgagagagagagagagagagagagagagagagagagagagagagagggaaagggagagagagaggagaggagagagaactcagagcaagcaagcttatccccctcttctacttggtgttccagccatgctggcagctgattggatggtgcccattcacattgaggaggggtcttcctctcccagtccactgactcaaatgtcagtctcctctggcaccaacctcacagacacacctagaaacaatacttcaccaaccatctaggcatccctcaatccagtcaagttgacacctaatattaattattatagcagtctataaattttatttatccttttaaataaccagctttctgttttgttgatccttcgtaagattttttttaattttcaatttcatttagttccgctctgatctttgttatgtcttttcttctgctagctttaggtttggtttgttcttatttttctagttccttgaggtgtgacgttagattgttaatttgagatctttatatctttttgatgtaagtattttaacagtataaactttcctcttagcattgctgttgctgcatcccagaagttttgatatgttgtgtctctattttcatttgtttctatttttttatttttaccttaatttcttatttacccaaaagttattcaggagcaagttgtttaattcccaagtatttgtgtggtttttagagtttctcctggtatttatttctaattttattccactgtggtctgagaagatgcttggtatgatttcaggactttgaatttattgagacttgctttatggctaagcatatggttgattttggagaatgttccatgtgcagataaaagattgtatattctgcagttgttgggtggaatgttctatagatgtctattaagtccatttggtcagaagtacatttatgtccagagtttctgtgttagttttctgccttggtgatcagtctgatgctatcagtggggtattgaagtcctccattattattgtagtgatgactatctcttttctcaggtctagtagcatttattttataaatctgggtgctctggtgttggatgtatatgtatctctctatatatctacatatatatatataggatagttaaatcttcttgttgaattgaactcttgttatgatataatgctgtctttgtctttttaatgttattggcttaaagtctgttttatctgacataaggatagcaactcctgctctttttgtttccagttgcatcatatatcatttccagcccctttacttggagcctgtgggtgtcattacatgttagatgggtgtcttgtatgcagcagatggttgggttttgtttttttaatccaattttctaatctataagtggaacattaaggctatttatgctcaagtttaatattgacatgtgaggttttgttcctatcatagtgttatcagctagttgcattataatctcagttgtgtaattgctttataggatgtgtgaactttgtacttatgtgtgcttttatggtggtatcatccttccccttccatgttgagaactcctttcagcatttcttgtatgaccagtctagtggtgacaaattcttttaacatttgtttgtctgggaaagactttatttctccttcgtttatgaagcttagcttgacaagatataaaattcttggctggcattttttttttctttaagaaggctaaaaataggccccgaatcttttctggcttataaggtttctgctgagaagttgactgttagtctgttggaatttcctttgcaggtaaatttgacacttctctctagctgcctttaagattttttctttagtgttgatcttggatactctgttgattatatttcttgatgatgttaatctcatatagtacctcccagatgttctctgagttttttgtatctgaataaatacttctctatcaagatcaggaaaacttttctgaatcattccctcaaatatgtttgagggaacatactgcactcctttgaaggtgtcaaaacactctgtctttttgtattgccagagttcttctgctgattctttctcatgtgaagaagctgtcacttcttatttttaaattagtcatcctttggatgggacatttaaatttttactcttttttcccttgaggatatggctgtggagtttgttgtatatgattgtttggctttgtttctaggtgctttcaggaggccaaggctctacatgggttccttggttatggatatctgttgtgtggtggctttctcaaacactgcttgttgtagcagtatattgggtgtatgaactgatacactgtcttctgtggggctgggagtgtggaggtctcaagaagtttatctcatacattagcactatgcccttctgcagcaggttttttatttggtcttcagtctccagtccagtaggtggcacttaaggatgacagctggcttacccttgggtagctggatgatgaatggaggcacctgccctgacaagggtgacaggaggaggatgtgctgagctcttggggataagggttagggggctgcagcagcttcccatcctagataggcagggatgtgattcactttcctgttgcaggactcgtgaccttcagttcacatagatgctgtcctttgactccagtctgcagtgtgactgaggtctgtgaaaggacctctctggtggctatcagcaaaatggccttggggcacagcttcttcccccaatccagagcagacagctctgtgacttgtctgtcctctgttgccaccatgctgcccactctgtttagggaggggaagatgggctctgccctttgtgcaaacccaaatggcataggctcactttcactgggggtgcggccatctggaaatgcactgaaaaggctttctccaagtgcacttgcccaaggccccagtaggggaagtctgctctgcatccacaatggtgggtgggggaagtgggaaatggcctcttttccatgatctttcccagccactggtgctacccctttcagaaatcagcaccatgcctgcatttcctttgttccaaggggcactttggcaggccgtattcccccttccctcggggcggcctctgccaagagctagctctctggagtacccagagcttcccagcatcctccctatcagtcccctatcattgccaagtcagagtgggttctaaggtatgtttgcaggggtctggtgacacagacaggcaggttcttcaggcaggcagtgacctacactgggtgcacagccggtatggcacctgccatttcagtgcaggcctgcggggagtccgagtgcacctggaggagctggccactgctgctctgtcctcaggaagttctcagattgccaccaacagcattgcccaaggtcacaagggcagaggtgctctctgacaatttagtggtcagcagtttgtcacagaagggaggggagtagagaagcacccccacctaccctttctgccgaattctaagttccttaagagtcagtctctgccagactctcgtagctttcctttttctacaccccagcttatttccatgggaactccaacaggtcctggctctcttctctcagctttccattcagatcatggccactcgtctgtaactttgatcccctttctgaagagaactggcttctgacgtctccagtcagccatcttggaaaaaacaacaacaacaacaaaaaaaccttggagcatttttttaaaaaaatgaaatttatcattgggatgtgtaaaagaagattcacgagaaagctgaaaacacttaaaaatcactcaaaaaatcagattcactattactagttttttttgttttcattttaatgattttactcttaaagaaaaaacccagcatatagaaaaagaaagtcaacatttcaaaagtatattctagaaatgttagctaaacccaagataattttccataaaacaaagtataaatggatccttgacgcataatacctgagccaggcaagggaaaatatctgagagtgtcatccatctccaccctcgatcagagacaactcgcatctaccccgccatgagtatgggattcctttctgaagcatccaggccatttggggcctgctgctactctcacagaagtatatcctttgacacatatatttaggggattcagagcaggtgattctatgtcaagacttgataaatccctctccagctcctgttctgaaaaggatatctaagagtccccagatagcgagtaaaatggaacaaagaaaatgtttccacgtctactgtaaacatcaagcctatagagatttctcctgatttgagaaaactaagcaagtaaatacatttttagattagcaaacacctatagagcaatacaaaagaaaaaataattattgcatgccagagttaaaagtttctttagagaacatgcaacaataacaaaaattacctgacatacaaagacaaaatttgaaaattgccttcctttttgttgtcagtaaaactcaagatgacctcgataggtgaaacaaaagatgaagggtgagatgataaggcaaccatattgagaagaaaagaaagtcactttgaaaggcagatgaaaagggaactcaataacatgagaaaagattttaaggggaggaaatgtaatattagaattaaaatttgcatgagatgtggtaaagacgagaagcaacactatagagaatcgatttagtgatatgaggacaagctggaggagttctcccaacacataaagagaagcacaagcaaagatgatagatttagggaccaaggagtgaagatacagctcatgggtagaagttcatcctgaagaagagactataagaatgttacagaagcagaagtggccagtataatagaaaaaaacatgctcaaactgaagttttcctagttgatggaattcctgcatgtggatcataagaaatcaccaaaaaaagcaaacttaatggggagagactacattgaaatgtattcttttaaatatttgagtttaaagtttaaaaaaaaagttctgcaagcatctaggttggaaataagaaagcactacaaatgaacaacaattaggttgttctctgacttatccatatcaatactaaaggtcagaagctattagaacaacatacaaattttgagcacaaagaaacacaatacagtaattctaccccaagtcaatagttggtcatgtaggaaagcagcagaaagacattaccaattacataaggtgctagagactttccatagaattcctaaaaagcattttatgaagctatattgcaattgactggaagatgactcaaatcaaggcagataggtgggaagacgtgataaagcaaatgtggtgacatgtctattgaggatcctaggtggtgggcacttggaagttcattgtatgattctatgtttttgaaattttttaaaaatttcttataatgttgagcagaaacccccaaaacatgtttaatggagacatcataaagaaatagagcagtgtttagtatttaaattattgaaatgtgtaacctaataattgttgggttacaaaccaaagatctttctcacagtgttagagtaacatttaaaaatgaaaccaactagtgtttaatgctaatagaactgttaaataacttgataaatagaataagcaataaagtattatatatccattactataacttttctcagaaacatgactcatgttttgtaagataaacccttgtatgattagaaaatgaatacaactaaatatatcaaaatgttaccataaattatttcttttattattttaaaatttgttagaaaaaaattttttaattgctttattagaaaaatgcctatgatcagttacaataacctactttataaataagtatggaatttcatgctgggcagaaggataatgaaagtatcttcaattgtctcatcccgaccagttgcgtgattgacacactactttcaggcattggtcagagctaatatcacaaagaaaacaagcaaataagtaaataaatgagtgaatgaatgtatgaatgcatgacataaacctcagagacgacaagttctcttgagcctatcactactctgacatgtttgggggtcttggtccttgttgacctgctttcatagcaccatctcatagcaggactggctagtttctgtcacccagttgtgtttccctattttacatgattgataacctaggctattgttgcatttcattcatgtcattacatttccagaaaattttgctaaagcaaatttaaactggtgtttaggggaccctggcatgaatgccataattatgtggctttccactaaggagatgattgagacagaagattagaaagcaatgaggggctgggcacggtggctcatgcctgtaatcccagcactttgggaggccaaggcaggtggattgcctgaggtcaggaattcaagaccagcctggccaacatggtgaaaccctgtctccactcaaaatacaaaaaaattagccaggtgtggtggcaggtgcctgtaatcccagctactcgggagactgaggcaggaaaatcgcttgaacctggggggcggaggttgcagtgagccaagatcacaccattgcactccagcctgggcaacaagagtgagacttcatttcaaaaaagaaaaagaaagaaaaaagaaagcaatgaggtatgtatggtgcagagagccaccacctactctctccagaaggttttgtgctggtcgctgtgatttctgtgtgatggacaggcgggttagcaatactcctagtttctgcacctcatagacctcatggatatagtaaatatgtgcccaaggtcaaggagaacatttttagtctctgtttgcaatagctgtttcccccataaatatatttgaccaatagatagtataggttgggcagaagataggataattgtgtttttctgaacatttagagtgaagagaaacatttgatagcactgggtatgaaaggcttgaagtactttcagcagattcagtccctggtctttgtgagtaacattttttaaaaagcaaatggtagtcatttatcattgtggtttttcctagcaggtataacatgtactgtagcaagcagagcatagaaaatgttttttcttttatagctctacaaatagctaacaaattgaaatgcatgacaacaacaataataataagaggtataactttcattgatgaaaacctttttactctttccttgattttatctacagctaacacctaatctgaacaaatgggttcctgttttccattgtatttttatgttgttctattcttgcggtcagtaaatacggcattggaagtattttggtaagagcaaaacatctggaccagattccagacataaagggaggactgatgccccctgatcatcagactagtgtcagaaacagaaagctatgaggatacgcagatagtggatgatccttctctgtttatgtagtttttaagccctgtaaaatcaacgtggtaagtaaacagcagctggaaaaatgggaattcattactaatggactcaaagtagggtgtaggagtgttgtttgttttccaagtagatcattaaaattgtttggcttctctttaaagtctaaagtgccaattccttagcaccttacctttgccagagttgttaatttcggtattttcctgatatttatttatcattcttaaaattcgttttctgcatgctgcagttcttttttatgtgacaaaaatcacagctgaggtgctgaggctgaggtatttgctcctacaacgtcaggaacgtcagagcagtcaggcagagcctttggccgccacctgctggtggttggtgtcacagcagctaatacctgttttttattattttattttatgtttatttttaacttttgtgggtacgtagggggtggatatatttatgaggtacgtgagatattttgatacagatatatgacatgtagtaattacctcagggtaaatatatctatcacctccttaagcatttatcctttttttgcattataatccagtaatattcttttagttattttaaaatgtacaataagttattgttgactgtagtcaccctgtttgtgttatgaaatactaggtcttatttattctttctaattattgtttgtgcccattaaccatcccccctacttcctcactacccttcccagcctctggtaagcatccttctactctctgtctccatgaattcaattgttttactttttagcacctagaaataagtaagaacattcaaagtttgtctttctgtgcctggcttttttcccttaacataatgacctccagttccatccatgttgttgcaaatgacaagatctcattgttttctatggctgaatagtactccattgtatatatgtatcacattttctttatccattcatctgttgatggatacttaggttgcttccaaatcttggctattgtgaatagtgctgcaataaacatgtgagtgcagatacctccttgatatattgatttcccttttttttttgtttttttttttttttgagtatatacctagcagtgggattgctggatcatatggtatctctacttttagtttttgtgtttttttttttttttgaggaacctccaaactgttcaccataatagttgcattaatttacatttccaccaacagtatatgaggtttcttttttctctacttcctcgccagcatttgttattgcctgtcttttggataaaagccgttttaactggggtgagatgagatctcattgtagtttcgatttgcatttctctgatgatcagtgaggttgagcaccttttcacatacttgtttgctatttatgtcttcttttgtgaactgtctattcagatcttttgcccattttttaattggaattattagattttttccccatagagttgtttgagatccttatgtattctggttattaatcccttgtcagatgggtagttcacaaatattttctcccattctgcaggttgtctttgttgattgttcccttggcagtgcagaggctttttaacttgacgtaatcccatttgtccattttcgctttgtgtgcctgtgcttttgggatattactcaagaaatctttacccagtccagtgtcctagagagctttcccaatgtttccttttggtagtttcatagtttgaagacttatatttaagtatttaatccatttttatttaatttttgtatatggcaaaagataggagtccagtttcgttgcctgcttaaattatctagcaaaggaaaggtgataacatgtatatttagtgatggtaaaatcttatacaaccaaattgatagatatctagagacaagttacaggttaataataaacattatgttcgtatggaacaagtttaaaaaatcacctgtggcaacaccatctataggtcatggaaagatatcctctcccagagatgtagtatcaattcaactgagactaaaagccaattagtaataatgtgtggttggaacatatatgtataaaaggatttatgcataatcacttgggagagtagcccatggaataacatcctgtctgctttttcatctgtagcagtgcctctgctgcatgtgtgtgtagtggtggtgtctgctgctctgtttgtccataccgtctgcatgtagatagagtccatctgcttccaagctgttgaaactagtgggatattcataggtgtgattttccagacagatggagagaataagcttgtaatcatgacacaacttattttctacatttgagctcataagtttattgcatgcacattttctttcagtatagtttttaacatagaagaaactttattaggtccttagtgtcgtagagaaatcctgttaatgtctccgacaataaagctatgagcaattgctccttgttcttctcaggattaagatgccctactaatttatgttctgattactattctcttgacaacagtaacaatagcatccataaaaaggtcggtgcttatttaaaacagtgatgaaagtctattcgatttcaaaataaactttttattataggaattttcagccatttgccaaaatataaaccctcatgtacttgttaccccacttcaataatgatcagcatttataattcactttaaataagtgtctgttacaattcatgagaaatcattacttttgtgaacccatattgtattagtccattttcatgctgctgataaagacatacctgagactgggcaatttgcaaaagaaagaggtttattggacttacagttccacatagctggggaggcctcacaatcatgatggaaggcaaagaggagcaagtcacatcttacatggatggcagcaggcaaaaacagagcttgtgcagggaaactcccatttttaaaaccatcaaatctggtgagacccagtcactatcatgagaacagcatgggaaagacccacccccatgattcaatcatctcccaccaagtccctcccacaacacatgggaattatgggacctacaagatgagatttgggtggggacacagagccaaaccatgtcacatgtactttcatgacagggcagaaagaaggaagtatgtcatggctagggattgcacatttggagagccacatcctcgtaataggagattctcataagagagggaaataagtttctaagaatatgagtaaatacttggacatataatgagtagtatagctgttaacatttctttttcattcccaaataaaatattatcttatagaaaaatgtactgtatatattctgtaacaggcatttttatttaaactattacctgtacctttgagccagcagaaacgtttttaaaactgctttgttataagtgtagatgtgtggttcatgttcttcatctccgatttctgatgctcactcggaggtactcttcattgtccttttctgttttctgagtttgaaagttaatatttgcaatattagggccttcctaacttaagatgttgaactggatagaatgtattcaacaaagaaaaaatagttaatcctaatcccatcagatagtaagagccatttttgaaatatgtgtcccggatatattatataagatcaacctgagattcttctaacatagtctttctcacgtgaacctctcaaatcaagtctgccaagctgatgttgtcagaatcctgtttaaagagttggactccaacccatttgttcaaaactaaaatttctgattgcatttcctttatttcattatctcaaattttaaatagtacttaaaactcttcttctgtgtttctaccttagaaagaaaattctgacttttttctatttcacttctccttactggacctaaactatgattttggcattttgcctataacaggctctacagctatttggagcattaccatgcatatttgattacaaaaatgatttccccttcattctcgagggttttcattgagaaagcttccttatgtatttttttttcctgtgaaagtgatttggcttctggaaccttcctcacaaagatttgaaagtttatactaaaatgcactctttctaaattttgactttgtgtgatgaggatgcttttctgatatggcttttctctctgacccaggccacttccatcctgtgacccagatgtgccatgtaaatcaaaaagtgaccaaggcacgtcttagtcatggagaggcttatttagccaaggttaaggatgcacccaggaaaaagagacacgagtcaaaggaggatctgtgacgtgtgctttttctgaagagagttttgagaacttcagtatttaaaggggaaatagcaagcaagaaggaaataatttttttaaaaagagggtggttaggcaatgaggcaagtgtcacattcttgtgaggctctgattagcgctcagtgaatctacattttacatgtgaaaagagggagtggggacaaactcactcatgccttcatctcatgctctgtagttctgcatgttacataagatgaaggaagtgtgtgaaattacagccctgtgtttgggaacaaaaggaaggtggttttcgtgtgactccgttcccaagcttagctttcctttggcatggtaagtttaaggtcccgagattcaattatatttctttcactcccctaaggcctcatttgttgcttccagccaataaaaatggaaatagcttgtggagaggaccacctacaccttaaaagccatgtctttggaatggtgtatgtcacttccattctaatcccatttgctacacctgacagcagggaaagctgaggagtgtagaattgttgggagctcagcagaagagaagtcggagtgttgatgaatagatggcagattctgctgtacctaaatcctgggagtgcaaagaatgttccaaatctgaatagcctccacagaggggagattagaaataggcttgagtttgactcctggcagaggcccatggagatgcagacgtggcctgctggtttctgccctgcagatcatacctggagctgatgctgatgcagctgttggaaccttggtgtcagcagctgagggggccccaggagaggaagcagaggcggagaaggccactgtccctgccggggaaggagtaagtttagaggaggccaaaattggaactgaaaccactgagggtgcagagagtgcccaacctgaagcagaggagctcgaagcaacagtgcctcaggtgagtgtcccatgtcgcagccaggggagctcctgggaagtagcatgggctgggtgctctgttggttggttcatggtgataactctttggatgtataataggtttgtagcaattttgtgactccaccaaacaacattattatcagattctcagaaagactaatcccagctgctcagtatcagcattgcaatgttgcatataggccctcagggcctgtggctgactgggcctaagcatggaaacgggaatgggaaactggggtgacgtggagaaaggaatgaagcaggacagtgaaaaggatgagaatggagccgggagaaagagaatgtgatgaagtgagcactcagcccagggagaactcaatagtatttagatcttattattcttattactgtttggtggttattattatcattagagtgccccaaattcaccatcaggccccttttaccaagagcccaccactgggtggcactttgagaagggaaacaaagggaccagggccattaggtccgtgcatgaggcgggagggggccctgctcggcactgcctcagagcagcattgagaggccacaaagccacatactctaccactgcgagggcctccaaccccagggcctgcctccattgtctggttcttcggtattctagaaggcaacattaagagagggcttaatggtatgcattgttttcttctgatgattttactcccaataagttttcaaaaatttctccagggttacttaaaacttgaaactgaattatccctttcattatccctttttgggctgggggctgaggcagataacagtgttatgggagaaggaacttaaaagaatattcctttttccccttagattttctcatcacagtgcccagagtgtttttgtgtatgttgttctactcatggaaagacggtattatctctccaagttgacgaatgttagtgctctagtctgctgatagcagagggaatatagaaagactcccgttctgctgatgaaactcccctccatgctcatctttgttaaacaaatgaaagggtggtcctaatcctttggttcagacactagagtacttggagtggattgtggaggtgtggtccctccagcggccacagcagtgtggggctggaatgataatcacaagcgaaggactagtggatgatctccaaaccccggctggatcttcatcagcaagcatggttcaggcactgggggcctcctgggactgggggaggggaggaaggggctcacaggaggtgaactgccaaccgcaagagttagggttccgtgggacaagaaccaggctggcctgcggggctgggcgtggtggctcacgcctgtaatcccagcactttgggaggccgaggtgggcggatcacgaggtcaggagatctagaccatcttggctcacacggtgaaaccccgtctctactaaaaatataaaaattagctgggcgtggtggcaggtgtctgtagtcccagctactcgggaggctgaggcaggagaatggcgtcaacccgggaggcagagtttgcagtgggctgagatcgcgtcattgcactccagcctgggcgacagagcaagactctgtctcaaaaaaaaaaaaaaaaaaaaaaaaaaagaaccaggccggcctgcattgactcctcctgcaatccctctcaggatggcctccctcacccttcaagactctgtctcccatcccctatccctcctcccaattcccaccgaaacctcatgcttaccaaactgcctggctattcaaggatccagaaattaattccactaagggtttaggcctcaggaggaacagaaggaggctgtgtggcacagcggaaggcccagacctgagtctggctagtggggaagtatggaagtggcagccccagctttgggctgggggctaaggcaggttgtgcaggacaaggaggttctgttttccaggccctgccgggcatcgccacggtttttcttcccccaggagaaggtcattccttcggtggtcatagagcctgcctccaaccatgaagaggaaggagaaaacgaaataactataggtgcagagcccaaggagaccaccgaggacgcggctcctccgggccccaccagcgagacaccggagctggctacggagcagaagcctatccaggaccctcagcccacgccttctgcaccagccatgggggctgctgaccagctagcatctgcaagggaggcctctcaggaattgcctcctggctttctctacaaggtattcttattttttaagtctcatttatcctttttttgctttaaggcccttttgctcaagcctttggttttccagtttttacttttactttttgcaattattatttctgtgaactgctttcccttcaccacaacatcacttggacaagccaggactacagtaatagattttcatgttttaacaaagaataattaaagggaagttcaccacagggcaaacagtatgcccctgggtaatgaatgggagagtcttttccagccctccctcctctctactcccccaggtgcctgtgaatctgtggagcctggctcagaccaggccttggaatcaccaagagctcctgactcggctatatcccctgggggtcgggcagcaatccttcagtcaactctggcaccttgtagggtgcatgacacagagtagggagcccataaatatttggtaaattaatggattcatgtatgaatgaacttgcaccaaaaggcagaaaaaaaaggcggctaagttaatgggaagaaggttttgctcagacaggctacttagagccttcataaaccaaagggttcttaccaaaaaaacttagtaaatacctaaaaacactggcttaacctaagtgtttcctgtctcagatgtttcctgatagaatctgaaaaggaattttaagtttttaaatttgattttacatttaaaaatcagctctttttcttctaaagtgtaaaatgttgtatcattccctctctctctctctctctctctctctctctctctgtctttgtctctctccattagaaagtaactgctaccttgctacctcttgtggggacaggggtggctataatggatttatgaataaattaatttggaggaaaagctaaacctctagataaggggttgtttcctgccaggttccgttttaactggagcacaagcagtccaagaagccttgtgccaagcacggctggagcttgctgggcccattctggcctcctcactaactgtagaataacctaaggcaccccatatagaccctctctctgggtatcagttttccaatcagaaaaattaatttagggataacataatccatttccagctctgacagcttgtgattctatgaatatgctcaatggcaaaatacacactttaaaagccaatgtttactctcaggggtggagttgagggaaaggtgggaaaaataaaatcagccatgacggtagagtgattcagactgggtgacagacgcataggggttcattatgttatttcttctgctttaaaatatttttctataataaaattttaaggaaatctttttcaaaatgggaaaggaaaagaaactggttgccattgtatataaggtaggatagggaaggaaggaaatatatttacacagaattgatcacagagttttatttagtagtaattactgtataacctgcaagtggtggttttccttattattatttgacagaagctggggttagaggagctttagacattttgggttccagttaaacaacaaacagtaataaagcatcagcgataataaaatgcaaatctctaacaaaaataagatgaattaaaatttgattaatatagtgcttttccctgttgtagagggcattgcattactattaataaatatacatatgaatggcctcatatcagagaataggacttcccttctggctttagaggccttcttcctccttgggatatggcaaatatcttcctcttttcatccaggttggagagtgacttgtaagagtgtctgcttgaaatctggctgggaaattgatttttatgtattcttatcttctgcaggtggaaacactgcatgattttgaggcagcaaattctgatgaacttaccttacaaaggggtgatgtggtgctggtggtcccctcagattcagaagctgatcaggtaaaagaaaagataggaagatgctttgggctacgttgatttttttctgagggtctgttggacacaatcacttcctaaagatgtttctattttctgagatgctacaagccatctgaaaagggcttaagggcttgtgacagcatagatcattaacgaggtttctaggacacccttttgggatgctgttgcattctttttttatataatacaaacagttgactgtttcttatcacgtaaccactttctgggaatgttatctctgtaacacctgtcttcaggaaatgcagacactatgaatgtgaactaaaagaccccttcaaaagtggttgcctctgggtgtgtggatattgatgaggaaagaacctggggaaccctctggagtgatggaaatgctttgtatcttgagagggatgtctgcatgtatttgtcaaaactcattgaactatatatacctaatcatctctgcattacacagtatttaagttatacctcaacttaaagagattctttaaaaatatcacttcctaaaagagtggtctgatgtaaggtactgagaactcccatcttgttctcattcataaaatatgtgaacccttgaaatggtatgcagagcaagtaaatgcatctgtaaacatatttttctggagagaaaaactctaacttccatactattctcaaagagatttatgagctctccccttaaaaaataaattcaagcatcactgcctttgaggttaagacttaatatgttcaacattttgttctttcttttgacaacacacttaccaagatacatcaggtgctgggtcaagcagtctctaccacaataaaatagattggaaatttatataacaataatctgctgggcagggtggctcatgcctgtaatcccaggactttgggaggccaaggcaggaggatcacttgaggccaggagttccagaccagcctggtcaacatagcaagacctcatctctacaaaaaaatttttttttaattagctgggtgcagcagtgtgcacctgtagtcctagctactcaaaaagctgacatgggaggatcacttgagcccaggaattcaaggctgcagtgagccatgatcacaccactgcactccagcctgggtaacagagcaagaccccgtctcaaaaaacaaaaaattaataacaataatatatctttaaaagcccccaaagatttaaaaattttaaaatacacttctaaataacccatgggtcaaataaatcatagtgtgagttaaaaaaaaatttcataatgatcattaaatagaaattaaatagaaaaatgcatagaaggaagaaaataataaaaataaattcacaaatgaatgcaataaaggactataacagataaaattgataaagccgaaagtaggtttttgagaggattaacaaaattattaaaaccttagaaatactcaagaaagaaaagtcacaaagcataaattaccaatacaaagaaaaggtgtcagcatcacacatctcaaagatattaaaaatcccatttataatgggatttttgtctgcattaaccagaagttattttgtaaagaaataaaaggaaaaaaagttagtcttttatgtttaccaccatgtttaccatttccaggtcttcattctttccttaagtccgagtttctatctggtcttaatttcctttctgcttaaagaacttcctttagctatttctgaagtgctagtctgctggcagcaaatcttcttggcttctgtatatctgaaaatgtctttattattcttaatttttaacaatactttcactaaggtagaaatctgagttgatttttttttctttcaactctttaaacatgtttcattgttttctggtctctattgtttataattagaaatcagctgtcatttgtttaatattgcttctctgtatgcaaagtgactttccctgactacttttaataaatttcgctgtatctttgattttcatcagtttaaatatattgtgcttgggtaggttttttttttttatggtcttcatacttgaaaatcactgagatccttagacttgtaacctaatgtttttcactacatttgctttttatctttaatttttttctgaattattctctttgttctttttttctgggtttctaattatacttaagttggacttcttgatagctaagatgctgttctttttctttcactatttctctctggtagtcaggttggataatttctattgatctgccttcaagtgctatgagtgtttcctctgctactttgagttcgtagttaaatttatccagtgactttttcatctcagatattagattcttacaattcttcatttccatattgttatttcatatgggtttccatttcttggctgagatttcccacttatagtctttcattattactgtctctcaatttatatacttgaacaaatttataatagctgccttaaatttcttactgctaattccaacagctgggccatctcagggcatatttctattgtttgctttttaatcttttggtcatattttcctgtttttccatgtctaataattttttaattgatactagacatagtaggtagaccatacgtggtaaagagtctgactctgttttctatatctgaaaattgcttatttttgttttagcagacatataaattactggataattcccttgaattgatgggagttggttttatactttgttagggtgggtctgtaccctttatgcatgcacagcttgggggtcagcccaggatttcaaggcagtttatccacatacgttaggatacccatcccccagtgattcctttcttttcaagataacccccctgagtgtacagcttctctgggagccttacactctatgctgtgaatgccccacatcacactgagtgaggataatcctcaggggaaaagctgtatcagcatagatctcaccccttgcagttctctactttcaagggtcaaatactttctaatttctgcctccttttggtcatttccagcatcttcaaatagttttacccattatttatacccatcccattatatataaatttacactttatatattgtataaccaagagttgtttgtttatataaatagttgcatatgtgtatatatagatatttggagatatatagttattccaatgtttttaattattctctccagaaggagttgtctaatacaagccattctaccattaccaagacaggaaatctttttctaccacatattttaagcagttaatatttaattttttatattttcctcagctaaagattgatgttggctaatattctttacaagttgtctttcagattatatgtgttggaatatatcttgattgtgggtttgtgtagtcctttacttgttttctttattgaaacaatttttaagtgcttaactctacttggctccattagatttttcacctactgtaaataaagtcaaatatagacacttgtgggggaaaaatgaccttttatatgctttctagagcttcagaaaatatttagctatcatcttttattttaagcatagctttgtccttcacatatatgacatcataattttaaagagggcacttttcctcatcagctaggatattatcagttattttattgagtcgtttttttcctcagcggtttttttcctgccttcaaaaattgggctgtctaaatacttatatttcttgtctatatggcagcatcaatttagagtctcagattatatcaaaagggaatgaattcagcttcttcatttaatttttgaggcctcattttatctgatatacttgaactatgttgggggtttgttcagactaaacctggccatccctcatctgaactggaatttcctttctgcactggttaacataataaagatagtcatttcccactccttgcacttcctatggtctcatttcccactgttcctttcaacacagcttttccagctagactctgcttaacttcaggaagccaagggcagaccacagcctctgtttctcagttttaagtatcatctcccattctgcatgaccatatatggatgggttctttaccctttctggggcaaactgtttcatttttgtgatggcacttctatatgacagacaaatgtttatgaggaataatttataaaggatataggagcgcttccagcaagaatgccatgacatccaactgctttgtagtttatataaacttgaaaaattaggtattataaaaacaaaaatagtaatataaggcaacacacatctagcttttagtatttgatgagccctacatctacataggtagtttattggggttataggatatgagctgggggtcagagttctttcttatgagcaagtggcttgggatgaaatataagatattccatggcctcatcagtattccattctaacccaagcaacctcaaaccttttttacactgtgaccccagaacaggtcatgctcttgtgcatgaaatgctttcacatggtattcctgtctttgcactggttgtaattgtaatccttttctcctctttaagaactcatattataatccagttaatatcaattaactatgctttgtacagtcacaatgtacaaagcattagctatactttatacagtcaataagtcattgcaaatgtttattccttctttttctttttctttttttttttaactaacaacttatttgggataggccttcccattgatcacggcacagcactttacctgtaatgtgacatcctggttcagaaccacaacactaatgtaacacattattaattaattgtggcagtgtggattttccagtagtttgctggaccctgaaagttctgtcattgtttttcaggatgcaggctggctggtgggagtgaaggaatcagactggcttcagtacagagaccttgccacctacaaaggcctctttccagagaacttcacccgacgcttagattagggcaacaagtactgcaagaaggagctcagttacggggtttttaaaccttcatgaaaacctgaagagttcacttttgttattatgctcttaatgatttacagactgatgccagacaaaccttgggaagatgtatcaatggagcatgtgtgcaaaaaaatgtaagaggaaaaaaagtaaattaaggaaaaaatcctcactcattcccatgttgtcaataacaggtttgtttgtgctttgtccaagctgtggagactcttgtacttgatcccctcccaccaattctaaagtagctttctccagatcagactttaatttctctgcatcaggtgtatcgtattgagtggctgccctgcagaagatgtgatgaattatcctgtagtacaagattatcttattcccctgcccaggtgtgagcacgtgctctcgctccctttcaggtttactatgtttaaaactaaactgctgcaaaagttctcaatgttcttttccaacacatctatatatatatggacacacagtcacgcaagctagttcccatgactcctggatctatgtgtatgcagaaggctacatatacatagttgcttctttcctttccattgtagctctttgcctctcaattgtcattgatacatgcattgctcttattctgtctggcattacaattgcagttttgcctaatggcaaaaccagccatcccattggcaaaagagtcaacagtatctgtgtttgtactgtgcagttttcaggatgagatgacagatagcacgactacactgaggcaccctcagagaaggcagggcctgatttatctagctgtccagccgctgtggctggaggtaggctagttgggatgggcagctaagcagtcttctcttctgcctttatgagattgggtagaaagatggggcatattcatctacccccaaaagaacactataaaaacagctcctctatatttccacctctttctatttatgcaactcatcttcacagattgttctaaagtaaaatagatggtgtatgctgtatccacaaatcatctgtaacaattatgttttcagtgctgtgtcattccaaataaacctttggtaatcttcaacgattaccctaattccttttgatgagtctttttttttttttttttggaaattttgttccagtcggatactctgcttgaaacagttggtattggagttgttatttgtgcagaaatatgcttgttcttccactaggttgcactccacgcccccaccgcacctccccacttctttcattccagtcattgctggtcactcggtgttccctgacatccagcaattactgcagcaccaataacagctgccaacggagagcccttaaaggtgccggctgtagactcccagtccgtgaatcactgataatcttacgaccttcataatcagcaatttcttctcacaccagcttcattttctggtcactttcctttttggcatgtttatgttcgtaggtacataaaaattagatcagttggaatagaaaagtgaattcacttggccattatttccaaaagagaattcttaacgcaaatccttttagttgatttggactcttttctgctaatataattctttatacaacataggctgatcaagaatgtatattattagacttttagatttagtatgtattcctgattcatggtttgaatcttcctggtgtattactgactttgttgttttaagtgtgaatagggaaataactgtttttgagccaagatttttccaggggctaatatacagagaagctgggtcatcatgaatgctattctagtgcaagaaaagcaaatgtcactgcccaggagcatgactgataattcagcaagtggaatgcagcaatgtaagattcgtaatagaaagccactcctgacagtagagtacacacaggatgttaaaagccaagactgaaaaattcgctctaataataaaatgcacctaatgttctgcaaagataattggcttgccacatctcctggagcagaagatgtgatgaatcattcttaaattcctttcaccctcctgcccacagtggctgctcacagtgtacagtttgccaggacatggcccagataactgtagccctagatgaatgttcctagatgaatgtaacaagttcttctgaaatgacgtgattttaattagctatttagtcctgttttttaaaatgcctttggatttttttttacactaaataagagttatcagattttttgtttgtttgtttcaggaattgccaaaatccaagaattcctaatgcattgaaaatgaaggagatggaggggatgggcgtgtggtggtggcattccccagaaatgtccttgaatgtggagtgaacattgttttccatttcagtggattttctaaggaatgttagtttcaaggactttctgggattactagtgtaaagttctttccacttctctttctcagttattccgttcaagttctcacaccaccaacccatcctaggcacatcacccagtcatataatggcaagtttgtattgtatcccaaatggccttgaaccaggccttggtcctttcattttttttttttttaaacggagtcttgctctgttgcccaggctggagtgcagtggcgtgatctcggctcactgcaagctccgcctcccgggttcacaccattctcctgcctcagcctcccaagtagctgggagtacaggtgcccgccaccgcacccggctaattttttttgtattttttagtagagatggggtttcactgtgttagccaggatgatctcgatctcctgaccacatgatctgcccacctcagcctcccaaagtgctggaattacaggcgtgagccaccacgcccagtcaggccttggtcctttctgagcttcctctccatgatttaagattcttcttagaaacccaatgtcatgcagaccttcaaatagttatgagtcagaactgtttggaaagaaagccagtagttcttattaaacatacacctacctggcattcctaccaatatgacaaatagtcactcatgtaaacctgtgtgatgcatataattgcaaagtaaaattgcctgg

SEQ ID NO: 17297 - DNA, 16885 bp, Human
gaaatagcatagcttttcctaaattcttaaaaagcaacaacagcagtttacatctttccccactgatctttccctcaagagctttccccccatctccagccagtgctgcctgagcctgtgtcttactatatgaggtcctgacatcccgaacctttaggaagtatgactgtggctggtcatcttcccaactcacctgtaagtaccttcaggacaagaataatgaacttaccttcttctctatgtcttctcatttatcctcccacattgtcccctagcactcagcccagaaggttctaaagaaataccaatactgcctgttaatataaattaaaatgtattcttgttatataatgtaaatctgaaaattcccttcctttcttttagatatttcctgtatcctttattccttctattcctttttctagcaaactttcatacttaccaaacaaccctattttgtgagggataggctatcatcacccagaaccgctccgccgccccccccccccccgccccccaccaccctatcaccccacaacatacacagagctgacacttggtttagtttgtggttaacaggggtggcactctttcttcaacttttgtttgaaggttttaggatgcaaagtaaagccactggccccatttctctgcaagattatcctgcccaaatctgtatgaatcaccagtggccatttctcatctacttccccaaaattattaaaggttttattgtataataccttcaccaccttcctaccctaagaagtcctcttctggctcattaacctccttcacatgttggggacaaacctcagcattgcctacaactcacttataagaaaatataagtttctataccaggcatgatttgtgattgcagtgcaattttcctattaagtctagagcttatcattcttctctcctacacattctggtctttctctaccccttctttccattctgcccccttttttcctacccctctccccaagaaatgaactggtttccattcagcaggtttagtcttgctttggccagcttattgtttcaaagtggttataaagttgctgggcttgaacacagattattaattttcaggcattcatgatgtctccctgttgagtgtggtatgtgcaggtgtgcacatgtgtacctggggtaactaacactcctggactatgcaattttgctggtgactgaaaagatgaagtcaaagttgatttgattattgaagaatcacattattttagaggtatacagaatgtcagagtccaactttggcgttttacagatgggaaaacgaggtggggcaaggtaaaaagacttagccagagtcataggttgatcagtagggggactaaggcttcagctctgagctgtcatatctcagtcccccaaggcttttccactcacataaattccccctcaagggctcaaatgtgtgagtgagaacccaggatgtccacatacaaacaaaaatgcatcatagacatgtgaacatgtacacacagagaagatagggagttattgcatttgtagcctacaaaacagaaccgagaatgtgctgttaaaattagagtaaaactgctgtaagcaggttaagttctcatctaaagagatcacatttccccaccatacccctgctatccatttcccccaagtggctcattagaaaaaaagatggctagatttcaaaaagcaacttggagagatttctataggatttttctttagttcaatcaatacagagttatctcttacttccacgaaaatagctttttcacacatctctgcacacacagtcacacacacatataaaacattggcagcaggtacttttaatttgctggaaaatatttctaagaagtcaaaaagctccagctgaattgcatgccctcttattggctcaccagaccagttgagggacctgattggtccttgatcctgaggaccgataagaacggctataaaatccctgggtgcagctcttgggcccccagtttgcaaaagccagaggtgcaagaagcagcgactgcagcagcagcagcagcagcggcggtggcagcagcagcagcagcggcggcagcagcagcagcagcggaggcaccggtggcagcagcagcatcaccagcaacaacaacaaaaaaaaatcctcatcaaatcctcacctaagctttcagtgtatccagatccacatcttcactcaagccaggagagggaaagaggaaaggggggcaggaaaaaaaaaaaacccaacaacttagcggaaacttctcagagaatgctccaaaactcagcagtgcttctggtgctggtgatcagtgcttctgcaacccatgaggcggagcagaatgactctgtgagccccaggaaatcccgagtggcggctcaaaactcaggtaagcagcaaacccaagagcggtttctcccccaaagagctgtcctcatttgcctctcccttttgcaactgtgtctgtgacggctgatcttgataataaatgtgcttcatgcctgatggcaataaactgccagtgtaatccaatagccttaggcagtggagctcctttgtttaataaattgcatgcaactaaacgaagaagctggacgctctgctgagggtatttcattgcataagcctagcctgattgcctgaaatctggcacgtaccctcttggagggggaggggtgagaggggaggaaaggcttgaatgttggcatgcttcaaagcgctctctatactttccagaagctgatctaaggtaagacctggcttgtttgatgctgtccctcttcctttcctcttaagactctacctcttcacttcttgacttctctacctaagagaatacacagaaaagctccctcttcagactgattttcagaaccatagccctcaagtctgacaaatccagggcggattcagagaaaaccctatacatcccacccccaaccctgctgcctgtctccctcctggctctgtagggctccattcagtcgtccctgcagcccgtagccagagagcccctagaaaaaaaaaattgtgaaacgtagcagctgtttctccaagggtaaggtctcactttcgtcttgactcttggagcagttaattgtgcattatcttggcttctgaaggaaaagaatcattaggaagcctgcattgacacctctgcctcttgacttctctggctccacttgttccccttccaatactgccctctgtcctccaactgtcagcaaagaccggatcacaggtgtcaaaatgctgcagatgatgatccccttggaagagcacaggtccctgccgagaggagggcttttgcttcacttccttttgtacttagttgctatagagatgcagtgattcacaattcgagcttgcctaaaacaatagcagccctaatgcatattaaaactgcttaaagcaaagttataatttaaacccgtggaaatatataattagggaaatgacttgtaacatcctagaggctgcgggtggtgggagggggtggggaagactaactgaaccatgcttttgatctcagaggagaatcctatggcatgaaggctgcagatcattccttgcctagctgcctgccagaacaccccccttctgtgggagaaaaattacttttatgggagatcttatccagaatgtagaaagcctcatgcaagttttttgcggttttcttccagtcttgcatagggaggccttggcctggttattccacacctgtgtttcttctttctttctttctttctttctttctttcttttttaaaaggcttttaatatgaaagagattatgcatacctctaagcactgtcctagtggagggttggggtgaaacatgaacggatcagatttctttttgccaatatgacggtaagttaaaagcctgaaatcagaagggtctccaagtggactcctggcacagtcttctctgccatttagactaaaatcccatgctttttactcgggagtgcatttttccaaagctagatggattccctggcccttttacctcttaaacctgaccactagccactgtctccttccttcccatgctttcaagtgctaagcaatgacctttgattctatggaatggcttaaaggcactgtgcatttccagacttgagcctcacttctccagacaccaaaattgtaggtaatggtgaaacagggagcgtgtgtctgaaacagagaactccctccctgtccatcatgtactccagcaatcataaacaaaaggagcctgtctatcctctctttctcaatcaaatgggtctatcaattgcccctcatgacagattcctaggataagttcttctgacctcatgtccttgaaattcacctctgcacccacttgatcccacccagccattcctcactgtttgacccagaatggatggatttgtctctttcagctgaagtggttcgttgcctcaacagtgctctacaggtcggctgcggggcttttgcatgcctggaaaactccacctgtgacacagatgggatgtatgacatctgtaaatccttcttgtacagcgctgctaaatttgacactcaggtaataaaaccttgacccctgctcccactggctgcttgtctttaacagtgtgttagaccatggttcttaggaaccagtcttgtagggaaccagccctgcttctcagcttccccactctaaattcccatctcagcatgtgtatgcacaagtgtgtgcatgcacacacacacacacacacacacacagaggcactcatctggccaggaaataggttctgtataagacacgccccactcactctaatgcatgattctaaggagctagtagaggctgtcttataaggccaggggtaataagccaaaaagattttcctctgtaagaggacataaaaacgtgcatagagcaaggaagttctctctgcatgacctagcatactagcttttgatctgaattctcaaagtctcaatctcaagaatatgaagtcagattacgactatttttaagctgcagaatggttgatcacggttcatcttttttttctgtaatttcatttcggtagagcttaattctcaagggaatccagggagatggggagagggcttttttttttttcaatccttagccgagacatgcaatcttctcattgcaaggatatgcagatggccatgatacgttgcccagatgagcccccttaaattcctccatgtatatgcccatcctctttgtcaggtcaagctaaagacctccctcttgtccttcctccatggcagggaaaagcattcgtcaaagagagcttaaaatgcatcgccaacggggtcacctccaaggtcttcctcgccattcggaggtgctccactttccaaaggatgattgctgaggtgcaggaagagtgctacagcaagctgaatgtgtgcagcatcgccaagcggaaccctgaagccatcactgaggtcgtccagctgcccaatcacttctccaacaggtacaaactgagtctactttttcacaatcaggggactgggagcaggtggctggctggcagagccagactgggagggagggttaaattgccacagtcatgctcttattttagcttgcagtcttcccagcttttgcaggaaaaaaatatgtttgtgattggttgtgacagtttaagcagcttgggcttttttttccctactgttataggaaaagtcttttcatgcagctcatagaaagccagcctcatctgcagcatccctgggtgctttcattgaccattttttgccataagcctgaagggaatggtgaagtttctggaaacaagcttttaagacatcagatttggctgaaaccatgaccgtgcaacaacacaattggccatgattaaaaaaaaaaaaaaaaaaaaaagccctctggttaaatgtcataatgcagattttaagtctccatctatttcaaatcagtcccaaacacagtcagagatttcactgggtagcccagagcaagccatctcacttccctggggctcagatttcctttgtaaaaagcaaaatggctggactggaccattttcaggtttccttccaggccttatgttatcccattcctctagcccaagatttcctagaatgagtgtgttttatggctgtccagatcccattctcatcttagtattcaaacaccacccaaggccactgagctagtacagtaacatctgggcattgtacttttcagtgtttttaccagccaggagtgaattcctgttacatgagacagctggcatcctcagttcatgtgcgtggcctggaaaggttcccagcaagaactaagagatgccaatggggttggcgtggaggtctggcaggggcagtgcagaccggtcaagtttagccccctgtgatatccctcagcctaaaaacttgactcccagccttgaatttctatgattctttgactctccactcaaatctgcacatatccacaatgatcagtgctttgcatgttactctgaccacctgagagttatcacaggcttatctgattaatttcctagccaggtgccaccacccttcttaagacagtggcaacagccaagtccctctggggcttacaagtgatttagtcatgtacatacatgcaacaaaaaagtagttcctccttagggaaaggctaaggtgcctaacacaaacgctgtgtaaaatttctttttcacccttaactacaggtgagtgcccttcagaaccacaaatcaatttgtaaaaatcacttctctagtccttggaagtgactttatcatggggttctaaatggtttcctcagaacagaaaaatccaaccatttctctcaagtgggctgtctctatataactcttggttttaaatttcccctaggaagattcttattgcacagaggaaacaggtgcagagggtggggaggggagatctgattaattattggagacttccttcaccattaggaaaagaaatgaagaattcttagccagacaggggctaaggacaaagtatgtgtttgtgtggtagttaggggtggggggagaggtacattagcaaagccactattacaatttagatccttaaggattctgtgacaaatcatgatctataatacggcatatttccaattttgaggcgatactaatctccctatttcatctgaagtagcatcttccattagaaaggcagagaggtctttaggcagaactatatagctactcgactagaggtcccaatttatctaagaagagactagtaaatttttaaccaggccattatttcttctaatcagtgccttattttcaacacctttagaaaatggtcacaaagaaagtcttcttatctccctctttcatcttagggactcattaggaaaggtcaattggagaaaaaaaaaatgtggccagcccttgaaaaccggaatcttccatgcaacctttctccaaaaatttcactttaacaggctatattattcctgctcaggattgtagaaatgtccggttccatgctgggcttgctttgctccattgaagctgctcaccttcctgagacatcctgctttcccagcctctatcccaccatagacacacgctaagtcagtgccaattggcacagaattgcaagaggaagtagttacaggttcattccaccttcctgtgacttatctagcatgagatttggggctgggagaatccaaaagcctgtgactggaccaggagccagaacaaggggattttccatgacagaaatgcacctagagggtaaagaggtagctggagtttccacctgcctgaatttgcagactatgctttcaaccctgtgggaagcaggcaaaattgatcaggccagcagggcggtgcgaggcttgggaaccacttagaccaacccagatccagagtgggaaaactgacaaagcttccaactctctagggcatggatagggaacaggaaacagaagaataatattgatcaagggaaacaaaggactatttataaaccctcacacagaacgttcctaggcagtatgtgtgtatttgggtaagcatggctgaaacagtagctatggagaatatctgatcttattctttatcaaaaaaaaaaaggtcagggatggaattttcaaagtgagaaaaaagaaacataattaaaaaggtcctttcgggctgggtgatcagaacacttagtccaccaagtctttccaacacatctcctccatcctccataaagataaagaaaggaatcttcttcttctttttttttttttttttttttttttttgacagagtatcgctctgttgcccaggctggagtacagtggtgagatctcagttcactgcaacctccatctcctgggttcaagcaattctcctgcctcagcctccagagtagctgggattacaagcactcaccaccacgcccagctaatttttgtatttttagtagagacagggtttcatcatgttggccgggctggtcttgaactcctgacctcaggtgatccacccatcttggcctcccaaagtgctgggactgcaggcatgagccaccatgcccagccaagaaaggaatcttcttaagcagtcctaactaccactgcaaaggaggggatgtaagcagagctgctctattttttgtaaaattgagaagaaaaatgtgtattgaatccctagaaacatagaatgtcatagttggagatgactgctgaggttaactagactaactgcctcattttactgattaaagaataaaggctcagagagtggagtgacctgctgaaggtcacacagcttgtgaataactaagttgggcttagaactcatgtggccttgagccaagctatttgatttctacttcaaaaatggcagccagcaaaatctgcaggaaatagccacaacccaaaaatagaataccaagcacaattgaatatatgtgcaccgtggtagtccacaattaaatttgcgtcctttctctcccaaaaggatggacacatcctaccaatagctataggaactataagaccatagcacaagaaggtgctcactaaataggtgatgattgctaagtcaactcttgctggagacacaacctcttaaataatccatctcacttagtgacacaggaaagggctatgtcattggcaagcatgatcccagaggtaaatggctattccagcccttactggacaggcactggttaacctattgctcatactgagaaactggtgacatcaaataatcctgacaaattttccagcctttgaagaactactaatggagacatggactttgttttatattctaaagagctttctcagcctgcccttgctgagttaacaaaagccccatgagggaaatagggtagattccagtgggggtgggtggttctcactaagagccctcaggctggcaagggtcactgtcaagaaacaccaaggtcaggtgtcatatctgagccagcagacaaagcaacagtaaaggtagaaaggtagaaaccctccaaaaaagagcaggcactctgacaaagtggggcctgaaggaaatgtatggccctgaagctgcaaagctggctgcagaagcttaattaccttaagggtactagacttctttgtccagacaagagctttcaagtccttctaaggaagaactagcatttctttttatccctttctagggaaagattgtattttccagcctatctggggactcatctggcatgaacagctctttctagaaatggaagggttaacttctaagttataaagtccttattggagggatgggagatcagaaaccacccaccaggatctaatcaccctctgaaatagacacagccatccaaagacccaggtcctagcagagcccaagagccaggtgatgcctggagatctatatgggtgtgtagatgtcagaagctgctggtgcaaagttgtttattctatgtttctccaaaactggttttctcctcatttccccatccaaaggagatctcctttgactcatgtgctttgtaattccaaagagttggaaaatgttcctctgtgccagagagtcccagttttgaccacagctggatataattctccctggagggaagggtttcaccaggcctgtgtcagcaaccaagacactgcacttgcctctcagtccccagcttccttctgctgggccacagaagggtgaccatatcacctcattacccacgttccatgctatttaccacacatctttgaaataacctctctgggggattaagttattctagaaagatgtttgatcctgtgcactgtttggtgagttaaaaataaacaggtttcttttcacggaagacctggtggccccagagatccttgggctcctctgagaaaaagttctctccatgtaaatactgcaggtcactgtcactgagtctcttattagcgaacacagaggtaatgggttttgacaactcaactgcgactacaaaatggaccaaatgcatcccagtctaaattggataatacctgaactgtcttcccaaataacaggacaagtcattgatatgccctaaatattagacagtttaatcctttctgagccacaaagcttagctacattgcttgggggtacttaaagaattcgctgcaaagatgaaggtaactgataccaaacacaaggggttttggtaaaatttactaaaactacagataagttttcttctgggaatcactacttattggagagaattatattcttaaaactccatttccttagtggctgcaaaataaatcaacaaatgtgcagtgatcaggcaatgtagcacgatggcaccgggccataaggaatacaaagaaggacacaaatcctgccttcagtaagcttacagtctagtcagcgaaagaaagccatcacaaaaccatcaaatgctggcctatgtgatggcaaacaaagatctataaatatccaaaaagggaagaggttagcaaactctggtatagtagaagaaggattcatgaattatagtagcatgaacccttaaaaaccaccaatatttccatttaaatagacttcttgcctaggatttggccttctgactacaatatacctttgaaggagggctgaagatggagtcagtcaatatcttttatcagggctgtccaagtatgtgataagggcattagattttgtagaaaaatgcatggcacacagaagagggggccttagacagaagtttcatcagaagatgcacagatctgcatacacacacacacacacacacctgtgcccacacaccaccaaaaaaaggaaaattacaaaaaagcatcaaaataattacacatgcatgtacaatggctactaatctcagtgatgagcattggactcacttcattctaatttgcttcacctcatccaccttagtttcttctctacaaaatgagagttgaactagtcaccaaatggtctctgtggtcccagctagctctgtaattctgtttctaaaaatgtcagtcaccacagtcagcctgctcttcaaagtgtgatctaaatctcctcaactctaaacatgaagatctgtcttgcattgtgtggtaaaccctaggagcagatgcattgaaactagggtgacatggcacaagggttagagagcaaaagccaccttcagctgatgaactattgatgtttgcatggtcaggccattagggactcgtgttggctagagcccgggtgaaagcctgggtctcgccgggctctcactggatgaccaccatatgcactctctttcttgatgcagatactataacagacttgtccgaagcctgctggaatgtgatgaagacacagtcagcacaatcagagacagcctgatggagaaaattgggcctaacatggccagcctcttccacatcctgcagacagaccactgtgcccaaacacacccacgagctgacttcaacaggagacgcaccaatgagccgcagaagctgaaagtcctcctcaggaacctccgaggtgaggaggactctccctcccacatcaaacgcacatcccatgagagtgcataaccagggagaggttattcacaacctcaccaaactagtatcattttaggggtgttgacacaccagttttgagtgtactgtgcctggtttgatttttttaaagtagttcctattttctatcccccttaaagaaaattgcatgaaactaggcttctgtaatcaatatcccaacattctgcaatggcagcattcccaccaacaaaatccatgtgaccattctgcctctcctcaggagaaagtaccctcttttaccaacttcctctgccatgtttttcccctgctcccctgagaccacccccaaacacaaaacattcatgtaactctccagccattgtaatttgaagatgtggatccctttagaacggttgccccagtagagttagctgataaggaaactttatttaaatgcatgtcttaaatgctcataaagatgttaaatggaattcgtgttatgaatctgtgctggccatggacgaatatgaatgtcacatttgaattcttgatctctaatgagctagtgtcttatggtcttgatcctccaatgtctaattttctttccgacacatttaccaaattgcttgagcctggctgtccaaccagactttgagcctgcatcttcttgcatctaatgaaaaacaaaaagctaacatctttacgtactgtaactgctcagagctttaaaagtatctttaacaattgtcttaaaaccagagaatcttaaggtctaactgtggaatataaatagctgaaaactaatgtactgtacataaattccagaggactctgcttaaacaaagcagtatataataactttattgcatatagatttagttttgtaacttagctttatttttcttttcctgggaatggaataactatctcacttccagatatccacataaatgctccttgtggccttttttataactaagggggtagaagtagttttaattcaacatcaaaacttaagatgggcctgtatgagacaggaaaaaccaacaggtttatctgaaggaccccaggtaagatgttaatctcccagcccacctcaacccagaggctactcttgacttagacctatactgaaagatctctgtcacatccaactggaaattccaggaaccaaaaagagcatccctatgggcttggaccacttacagtgtgataaggcctactatacattaggaagtggcagttctttactcgtcccctttcatcggtgcctggtactctggcaaatgatgatggggtgggagactttccattaaatcaatcaggaatgagtcaatcagcctttaggtctttagtccgggggacttggggctgagagagtataaataaccctgggctgtccagccttaatagacttctcttacattttcgtcctgtagcacgctgcctgccaaagtagtcctggcagctggaccatctctgtaggatcgtaaaaaaatagaaaaaaagaaaaaaaaaagaaagaaagagggaaaaagagctggtggtttgatcatttctgccatgatgtttacaagatggcgaccaccaaagtcaaacgactaacctatctatgaacaacagtagtttctcagggtcactgtccttgaacccaacagtcccttatgagcgtcactgcccaccaaaggtcaatgtcaagagaggaagagagggaggaggggtaggactgcaggggccactccaaactcgcttaggtagaaactattggtgcttgactctcactaggctaaactcaagatttgaccaaatcgagtgatagggatcctggtgggaggagagagggcacatctccagaaaaatgaaaagcaatacaactttaccataaagcctttaaaaccagtaacgtgctgctcaaggaccaagagcaattgcagcagacccagcagcagcagcagcagcacaaacattgctgcctttgtccccacacagcctctaagcgtgctgacatcagattgttaagggcatttttatactcagaactgtcccatccccaggtccccaaacttatggacactgccttagcctcttggaaatcaggtagaccatattctaagttagactcttcccctccctcccacacttcccacccccaggcaaggctgacttctctgaatcagaaaagctattaaagtttgtgtgttgtgtccattttgcaaacccaactaagccaggaccccaatgcgacaagtagttcatgagtattcctagcaaatttctctctttcttcagttcagtagatttccttttttcttttctttttttttttttttttttggctgtgacctcttcaaaccgtggtacccccccttttctccccacgatgatatctatatatgtatctacaatacatatatctacacatacagaaagaagcagttctcacaatgttgctagttttttgcttctctttcccccaccctactccctccaattcccccttaaacttccaaagcttcgtcttgtgtttgctgcagagtgattcgggggctgacctagaccagtttgcatgattcttctcttgtgatttggttgcactttagacatttttgtgccattatatttgcattatgtatttataatttaaatgatatttaggtttttggctgagtactggaataaacagtgagcatatctggtatatgtcattatttattgttaaattacatttttaagctccatgtgcatataaaggttatgaaacatatcatggtaatgacagatgcaagttattttatttgcttatttttataattaaagatgccatagcataatatgaagcctttggtgaattccttctaagataaaaataataataaagtgttacgttttattggtttccccccatgtctttcattgttattcttgaaaaacttattgaatgagaatttctgaacatgaaccacagactggttggtttctttaaagtcactaattgtcaatatgtaaatttgacatattgtttaagtcaacatttcctaagttttttaaaaaacattgagtgactcccattattctcactgatggtatcccaaactccttacaaagttggaagaagctttaaggtctacaggctgctcaactgtaagacccaactttctttctgttcagtgacctctacgctcccaccacataggcagttctgggaatgattgggatctgtcccttccaggtcttttatttatgctattgtctctttttggaagattttttttctccatccttcactcagactgaaagcatgatggggagaagcgcgtgcttggtcaccagtgtgttcccaacgctaaaatagcatcttcaatactttaaatgaatgatttagaaagagttggaggagggggaaaaagacaactgaatcagtgtgacaaggaaggcagatagctctgcagttaaaacaaaagatttgaattcagtctctgtcactcattaaccacatgatgtcagaagagtttcttaatctcaaaacacatcaatttctccctccgtaaaatggggattgtgacagtcatctcacagagctgctacggggaaataaaacaagtgaactgcttacaatattcccaatatacgattatgctcaacgagggtcagctgttatcatacaagttgcgacaatgagagcaaaagctccctatctcagaaaatggtcaaagacttcacaacagaatgacagctgggtcttgaaggatgcttatgagtttggtcacataaaaaggggagcttcggtggtataatttttttcaagagacaccttatataagagacacctttaattgtgaaggttatcttcacaattaaatattagtgaatttttcccatattttaaattcaaatgggggcatttttctcaacatcattcatttctagctccaaattgcattttcccaagttcagttatgcccaaagcaactaataaatagtacatgaattgtcacttaagggccaaatacgtactgcacttgctttactctgacctggccaaggaaaaagagcacatttcttttattattatccttcatccatagtctcctataaatatttatttatacagagagactgcatgctgcactgtagtatagtgtttaaaaaaaaaaaaacagacctgggatttgtataaactgagtttaaaccttagttcctctaccatttctgtggccttgggccaagtgtctcatatcttcacactttagtttttttcatttatgaaaatgcccctacaaaatagggacaaatagtaggccttagttccaaaagtaactgagaattcaatgtgttacatataaaggacttaaaatagtgtctaccatatagcaagtacccaaagaatagaattcctcgagccctcaatacatgtaactctcaccatttacattaaagttattcccatcacttagattctactctcaccctcactgtgagtattgaggtaccattttggatgaagaatgtttttctgactttttccttttgtaggtcaccaaacattattatttaattaagattttataaatctgtttttttgtttgtttgtttgagacagagtctcactctgtcacccaggctagagtgcagtggtgagatctcagctcactgcaacctccgcctcccgggttcaagcgattctcctgcctcagcctctggagtagctggaattacaggtgcccaccactatgcccagctaatttttgtagttttagtagagaaaactgctaatctgagcaacaaaagactcaccaacaaacatggttagatattagcctgacctatgcaaagcattgtgttagagagctagaacacagagagactatatccacctgcaagtcaagctccatc

SEQ ID NO: 17298 - DNA, 41594 bp, Human
  misc_feature (1)...(41594): n = A,T,C or G
tttttacagctgtgagctcagactaaaagataaacaatgctattactttggaatataattctaataacacaaaaaagactcatagaccacaatatgtatttattttgtggcaaaggtgtcatttttagaaagaaacaaatgtgttcaattttgctttccctgtttttaatgaattaagaaaggtcttctcttaccttcttttgactgtcatcattcctctcatccaggaatatttacaggtttgcaagaagacaccatctttaagtagtttttaggcacttttacaatactgactaaattgtataaaatagtattataaattaatatttaaattataattttatgacgtgaaaatcaacaacgaatgtcaatttcacttcgttttgactgtcatctgtggcctctggagtccctcacttaaatcattggtccttggttttattttttaagcctattaaaaaggaggatggggccgggcacggtggctcacacctgtaatcccagcactttgggaggctgaggtggacagatcatttgaggtcaggagttgaagaccggcctggccaacaccgtgaaaccccatctctactaaatatacaaaaaaaaaaaaaaaaaaaaaatacaacaacaacaaaaaattagacgggtgtggaggcagaggcaggagaatttcttgaacctgggaggcagaggttgcagtgagctgagatggtgccactgctctccagtctgggagacagagcgagaccctgtctcaaaacaaacaagcaaacaagcaagcaagcaaacaaacaaaaaacaagttgggcatggtggctcacccctgtaatcccagcactttgggaagccgaggcaggcggatcacctgaggtcaggagtttgagaccagcttggccaacatggcgaaaccccatgtctactaaaaatacaaaaattagccgggcatcgtggcgcctgcctataattccagctactcgggaggctgaggcaggataaactcttgaacccgggatgtggaggttgcaggttgcacgtgacatagccgagatcgcgccattgcactccagcctgggcaacaaaagcgaaactccatctcaaaaaaaaaaaaaaaaaaaaaaaaaaacaaaaaaaaccagaaaaacaaaaaaacaacaaacaaaaagggaggatggtagataactgtccagatactttccagctttgccgctatatgaactattccttttgtttagttttcagcatgggagcttctggcacttttacgtactttccagcttctggggaccggctgcctagaataacaggcatttgccccagaggccgtggagtggcctcactttggggtcgtgggcagatcgctggctcccacgcctggacttcgggatcgcaggcaggatcccttccagcccaagcactccgcccaggcgcgccaggcagagccccgccccatcccgccgttcccttcagccccggggcgcggatcttgcatctgaaactgagcagagcagggcgccgggcagggccggcgggccacgtgataagcccggaaacagctccgccccctcgcttcttgagccgccacatcccggcagccctcctaccggcgcacgtggtgccgccgctgctgcctcccgctcgccctgaacccagtgcctgcagccatggctcccggccagctcggtgaggccctagcggagcggcgcggtctgcgtcctcgcctgcggccccccacgctcccgccttggcggcggccggcgggacccggcactgcaggggcggcgctgcgggattgaaagccagcgtccccgctccccggccgggccgcagcctgcgtggggcccgccttagagcagctcgcgggtgtaagacctggggaggcccggaccaggcctgcgaacgcagggtccaggtgctggccttgcgattcgagaatctcctcccccagaccctcccaaggccttgcagaacacagtgcaatgtgctgcgaatcatgagaaaaaatgtcttctctttcagccttatttagtgtctctgacaaaaccggccttgtggaatttgcaagaaacctgaccgctcttggtttgaatctggtcgcttccggagggactgcaaaagctctcagggatgctggtctggcagtcaggtaaggcatagctagttccatcagaaaggagtgtgatcacattaaccaggaagtattgtattccaggcaccagcagcaaaacgccttatttactcctcccagtagcgctgtgaggttggtgtaatacttccccactttatggggaaaaaaagtgaggctcagcagagatttagcaacttttaagaccctggacggctgggctaggtggctcacgcatgtaatcccagcactttgggaggccgaggtgggctgatcacttacggtcaagagttcgagaccagcctggccaacatggtgaaacccgtctctactaaaaatacaaaaattagccggtatggtggcacacgcctgtaatcccagctactgggaaggctgaggcaggagaatcgcttgaacctaggaggcggaggttgtggtgagccgagatggcactactgcactccatcctgggtgacagagaaagaccctggacaacacactggacagatttagcatcttctgcacaagtttaaacagttgagtaagggaaaagtaggattggaacccgtgctgttcctgattttaggacactagtcttagccccttccttaaacagattaacttaggtgggccacttgttatgcaaggaaaacttcagttactttgactggtgatttaataaaactcgacatcatgaagattccaatttacctgccttcccttagaatctctggtaaccatatgaaggtgcaaatcattcattcccacgttcacaagcccttcattagctgactaggccatggaaagaagggacttagaaatgattaaccaggatgccattgctgatgtcaaggagtggcattctgggaggagagggaggaagtctactgaaaggtagaaaaatgaaaaaaactataggatagctatttaataaacggcagtgagagttgggaggaacgagatgaccacccctgaaacatattttagaatgaaagagatgaaggatatctgtctgctttttgttgccatgtggaaaatttgcttcttggtttctagatccatgtagaggtaggttattaccttttctttgtgcagttcccagctatgtgagcagtacacagcttccctaagtttaacaagttcagatggtaagaatgccttactttattaacaaatacataactgtatattttcggatgtctttttgcgtcttgtctctgtggttttcatgggaaacctgtgagaatcgtggcaggcaagttggctctttgctcatcagcaaccgaatgagaattcaaagtccagacctgcgtgctttccattgggccaagttgggtcctcctatggtaatggaaccttcgtaaagcaaaatcctcatctgtagtctcttttttttccccaccaaactttgtattatggaaacatttcagacacaatcaaaagtagaaaagtataatgatcccttgggtcctatatctgtcacccactttaggtacttatcaactgattagtcttgtttctgtacctatacccactcctcacttatcttcattatggtcatatcttctttaaaaactggaaatgtaaatgtgtttctcttctatgaaaggataagaagttcaccatgagtgatttatttagaccccagcacagtaaagttcactgaatgaaatgtaaacaacttggagcaattgttttttcttcaacaaaggccacattcagttgcagtggtattttattcagttgcagtggtattttacatatataaactcttatagtccttataacaactttttagtttaggtagtgttatcctcattttataggtgaggaaactaagcacaacgtagttaagtaactcgctcgagattacacagctagttaagaggccaagattttttttttttttctctgagacagagttttactcttgttgctgaggctggagtgcaatggcactgtctcagctcactgcaacctctgcctcccaggttcaaacgattctcctgcctcagcctcccaagtagctaggattacaggcgcccgccaccacgcctggctaatttttttgtatttttggtagagacagagtttcaccatgttggccaggctgatctcgaactcctgacctcaagtgatcgcccgccttggcctgctgggattacaggtgtgagccaccgcacccgaggccaagattttgtaggggtggaaaggtgtgatcctttgctctccatcgtaaacgtcacggccaatatttttataagagaagacaggttataataagagaaaagcataacaaatttatttaacaaagttttacatgacatgagagccttcagaatgaagacccaaagacagaggaaaaaccatccatttttatgtttaggttcaacaaagaatggacagaaaggtggaagtatgattggacagcaaggatatggtgtatgctagtagactgaggtggagaaagccaggaaagcctgtctgtccagattcttcttggcttctctaaaattctttctccaccccctaaggatctcctgacctactaatgggcaaggagatgagaggatttctttacgtccagctcctagacagaaagccagtggaaagttagaatcataagtttaaatcttatgactggctttggggaaaaagagttttagtttctgtaaactgccctggggaagagaaattctcatttctgtgacttcagggaagaatgaagggtgagaggcaagagggcaggagaaagctatatatatattttttttgagagggttttactctgtcacccaggctggagtgcagtggcacaatcatggctaattgcagcctcgatctcccaggctgaggcaatccttccacctcagcctcctgagtatctgggactacaggtgcacaccagcatgcccaactaatttttgtatttttcatagagatggtttcaccatgttgtctgtctggtcttgaactctagggcttaagcaattttgcctgccttggcctcccaaagtgctgggattacaagtgtgatccaccatgcctggacaaggtcttggttctggctgggcgcagtggctcacccctgtaatcccagcactttgggaggctgaggctgctggatcatctgaggtcaggagtttgagcccagcctggccaacatggtgcaactccatctctgctaaaaatacaaaaaagaatcagccgggtgtggtggcgtgcacctgtaaacccagctactcaggaggctgaggcaggagaattgcttgaacccaggaggtggaggttgcagtgagccgagattccaccactacactccagcctggatgacagagagaaacactgtctcaaaaaaaaaaaaaaagatcttggttctgaggctgcttctgagcatatttttgggtgttgttatctgcaataattttatcccaggaagttaaccattaccttgtcatgaggtaaactgatggattttaattagtgagtatacagcagtgagcatacatagaattatttcccgagactacagccattatgtataaattcttcagttcaaaggagtagcaagctttttaattaccccaaatgtttaattctagaaataaatccgccttctctaagttttaagtgactgtcttcatttggaggaaatggattttatttcctgaaccccaggaaaagaaattttgaatttgaaaacacttatgtcaccagtttgtggatgttggaactgtgtgtgtcattggtcaaacaccagtcatttgcaaatggctccccttaacaggagaatctacccaggaaattccgtatcttactggcagaacttgctgctttaaagtgtttattatagtctcagctacttggaggattacttaataagcccaggagttctaggctgccatggactgtaatcttgcctgtgaataatcactgtactccaggctgggcaatatagtgagatcccatctcaaaaactatatatgttgattgtagaaaattcgaaaatatggacaactataaagaaggtagtaaaaatggattgtaattcttaacatgctagtatatttttcttcaagcatttttataagcatgtactttatttcatagcttacacagaagatagatgcagttttgcttcctgctttatttatttttatgtatttatttattttttgagacggagttttgctgttgttgcccaggttgaaatgcagtggcacaatcttggctcactgcaacctccgcctcccgggttcaagcgattctcctgcctcagcctcccaagtagctgggattataggcatgccccaccatgcctggctaattttgtatttttagtagaggcggggtttcaccatgttggtcaggctggtctggaactcccttacctcaggtgatccattcgccttggcctcccaaagtgctgggattacaggtgtgagccaccccacctggcccctgctttattttttcttatatattgtgggcatttttacacaccattacaacttataaagtctgccagagtgttcgtggttacgactttctaggggtctgctttgtgatatggattaatatttactgtccttcacttgaccctttgtcacattgtgtgattattttttctagtttacttttttttcccatgtaaaactttttatttaacatttctgtaatcagaactctcaatcttttgtttaaaacttggaaagcattcctcacatatttaattttgctacatgcatgattttttaaatgctaaacctttgattcataaggaatatatttttgtttgggtttaacccgttattccaatagcaacaccactttattaaacagtcttttatgtcttcactcacttgatatgccatcttcatgtgttgttgttgttgttttttgagatggagtcttgctctgtcgcccaggctggagtgcagtggcatgatctcggctcactgcgacctccaactcttgggttcaagtgattctcctgcctcagcctccccagtagctgggattacaggtgcccgccatcacgctcggctaattttttgtatttttttagtagagctggggtttcatcatgttggccaggctggtctcaaactcccctcctcaggtgatccacctgcctcagccttccaaagtgctgggtttacagccatgagccaccgtgcccggccaaggatatttttaatgctttttgttacatactgccaaattctcagttgtatgtcttagtaatatttaatgagtatggcttatgattcagtttctaaatgctctgaaaattataaaaccagtgctgtagtagttaccaattatccctgaacatacacaacagttaggaaataaattaaataaactttttttcggaagtaaatagaattttacttaagaaataaaatatagtgaaatactttaaaaaatcagaattttctcgttgaattcaggctcaaaatctcttgaaatgaaaacagtagatgctttgaatagtgaaaattacaattcagccacaccagtagtaccattctgtttatctgtttttcagagatgtctctgagttgacgggatttcctgaaatgttggggggacgtgtgaaaactttgcatcctgcagtccatgctggtaagtggttggtatctttaatgtaaaaacagtcagtggtttccaggaatattttagttgatagcgtcctaaaataaaggaagaaaaaggctcaagagaaatttacatataaagttaatgttatgaagttgctgccagatttcataatacgttagaactggtttaaaatccagcttgtcttactacttgatgaattcagattgttttcctctgcttgctattagtcctgacctgatacctaatttagagtctggtgtttcctgctcaagttgctgaagatatttagatttcatcgtatgaaaatacttttaaaatagttcaaacttagaagaaagcatcacagcgtaactgacttgcaaaggaattttttttttcaaagtgctttacatttgttcgttcacctaagaatgaattgtatataaaccgaaacggcaagaaactggtatcctcctagtttgtcagttgtggtacaatttggtgaataaagctgaatggctacagatcatcagacaagccattgacttacagaaacgcatagactgttctggaactagcaacagttttgtaaaattccttttaccttttttacattttattgctcaagaaactgggatcaagaactgaagaaaaagatttttaaatatatctctcttttttttttttgagacaggattatactcttgcccaggctggagtgcagtggtgcgatcatggctcgctgcagcctctgtctgcttcccaggctcaagcagttctcccacctcagcctcccaagtagctgggactataggcatgtaccaccacacccagctaatttttgtattttttgtagagacggagcttcaccatgttgcccaggctggtcttgaacatctggactcaagttatctgtcaccttggcctcccaaagtgctgggattacagacatgagccacagcaccttgcttattcttttgtttgctattaaaatataagcattttctagtcaataaaaattaaccaagaacataatttgcaatggctgcataatattctgttatattgaagttataatagatgtgaggagtttcctattgctgaatatttactttttctagaggttaagaagagcttttagagtcagaaagacttgacttgttgactctaaagtcctggctggtggtgggtgcagtgactcacgcccataatctcaacactttgggaggccgannnnnnnnnnnnnnnnnnnnatcccccacctagcctcccaaagtgctgtattacagaccatgagccactgtgccagccagatatatctgttaatcctaattttgtgtgtgatactccccaactacatgtttgatattctttaattaagaatattatgctgggcatggtgctcttgcctgtagtcccagcacttggagagctgagacaggagaaccgcttgagcccaggagtttaagatcaccctgggcaagatggcaacaccccccttctctttaaaaaattgaaaagaccagctgggtgtggtgatgcattcctgtagtcccagctacttgggaggctgaggtaggaggatcacttgagccctggaggtcagggctatagtgagttgtgattacgccactacaatccagcctgggcgatagagtgagaccatctcaaaaaaataaattttttttttaatcaatgggatttaatttgattgaagacactatgttgaaagacattccttaatctgacttgttttttgaagctaatgactttgtttaacttttttaaattaggaatcctagctcgtaatattccagaagataatgctgacatggccagacttgatttcaatcttataaggtaaaaacctgaaattaaacttttaacacattacgaaccaacgacaaagactatgccaaacctggtgtccctgtgttttcttactcactataaacctttactgcgtaccttctgtgtgactttgtatgtgtgtaagcattttggtttggccagatttatataccaaaatacatactgaagttttttaggaagttacaatctaaatcttagtatgtataggttgagtatcccttatctgaaatgcttgggacccagaagtgtcttggatttcagatttcttcagattttggaatatttgcaggtaacatgccagttgagcgtccctcagaaatccgaaatgcttcagtgagcatttcctccaagtgtcatgttgacgctcaaaaagtttcagattttggagcatttcagatttcaggttttcatattaggaattatcaacttgcacaactaactgagttatttgcataaagatactggctgtttctcttaaatatacgtaacagctttattgagatctaatccacataccatacaactcaccaatttaaaatgtacaaatcagtggttcacagaagttgtgcaaccattactgtgttagtctgttctgcattgctataaaggaatactagaagctgggtaatttatgaaaataggtttattttggctcgtgattctatagacagtacaagaagtgtggtgccagcatcaacttctggtgagggcctcaggaagtttataatcacagtggaaagcagagggggagctggcatatcccatgagagaagaagcaagagagagggagaggaggagttgcccagctcttttactttttaacttttattcttaatttaatttaattttattttgagacagggtctcgctctgttgctcaggttggagttcagtggcatgaccttggctcactgcaacctctgcctcctgtgttcaagtgattctcctgcctcagcctcctgagtagctgagattacaggcgtttgtcaccacgcccaactcatttttactatttttagtagagatggggtttcaccatgttggtcaggctgctcttggaactcctgacctcaaatgatgcacccaccccggcctcccaaagtgctgggattaggtgtgagccaccacgcccggcctgcccggctctgttaaacaaccagctctacatgaactcagagtgaggactcattatggggagggcaccaagccattcataagggatctcccccgtgacccaatcatctcccaccaggccccacctccaacattggggatcacattgcaaaatgagatttggagaggacacacatccaaaccatattaattgccacatccaatattaaaacatattcatcacccccaccctaaaccctatacccatacgcatttattctccatttccccaacgtcctccagcctcggcaaccaccaattgttacgtgtctgatttgcctgtagtggacattttcatataaatagaatctaacaatatatggtttttttgttcctggcttctttcacttagcatgttttcaaggtttatccatgttatagcatagtatcaatagttcatttcgtttttagtgctgaaaaataatccattgtgtggtcataccctgttttgtttatcagttcatttgttgatggacatttgggttgtttctactttttgaatattatgaataatgcagctataaatatttgtgtataagtttttgtgtggacatacacattcgtttcattggggtatatacctaggagtggaattccttggtcatatggtaactatgtttagcttttgaggaactgcgaccctgtatttcagagtgctgcaccattttacatttccagcagcagtgtgctggatggggctccagtttctccacatcctcatcaacgttactatctgtctttttgattctagtcattctaggggttctgaagtggcatctcattgtggttataatttgctttccaaataatgtggaacaccgttggatgtgcttcctagccagttgtttacctcctttggagaaatgtctgttgagacctcttgtccatttttagttgaggtatttatctgtttattattgagttgtaagtttatttcctctcattctatggattgtgttagcctttcttgatggtttcctttgatcatcacaagttttttcttttttttgagacggagtcttactctcgcccaggctggagcacagtggcgtcatcttggctcactgcaacctccacctcccggattcaagcgattctgcctcagtctcatgagtagctggggttacaggtgcccgccaccacacttggctaatttttttggatttttaatagagatagggtttcactatgttggccaggttggtcttgaattcctgacctcgggttatctgcccgccttggcctcccaaagtgctgggattacaggcttgagccaccatgcccggcccacaaaagtttttaattttgatgatgttgaatttattttttcttttgttgcttgtgttaatggtgtcatgtctaagaaaccattgcctaatcctcagtgatgaagatttttgtgtatattttctttctttctttttttttttttgagatggagtttcgctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggctggcctgtcggacgaacgggggtcgggagcgaaggccgcgattggcgagggcggggaagcggaggtggagaagcacacgggagtggggtaatgagcgagagaggagggggggaagagtagcgagacgaaagcgcaaggacggaaggaagttgggcagagtaaacaaagtagcagacgcagacattaaatagaaggcgtgtggaagtgtggatgtgccggcagagggagctcatcagcaggggatgaaaagactagtcgggccgcagatcgaataggcgcatcagccatgcaggcatgtgcctgctaggacgccaggactacactatgactatatgctggaaacagagagtgaaagtcagcaagtgtgagtcctccaactgtcagttggcaggtgtgtgtttgtttggttgggatgtggtgttttgtttttgagacggagtctggctctgttgcccaggctggagtgcagtggcgcgatcttggctcactgcaagctctgcctcccgggttcacgcccttctcctgcctcagcctcccgagtagctgggactataggcgcccgctaccatgcgcagctaatttttttgtatttttagtagagacagggtttcaccgtgttcgccaggatggtctcgatctcctgacctcgtgatccgcccgcctcggcctcccaaagtgctaggattacaggcgtgagccactgcgcccggccccaacttcgttttttttattcaagatgactttgactcttcagagtcccttgcatttccacatgatttttagaatcagcttgtccatttctgcaaaacaacgcagttggaattttcataggtattgtgttgaatctgtagatcaatttgggaaatgttaccatcctaagaatattaaatcttccagtctgtgaacatggggtgtctttaatttctttaacattgtcttgtgaagtagaattgttttcttaatttttttctcattcactgctaatgtatattttaatacaattgatttttatatattgatcatatatcctgcggctttgctgaactcatttattagtgctaaaaggttatttttgtgaatttgggattttctgtatactaggtggtatcatctgcaaatagatataacttcactgctttctttccagtcctgatgccttttattttcttttctttgctaattgctctggctagaacttctagtacagtgttcagtagaagtggtaagaatggacattattgttttgtttcttttttttaagatggcgttttgctcttgttgcccaaggcggagtgcagttgcgtgatcttggctcactgtgacctccgcctcccgggtttaagtgattatcctgcttcagcctggggttacaggcatgtgccaccttgcctggctaattttgtatttttagtagagatggggtttctccatgttggtcaggctggtcttgaacttccaacctcagttgatccatcctcctgagcctcccaaagtgctgggattgcaggcgtgcgccaccttgcccggctaatttttgtatttttagtagagatggggttttaccatattggccacgctggtctcgaacttctgacctcaggtgatctgcctggctcagcctcccaaagtgctgggattataggcatgagccactgcgcctggcctcttgtcttgtttctgagttgagtagacaagtattttagtctttcaccatcaagtatgatgttagctgtgggtttttcttacactttgtcatgttcagtaagttcccttctatttttaatttgctgagtgtttctatatgaatacctgttgaattgtgtcagatcctttttgtacatctattgagatgatcaggtggtttttgcatttttctggattcagtttgttagtgttttgttgagagtttttgtgtgaagatacctaagagatactggtctctagttttcttgtgacatttgtctggttttagtaggagggcagtagacttaataaagatgagctgcaaaatgtttcccctccaattctgttcttctgtttttgtttttgttttttttaattagttttcagcagttaggcttgtttggagcctgcccgtagagctcctcgcactacaggcctaggagtggaactgtacttcactgattgttaattttagattacttctgtattttaaattattcttttggcattcctgttaccatcatttttatgacctctctgaaggcaaaacaaatgtttcacccttagaatgctctgatatttttcatcattgtgccaatccactggaaaaagaatctaaattctaatgttctggataatagtgatcacattccaaaatgagaatgttatctgtaatcttgtactttatacttctattaaaatgttctataaatttttcatggcttggtggttctgggtagctaaggttatgcaagcagcagcgttgcagtgtgacgtggagggagtactgtgtattcagatccggggagcacctgctgactaaattacctctgctcgaccccagcaggacaccctgactttttaacacactcgttagaattctaaaatgtcaggctcacagtttatatattagttctctatggcttttgtttacgttaatagtactgacttgtttttttcctagatagctgtaaaccacatgagtggactttttaatgacagccagattcgtctttgttttatagagttgttgcctgcaatctctatccctttgtaaagacagtggcttctccaggtgtaagtgttgaggaggctgtggagcaaattgacattggtaagtcagaaaaaccattttagaagactgagaggagaggattatttaaattttagtgagatttcattttgaattttattactgaggaaatagaaagaaaatagctacttctggattgtgttttgggattactataattcatttatattttctttttttcatttatattttctaagctttttttgtatgcagagatgcatctgggttattttcctgatttatttatttatttattttatttttatttttttgagatgaagtcttgctgtgtcacccaggctggagtacagtggcacagttttggctgactgcaacctctgcctcctgggctcaagtgattctcttgcctcagcctcctgagtagctgggattacaggtgcacaccaccacgcctggctaattttttttgtattttttatagagatggaatttcgccatgttggccagagtggtctcgaactcctgacctcaggtgatccacctgcctcagcctcccaaagtgctgggattccaggcatgagccactgcgcccagcttattttcctgatttttaagtcaggaattaaaatggaagtacatgcacaatgactttatttaaaagcggttcataagctgatagggacatacaaaaatcaatacgtcttttgttcttcaaaggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaaggtgggatgcactttcatgatattgtaagttacatccatggagtgcagtgtttgccagaccaagcagtattcagttcttggtagattgcattacctaccaaagctttgcttggagctgctatccttttgttaaaaatggagaaaccagctattacagaggtgttctgtcaaaaagattgaaagagagctgggcgcggtggctcacgcctgtaatcctagcactttgggaggccgaggcgggcggatcacctgaggtcaggagtttgagaccagcctggccaatgtggtgaaaccctgtctctactgaaaatacaaaaattagccgagtgtggtgtggtgtggtacgcctgtaatcccagctactcgggagactgaggcaggagaatcgcttgaacccaggagatggaagttgcagtaagctgacatcacaccactgcactctagcctgggcagcagagtgagactttgtctcaaaaaaaaaaaaaaagattgaaaaagaattggaaaggggtaatttgttgggccattcagtgctttgctgtcattcatggtgtcatcgtgttgtgcagccaccacatagcactgaatagtgaggagatgttgtttgctgtggacgtagaaaaccatcttgtccccactttggaaagtgctgctcgtgtctcacaaaacttacgctttttgtaggcattcactcatacggcacaatatgatgaagcaatttcagattatttcaggaaacagtacagcaaaggcgtatctcagatgcccttgagatatggaatgaacccaccatcagacccctgcccagctgtacacactgcagcccaagcttcccatcacaggtaaagcccgagcgttctgtggcatggtttgctgtgcctggagagtgtgtgtttctctgtattgcatctgatgtggttcacattcagaagatgatacattccgtaatgcctcctgtagccatctgataaccatctggtttgagacgccatttggactgaagagcacagaagttgagtagtctggagttctgaaaagatgtcatgggggagatggagattggaatgtctctgccacgtagatctttttgaagacatgagacaggatgggatggcctggattttatagagaagagggtcaagaaagccttggggtaaaggcttggtaggtgtactgtggaggaaccagcagaagaaaagttgtgaaattccaaccttttagaatgcatttgagaacagaaaagggactgtttgttttgcacatattgtaagaagccgttgccttggaatattggatctagaagcccaattgaagtaggccaaagcagaaatgtgatgttaagaactaacaacgataaagaggtttcttggaacaagaaagtaggactttctctgggtttgtagagtttagagagggtttttaaatgtgtgtcctgttctgttccaaaggtaggctgtgagagcctgtcctgctctggtacaagggagagtaggggcagggacagaggtgagagtcccaggcatggaggccttggaatcccaagcactaccggtgcagctggccttggctgagagcaagggcagcctccttcctgcctggggcggtcagcatttggtgagggggtgcagcctgggcttcctttccctgtcatcagctgagagagcgatgggggaggggagcagcgtgccaggtgggaggagaatctgaaagtttcttcacgtttgccgcgttctattgttctgcctcagatagattttttttttttttttaaattaagacaacggagtctcgctctgtcacccaggctggagtgcagtggcgcaatctctggttcaagcgattctcctgcctcagcctcctgagtagctgggattacaggtgcgcaccacaatgcctggctagtttttctgtttttagtagagatggggtttcaccatgttggccaggctggtctcaaactcctgacctcaagttatctgcctatctcagcctccccagagtgctgggattacaggcgtgagccaccacacctggcctcagatctcagatacactttgacactaacacttcccaaatccccacagacaccctgtgaagtcctgtaggctgaagtaatctaagtaatttgttttctctcggcctttctgggcttcacagcacagtaatcttttaaaaatggaaatcggatgatgtcagaccctacttaaagccattccttggcttttcttaagcactttgcgctgccccacaaaccctgtgctgcctgcctgcctcctatctgccccctcagcagctctccctgcgcctgctgctagcccctccgccctgtgcctccaagtgggcccagctctttccactccagcgcctctggctccttgtccccttcacccagaattcttccctctgcccttcaccgtcctggtttcttgttattcaggcctcacctcctcagagaagccttccttgaccgcttagaccaaagtagcagcccatcatgcttccatcccatcaccctgttttgctgcatgtgtttctattcaatctgttcaaattgtcttcccccattaggatggcagcttccttttttttttttttttgagatagagtttcactcttttcgcccaggctggagtgcagtggtgcgatcttggctcgctgcaaactccacctcccgggttgaagtgattctcctgcctcggcctctcaagtagctgggactacaggcgcctgccaccacacttggctaattttgtatttttagtagagatagggtttcaccacgttggccaggctggttttgaactcctgacctcaggtgatctgcctgcctcggcctcccagagtgctgggattacaggcatgagccacagcgcccagccaggatgtcagcttttgagagcagaagctgcatctgtttttgtttgtcgctgaatccccagggcttagaagactgcttggcacattccctaaatgtttactgaatgaataattagcaacctgacattttgcacaaatttttccttgtaggacttcttgaaactgatttgtctgctgttatatctgacctatttcctgcttatagtttatattctccattaagattctgagacaaaaaaatccccatgtactgtcagttcttatacttttcattttccaaagcattttcattggactatataaaagccttcattgttccttagactgtgtgtgcgtttcttttgaagtttaaagtattatttgtggtaaacatggcagaggcggccctggacacgtaaataagcgtttcttgtgcgagattcccaggatttctccccaacatgggcttatttccacaatagaaaaggcactttgccttttcatgtggtttgagtatttggcagtgatgttattacagagtgtatggttgcgattgtatctaaaacaaaattgaagcaagaacaaagatggggttgtgtgagtgtgtgtatgtgtctgagattttaatgactggtttgcttatgattggaaagaagaaaattcctatttatttcagctatttactagattaagcaactttcagcatttctctggcactttctatttcagttattaatgtctttgaaaatttgatatttgaaggggaaccggatactcttttttttttgaggcagagtcttgctctgtcgcccaggctggagtgcagtggcatgatctcggctcaccacaacctccgcctcccaggttcaggtgatctcctgcctcagcctcctgagtagttgggattacaggcatgtacaccaggcccagctaatttttgtatttttagtaaagacagagtttcaccatattggccagaccagtctgaaactcccaacctcaggtgatccacccaccttggcctcccaaagtgttggggattacaggcatgagccaccgcacccatccagatacgcttaactatgagatgtttcagaaaccaaaagttttctcccacttatcaaccttagcctaaaccatctatgaggagtgggagggagatgggggagttgtacatatggtgttttgttttattatgcctgttgtatgccttaggggatattttacttctattgtttactatttattgcctagtttgttttcttctgtgcctctcgcataaatttcatgaggacagtgattttatttgacttgatttttggttgggggaattattttttcaagttctttttaaaacgggctttatttttttagagtagttacaggtttacagaaaaaatacacggtgattatagggaatttccatataccccgcttccccgcagtttctcctattaacatcatgcattagtgtggtgtatttgttacaactgatgaaccgattttgattcattattaaccaaggttcatagtttaacattcattctttgtgttgtacattctgtgtatttggaaaaatgcacagtggcatgtctcccccattacagtatcatgcagaatagtttcaatgccctaaaactcccttgtgctcctccgcctcatccctcctttcccttctccccaaccctttgcaaccactgttatctttttctcttttcttttttttttttttggaatggagtcttgctatgttgtctgagctggttttgatatcctgggactcaagcagtccttccgccttggcctctcaagtagctgggattacaggcatgcaccaccatgcccagctgtttttactgactctgtacccatttccagaatgtcagatagttgggatcatacagtatggagcccttttaggcactttcagttaacaacatgcattaagtttcttccacatctttttgtgggttggtagcttatttcttaatgctgaataatatttcactgtgtatgaatgtaccacagtttatccatggacatattgaagggcatcaaaacttcaaggacagtttttggtagtttatgaacaaaattgctataatcatttgtgtgcaagttttcaactcattttgataaatacctaatattttcttttattgtatactatttattgcctattttttatttgcctccccagtaagctccataaggacagtgacttttttttaagagggttgcagggacggtttttttcactgatgtatcctgaatacctagaacagtgcttaacatcgtagtaggcaactcagtaaatatttggcaaggtctttaaaaactatcttaacccatgaaggacatgaaattacacatttttgttttttgggttttttttttttttttttgagacggagtctcgctcttgttggccaggctggagtgcagtggcgcggtttcggctcactacaacctccaccttccaggttcaagcgattctcctgcctcagcctccctagtagctgggattacatgcgcccgccaccacacccagctaatttttgtgtttttagtagagacgggggtttcaccatgttgaccaggctgatctcgaactcctgaccttgtgatccacccacctcggcctcccaaagtgctggggtcatgggggtgagccattgtacccggctcatttttgtttttaattagtgctggcccaccatttctttctgtgtgctgaacttcttatgtttattcacaagagatactagctcctaaaaaaatctgccagtgttgagaaactaggtaatggaaaactctgaagttgcagtctccttttaactacagttctgctttaggcagagtctgttgagtttgccatcaaagaagaaagaaaaaacacattatttcttctcttcttccacccacagctgttgctttagcttgtaatataatttcttacatcgatagggtttataactttaattttgtactgtctctgtgattacctcaattgtttaatcttagttctgtatttacatgaattcctgactgatcactagtcttgtcatagtttctcccatccctaaatctcttattgtggatttatttctagactggctggttctggtcctccagtcgtgtgtgtgtgtgtgtgtgtgtgtgtgtgtgtgtgtgtgtgtgttcatgtacatgtgcattttttttaaagatgggctcaggctcagttgctttgttctttatcatcaagattatatgtgtgtgtgtatctgtttggctcttaattatacttaaaacatttgtttagtcatgttatttttttgagaagtgtgcatacatctgaccttactgatcctgcttagtaatgtgcatgtatatttttacatttagttctaaatggagcccctggatttataaacttgtgcgatgctttgaacgcctggcagctggtgaaggaactcaaggaggctttaggtattccagccgctgcctctttcaaacatgtcagcccagcaggtaaagctctgtgctctggaaagctccagaattgttcgaaaggcatttcttcttaaatttttttgaatattaacaagttctaatgtgaatatagacatgctatgaaatctgaaagtcatctgttgataacagtatcaatgtaataatataaaatctgatacacacacacacacagaattgtgtaatattgtcaggaaaatgaggcaggaatttgtttgtggggtggaaccataaaagtttagaaaataaaagtgaaatgtcctaatgcaatagactaagtcttgtgccacatctttgaaaatgtaatggagtaaacataaagaagttcttctttggactctttatctgaaacttcttatagtcgttgtatgagatactttgcttctgtgtttaaatcatgaactccgcaattgagttgtctgtacaccacatcttgctgacagtcctccagcacatgatttgttctcaggtgtttattgggtgttaaagtgatgtgagtggggaagaaataaatgatgtgtgatatcaaagtgatatcaagcagaacagagagaaagagtgagtcagtaatgaagtaaacgagcttcacctacacgctgggtactgtcaggcttcagtggctctgtggttttggagggcagagaggagatttccctcacactgctcccacaaccatatttttagtgtataattatctggctaaatagatttctgtttaatttagcacaggcactagaaaatgtgctgcgtagactgggtgttaagaaaactgtcttgatttaggagttgacaggtagtaactttagctttctttgtttatgattttactattttctaaccaggtgctgctgttggaattccactcagtgaagatgaggccaaagtctgcatggtttatgatctctataaaaccctcacacccatctcagcggcatatgcaagagcaagaggtcagactcatagggctttttgatttgggggagaaagaaaaagcaatattttatcctaaatagaataaagaggatagaataaagaaaaaatatatagatattctgtataatatatagatgaaattaaggacttctatctctatgtaaatatacagttattctatataatatagtttgattaaagtaaaataccctttgtttcattataggatttcctatttaatttgttttattaatatttgagattgattctgtgagtacctcaaaatacatttctttataaaagtgtatgttagtattttaggccgggcgcaatgtctcacgcctgtagtaccaggactttgggaggctgaggcgggcagatcacgaggtcaggagatcgagaccatcctggctaacacggtgaaaccccgtctctactaaaaatacaaaaaattagctgggcgtggtggggggtaccctgtagtcccaggtactcaggaggctgaggcaggagaatggtgtgaacccggcaggtggaacttgcagtgagccaagatagcgccagtgcactccagcctgggtgacagagcgatactccgtctcaaaaaaaaaaaagtatttgttagtattttagtgtaataaatggaaacacaattggaatttggtcaatgtaattttgctaatttaggctattgaatgcatttgttattgtttaatatgtgaccaaaattgaaattacaaaaagctattcttttttttttttttttttttttgagacagcttcttgctctgttgcccaggctggagtgcagtggcgccatctcagctcactgcaacctccacctcctgggttcaagcgattctcctgcctcagcgtcctgagtagctgggattacaggtgcgtgccaccacacctggctaatttttttgtatttttagtagagacatggtttcaccatgttggccaggctggtcttgagctcctgacctcaagtgattcacctgcctcagcctcccagagggctgggattacaggcgtgatttatggctcttctaactttactacatttggttagagtcatgttttatcagagacatttacttgttgaatttaataacccatgaatatccctttagtatttctgaaagttcttgagaaactattaccatagtttatcatctacagcagtggtcagcaacttcagctgaatccagcctgccaccctgtttttgtgaatatagtatatataaattggtccttcacagaaaaagttttctgagtgtcactctagagggtaaaattaaagaatactttcttactggttacttcagttaaatgacttattgatctgttaaaatcttatgtaaacagtaagattagctttagagtaatgaattttatatgacagtggagaattttattactttttctgtatcaggatactttgtgataaatacctcattttaattttatttacaggggctgataggatgtcttcatttggtgattttgttgcattgtccgatgtttgtgatgtaccaactgcaaaaattatttccagagaagttagtggacattcatgtatcttaatctgtgtgttgaataaagctttatttgttcataatgttaattgaaaccataacctataatatttatatttataatatcttttaattagctaagtttatcatttaatgttcatattttaaatagaacatgaatcttaaattgttaattttgaaatgtagtgaattattgtttcagatggatatttggctgttatgatgttttttacttatatatttattttaaattctttgttgtcttcatgccaaagttactgtttctgaagagcagaagttgtaattttaggtggtgatgcgatataatccatcttactgcatagtgggtaaaaaacagaaactacattaataaacttaccccatcagttgaataccaaacaggtattccagacaggtgggggtactgttggtagtaggaagacaggaagaaaagagaaaaagattaaatagctcagaaaggggaaaaaaataagcagaggtgaaggctgaaggagcatgtggcttggcactattttgttgctttaggattctttccatggccactgccatccctgggttacaggttacaggagggctgtgacatttgtatctttcgtcatgtcaaatctctgatttaatctggtcttgctgttaaggaaaacgccttgccggaagaggtcatttaaccatgtactaggagagtcaggactagaatgtgctcttgctcattcaaaacactccctgaagaaatatttcctcctgaggtacatgtgttaagagcaaatcagtcatattttcttagtttaaactgaaacgaacaaaaacttggagaggacagaaagttaggatctgctatacagaaagctgtattctaatagatttctcttttcaagtatagcgttagcattgtttgttggaggcagaaaccagaatatgctgccacattatttaagactgataattgctgctagatttttttaagaggtgttctctgatttttaaaaatagaaattaaaatttaatatttttgcaggtatctgatggtataattgccccaggatatgaagaagaagccttgacaatactttccaaaaagaaaaatggaaactattgtgtccttcaggtgagtgcaattcatgtttgaagcggtaatttgctcttttattctgtgtctctttctccgttgtttactctttcctttatactcatacccttctagtttatccttattatagtttattttccccaatcctgcatttaaaaaaatactattaacttggggttttgagatgagagtagctttcttaccctcaattttaactttttgctggttgtgatggctcatgcctataatttcagccacttgagaggctgatgtgggaggatggcttgaggccaagaattggaggctgtattgtggtactatgatgcctgtgaataacgactgcactccagccttggcagtgtagtaagaccatgtctctaaaatactaataatagtaacaatatttaatggaaagtctctccatccttctgttaccttttgaaaagataactattttaaatttcttgcttatctttcctgaaatagtctatatattcagcaaatatttgcatgtgcatttctttttctattttcctattgacacaagtgcaccctgcttcaccttcttggaagtttgtcctgtatctgtgtattttaacttacctagacagtcaccaatctttagctactacaaatacccctgcagtgaataacctagaaaagtcctgagagtgaaattaaggcttaataacaagctctatgtatattggtaatcttaattgatactgccccttttagatgttgtaggcaaattcattgtcctaactgaaatatataaggatgcctgtttcccaacacttttgtcagcattgtggttttatacttttaaaaagtctctgcagttagaaaatggcatctcaatgtagttttaacattgtgtgtggtatgagcatcttttcatgtttgaatgtttttattcctttctatgaactgtctttccatattctttgatgatttttctactaagttgttgttggcttttttttttttttaactgatttttatgagctcttctgtattgggaaaagtagctcatggtctaagattatgcattgataaagcaaagagttatttcaatttaaagtaaaaattcctaatgctacttttcatagtattgatatcagaactctgtggaatcctaattccttacaaggaaagttattaagtatattcttttgattgtaagataccaataattttatagttcaccatagattccatgtcagctatttaaggaaagaagagaataccacattaaagttaatacttatttttttttagccacttgacagtctgttgcccaggctagagtgcagtggtgtgatcttggctcactgcaacctctgcctcctgagttcaagcgattttcctgcctcaccctcccaagtacctgggactacaggcatgtactaccaggcctggctgagttttgtatttttagtagagacagggtttcaccatgttggccaggctggtctcaaactcctgacctcaagggatctgcccgcctcggcctcccaaagtgttgggattacaggcgtgagccaccgcgcctggcccccagtttcttaatcaagtttttttgttgttgttgttgttaagagtgttatgtacttaacaaccattagcattttcttgtagcatcatggaaaatattttccaaaacctgagtcattttcttgatctctttaacacctgatagttggagagtgtcaaaggaatatcaggacttcattggtattttacttatttgagaatttggcttagtttgcacattggacgcatgattataagcatgagacaacttatccctctacctgactaatgataagtttctcctagcatcagttaataggagagcatatcaattttagaaattttatagtgcataatacaaaggaacattttagaattcaagaaaatgtagattaaacagaactaatatttacggggtcttgcttataaattatatgtcagggctttctaaatcaaagatcatccaaagcataaagaagaaatagtgtcaagtttaaaaaaatatccagggagagagtagtgttacacgtattgttccacacaccttaatgttctttcggctcaaaatttgggagaggaagatggcagtaaatgatacaaattccttccaaatagcaaagacacagattacaaatcctgttttctcacttttagctttcaattcctgggttagctgggtattttgtaacagatttttagaaaggaaaattagaatttaatttttgtgccattgcttatttaattagcacatctgttttatctgctgaccttccaaaagaaccatataggtagtaacttaaccaaaaatacactcactggaatcattgttttttaacatgttgtatataggttgtaaaatctataaaatactattgggtagtaaaatctataaaagactttggagaaaaatattagcgcctggctgttgtatcataccagaatgttgaattgtatcataccagaatgatttaacacatcatttgttgtgtgagaaaaattagaaaattagaaaactgtaaaaaattagaaacatgcatataactttacttacaatgaaatcttttgtatataaattaaatgaaaaatttgagggaagtggagagattaactttaacttttaaaatttgtattttagatggaccaatcttacaaaccagatgaaaatgaagttcgaactctctttggtcttcatttaagccagaagagaaataatggtgtcgtcgacaagtcattatttagcaatgttgttaccaaaaataaagatgtaagttgggaagtatctgaactgactgctagtaacttccattggtctgttttcaatacttaatgagctttacatttattaaggtctggatttggaactggtctgtatgcacacggctagctagcttatctttgagttgtcacataagctttggagtttaagaaatgaatcaaaggccatgttagaagcttctgtgcatatgtacacactagagataagtagctttaattgtgtataaatgggatcatgtcttccataatctggctcctgtaacttggcttttttccatgtgctaggctacaaatgtgtttttatatcaatacatatagatgctgggtgcagtagctgacatttgtaatcccaacactttggtaggccaaggggcagctctcttgaggtcaggagtttaagaccagcctgaccatgtagtgaaaccttgtctctagaaaaagtacaaaaattagcctggcgtggtagctgcgcctgtaggtccagctactcgagaggctgaggtgagaggattgcatgagtctgggagatcaaggctgcagtgagccgtgtttgtgccactgcactcctctctgggtgacagaacaagatcctatctcgaaaataaatgcatattcatatctttatctgaaagtccatgtggcagtcagtccatgtgtagatgtactacgatggatatttattgttcttatttttaccctgattgattgatttatttttttattttattttttctgagacagagtctcgctctgtcacccaggctggagtgcagtggtgcgatctcgggtcactgcaagctccgcctcccgggttcacgccattctcctgcttcagcctcccaagtagctgggactacaggcgcccgccacaacgcctggctaattttttttgtatttttagtagagacggtgtttcactgtgttagccaggatggtctcgatctcctaacctcgtgatctgcccacctcagcctcccaaagtgctggggttacaggcgtgagccaccatgcccagcctttattattttttttaagagacttttgaatgtttttatccctttgaagctcgctctgtttgaatgtttttattcctttgaagcttgctctgttgcccaggctggagtgcagtggtgcgatcatagctcactgcaacgtggatcttctgatggatatttagattgcttacattttcagtgctatgatcaatgtttttatatagacaagtttttgggcttgtgctctttgttaccttgtagtaaggacacgttcctaggataataatggtgatttttgtgttttggatatattatctcatttaacacttaggtcactctatgggggtgactaccatcgtgtcaattgtgaagatcacaaaattgtaccataaaggacaattaagaaatttgaccggagttacacaataaagaatggacaagctgacatttattttttggagtatcttaattgggccttcagtttgaaggatgtttgtcctaggtctaaagtaggctgtgcttgttgttcagtactttgcaggaatcattccattgctttctggtctgtctggctgatagcctggaattttttattgagtgctaggcattgggtatgaaaaaactgtagcgatattttgagggctggatggtgttatttttctctccagagttgacttgtccttcttttgggcagataaggtgtaggaggtatcttcattctgtcaggaattgttgagcttcctaaaggctaaataggaatttagccttcagtctttgtgaggactggtctgttcatggttcattcctgctcctgaatccctaggtatctactgctctacgctgaactcggcttttgtcccttagtcctctaagactgccaaaagttgtgctcagccaatttacctttagtttattgcatgcaacttggaaaatgccttgaggagaaaagcatagactgtcaggcccatttcttactgcttccattttctctgggatctttgtctgttagcacttgctgtctgtccgctctgcccagcatttctgtttgttactaaaagaggattggtctcttaagctatttgctgtaacagaaggagatgaggggctgcagcttgctcccaggtctgaatcctgaggccttttcagtagaattgctggaaataagccttaaaatctttatccagagagttctgtctgttgataagcatacgacgattaacatatcttttttgtttgatttaatggatattctttcatttctatctttgacaattaatggtgtcctgaagtaaagaaacatgtaggcattatacatagaaatatctttcagccctttggaatccactctggttggttcatgtactttgaaaaatactgaatggatattgacctagattccatggtaccatgttgagagttgtgcctagctactgagagtcttttttctaaggtttgtagatattggattcattaataatttagtgatcttgataggttttgtgcctctggatattttttataagagtggtaggtatgatcttaatcgtttatctaaactctttccttgcttcatatgaattcttagtagaaatttggaaacttaaggatgagagaatgatagctttgttctcctttctgttttacccgtctttttaagtggatttttgttaacattccagcctcagaattattaggtctggaaccatttcagtcctgagagagccagacaggtggatggaatgtttattaatactgaacatgtttgaattatttcctcttctcccatttttcttgaatagtgctttaattgtgttaactatttgtagcatgtttctaagactggattcccttactcccagtccactggcatttctcgtatgccttgatcccaacccaggatgccaagtgtattagtttttatcacgctgctatgaagaaattcctgagactgggcaatttataaagaaaagaggtttaattgactcacagttccacacggttggggaggcctcaggaatcttataatcatggcagaaggcacctcttcagagggcggcaggagagggaatgagtgcaagcgagagaaatgccagacgcttactgtcagatctcatgagactcattcattgtcatgagaactacatgggggaaactgcccccatgatccagttacctccacctagtcccgcctgttgacacatggggattattataattcagggtgagatttaggtggggacacagccaaaccgtatcaccaagattatctttgaaggtctagacatctatgaagctggcttttgctactaagttttctgggaaccagaggaatcagatttatagttgatgactcaaatagcagataaagataaaagatatataacattaataataccttagagtaataaattcttaagaaatcctaatagcttttttaaattaaactttttaattttgagataaaagttgtagattcatatacagttgtaagagttcccatgtaaccgttaccctatttctcctaatgctagcatttgtcacactacagtacagttccacaaccatgccattgacattgataacagttaaagacacagggcatttccaacactgcagtgatccctcatgttcttttgtatccgggctcacttgatatggcttccaccctctccttacccttgggcaaccacaaatctgtttttcctttctataattttcattcatcgtgcattcatgtacagtttttgtgtgtgtgtgtgagcataaggtttttgtcttttggggaaacagggtccaactctgttgtccaggctggagtgcaatggctcggtcttggctcactgcaatctccgcctcccgggttcaagcgattctcctgcctcagcctcccagggagctgggattacaggcatgcggcaccacacctggctaatctttgtattttcagtagagacggggtttcaccatgttggtcaggctggtcttgaactcctgactcaggtgatctacccgcctgggattacaggcatgagccactgtgcccagcctaaacgtaagtttttatttctctttgataaatgcccagggttgttaactgctttgtggtatggtagttgcatgtttagtttactaagaaactgctgaattgttttccagagtggcttgtaccattttgtattcccaccagcaatggatgagtgatccaatgtctctgcatccttactagcttttggtattgctactttttttttttttttaaagacatgggatagttgtgtagcaatctgtcactgattttaatttgcataatagctcatgatgttgaacatttttttgtgtacttatttgctacatgtgtatcctttttggtgaaaatgtctgtcttttgcccattttctaattaaatttttgattgttactgagtttttttgttttgttttgagatgaagtctcgctctgtcacctagactggagtgcagtggcatgatcttgtctcactgcagcctccacctcccgggttcaagtggttctcctgtctcagcttcccaagtagctgggattacaggaatgcgccaccacacctggcaaatttttatagttttagtagagatggggttcaccatgttggtcaggctggcctggaacttctgacctcaggtggtccacccgccttggcctcccaaagtgctaggattacaggcatgtgccactgcgcctgtcctgttacagagtttttaaagtttttttatgttttaggtgctagtttgttgttggatatgaggtttgttaataattttctcctagttcgtagcttgtcttttcatcctctttaatgaggaatcttttacagaggaaaagttcttaattttactgaagtcaaatttatcaacttatctgttggctgtagcaaatatcctctgtccatttagcatacagacgtggactatcatccttcttttccatttgtattcatgcctgatactaaagatagtgatatttttgggcgttattcttgttgttctatttggactggtaattcctaatggtttttgaacagtttcaacttaagttattctaaacaaaagagaaaatgatcgtaatttgatttttccaaagtcttggctgtctgtgtgcatcataacgatttgtgatgtctatgaaacaattctccgcattggttctgaacgtaaattttaccatgtctccagatatttaaaagtactctggtcaagaaaatattgtttgtcagttttggaatggatatggtagttcttacctcatgtgatataaaaaggcttaatccacaattgctacaaaataacatgagtttgtgtctatggatgcattgtgctaagttccaccccaaatgtgttaaatatttaagtaaatcatggtagtgtgtaggagaacagttaatttccctctgtcatttgagtggtataactatgttgtaggtcttttacattaaatagaactaagaaacttaaagttggccaggtgtggtggctcacacctgttgtaatcctggcactctgggaggctgaggcacgtagatgacttgagctcaggagttcgagaccagcctggccaacatggtgaaaccccatctctactaaaaatacaaaaattagccaggcatggtggtgcatgcgcctgtaattgaagcgtgagaatctcttgcacccgggaggtggaggttacagtgagccgagattgtgccgttggagattgtcccattgtgcctgggagacagagtgagactctgactcaaaaaaaccacaaaaaataatatttaaaaaaagaagcttaaagttaaatgagtttaaaaggccccgtgcaatttaccattgtgtatgtgtttcagttgccagagtctgccctccgagacctcatcgtagccaccattgctgtcaagtacactcagtctaactctgtgtgctacgccaagaacgggcaggtaagtgggctgttggactcgccttcgggggactgttgttttacgaaatgatatttaaacatccgtctgccttagatattggacagcttgaaagggaatatttgccaaatgtttgtcttttgtgtttgtcagtgtttcctcagtaccctggtgggctgttaaaactaatgatgatcagaaaatatctttggaaccaggtactcaaagtagttgtgctgcttcttgccttgaataggttggcacattttggattagtgagactctaatagctgttacaaaactggattatttcctttccttttcccccattggtattatttccagggaagaggaggtaagttacggtactgccacccaccagcctatatttttgcagcctgcagggtattttcacattatttcttatgttgtcttatcaagaatctgctgagtagaaagactgctagactaggagttaacttcatctttaaaaagttaggttcattgaggcataatttgtatacagtagaattcacctttttaaagtacagtttgaccagttttcacaaatttcacagtatgtgaccgctgccacaattaaataccaaacatttctcactgtgtgacgttaagcaagatattacacttctttcctagtgtcccgagcctcagaatacaagatggagctggttcatctctgaggtctctgctagccttttcttcacatggtgtcctgagcttatctcttggcatttgttaaattatttggcccacaagtgacagggaggtgggtggatatgaattagcctatggcctggaagaccccagattgccagtctctgtagtaacaaactcctgggagattgtgtctactggtgtcaggttctaagaagttctgtaagtccatgtagaatgagtgcttcattcctgatgttgaggaggaggcggctgcccaggtatttgtggtctcttttattctcttgtagctgtgggcagggttgccagcagctgtgctcagaaagagatggactgttgggcagacagcttaggggctgttcattataggaactaaaaccagaaaacacacctgtgcatttaagtccttgttgcttagaattcaacccatagaaatagaggaaagaaggaagaacatttgtacctggcggaattgtttctacttttagctacccatgtcagatccttatctcaatttctgagagttgatattttaactgtaatttatacactggggcaaacaaaagactttcaagtaaccatagttatttttgtggtcattagttttatttatttatttatttatttattttttatagagacagggtcttgctctgttgcccaggccagagtacagtgacatgatcatagctcattgtagccttcgactcctggcctcaagcggtcctaccacttcagcctcctgagtagctgggactgcaggtgtgcgccactacccctagctattttttaattcttattttttgtagagatgagatgttgccatcttgcccaggctggtctcctgagctcaagcaatccttctgtcctaacctcacaaagtgctgggattacaggcatgagccagtgcacccagcattggtcatttattttaacttttttttttttttgacctcaaaccatcaattttattgaattgtagattattaatagtcatatgtcacatatcactgaagaggtataaatagtagttataaacaaacctcttactccaccccttttaatgacttaaaaattatttatatttctcttattttggcctgatatgttcttccacaaaactaataaataggttttggagaatgtgcacaaaagatccttttgagaagaaagtgtctttggaagaggtgttcactttaatgtctgtgttcctcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggtgaaagacttggcattgggttctcggctgtgttaatattcagttcatccctttatgtgtaacagattttaacttcatcaccacacagagaaaaagatactttcattgaaattctatgttgtctaaaattgatcattgaaacttcttacacatttctcatgttcttctgtctcatgtaactttcttcattgtttttgacccctttctgaaaccacagtcctctgtctttttaaattgcagccttggtgtaggtttgtatatttgtacttcccctgttgattataagcttttgatgacaaggactgcttttcacctacgtcgaggtgcctgccaccacgtcatgcatggtgcttgctgtccgatgggtctgtattcaacattaaatacaaattgcctgacggcaggtaaccctggggtcttctcctaccacattttctacatgtgccattaataacttgatacattttgttacatttcatgttcttctgtttgaagaaggtatgtgggaacattacaatcgcaaacgttaggtaggtagcccgccagaagaaaagatctagcccagtttctggacatattgcgtgcctaacaaaatgctggatggaaaacagaagcctgctaatcaaatactagatggtcttctgaagagccaattgactaccctcagttttttactcaggagcaggaatcaacataagtgtcattgaagagtgaggctgcagaatgtaactgaagtccttaagatatcttttttttttcaactttgatacttggatttttctgtttgatattaccagtcaacccctgctactagtcctgaaagagtcctggaagtgaacaagaataaaagtatgtcaaagctaaaacatgacccaagatagaagcaccttgtaaaatatgattaactgtctgtgccactatgacacaatactgcaggctgggtaacttataaaccatagacatttatttttcatagttctggaggctgtgaagtcccagatcaaggtactggtgggctgagagtctggggaggcctaccctctgcttcccagatggcacagccctctctggaaaggacaaacactgtgtccttacttcacagaaggggcatacttcccctgaagcccttttataagtctgtaatccattcatgagggccccaccctcattgcccaataactttctaaaggccttatacttcttaatactgttgcattggggattaagtttcaacatgaattttggagtggatacacacactcaaaccatagcaaatattatgaattgtgttttgtctacaactgcctttacatttagaataatttttgtataaatgtagttaaagaactactcatctctttcctagattggatatagagggtttttttgaaaacccttggaacacaatttttatttgctttctttgctacagtagtaccaaagcagtagatttaaattagacggtagtctaatagacataaagtagtagatacgaagtagatttaaattagagattttaaaacagtgtatttttatgtaagtagcttagccaaaaataaaaaaaattacatatgtacttggaataaactgatttggaaagtaaaatggtattatctttatttggtaaacttagaatcactttttttccttaatgaaaatatttctaaaagcatcaaagagattctagatatgtgaacttccatgtaaataatggtcattatttacaattaagaaatcctggccgggcgcggtggctcatgcctataatcccagcactttgggaggccgaggtgagtggatcatgaggtcaagagattgagaccctcctggccaacatggtgaaactctgtctccaaaaatacaaaaattagctgggtgtggtggtgtgcacttgtggtcccaggtacttgggaggctgaggcaggagaattgcttgaacctgggaggtggaggttgcggtgagccgagatcgcaccactgcactccagcctggtgatagtgcaaaactccgtctaaaaaaaaaaaaataataataataataaaaacaagtcctaagaaaaatgcccaggtgctttctggcatggtgatttgcaccacatagaactaaagacgatgtcagaccaagcttcttcctttctctctccccgcataggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaagggtaagtatggaattgggtgcatttgcttagagttgagcattatgtagaaactgtttcagaaatcctgcttttgatttttaaaaggtgtggcaaagtgatacagatcagtaatattcagagaaccatttgacttctccattgggtggatggagaacccaaatcctgttgttattttgcctttttgactgagtgtatctttgttagcatatgctttttagagggggattttgagttttgcaggtttttacataaaatcgcgttttgaaaatcaatatacttcccccagagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatctcttaatcactggatccatagtttttggtagttgtgttttatgttaaagatgcaggctctttgaactgacacatgacacataacacataaatgaggaattccagagcacccctgcctaccggagctcagcccatcccacagcactgcccgtgtgaaacataaacattagcaggaaccaaacgagctgagcagccagaggacatggcacaagtcactgtgtacaggccacacttaaggactgggagttatacccatcttaaaggtggagtattgatgtaaattacctagaattcttctgcatgggagttgtatattaaaggtccatgttgcctcctaggggagtcttctcatgccgtttttgtttgtttgtttttcatttttttgatttgttattttgagagggagtctcaaaaaaatagctctgtcactcaggctagagtcagtggcaccgtcttggctcactgcaacctccgcctcccgggttcaagcgattctcctgcctcagtctcctgagtagctgggactacaggcatgtgccaccatgcctggctaatttttgtatttagtagagacagggtttcaccatgttggtcaggctggtctcgaactcttgacctcatgatccacccgccctggcctcccaaagtgctgggattacgggcgtgagccaccgtgcccggccctcatgccatttatttttaatcacacttctgagaagcttggttgtctactttccaaacaaacagcagattggcacctgtgaactggaaccttagaggggattggtttaagtcttgttgaccccctctatggataatctgatgtatatttttctcagtgctaagtgaaatgtttcccagaatttcagcagcccgagattcaccctctggagctgcataaaaatgtagtcaatatttggtgctcagaaattgtacccaatattccaattacaggcttaatcactacagtgggcacagtgggagggcagtgccttccttcatcaggacagacctgtgcatctgtgtgtcctgcctgtgtgctcctgaccattcccgtgcattgcacctgtgttcaactaaaaccctttgccattgttcacctttaccaatgagtcctaccctcttcccaagtctttaacttatccccttgctaaataaaaatttctgaagttttttcttaatggtcatctttctaagttatttctggttcagctaatcttccagccctggcctaggacctgcccacattgaaacaaggctgacttgtgtgatcagtaaaatactgcagaaaaaataagacttttgaggctaggtcctaatacattgcaacttcagccttagtttcttggattacttcctctgggataagccaagaccacgttgtaagagttaagcagccctccacaaggagagacgccatcttgcttacactagttgccagccacatgagtgagccacctcagaggtggatcctccagcttcagtcccaggcaacatctggcttcaacctcttcagagacctgagccagaactgcccaaaagagctcttgaattcctgacccacagatacagagagatgcatactgttgttaagccacaaagttctggggtaattatgtagcagtaaatagctaatacagattttggcttgtaaattaagtgtgtgttgtctttttcatggttctttggcttgaccaaaggttaacattaagggtatgataatgggaacaggctgagcactgtgtctcctgtctataatcccagcactttgggaggattgcttgaggccaggagttcaagaccagcctgggcaacatagcgacatcctcatctctaaaaaaagagaaaattttaattagctgggcatggtggctcctgtttgtagtattcttcacatagatgaagaa

SEQ ID NO: 17299 - DNA, 30222 bp, Human
cagcactttgggaggccgaggtgggcagatcacaaggtcaggagatcaagaccatcctggctaacatggtgaaaccccgtctctactaaaaaaaaatacaaaaaaaaaattagccaggcatggtggcaggtgcctgtagtcccagctactcaggaggctgaggcaggagaatggcatgaacctgggaggcagagcttgcagtgagctgagttggcgccactgcactccagcctgggcgacagagcaagactccgtctaaaaaaaaaaaaaaaaaagctttcctggaaaccccacccaaggacctgcagcttaatgctcattggcaacccttggtcaatgggaaatgtagtcttttagctaagtgcattgatgcctggaataaaatcaagggtaccgtttagtaaggaagaacagggaaatggggattgggtaggcagcctgcaatatctgccacatcatgtatgaaatcaggttccaggcctgagacactgaagtacatcaggatgcaaaagtgaccccgtgtcagtcagtgaacatgctggtttcccaaagagtccaaaatggtagctgcgacctgcagtgtaaggtttgggcaacagagatctaagtgaagaatcatgagtatgctggtctcctgagcccttttgctgtgaacacagacggaagggaaattttattctcagaacctgttgctcttaacctgagcagatgtttgctgtctttttcctattttctttttatggagatgtaattcccataacataaaatgcaccattttaaagcatacaatttggtgggttttagtattcttgctatgttgtgcaaccatcacctcagtctaaatccagaacatttccattaccccaaaaagaaaccctataccatttgcagtcagggcagatgcttccctcaatccttctccacccagtcctgggtagaccagagagctggacttaaccacatgaatgagtgcttgagctccttggatgacataggttcaaaccctgggattctggaatattttagaccctcttaggaaaaccaaggacagggtcatggtgaaattcacctaaggtaaggaaacgtggggtccacaaggatgctaaaccctcaagcctgtgccttcagcctgtgagctcctttcctgcagcccacaacccccggcggctgtagaagacaaagaggctctgcagtaagggacagggaagcttccagagcttctgagcctccagggccctcggtagtgatgccctaagttgcagaagctttaaaagctctctgttgtgacaccagacactgatatgggatttctacatccaggtggtactaatcagtgtgaaaagcgggctgagaggagagggaggatgcagcacattcattaagggcctcgtgtgttgtagattcaaacagaatctcctttttctactcacaaccatcctgggcagtattagactcattttccggaaggaggacttgaggttcacaaagagatgtgccttgctctgactgtacagccgaatttcagacacttccatctgagcctcgagtctcagcattctccattgcaccatgctgtgggcacctgtggaaatgcctcctgacctggcccagggcaggtgcagccacctcttgagtggcctagttaggggcaatgacattaggtcagggcttggcttagctcagccctgggctcctccgagtcggtaggagcttggcatgagctcccctcccttctgcctgcctcctattcttcactcctcaggcaaaaaggttgctcaaggagactccaggatttggggtctgcctcgtcactgtcaccaggaggctttttttctgacttgccagagctccccgtcagtcctcacagagcctctggaagcacagggaaggcagctgtgggatcctggctgaacagagtccaggtgaagcaggcttgagaatggattgatggggaggtggggatgtcacaggtctgatggcagagccgggggaagggaacagccaggaaggcttgcaggttctgctgtttggttgctgaagggggtcagtgtgtgtatgtgtcatggaggtgggcagggaaggggagggctgtgcgtgggggagaggatatatatgctggtgtggctgagaaagcggaaccgagcctcgcatccatcggagggagccggggactgacagctctcaggtaggcaactgcacggggcccccagcccgaccgcgactaactggactaactgagtggagctccgggagggcagggccaccaggggctggctcctcggcctctctcctttgtccagtgtggatgctgctggcctcttgcgagatggtttcttcattcatctcctttgtagcgcttggatggtggggaacgggggagggctgagtctcttttttaacctcagacagacgcagaagcagaaagaggggaacttggaaatgaggaaaagttttgcttccccagctgtggcccctacgtggttgttgctctgtgtcgagaggaggctgctggaggagtgaggccagaggaggggcaggcacttgggagggggtttgccttccacggggcggcccccaggaagaccctggccccctcatgagggtttcctctcagtggcttcctttcctctcagatgcggtgcgcaggctgcttctccgcctatcactgaacttgatgccatccagatgggagtttttaatccggagggagcccttctcccttctgcccccagcagaaattgctacaaataatggggaagcgccagatctggggagtgtgcttcacctgtatacacacactgctgagcgccacggcgtgtgaattccagagagcatttctacgggcgtgaccttggtctcccagaacccgattcatttagagggctcttctcttgcttggcatccctctccccctgcccatctcccccacctaaaggtctttgcccaggtcatgcagaatactccgttcatagtcaccgcatcccaactctcgaggctctctcagccaccttctttcttcctcctctctttgtgcatctctctccctcgagtcttgcttccccggcttcactacccagcccctcctccccgaatctcgctctgaacatgggcaagttctgggggaatttcaagtaaggcaggatgattcgggaaatggactatttaaagcaagctgctttggacttgaatacccccatcctgcgcttaaacatctgtgtttagcttcctcaagcagcccataattgccccaattataaccaataacattgttcggcagactaacaaaagatgagctttgcacggcattcgccagcaagcccaaaccagagttttcaacatagatgggaaaagtaactgcctggcttcttatcaaaacctcccaaagcaaatactgctctttttcgctgcttgtgggtggctactgcatgcagcctctttttttctcatttgtaaagtgtggcagggaaatattctacaagcttacactgaggctatgttacctttaacaaaaaggattcgtgctcctttgggcttgctgagtcttctgcagaggagggtccctggaaaacccatccccaaccatcaccacctctgtaaaagcatgtgccgcctggtgctgcctggcgagggcgctgtggtacagcctcgggtcattttgagggcgcagttttgttgcgcacagggcagcagcccctgctttatcagctgaaggctgagagtacttacggatttgtaaaatgcaggcgagtttgcattgtcagtgaagggagtgattgcaggattaggctcaaacctgtgctccctggagcctatgacaagagctgtcactaagctatcctgtattcaatcaatcaggtagttaccgtctacactccaccaggcagggaggcttgcaggggctctagtagattcagcagaggtgataataacagcactttacatttgtacaacgatttaggcgctttcacacctattatcccagcaacagccctgtgaggtggtgccattatctcggtgttgcagttggagaaactgaaactgagagattaaatgatttattcagtacatggcagggtcaggactgagccaaggcattgtggctccagttcatctccccgttacggtcaggggtgcttatgaactcatagtggggtcgggggtagaggagagacgtaacacaaacatgagaaacaattagaggaccatgcaaggcagggtgtaattcagtcctaaatcacataatccagagagcaagtgctagaagaattcgggagaaggagcatttcctccaggcattcctgggatcctaccaagtgagaaggcaggtggaatttggatgggtgaagggctttgaagagggaggcagcagccaggtcaaacacataaaatgagggcaaaggaattaacatttcttgaaacccactctgtgccaggcagtgagctaagcttgtctacgtgcttatttcatgctaatacacacatgcacatatgcacactggtaggaatgggaagtttcaggtgagcgttctctacttgcactgacacggttcagtgatccctcatttctccatccagctccacagctcccaaagcccacgaaggaagctttgaaatatcttgcattccgagtctgggtggagctactcctcagatatcttaggaaagggacgggcccttctcagaaaacgggagccgtcctgacaatgagtggctggcagtggcttgaattgctgggcagtcatgaagcaaactggattttctaaacgcctttatttaaatcccacagtcgaacataaagttttccatctaatcacaaactagtcatgagatttggagcacatcgatttcaggggcaagccagttttctgggcatctccctggataggctacaattagtttcagtctcaattttccacgatcctgtggggttttttttgtttgtttctttctttctttctttcctttttttttttttttttttttttttttttcaaaatactggcagctgcttcaacattgcagaagcacaaaatcatcagcccgggggcccagcctggcaggtggagtagatagcatgcctcaccatgcaccccagctctgccatcccacagtggctcagatccaacctcccctctttccacactggcctgcaatcttccccccaccctccttccccattcatcctttcattcattcggccaaggaacgtgtgtggggttcctgataggagccacacagagcaagtgccaggagcacagggcggccagagcgctggcttcctccaaactcacaatgggcttcaggagactgagacttttgtttttatcttacctttcttaatttgcattttagtggattttataatgtatgtaacttataaataaattaggaatgtgtactcaaaatcgactgctaggggtacaaagttaaagaagtttggccgggcgcagtggctcatgcctgtaatcccagcactttgggaggccgaggtgggcagatcacaaggtcaggagatcaagaccatcccggctaacacggtgaaaccccgtctctactaaaaatacaaaaaaattctctgggcgtggcggtgggcgcctgtagtcccagctactcgggaggctgaggcaggagaatggcgtgaactcgggaggtggaggttgcggtgagccgagatcacaccactgcactcctgcctgggtgacagagcgagactccatctcaaaaaaaaaaaaaaaaaagaagaagaagtttgaagattgttgtcctagattcattgctgtttctctgtgttttccaatattttagaaaagaacaccgaatgattttattacataaaagtaaataaaagcttttctttctttctttctgagttggaggtcttgctatattgcccaggcaggtcttttgttgttgttgttgttgtttacagacagggtctcactctgtcacccacactggagtgcagtggcacaatcatagctcactgcagactcaacctcctgggcccaagctatcctcctgcctcaaccttctgaatagctaagactgcagatgtgcaccaccacacctagctaaattttttttttttttttttttttgtagagataggtgtcttactatgttccccaagctggtctcaaactcctgggctcaagcgtcctaagttgctgggattgcagttgcatgccaatacacccagctaaaagtaaataaaagctttccaaaatctatttaaattatgttgccagtatatgtgggagtgtggcccagaaccaggaagatgggagttgagagctaccttcccacctgcagtagccctgaacgtgtgtcttttgccccctccacactctttctatggctttcctcatgctgcccggaagctacttccccataaagccttcatctccttttcctcttcccttcttccttccatccttacttccaggaaaggacaaatatctggccattcataaaatcagagaatatcaaccatctcatctaactgcctcttcttatagagggaaaagctgaggcccagagagaaaaggtcttgcttaaaatcccacaggtaacgacagagccagactagaagccaggactcttgtttctgagcacagctctcacgcgttcatttctctccagcctggggaatgcttgacctgtgctgggctgggcaattgttctttcctccacctcctctatgccgtccccctctttccaggtggaaatttagatgagaggagagacacttgaagtgtaattgtatcagccagaagaggaaaagaaactaaagcagcctctctccataatagctggtaaacaagcataagctccattgtaggagtcttatctgcaatgggtctaagaaatggggcatcgggaagacccacctatcttctgatggacatgcagctggtgcataatgaaggatccctgtgtggactggagagaagccaccataaagaggttgtcatcagccccggcacagtggctcatgcctgtaatcccagcaccttagggaggctgaggcgggaggatcattcgaggtcaggagtttgagaccagactgaccaacgtggtgaaaccccgtctctactaaaaatacaaaaaaaattagccaggcatggtggcgggcacctgtaatcccagctactcaggaggctgaggcgggagaatcatttgaacccaggaggcagagtttgcagtaagccaagatagcgccactgaactccagcctgggcaacagagcgagactccatctccaaaaaataaaaaataagaagtaaataaaaaaggttgtcatcagacagggagtacagacttcaggacaagaggaagccctacatgaagacagctgctgggatcactgacaggcagggtcagacataagtcccagctctgccacttcaagttacatcagctcctcaagcctcaatctgctcaactataaaatggggatgatagcacttaccccatagggtgatgcttataaagcaattagcgcaaagcctggctcatagtgctctaaagtcatagcaatatgattgctatgaaatgcaaatagattccaccgcaatgagatgccatcagaatctggcaatcttccaaaagcagaaacagtgtgtaaagttgatggtttcccagaacacatggtttgaagtcaacacacctgagtttaagtcctggctctgctacttataaaccggatgatcctagtcaacttgcttaacctctaagagtttatgttcattttaaaaggtgggttgatattaaccctagattacagggttgtataatatatgaatataaaattttttggtaacctgtcaagaatattctctacatgtggttgatgaaaaggatggaggtgtatctgcctctagcaagagcagtcccctcttctctgctggcagcatcaaaattacaggacttcgaataggtcataagacaaaactcaattagggtccagcttcggctaaagctgcatatgtgattctccaaacagataagcaactaattatattgcccttggaagcaagattacatgcaaatcgattaaggccaagccatagtggtattttatctttataaacagcaaggcacaattaaatttatgaggtgtcattaccaaaagaaaaggcaattcaacatttctttattcaatatgagacgctcagaatatagtattgccacatagaagtattagctgagcttggctcacgaagtgaaatacaagccatggaaaattcagcctactcaggtaacttttgatttactgatgtttgctatggttgtataaaaatagcaacaacctgtcactattcccatttcacagttgagaagactgaggctcacagaagtgaaataatttgcacacagtcccaccgttacaaagtataaagtttcagcatcaatgtaacaacaaacctgttattatccccactttgtagttgaaaggactgaccatctcaggacttgtctgcagtcacacaggtccacagtgtaaggtttaaacacaaatacaactcgtgaattaactaagtactcatctccatttaaatacagaacatcatccagcatggagatatagtcaagacttcttacaaatgaaaaacatctactgagttttcaaagttcaaaatctgatttaacctagaacacagttgtagtaggtgttgggaagtgtatgagaaaatacagaatgctgtctctataacgatatttacataattttgagttttcactgacattaatctcattttaaagcttgcaagccacctgtagggtggatggaactatgtggtcatctccattttgcagattctgtgaattgcaggggggaatggatagcattgaatatggatggctcctcaaataatcagtggagtcaattgttaaaagtgaggggagacagagaagggtcgggaggttggagtccgaaaggtagacgtgcctctgacccacagggaggtcctggctagagccaaggacactcaacaaggtctccctaagtgccaagctgcagggcctcacatttcacctgcaggaagactatcaaatggaacatgtactacgtgtcccagaagctcatcttccttttatacctcgcccttaaatcccatttacccagattttggcaagcatcagtcaaaccagccaacatttcctgaacatgcaagttgccccagttaatgaagttcacaaaaaacctcagccagagagcattttgctaacatctgtcacagtttgtcagctcagcctatgcacacattctgtattacaacctcatattaggaaggaaaggaaacggctccttttctcctcccttccctttcttctgcgacgtatagccactgccaccatgtggctgtagagggcacagccacgctgtttggaacaaattctacaaaaatgtctagaaagacggaaacttagtagaatgagaaatgtaaggccaggcatggtggctcatgtctgtaatcccagcacttggggaggccgaagcgggaggatcacctgaggtcaggagttcgagaccagcttggccaacatggtgaaacccatctctactaataatacaaaaattagctgggggtggtggtgcactcctggagtcccagctactgaggaggctgaggcaagagaattgcttgaacctgggaggtgtgggttgcagtgagccaaggttgtgccactgtactccagcctgggcaacagagtgaaacatcgtctcaaaaaacaaaaaagagtgttagagtgaatgctgcatgccaggttctttccttcttttcctttcgtatatattcttattgcctgtcagttctattttaattgcttacaaacgttaacccactaatcatcctctgagataggtactaatttcatcccatttttgcagatgaggaaatgagaggtcaagtacagctagcaagcttcagagctgtgatcggaagcaggcagtctgtagtcattagcagatgagaaagcgcatatcaccgccactctgcagcgtgggtctgttgtgcctgtgttgatagatggggcccccgaggctcgctggcctcccactatgatgtgctcttccagatgccagggcagcagaggagactgatctaactcagaccagggggtggacatggcttcccagaagggatgatgctagaggtgtgtgtgaaggatgagttggagaaggatattctgggcagagggaacagcaagtgccaagataaaaagacattaagaagccaggcacagtggctcatgtctgtaatcccagcactttgggaggccgaggtaggcagatcacttgaggtgaggagttcaagaccagcctggccaacatgtgaagccccgtctctactaaaaacacaaaaattagctggatgtggtggtgtgcacctgtaatcttgctactcaggaggctgaggcatgagaatcacttaaacttaagaggcggagtttgcagtgagtcgagatcgcgccactgcactccagcctgggcgacagagtgagactctgtctcaaaaaaaaaaaaaagaaaaagaaaaaaaaaaaaaaaaagacattaagagcctgatacagttgggagctacacgtgatcggctgagactagaggctatgcaaggttaggtgccaggagatgaagcaggagttggtcagtgctaagtccttggagctccccctgacagcaacaaggttataaaattagtttaaatataaggtgacatcatcagattggagatggcttggggggaagccagatcattaggtggactaattaggaggctattacaataaccaaggcaataaatctcaactaaagccctggtccttgggatagagaagaaaaattaatctcaaatgcatttgcgatacagtcatttatgtaggcactgtgttcattatttgtttcaaaacccgtctcaaatgtgagttcattggccaggtgcagtgacttatgcctgtaatcccaacactttgggaggctaaggtgggaggaacatttgaggccaggagttagagaccagcctaggcaacatggcgagacctcatttctgctaaaaatttaaaaactaaccaagcatcctgggctcaaacaatcctcccagctacttgggaggctgaggtgggaggattgcttgcgcccaggagttcaacgcttcagtgagccgtgattgccccactacacaccagcctgggcaacagagcgagaccatctcaaacaaacaaaaagtcaattcattgatttaacaaacacttattgagcaccccagtagtcatcatcctctgggtatgaaatgctttgatgacgcacaagaagaactggggtgggctcagctgcaggtccctcctttgttcacgtccttctcataccagcacttcccaaactttggcatggatacaagtcacctgggaatcttgctaaaaatgtggatccttacaaaaaattagcgggacctggtagcatatgcctgtaatctcagcactttgggaggccgaggcgggcagatcacaaggtcaggagttcgagaccagcttggccaacatggtgaaaccctgtctccactaaaaatacaaaaattagccaggtgttgtggcatgtgcctgtaatcccagccactcgggaggctgtggcatgagaatctcttgaaccagggaggtgatggttgcagtgagctgagattgtgccactgaactgcagcctgggtgacagagcaagactctgtctcaaaacaaaaacaaaaacaaaaagacctgcagatcctgattcagtggttctggggtgaggcccaagagtctgcatttctaacaagattccagctggtctgcagggtgcattggagtaccaagaccttctacagttcctcaatatcatctgaagaaaaagcaataaaggcagttatttttggttttctacactgaactctttattaagggaactgcatacagtgaaatgcacaaaatgtaaatgtacaactcaatgggttttggcaaatggatacacccctgcgacttcagtcaagaacatttacatttctagaaagttctttgttccttttccatttaatcctctacctaaagatggttctacagggacccaaaatgatacagtacaggcaagcatctttcagatttagaagccttgatcaaaagataagtttcaaggagaaacagtgaaaactgcacacctttcaggcaatcctacataagattgcaaaccactgatctaatcaaccaatccttggagctactatcttggaatagtttctttgttcggttttaaatagcaagttccacatgccagggcctgtgcttggcctggaatgccaaggtgaataacatgaccctttgctcgggaagccaactgtcttagtctgtccaggctactgtaacaaaagagcgtatactggatggcttataaacaacataaatttcttttttttttttttttttttgagatggagtcttgctctgtcacccaagctggagtgcagtggcatgatcttggaccactgcaacctccgcctcctgggttcaggcaatttctggctaatttttgtatttttagtagagatggggtttcaccatgttggccaggctagtcttgaactcctgacctctagtgatccacctgcctcagcctcccaaagtgctgggattacaggcatgagccactgtgccctgccaacaacagaaacaactttttcacagtcctggaggctgggaagtttgagatcaaggtgcctgcagattcagtgtctggtgaaggtctattcctggctcttagattttgccttcttgctgtgtcctcaagtggtggaagggactagctagctctctggggcctcttttataagggcactaatcccattcataagggctctagtcttatgatctcatcatctcccaaaggttccatctctctctctctctcttttttttttttttttttttttgagacagagtctcactctgtcaaccaggctggtgtgcaatggcacaatctcggctcactgcaacctccacctcccaggttcaagcaatactctcgcctcagcctcccaagtagctaggattacaagtgtgtaccaccacacccggatatatatatatatttgtatttttagtaaagacagggttttgccatgatgttggccaggctggtcttgaactcctgacctctagtgatccacctgccctggcctcccaaagttctgggattacaggcatgagccactgtgcctggcccaaagatcccatctcttaatatcatcacgttggaggttaggatttcaacataggaattttagggagacagagatagaccatagcactagctcacatctaacagggataagaggcaagtacctggaagagagagttcggggcataggggggttgggggcattcctggctgcagcagggaaggccaggaggatgaaaggaagcacttgagtcattaataaatgtcgtattttactcatcttacttttgcacagcactttgcaaaactccccttacagatctcatttcatcttcacaataggcctgtgataaggcaggtgccactgttccccttttatgggctatgaaaactgaggctcaaagtggttgatttaatgtcacatgctggtaaactgcaaagcgatgcctttagctcccaagaaagctgtctctgccaccacacagctgctcccaaaagtgcctatgaggtgtcgaggccagccaggtggcaggaatcacaggggtatcctgccacccaggactaacccaggaacccagacacactaacaagcctctgcatgaacactgagcctaggtgataggccgggtcgcctatggccttgacaatttacacccctgcaaagtgaatcgcaggcccctagtgccatcctgccagagacagcagagaagtgtctttcctgcattctctgggttaggtctctggccctgagcagccccccgagaatggctgtactcattgccatgcttcctgtatgttccagcacctgcttcctgctcctgcaccatgaaagtcctgctttgtgacctgctgctgctcagtctcttctccagtgtgttcagcagttgtcagagggactgtctcacatgccaggagaagctccacccagccctggacagcttcgacctggaggtaggtctccaaggcaaggcagagaggctgtcctcctccctgactacctcctccctccctactccagagcagactctgagtgagaagccaaggcctctcccacagctcacaggacttgctcagcattacatggcccgtaggaaacagatcagacaggagctgctcttctgacccagaaccttacgatctttccaccttaccacctgcaggaagagccctgcctgtgatgccaggtcattcccaggattaaaataatgttactcatttcagagagtttggcaaattcagaaaagtataaaacaagagaaatttaaatcctccttcattacaccagtcagagaaagtatcctactttttttcacttactatattataccaggataaatttctcatgttattatttctttccatgagtatagtctacagttggcccttggtatctactggtttcacattcaaggattcaactaaccatggatagaaaatattcagaaaaaaataaaaaatactaatacatcaatgaaaaataatacaaataaagcaatacagcataacaactacttaaatagcatttacattatattaagtattataagtaatccagagataatttaaagtgtacaggaggatgtgcatagccattttattgatcatttttatttttatttattcattttttttgagacagagtctcactctgtcactcaggctggaatgcagtggtgcgatctcagttcactgcaacatccacctcgcaggttcaagcaattcttctgcctcagcctcccaagtagctgggattacagacgcccaccaccacgccccgctattttttatatttttagtagagacgggtttcaccacattggccaggctggtcttgaactcctgacctcaagtgatccacccacctcatcctcccaaagtgctgggattacaggcatgagccaccgtgcccctccgcatagccattttatataagggacttgagcatctgcagatttagtatcctgaaaccaatcccctgtggatacagaaggaccgtgtaatttgtttaaccactgaacaggtatgtgccctttattttattttattttattttattttattttattttttttttttttttgagacggagtcttgctctgtcgcccaggctggagtgcagtggcgcaacctcggctcactgcaagctctgcctcctgggttcatgccattctcctgcctcagcctcccgagtagctgggactaaggtgcccaccaccacacccggctacttttttttttttttttttttttgtatttttagtagagatggggtttcaccgtgttaggatggtctcaatctcatgacctcatgatccacccgcctcagcctcccaaagtgctgggattacaggcgtgagccaccacgcctggcctgtgctctttatttttgatattgcagataactcaacagtgaaccccttagtaccaaaatgctctcttatattttaaatttccaacttaaggtgcaaatccagtattaactttttcttcattaaataaactgctttgtcaactatctacatttcagtccagatagttactcctctcctattaaatccagtatagctcaattgttttttactttatagtcaaataacttccttcaaaagatgccatcttttaaaccccttaacctttcaaaaacaccagaagcaccacagttccttaaggcaaatgtacaaatgtagaaccgagtatttgcagggggactaacacaccctggtgtctcccacctccagataacagaggaggagataaaatccagcagacccaaagcaccaagctctcgggcttagtggttttcaagcccattttccaaccagtcataactacccagggcatctccagttaaccaattcacttactatattataccaggatcaatttcccatgttattaacattattactttccatgaatatagtctacagttggccctcggttaagtggttacagtaaatgtctcctcttactcatccaccgtgtttctctctgagctcctaccttgctgatgatttcctccttcaggaacaccagccctctctcggtccatgtgcctcattctcttcctcactctggctactgtgttggttccttgtcctctccccactccctacacataaaggatcgccaagattctctgcttttcacctccctctgagaacccacccatacatcccaggccttctgctcctcccaggctgcagaaaactcctagaggaatcctcctgaactcctctcacctgggctccagacccgtgttcccaatcactttccatagttcccagaaatcctgccttctcttcctgccctgccattgtgcctgccacagcctcctcccccatccataaatcccagtcgcacttcaaatcccagattaagtgtcctctggtaagagaacattgcactgattctccacccaccccagtggagtgggccctccttcctcatgttctgattgttagttgtatctgcaggactctctctccccatatggagtgaggtttctttactgatggatctgggtatcccagcactcagtacagtgtgtggcacagagcatagctcaataaacacatcccatcccgtggaaattggaagattctaagaccattagtctcctaataggcacatctgctgcagtctctgtaaaggttttacatttccatctttcagagactcaaaaatttggagcatgtctgcatctctccatagcatcttaaatatctggggtctagacaacattatcagctctacttctttgaaacaagtcagaaaatggacctgtaaaagcctcacaatgggggactaacaccttcacagtgctcgctaaccccccggaggatgtggctgcctgcttgtttttgtttctagtttgtattcacttttaacctatgtttaagtttaatgaaatgcctagaatgtaggcactcaaatccatttccaaatctggcagcctttgactatgtccattctgtgaatgatcaggggactcatatttcagcaagggtcacttccccagtccttccaccaaattacataatcctgagctattcccaggatcctctggatccttggcttcatcaagaaactttttatttctgctcctagtagactatttgagtatggctgcttgttgttagactataatttttattggtaaatgactcacacccaaatccattgcaacgtcctggcctttaacctaattgtgaatggtacttacttcatcagctcaaggagaaaaaactggattcactgagttgttttagagacaaaaataaggcaaccaatcccaagaaagagtgtggggaaatttatttcaaactccctaaaatttggcctggtgcagtggctcacacctgtaatcccagcattttgggaggctgaggcaggtggatcacttgaggccagcagttctagaccagcctggccaacaaggcgaaaccctgtctctactaaaaatacaaaaattagctgggcatggtgatgcatgcctgtaatcccagctactcaggaggctgaggcagaagaatcacttaaacccaaaaggcagagatttcagtgagctgagatcatgctactgcactccagcctgggggacaaagtaagactctgtctcaatcaatcaataaaattccctaaaattctactgcaaaacgagctaccttctggtagttctttctatcttcatgagatgaaaattctaatgaggtgacttgcagtaggagttccttatatgtttgtcttctatgctcatctgctgtatttgtcctcagatattctagcaggacctcacaaagcaaatagctcccaaatgtctcttggtcagaagtggtgtgactctttagtggcagaaacttgaccacctttgtgagctgctcctttcatccccaatgggttcatatgcctgtttcccactttgtaccctaatctttgagcccagacacccaaatggccatttgttcactttccccataagcccagctttacagatgaatttggcagccatctgagactccagatgcccatacgcattctggcttaatatagcaatgccatcagcgtgggctgccaaaacgtgtccagctcacttaataagccattaacccatctctggaaaaaggctggtgagttccccgcaccagagggtcaggcattaagctcctatgcccatctggtgctacaaatgcgttgtgaatttagcttcctcctatttgcccaaaaccctctcctaagtcaagagttgagatgattttgtcagcatctaatttatctaacagtgcatcaagtctgggtatggactgtggcatctggtttgatcacacaatttcattttctctgactgacacaaaatctaattactatctgggcttggaaacccaggggctcacagaagatctaagcacctccaagtttaacaactcttccacttgtttccataaactgacggagcagaacaattcaacaagcagtttggggctcctgttctgcaaggattgggccaagcatgctcaaaagtcagatccagctcccccactctacccttctatgactttcccagtgctagccacacttctctgcatccctgttgactttgtagagcagagtttctcaaacttgccactatgggcacttttgactggggaattatttgttgtgggggttgtcctgggcactttaggatgtttactggcatccctggcctctaggtgccagtaacacacacacacacacacacacacacacacacaccaccagttctgacaaccaacaatgtctccagagattgccaaatggccccttagtgggcaaaatcactcccagttgagatccacgcctgtagagtactaactcaacaggattctgatctgaaagaatatactacacattgattctagctggttttcttccaagtatttcaggagcaggctaagtacagacccaggtgactctttctctgtaggagtctttaaccaccgtgttctgtgatggcttcttcctcctcagagcaagttccaaaacaggatttctccaggtatcatccagtctcagaatcacctgagctattgctaaaaatacaaatttctgggccccacccttgacttagtggatcagaatctccaatgctttaggctaaaaatttgcattctaacaaactccagtagcatttttttttctttgagacagtcccgttctgtcaccaaggctggagtgcagtacagcaatctcagctcactgcagccttgacttcccaggcccaagcaatcctctcacctcagcctcccaagtagctagaactgtaggcatgcaccaccacaccccactaacatttttatttttgtagagctgaggtctccctatgttgcccaggctgctctcaaactcctgggctcaaaggcgcctccctccttggcctcctaaagtactgggattataggcgggagccaccatgcccagcacagtagcaatttttatagaatactccagaagtttgcaacttcattgttcttaaggcagccctccctatctatggaagttacctatcattttttataatcagtaacattgcaggtgtgaaaaagtagttcccttcctctccctgctgaggtcattctgtcagcaactaggttccatgtgttaagcatctctgagcaaaagctaaatgaaaaagccatgctcagaaaaaccacggcgtgagcatcactaggggccagtgtcacctcctgtgactaataggtggacttggacaggttgcttcttggaaaccctgccagggaaggaaagggacactcctgtcagacctagtccctgcctgtcccttccagtccagtggaacataggcaatactcccatccaaacctcagctcttggtctcatagaatccttcttcttgcattaattgccaccaattcatattgcaagcacacagaggtagctgagtagatgtcttggactgggccacaaggcatctttgagttcttgttcaggttatactgttatctaaccgtgttgttttggacacattactcaaccacatcataaaatgcaaaggttgaattatattcatgatttgcaaacccaggcaaatatcggaattacctgaactttgtaaaattaagtttttaattcctttgtaaaaataagttttaatccctgcttctattcttcagagatttagttgagtcttgaaattctgttttgtttttttctgagtaggagtttcactcttgttgcccaggctggagtgcagtggtacagtctcggttcaccacaacctccgcctcccaggttgaagtgattctcctgcctcagcctcctgagtagctgggattacaggcatgcaccaccacgcccagcttattttttgtattttaagtagagacagggtttctccatgttggtctggctggtctcaaactcccaacctcagatgatccgcccgcctcagcctcccaaagtgctgggattataggcatgagccactgcgcctagccgaaattctgtttttaaaagctctgcaggtgattgggactcacatccaggtgtgggaccctttagaccaggtgtgggctctgtctccaaagaaaaaaaaaaaagaataaaagaatcctggaatcctggactaatgggacagataagtaatcagataagcaaagggtggcagcagggtgacaggagctgcctgcaacagtgcgcatgctaagcactaggggcgtcccagtcctggttgcaactagctgcgacccctgttcttccagggactctttctcacctcttttcattcccttcttttatactctcagctaaatatagagtgacttcttgattaattcatctcagttcaactaacctctactggaaccctactctttactggaaggagaagattcctgcaagggattcacacatgagtaagatgtggtccctaacttgtcatattccgccttagaaggtattgcaatttaatgacataaagcattaaaatttccacaagaggaatacaaagttctgtgggaagacagaggcaggagagagtgattcttgccagggaactagaagttatcagagaggggcagcactggagcttgtctgggtcccaaaggatggatgaaaggatgcaaggaggtcattgcatccaagggacagagagaaaggcatgcaggtgcgaggagctttgtggtgtttaaggcactaggaacagcctcataggcctcaaggggtgtgtgatgaagaatcggaaataagacctagatggtgggctggaccaggtggtagagggatttgaatgctttgctcaagagtttggagctgttttatggatatgataaacaattagacagctgtgagcaaggtaatgacatgattagttactcttcaggaagagtatcctgccaggggtaccacactgatgacagtggcaaagaccagagatgcggagatcagttagggacccacttcacctaagaggcacttaggcggtggtagagggagtgggaggaggggcagaactgtagactggcaggatgggggcagtgagagaggaggaaaagatatgcccagggtttgaaatctgagtcaactggggagtgaggtgccactcagagacagggaccgagaggccaagcagaaggacaaatatatcagataagaatgaaattcacctgctagtaacaaacatctaaagtgacagcggctgaaatcaatagattcagttcctcacaaggagtgagaagggaacagcccagggctgcagtggcagctccagtctcctctctcttctctgccagtcggcagcttctagcccatgactcccatcctttgagtcgctgcatggtttctagatggcaaacacaatgtcagcccaaatgtccacattccaaacagaaagttggaggaagaggaaaacggaatgttcttcccacttaagtcagtctcctactttcttggaaaccccatctgatgcccgatcaccttttttttctttttaggcaaagtctcactctgtcacccaggctggagtgcagtgacatgatagctcaccgcaacctccgcctcccaggttcaagcaactcttttgcttcagcctccccagtagctgggattacaggcacccatcaccacacccgtctaatttttgtatttttagcagagatgggtttttgccatgttggccaggctggtctcaaactcctggcctcaagtgatccgcctgctttggcctcccaaagttctgggattacgtttccttttttttttttttttttttgagacggagtctcgttctgtcgcccagcgtcaagtgcagtggcacgatctcggttcactgcaagctccgcctcccgggttcacgccattctcctgcttcagcctcctgagtagctgggactacaggcgcccgccaccacgcccagctaattttttttttttttttgtatttttagtagagatggggtttcaccatgttagccaggatggtctcgatctcctgacctcgtgatccacccgcctcggcctcccaaagtgctgggattacaggcgtgcgccaccgcacccggcctacacttccatttttatgtcgtcagctacttatggctccaaggaagcttgggaaacatatacgttgcctttaggaataaaacagtgttctgtgcataaggagaaggggagatgaataagggccagttgcagcctctgccccagaaggtgacctggaagccaggcaggagctccacgctatgatgaggagctctgcctactgagtcacagcagtaaggtcaggttgaagtggggtttccagccggctaaggccagaaacctggactgaaattaggggtgaagccaaaacagcaaataggaagaaaagctgggggcagaggcttccaggagacccaatcagaaccaagaacgtgggaggtggggggccaaggtcagaaccagccaagagggggtggagaaacatcgtggtccagctggtggctagaagtcagggttggcaggagaggcagagcagagtgttcctaggagccgagcgggtctgctgggctctggtctgatgatggcatctctccccacacctggaactggatcacaggttcagccccgcacgtccagccggcctaccaccccacagggtcttgaccccatttgctataaatgatacacagatagtgacgactgctgtacgcgggatgaaaaattaacaacacctaggtagatctttacatggtgaccttaaaataaacctgcagatttgactacatactttcacatccccaatttctttaacccatgtgacctcccacaagcctgaagagagaacaaaataaaattctttatgggtgacagtcatgagctgtgcttggctccaaaaacccgactaaagatgtaacaaggtgcggtgttgggcgcatttatcctgtgttaacttcctatgttaacgtgctgtgacaccagaggtaagttacgctcacctctctgagccctggtttctttgtaaaatgatggagctgggtcagatgattctctgtttgtttccaattctgaaattctacgaacctaaaacctgtgtaaaactgctccacgttacttgataacttagatgcttcagaagcacttgcactggtgcagtgggccagatctcctccctcgccctggattaacagaggtccttgttccttctcccctcctctcacccgtatctttgcaggtgtgcatcctcgagtgtgaagagaaggtcttccccagccccctctggactccatgcaccaaggtcatggccaggagctcttggcagctcagccctgccgccccagagcatgtggcggctgctctctaccagccgagagcttcggagatgcagcatctgcggcgaatgccccgagtccggagcttgttccaggagcaggaagagcccgagcctggcatggaggaggctggtgagatggagcagaagcagctgcagaagagatttgggggcttcaccggggcccggaagtcggccaggaagttggccaatcagaagcggttcagtgagtttatgaggcaatacttggtcctgagcatgcagtccagccagcgccggcgcaccctgcaccagaatggtaatgtgtagccggaaggggcgctcctcccagctgtaccggccactgcaacccatgagtgagttgggcaccaataagctgggggcaaggagagacctcacacaccaactgtcttagccttgctcccaggcctagaagcacattcatctccccgccccctccccactccacacacacacaccccgcaaggagtccagcccaccctttctctaggcagcagattttcctatgattgcaccttgaagctgaccacttccggctagagactggttaccatggggataatagtagtatgttaagataactaattcctctatcactccccaggagcttagttactatggggacagttaagtggaccaatacgcccatccagttgccacagcaaccagtcagctcacctttcctcgagattgtctctctaaacaccaagagtgggacctactcttagccattagcagagtccaattaccacagctatgatggtgctatttcatcttcaaagacggcttacctatcccctctcctttccccagctctcagggtgcctggctccatggaaacattaaagtttcccattttacctggacaaagagttcctgttaagattaggagttgtggtttctgctcttcctccttccacaagccatttgtccatcctgccaccttgccagagagggactgattccttgtggtcaacggtatcattactgagcaagacgtggagaatttggtccaatggacctagtagctactagaatatggactaaaggggttcatcttctttcctccatttcgcttctttccagcgtgccatttttgttttggttttgtttgcttgcttttattcctctctttcttccttgttctctctttcttctgctctgttcctatacccacaggcaccttatacaagtccacatgtctcataatatacatcaaataccctaactgattgcctgttcattcaaaacccaactttccttaggatatcaaccaatacatcactttgagtggcattggcaacctagcacagtagaattttctgaaaatttaggaaactcccaaccatcaaggctatgtgccttaatttgtatatgggaatatgatcatctgcagagtcccatacgtctccttaaatagctaagaaacttgccatattcatccattttgcattgctacgaaggaatacctgaggctgggtactttataaacaaagtttatttggctcacgttctgcagtctatacaagaagcatggcacccgcatctgcttctggtgaggccctcggggagcttttactcatggcagaaggcaaggggagctggcgtgccacatggcaagagggggcaagagggggaaaaggggaggtcccagcctctttaacaaccagatctcccacgaactcattaccatagggtgggcacaaaggcattcctgaaggatccacccccatgacccaaacaccacccactaggcccacctccaacattagggatcacatctcaacatgaaattggaagaggacaaacttctaaactgtatcattgtcctaacacaaagaaccagtcagatcatcaaaatcaccccaaaacattacccaagtggggcttttccctgagtccgagcataagagaaaaatgtctgcatgtgctattttaagttgcgtcccatgtgtcagaggtagccgtgtcactaataaccttccttgatgatctattagtacatatgctaatgtttggtgcccacactttagcatggagacggcccctttgcaggtaggccaacatgttcaccacgggcctgttaccaaatatggacacgtgtattaagttgtgaagagaaagctgatgtgtttattttagcaggatgactcatctccaaaggccccaaattaacctgcactgcttttgaagtcatactcactcttggatccttcacaagcctcctatttctttctaacacatatctgcacagcacctaacagtaaatcgttcagaagtagcatgggttgaattctttcaaatcttaaagacattcttctttaaagtggctcttcagggacactgaagctcatgtctaattctgaacgatggcaatgttctttacctaaacacagttgaaaatcaggcccattaacaggaatccatttattttttaaaaaatgatttgagcctctatccaggcaattggtttttctaatcttctattatgcttccaactgagaggcactgaaacaaagccagtaaggagcttctgtctgtggctctgctcaaatgtcaagttctggatggaaactggaaacattaaccagctcatttgggtattattgatgactctcctttctccttctgcaaccatctctctgcttcttttcccccaacatgcacagttggtgagttccaatatggatatttatgagtctataacagccggcttcaaccttgttttcatccacatacacacaccccaacctgccctacacatgatggagatgtctccatcttgggggactcttgttaccaatgctgtccttgacttctaagatacctaatactaatagacatggagaaggctgggaagaagtggggccaccttacactggaatgggataaagaaccctattcagggccgggcgcggtagctcatgcctataatcccagtgctttgggatgccgaggctggtggatcacctgaggtcagaagtttgagaccagcctggccaacatggtgaaaacccgtctctactaaaaatacaaaaattagccacttagccgggcgttgtggtgggtgcctgtagtcccagctacttgggaggctgaggcaggagaatcgcttgaacccaggaggcggaggttgcagtgagccgagattgtgcacattgcactccagcctgggcaacaagaaagaaactccatctcaaaaaaaaaaaaaaaaaaaagaacactattcagaaagtgtaatgatgtcctaggaaggaaaggtgttggggtgcaggcccacctctagacagaacttgtcacagctggtcttagggttctgccttcctttcccctgaccctatactaccttcctcttttctgctacccttagactttgacccttctaggcaatggaaactgagcacattcattcgtggtcaggttatcagtgccatcaggctcaaagagcacttgcaaagaaaagaactgtaaaacaagggcactatttcgcatgggctccgaataccagcaagaactgttccccgggaaggggcttgccactgtgcctatcgagtcacagcctacagacctcccgtttagtctattagtccagccagtagacccggggctgggggagcagatgtgcggagatgctgaggacccctctggctacgttaggaacgatttacttgggttgatagcttttctttgcctccctttcactgcttccgtctctagggggaatagaaaagggtcagaaaaaccatcaggtttgccattttttaaccatttctgtctccccaggcgtccaggtgatcccccaaacagcatgtgctcagccccagacctgccgcctgggaatcaggattccttcttccccaaggcactgagcgcctgcagatcccgcaggcttcgtttgcctccagaaccttcccgtctgattgttcctccccagccccctggcatgtttcaccacaaccctgttgctacatcagagtgtatttttgtaattcctctagctaccatttcaatagccccatctctcctgctcacccgcctcttgccccttctaggggcaggtgaaaggaataggaaattgaacctggggttttgacttgccactgccataacttgtttgtaaaagagctgttctttttgactgattgttttaaacaacgatttctccattaaacttctactgagcaaatggttaataaattggtttgctgtttttaagtgaagtgacagaagcagactctgcacacacacaaccagcgctgccgctcccgggaggcagaggtaaaaagcgcatggcactgctgtgtagaaaggaggataggcaggctgggctcagtggctcacgcctataatcccagcactttgggaggctgaggcgggtggatcatgaggtcaggggttcaagaccagcctggccaacatggtgaaaccctgtctcttctaaagatataaaaaattagccaggcgtggtggcacgtgcctgtaatcccagctacacaggaggctgagacaggagaatcacttgaactcgggaggcagaggttgcagtgagccaagattgtgccattgcactccagcctgggagacagagcaagactcagtctcaaaaaaaaaagagagaatgggcaaggtgcaccccgacggcacagtgcccagatccgagtgcaacaggtgggggaatgaatgcacatggctgtgtgaacggacagggtggagagagggcaggggctctccaaacccctgcgtgcatcagcaccgcagagaggcaggctgctggccccacccccagtttcagatggtagaaatctgcctttttaccaagctccaggtggtgcagatcctgctggtttgggtccaatggactgggacacacagcaaggagcagggcggagagaaacctgctgatgccacttttatctccagcttcccacgttagggtgtgtcactgccagagtccagccgagaaacacgaggcaaaccaaaccgagtctgtcggggagagttaaccgtctacacgaatgggcagggttacagaagatcagcaagggatggaaaggtgctctgttgggagccggagagccctggtaggggtaagggagttcctggacccacaaggactctagctctccatagctttcagtagagaaatacagccatttactcacacactgtgggagccaggattcaatacccccactttcaaactccagcctgatgtctgtcagccaaatccaaccagaagctggaaagttggggggtcgatccactgatgcagctgcgaaggtaggggtagggggtgagctacagatggagaaggcaggtagctaacttggagggggacttggtaaacgcagtagaacaggtaattctattcgaggtgttcttagagggatgagctggaacaaggacacagagaaggggagaaggaagtccctgactgcacccccaagatattaaaaaaaggccaaaaggagggaaaaagaaactgctttgtgggctgctgggcgtggctgactcaggccataatgaagtgcctgggcatgacacccccactggccagcaatgtgaagggtccctgcaacccgccccaagagacacttcacaatccccaaagctcctgcctctttgccttccctattccccagagcctcttcctatagctcctgcttctccccaccagatgactcagtgcggaaaagatcctgtggggccttccacctgccccaccaccacctcgaactcttattttaaatataccttaaacgtttaaacacatttccacaacttcctcaagcaagcctggtttatttgacttggtcttcttggaatctatcattgcttcactaagtggttcttaaaattcagcaactgaaattgcacaaaccagcccctgggtggaatgacgccttctgcttccaacagccttcccacctaggccagctctgccagccacttgggccatcgcagcacctggaactgatgtctgtatggagcagaccatgttcagaagccatttgataggtagcgtgtgactttattttctcccatgtcacttgcttgctcctcaaaagactcaggaatgcagtcaagaatatgctcccctttgtcaagaaaagcagcagaaaatgctgcctggagtgctgttatttcccagtttataaccttgagcaagttattgaacctctgtgcctcactc

SEQ ID NO: 17300 - DNA, 5939 bp, Human
cgcgtggtgggggtgcaggtccgtcctgctggcggcctgtgggctcgcccctcccctatccatttctctcccccacacacgctcataaacacaggacacgtggaaattctcagccaaagcgtcttgcccgggcgggtgctcaacgtggtgatttataaacagctcagccactctccaaagagcatgactccttgttagtcatgatgaattttctggcccgctccagtctgctgtctggattcagatgctcagaggccccaaaatgctccctctgagcgttgatttggctgccctctcaagcctacgaccgccggcaaaaccagcgatagagcgaggggtgagaggtggggacgcgatccaggttccctggggtctgtcattcccttcccggcagtaactgttgattcgctttacagcgcccatgtacacacccggccctgcgtggcggtcacgccgctccagcctgggtccgcgcccaagttctagctaccgggcttgcaggctcggaaactcgcaggcggcacctgctctgggcggctaaagaactgatggcgcgacgcgcccgcgctccgtagagcggcgctgcgggtgcatggtcccatagtcttgctctggagttcactgctgaaagctgagctgggagcttggccagggagcgccaaagacatagactaaccccacccgctagcgcccaccgaagttactgattaggaaggttcccctggcatcagcccatttgcttcacacactcttcctccttcccaaggggctaacggaaaagttgcacctaccagcggtaggagcacggggaatcgcgcacgcaggccctccgcgcggcttcccggagcggcctttggcgactgcgccgcccctacaaggccgcacacccctcgccagcactccggcagcctcgcacaagacggagcccacgcaggcttctagttttctaaaccaaaaactgcacgcgccggcgtgtgaatctgacggagagacttttagagttttgtttggttttcagttcagaccgctacgctgtcagagcaagcaactccgagccttgatgggaatgacttacaagccgcggtgcgggctgagcctgcctctctcggggttctttccccaagggagtgggagacaattgggcctggaacctaaaaggaagagagcctgtgctagccgcggggtagaggggaaggagaagagctttgggcagaagtgtccgcacaccctggagcaagagacacttgtgcactgaaattctaaccgtgggatgcaaggagagttgaacaggggaacaggtctggctcttggctctaggtttaagagatacacactgtgtgtgtgtccctaggtgaataaaaatccgactcccgctggctcggtgcgacccagcttttcccttaccccctccgtttccccatcttaaagccctattgggaaacgaaagtggacaccactgcctcccgccccccaccccaatccaagtcttccaagtgtctgtggccgataagagcaccgggaccgcccccctgccggtcttctctgcctgggagacagatggggggcggggcccatccgagagagggcggaggaggccccgggtgaggaagaagcgggggggtgagaactgagagaatctgaatcgggaggcgaaggggacggggaggagggctaggaggactccgagcccgggggagggggagggagtagctctgcgccaatcagtggcgccggcctgggaggttgctagcggtatccacgtaaatcaaagggcgcggagccaatgggagggggcggagggggcggggcccaggcgcgtgccgctgcgagccggcgctgccaagagagcgggagagagctggagagagcagggagaggggggagcgccgagctagtcagagagtgagcgagagcgagaaggagggagaggaggagaaagagagcgagggcgggcgggaggcggcggcggcggcagcagcagcagtaatagcaggagcagcaacagaaggcgtcggagcgggcgtcggagctgcccgctgtgggagagagaggagacagaaagagcgagcgaggagagggagcccgaggcgaaaaagtaactgtcaaatgcgcggctcctttaaccggagcgctcagtccggctccgagagtcatggcgaccgcagcgtctaaccactacagcctgctcacctccagcgcctccatcgtgcacgccgagccgcccggcggcatgcagcagggcgcggggggctaccgcgaagcgcagagcctggtgcagggcgactacggcgctctgcagagcaacggacacccgctcagccacgctcaccagtggatcaccgcgctgtcccacggcggcggcggcgggggcggtggcggcggcggggggggcgggggcggcggcgggggcggcggcgacggctccccgtggtccaccagccccctgggccagccggacatcaagccctcggtggtggtgcagcagggcggccgcggagacgagctgcacgggccaggcgccctgcagcagcagcatcagcagcagcaacagcaacagcagcagcaacagcagcaacagcagcagcagcagcagcaacagcggccgccgcatctggtgcaccacgccgctaaccaccacccgggacccggggcatggcggagcgcggcggctgcagcgcacctcccaccctccatgggagcgtccaacggcggcttgctctactcgcagcccagcttcacggtgaacggcatgctgggcgccggcgggcagccggccggtctgcaccaccacggcctgcgggacgcgcacgacgagccacaccatgccgaccaccacccgcacccgcactcgcacccacaccagcagccgccgcccccgccgcccccgcagggtccgcctggccacccaggcgcgcaccacgacccgcactcggacgaggacacgccgacctcggacgacctggagcagttcgccaagcagttcaagcagcggcggatcaaactgggatttacccaagcggacgtggggctggctctgggcaccctgtatggcaacgtgttctcgcagaccaccatctgcaggtttgaggccctgcagctgagcttcaagaacatgtgcaagctgaagcctttgttgaacaagtggttggaggaggcggactcgtcctcgggcagccccacgagcatagacaagatcgcagcgcaagggcgcaagcggaaaaagcggacctccatcgaggtgagcgtcaagggggctctggagagccatttcctcaaatgccccaagccctcggcccaggagatcacctccctcgcggacagcttacagctggagaaggaggtggtgagagtttggttttgtaacaggagacagaaagagaaaaggatgacccctcccggagggactctgccgggcgccgaggatgtgtacggggggagtagggacactccaccacaccacggggtgcagacgcccgtccagtgaactcgagctgggggaggggcagagcgcggggctccccctccccttcggtccttggccctttcccggccctcttgttccctctctaacttctgattgttcttttatttttaattattatttccccgtcccttaaaaagacaaaaaaaataaggcaaaaggaaagcaactaagacactggactatcctttaaaggtagcaggtgtaatgatgtgttttgacctttgcaggcgagtaaccaggcaatggagtggagtgtctcctggagagagtgaggagagtgtgtgatagctagaaagagagagagacagagagatggcaagcactgagataaatacctggcaaaactaaataaattaccaaaaaggaaaaaaaatccaccaaaccatgataaacacaaaatgcagcttcctgatgcttagagttggcacatgctgctgtgtttatttattgtggattcccatcaggaaagaggaaaaaatacacatgttctttcatataggcaaaatttaaccacataaatttgcactgcaagaaaattgaagtttacgtgaacaaattcatgagcatattttctctttctccccaccgttaatttgggagttgccgttttgggggattttgttttgctttgctttattcatcggagagagttgaagccagctcttggccactctccatttctaatgttcttgtgttgccccttcttcgtactgtttgtgaactttggttaccttcacattccccttacgagggtgtaacatctatttgttcctcttaccaaagcaaaaggattggcttcatacaaaatagacaattctctgatttcaggaaatgtgcatggtctacccgctttatcgaaggcaagaatccggtttggaatataaaaataagcattggttgttcttaccagccacaaagtaaacttcattttcaggcagtgtttctgggggaggttatggagggaagaaaaaagaaaaatcgatagtgagtgactgattgcttcattttatcaggcgggcccattgtgaaagagctcaggggaaatgtggaggttaaatatatttccagagttgtccagcagaaagaaagtggcactttgaagagaactagggaagtacatatcttcagatatccctatatagttctctaccttcagttttagtaacaattatgaagaattatttgtgctgacagcagcagttaaactttgtttctctaatagctttttttttacataaaaaaagacccaggaacttaatagtgtatgcataagactgtgttttttagcacacagatacccacagcatacactgacgatctccacgcagtagacaggttttgtcttcactagctcatttgtttatcaagtcatatttagggtcccacaccctcttttcctgtaatttattgcagaatacaccactttgacttggacagctttctgccccctctttcactaaggaaggcaaatgaagtgaaaaaaaaaatgccattttcaatccttcctttctcccctttgttaatagttttaagtgaatttttgaccttatcttaatggaaaacggttaactccaaacacaaaagactctactggaaagtgtaggtgaaaaaacttgtaactgtattgaaaataaataccattaaactgtgatcagttaaaatttaaaagaaaaatcagcacaaaagggcgctaaaagggaaaacactttttattaatcttaaaagtttgggggtttttttccagttaggtattagataaatttttattttaaaaaatgaaagtctcactaccataaaattatggttcagcatcagattagcattgcactcagtagtctttaaggttttaggaaatatgctttatattgtcttttcaaacacctgtgattgtttcattttccatgtttttgcaagataaatggtgacttataatgggcatatttatttgcctgtatttcatttcccccaatgaatgtcacaaggagatgggcacggagctgcttcgggtgcatcacgctgctcgttcctgaggtatgggaactggcctttagtgaagctatccagagcagggcaaatagccactggtaaagggaggaaatgaatttccagatacttattaccaagtaggtaaggtcagaagctggagttcagagaatgtgtctacagcttctctgactcttataggtttactaagatgaaagttaccactgaaccttaccactatgtatatatgtttaatatctgtcttttgaaatgcagaaatagtttaaatgtttctttgtctatttttctttttttttaatgctacccagggaaatattttcatatcatttttaagtggcctgcctcaatgtatatttatttcttttgaaacaaaaaggttctggaaactgtttttctgtagctttaaatgaataggtgagcaaaatctatatgggatgtaatttttttgttc

SEQ ID NO: 17301 - DNA, 17679 bp, Human
ttgtatttttttctgaagcagagtctcgctctgtcacccaggctggagtgcagtggcgtgatctcgactcactgcaacctctgcctcccaggctcaagtgattctcgtgcctcagcctcctgagtagctgggattacaggcacctgccaccatgcctggctaaactttggatttgtagtagagacgggggtttctccatgttggccaggttggtctcgaactcctgacctcaagtgattcacctgcctcacttagtcacaggatgagctagggttggcacaagatacaggtcacaaagtccctgctgataaaataggatgcggtaaaggagctggccaaaactcaccaaaaccaagatggcgacctctggtaggtctcactgctcattatacgctaattataatgcattagcatgttaaaaaaaaaacaactcccaccagcgtcatgacagttcacaaatgcaatggcaacgtccagagaagttaccctatagtccaaaaagcggaggaaccgttagttctaggaaatccctgccccttttctggagaactcttgaatgatccaccccttgtttagcatacaatcaagaaataactataagtacacttagtcgagaagccatactgctgctctgtctacgaagaagccattcttttttttctttacttctctattaaacgtgctttcactttatagactctccccaaattctttcttgcatgaggtccaaaaaccctctcttggggtctggattgggagccctttctgtaacagtactaaaggtgtgtgtgtagcttaaggtgtttttcagaacagtatttctttgctgactcatggccactccataaaatctgtgttaaaggtgaggtttttcccagaacctaatttttttctgacttcttggattgggatgatgacttcggcttttctcggaaggccttggtcacaccgctggccgatgaaacaaggaattgtgcacactgggtctcagctctctgcgttttgaatatttctgcattagtgactggcttgggtccagtctccaccaagaagccacttatgacccttggacaagtctttattcctttttaagtaagcttctggattctgccggtcctgtttggggtccctggggctctttgagacaggaacgttacagagcagttgaaggagaatagaaacttccaggctgcagttctgtctaacaaaaggaaactgttgaaatagctgcacaagctatgggctaagaccctgaaaaaccagggtgtgggtcaacctggctaaaaccaactggacccaacgtggtgtggctttgacctaggcttcacctaggactcattaacatactaagtcacacacccaccggcaccacaacaattccgggaacacccatatttggtgtaaaaatgggtggcaccacagttctgacaagtctccaccttattccagaaacctttgtgcatattccatttctcaaagaaacccataaagatggaaaccccaagccccattgtgtggccctcttttgagtccgccctttcttcagtgtgtactttgcagtaaacctctgtactttcacgactttccgacttgttcttgaattccttcgtgaggtggtgaaaccacctttgaaaacttatgacagaggcagtaaaagagatacacatgtggaaaggaacccagtctggggctaggccccgcccccctcctgcgggcagcccaatcatacccaggcccgccgcgctagtctccgcctctcggtgctgcctcttccgggcctcaggttcttccccatgcccacgcccctctttcgcgtcgccgtatccgaggtcgcgccaggccctggagtccccagtctccgcgtgctggccaatcagaccctgcctcgccccctcgcctgggagtctccgccctccacgctctgcccagtcaggctctgtcccgcccccgcggcaccgcctccgcgcctccatccagccggctccctccggccgcgaactgcccctccccgccccgcctcccggcgcgggtggccgaggcgtagcgctgcgacccccgcacccctgcgaacatggcgctgcgagtggtgcggagcgtgcgggccctgctctgcaccctgcgcgcggtcccgttacccgccgcgccctgcccgccgaggccctggcagctgggggtgggcgccgtccgtacgctgcgcactggacccgctctgctctcgggtaagcgcggcgggcacgtgggcggctgctccctccccgcctgggctgcttgtcccgggcccagcgggacacggaggacgccggggcaccgctcctgagccaccggggcggagcgagcgcggaccctgcccccttcttatttctgttgggatccctggctctgcggccgcttctcccccttaagtagcgggaggacccgcgagtagcctttgccctagggattgcatgcagccgggagggtaggcctgcgggacaccgaggcgggggtggcccggcgggtccggcgggcaggtcggccgcttgctgcagaagccaggcatgtgtcgcttaagcgtctcggtggccttaagtttatctcccatctgcgtgcatcgttgagaccccaaatggggaggcctttagtttactaaatggaccgttactgagaactccgaagtaaaattaaaacagaagcgcttattaaaattaaagcaccaggcagggcgcgttggctcatgccggagggcggatcacgaggtcaggagatcgagactatcctggctaacacggtgaaatcccatctctactaaaagtacaaaaaattagccaggcgtggcgcatgcgcatgtaatcccagctactcgggaggctgaggcaggagaatcgcttgaacctgggaggcagaggttgcagtgagccgagatcgcgccactgcactccagcctgggcgacagagcaaaactcccccggggggggggggttattttttaaaattaaagcgccagatctagatttttttactagataaaacaatcataactttgaagattcagctatttccccaaaacaagtaagataaagtcttctggactcaacagaagttctgctaaagtttgtattggatcattcatgtgtgtgcttgctgaaatgagccctaactcaaacggacttgaaataactgggaaacctgcccatgaatgtttcggccatttgtgctacttcagcacaattattgcaggggaaaaacaattttctttttttttttttttctttttattgagacggagcctcgctctgtcgcccaggctggagtgcagcggcgtgatctcggctcactgcaagcgccacctcccagattcaagcgattctcttgcctcagcctcccgagtagctgggttcactggcgcccgtcaccacctccagctgagttttgtatttttagtagagacagggtttcgccacgttaggatggtctcaaactcctgacctcaagtgatccacccgcctcggcctcccaaagtgctgagattacagtcgtgcgtcaccgcgccaggccaacaattttctttacgcccaaatgtttgagacactgactgctcctctgcttcgattgcgtagatcagtgatggctcttgtctcattagctcattgttttagaaacctgtttggagctggaatggttgacaaatttattccaaaatttgtagcataaagatttacttatgctgtcttgctaatagtctgttcgctctgtttctgatagggatccctacatcactaatttgaatacaaaggtaaagcatttctcagataagaatttagtttcaagtctgtggttttcgttccttttttttttcttcttttttgagaatggagtctcgctctgtcgcccaggctggcatccagtggcaggatcttggctcactgcaaccttcgcctcccgggttcaaacacttctcctgcctcagcctgtggagtagctggacgacaagagcacacctccatctcaaaaaaaaaaagagaagaaaaattgactaatactaatataaaatattttatctgactagtgacattgaaaaaggaaaatgcaaaattttcataaattgctcacaactcctaattttccgaggccaaaaaccacctttttcaaggcccagttagaaagtaattattgtccaggcacggtggctcatgcctttaatcccagcactttgggaggctgaggcaggcggatcacctgaggtcaggagttcaagaccagcctggccaacatggtgaaaccctgtctctaccaaaaatacaaaaaattagccgggcgtggtggcacgtgcttgtaatcccagctccttgggaggatgaggccgaatcacttgaacccgggaggcagaggttgcagtgagcctagattgcaccactacactccagcttgggcgacagagtgagactctgtctcaaaaaaagaaagtaattatttacctaatctatccacttcttcctgtcgggccaggggttaaaggagaattgtactaatcattgcctttagcctaaacagcatgcttagtaaaataaagacttaggtctttgaatcactgcaacctctgcctcccaggttcaagtgattctcctgcctcagcctcccgggtagctgggattataggtgcccgccaccatacccggccaattttttgtattttagtagagacggggtttcaccatgttggccagggtggtcttgaactcctgatctcaggtgatctgcctgcctcggcctcccaaagtgctgggattacaggcgagagccactgctgttggccaggactgaggggtaacattacctgtaatgttgccgtctccctctaaacttggggccaacaattttctttacacccaaatgtttgagacactaactgctccttgttaaggagaattgtactaattacaattagtaattgctcggttgctaaaatgagggtcacagcagccttactcctaaaattatcttcacaggtaggcaagatggcaaggtcaaagaaggtagtctcaggtggtgtttatagttgtccagtgcttactttgaaaaggtgttttagcttcaaactgctcataattggcatataaccggcgatttgtagcagagtgagagaattaagtgttaaagacaaataactatatactatctattttcctcagaatcctcttaataaactttaaaaaatcacgtcattctgcaactttttttttttttttttggagatgaagtttcgctagtcgcccaggcaatggtgcaatctcggctcactggaatctccgcctcccaggttcaagtgattctcctgcctcagcctcccaagtagctaggattataggcgtgtaccactacacctggctaatttttgtatttttagtagggacttggtttcaccatgctggccaggctggtcttgacctccttacgtcaggtgatccgcccgccttggcctcccaaagtgctgggattacaggcatgagccactgtgcccggcctgcaacatgataatttaaggggaaaaatatatatatttttctcccaaagtgttgagattacaggcatgagccaccacgcccagggattttttttgtttgttttttttgagactgagtcttgctctgttgctcaggctggagtgcagtggcgtgatctcagctcactgcaacctctgcctcctgggttcaagcaattctcatgcctcagcttcccaagtcgctggcattacaggagtgtgccaccacacctggctaatttttgtatttttttagtagagatgtggtttcactatgctggccaggctggtctcaaaccccggacctcaggtgatccacccgcctcggcctcccaaagtgctgggattacacgcatgagtcactgtgcctggcctgcgacatgataatttaaggaaaaaaaaaattatttcattccttcagcttttgagtgcttgctatgtggcaagcactgtatttaaaattgggaaaacaaatgaaaataagataaaccttgctgtttcttggtgggtacacagcctacttcctggggagactgacagatgatctctagtatgttcagcaccgtgtgtgtgctgggggatagtggtacagggtgccgtaagagcatgttggctggcctaagaacctagacttggttagacaagcctttgggcaggaacggacttctgaatctagaccggaagtagttagtaaagatggtagggagagtctttcagtcaaaacacagtgtacacatcttaaactttcttacctgaacgtcagagtgacctgaaacattcagttctttgaagtggaatgaagcaaaataaatttcttagtgacacattttttgacttcttccactgaaggggtatgaactttagaaagtttcataattaaggggaaaagaaagcaatattgaattatatacttggctaggcacggtggctcacacactattatcccagcactgtgagaggttgaggtgggaggatcatgagctcaggaatttgagaccagtctggacaacatagacccccccatctctacaaaaataaaaaataaaaataataattatacactctacttacgttgtgctgcgtatcagagctgtaaccaaagcaattgaatgctgttttaagtactactatcctttgggtaaggggtaaaatgagccagtgaggcctctttaaaacagtatttgagttaaccatttttctatgaacttacgttgcattgtttttagaaaaatacttggtgtcagaatatgaactgtatttaatatagcatatgctttttaaaaaatattattctctaaggcaagtacttttaactttatatcctaaataactctttttactcttgaacattggccggtccttctttcaggattccctgaatcgtttgaccgtatctttagagaagtgctcagtaagtcgagggctgaacctgtccagtgagtggtgagcagagcttgattctccaccaacccatggcttagctctgagaagactgttgagttgtgatcttaattttcttctttaagcgatggtagtgctatcttcaaggttaggcttgaatttgattaaagtagaattttaagaacttagtcaaattatagttgttccaggaggtcagtttcattcctgtaaaattttactttgtaacccaagctgcactgaagctctcttaggtcaactctgcctaaagaggcacctgattattactgttatttttttttttaggttaaatcatttcttatatgagccatctttatgctgcctccctaaacctcatcaccccaaatttgtcttcagaggcacagatttttttttctgcaagacagaccagtaatagttaagtatacatttgaaatatgctccaaaattttcttttgtgatttaggctaagtaatgttaaagcagataatccaatctccaaaagatgcacaaggtgttcagatgaagccatctttgcttaaatggtactgctgtttaaatgcgtcatctctatacatgatcttcattctttcctgagccatgcactatttaaaggtagtgtcaacaggtcaaacagaaattctgggaaagtcttttgaaagcaatggtaatgaaaagtgcttcttaagaagtaatgctactgcttttctgaaatgttggtcttctgttttagtgcgtaaattcacagagaaacacgaatgggtaacaacagaaaatggcattggaacagtgggaatcagcaattttgcacaggtattggattatattgaaatatttgtcccagtgtgctcttgcatgatttgctttatctctacctttttaaaagtgtttaggctgcgtgaggtggctcatgcctgtaatcccaacactttgggaggctgaggcaggaggattgcttgaggccaggagttcaagaccagcctggtcaacaaagtgagaccccgtctctaccaaaagttaaaaaaaaaaattagcctggcatggttgctcatgcctgtggtcccagctactcaggaggctaaggcaggagggtcgctggagcccaggaggttgaggctgcagtgaaccatgatcatgtcactgcaaaatacaaaaattagctggtcttggtggtgcacacctgtaatcccagctcgtcaggaggctgagacagaagaatcacttgaacctgggaggcagaagttgcagtaagccgagattgcaccactgcactctagcctgggtgacagagtgagactccatctccaaaaaaaaaaagaaagaaagaaagtaagaaaaccaaccagagttgaattaagtaaaacataatttagttagggcattatgtggtgttttaagagatgttgcaagcttaacactgaaagtaggaaacatgtcctattcaagaaggaaatgtgtgtgttttgtactgggcaattaaggaaagaggaaaaagaagagcagggtgttgccaccattttgtgggtccagtgatacacacgtgaccaggaggacgggaagaaagaaaacctcaataggcacagatgacacaaagggaaggcttttattcagcccatcttttctctgtaaattcccctcaattccatatggcgatactgtttaagagaaaatgagaagccaaatactagcgtgttcagtgattttcaactggatgtatgtattgggtgaggcggggaaggggggatgttaactgatgggaatgcactcgtgtcacttaatgatggagctatgttctgataactgcctcctcggggattgcgtccttctgtgagcctcctagggtgcccttacacacacctagacggtacagcctattacacaccttggctgtatggtacagcctttgctcctgggctacaaacctgtacagcatgttactgtactgaatactgtaggcaatcgtaacacacttggcctatcaaaacacagaaaaggtacagtaaaaatatggcataggttgagcatctctaatccctgaaatactccaaaaatctgaaactttttgagcaccaacgtgactcttaaagaaaatgctcattggagcgttttggattccagaatcttggatgaggagtgctcatgtattaagtataatgcaagtattccaaaatctgaaatccaaaacacttctgctcccaagcattttggacaagtgatactaactatattataatttcatgggaccactgtcatatatgtggtctgttgttgaccaaaatgccattaggcggcacgtgactgtacaaaattcctcagacatgtaagatgcttgtgtgttgataatcacaattatatcttccttggcatctctgtatacctactatgaggcccagtgttggatagtttttgagatgttgtgtaagatgtcgtccttacctcctagagtttatttgtgaggggaattacctacatgagaatgacttgcaaacattacatgatggcatcggaacggtggggttgtaattcacttacctgatggagagaccacttctttctggagtcagggacttcagggagtacaaggtgtgaggactatgatttgtagaatcagtgagcaggatttcagcaaatgctttgggggcaatggtgtacataaaactacagaggtggaagaacaccaaatatgttcatgcccagaagagctagcagtgtttgccgggcgcagtggctcacacctgtaatcctagcactttggaaggccgaggcaagttgattatctgaggtcaaaagttcaagaccagctggccaacatggtgaaactgcatctctagcaaaaaattttaaaaaattaaccaggcatggtggtgggcacctgtaatcccagctacttgggaggctgaggcaggagaatcgcttgaacctgggaggcagaggttgcagtgagctgagatcaggccactgcactccagcctgggcaacaagagagaaactctgtctcaaaaccaaataaaacaaagagctagcagtcttgtgtggggcaggaggcttgtgttaggttgctaaagcctgtgagccagatctggctggcggctggtctcttgcagctcctgagttgagaatagttttttaaaatcattttattttacttagttttggagaacagggtcttgctatattgccaaggcaggtctcaaactcctgggctcaagctatcctcccacctctgcctccctaagagctgggattacaggcatgagccaccgcacccagccatttatttttattcttgacatggagtcttgctctgtcgccaaggctggagtatacaggtgcaatctcaactcactgcaacctctgcctcccagatttaagtgattctcctgcctcagcctcctgagtagctgggattgcaagtgcctgccaccacacccagctaatttttgtatttttattagagactgggtttcaccatgtcaaccaggctggtctcgaacttctgacctcatgtgataacacccactttgggcctttcaaagtgctgggattacaggcgtgaactaccacacctgactgagagtagtttttacatgtttaaaggattttaaggaaaactcaagaatgtagcccctccagtataaaatatatactaaatcttcattataggggattcagtgtttggcttattctgtttactggagggtttagttataacttcttagagatttttggttttgtcttgttttatttaggaagcgttgggagatgttgtttattgtagtctccctgaagttgggacaaaattgaacaaacaaggtgagtgttcttaggatcttagaatgatccatgccatgaattttgtttacattgaatagtaatttgtttgtaccctggattaattagagtgcttttttttttttggagacagtcttgctttgtcacccaggctggagtgcagtggcaccatctcggcccactgtaacctctgcctcctgggttaaagcgattcttgtgtctcaggcacgtgccaccacgcccagctaatttttgtattgtagagacagagtttccccatgttggcaaggctgttctcgaactcctgacctcgagtgatccgcccgccttggcctcccaaaatgctgagattacaagtgtgagccaccgtgcccagccaattagagtgcttttgacccaagtattaggttggtgcaaaagtaattgctactcagaggctgagacaggagaattgctggaacttgggaggcggaggttgcagtgagccgagatcccatcactgtactccagcctgggcaacagagcaagactccgtttttttttatagagagaaaaaaagtctattaatatcgatatgttagataatatccttaaactaatgaatacccttttaagacattctgctaaaggtagttttttaacttgatgtaaaatctacatacagtgaaatgcatggaccagaagtgtacaattcagtgagttttaacaaatgtatacacttaaataaaccttcctagtcaaatagatgacctcttctctcgtttctacaccataggtttattttgcctattctttatatgaaaggaatcacacagtgtgtgttacgtttggctgcttttgggatttaccaagcttcttgaatctgtagattgaattttttttcgattaaatttggagacttcttattttagtcatgatttctttctcttcccacttcattcctttttccttctctgatttgagacatgttcgtcatatcacttgatattgtcctatagggtccctaagactgttaacttttcagccttttttaaactgttctttttttttacttcttatttttttgagacggagtcttgctctgttgcccaggctggaatgcgatggtgcgacattggctcactgcaacctccgcctcctaggttcaagcagttctcctttttcagccacccaagtagctgggagtacaggcatgcacaaccacaccaggctaattttttaaattaattaatttatttatttcgaggttttggtagaggcggggtttcaccatgttggccaggctggtcttgaactcgtgacctcaagtgatctacccgccttggcttcccaaagtgttgggattacaggcatgagccgccgttcctggccagtagttcagagttcataattgtgttttttttgtttttgagacggagtctcacactgtcaccaaggctggactgcaatggcatggtctcggctcactgcaacctccacctcccgggttcaagtgattctcctgcctcagtctcccaagtagctgggattataggcgcccaccaccacgcccggctaatttttttgtattttagtagagaccatgttggctaggctggtttcaaactactgacctcaggtgatcttcctgccttggtcttccaaagtgctggaattacaggcatgagccaccacgcctggcccagagcttataattgttatctgatacagggtacttcactgtcactggaacattctaaagttttcattttgtctttttctgagccacagctaagttgcaagaacatggagttttactgaacctacacacatctggcattcaggcacatcaccatttgttatttactgtgtccaggacacacagataggtccactttattgagacaatatatacccttctcgtggttattatagcctgacaaaacttatggttttatttttaattaaagaaatgtaggccaggcacggtggctcacggttataatcccagcactttgggaggctgaggcgggttgatcacgaggtcaggagttcaagaccagcttggccaacacagtgaaacgctgtctctactaaaaatacaaaaattagctgggcgtggtggtgcgcgcctgtaatcctagctacttgggaggctgaggcaggagaatggcttgaacccgggaggcagaggtggcagtgagcctagaacacaccattgtactgtagcctggtgacagagcgagactccgtctcaaaaaaaaaaaaaaaaaaagagccaggtgcagtggcttatgcctataatcccagcactttgggaggccgaggcgggcggatcacgacatcaggagattgagaccatcctagctaacacggtgaaaccccgtctctactacaaatacaaaaaattagacgggcgtggtggcaggtgggcgcctgtagtcccagctactcgggaggctgaggcaggagaatggcatgaacccttgggaggtggagcttgcagtgacgtgagattgcgccactgcactccagcctgggcaacagagcgagactccatctcaaaaaaaaaaaaaaaagaaatttggaattttaaaatcatagctatatgacaggaatctactttttcgtattttatgttttcaagtaactgacttttaacatttcatgttttctttaattttttttccacttagatgagtttggtgctttggaaagtgtgaaagctgctagtgaactctattctcctttatcaggagaagtaactgaaattaatgaagctcttgcagaaaatccaggacttgtaaacaaatcttgttatgaagatggtaagctgttgctagaaatttctcaaggaattactactacagtaaatattttatctagaatttaaagcaagtttagctgattgtgacttcatctttttctacttcttggtactaaatagagatgttctgctttaaaagaaaaacagaggttagttgaatacttaaagttatgtttaagatttctggctaggcgcagtggctcgcgcctgtgatcccagcactttgggaggccaaggtgggtggattgctttagtccaggagttggagaccagcctgggcaacatggtgaaactctgtctctatagaaatacaaaaattagctggctgtggtggaatgtgcctgtagtctcagttactagggaggctgaggtgggagaattgcttgaacctgggaggtcaaggctgcagtctatagtgagccaagatcgcaccactccactccagcctgagtgacagagcgagaccttctcaaaaaaagaaaaaaaaatctctgatgataaaagcattaccttattttgcaggttcttgatatcagttgtagattctttggttttggtgtaaacatctgcaaagtatttactttttcagacataaagcagccactcatattgtgtgacatgggaggtaaaaaaatatatattttgcattaatttttggttttctcacattttcacccttataatctaatcaggtaagctaacagcaattttctctattttgtagatgaatagaggctccaaaggatttatctgtcagggtctcatggctgataaatggcaaagctaggattaggttgtagttctcttttgtctgtcacctagcccttctaattactactgctttctaatcccgttaacctcagtagttagtgttccatttgttaaagacatacctggtcttgtgtatttggatcatatatttaaggacttatttttattatttttttgagacagagtctccctctgtcgcccaggctggagtgcagtggcgtgatctcggtgcactgcaacctccccttctcgggttcaagcacttcttctgcctcagcttcccagtagctgggatcaagggcaactgccaccacgcccagctaatttttgtggttttggtagagatggggttccactatgttggccaggctggtctagagctcctagcctcaagtgatttgcttgccttcgcttcccaaagtactgggattacaggcatgagccaccgtgcccggcccttaaagatttaaatgtcattttctgatgcttattacaacctaagagttcttaatttattatggtggaatctattctagccataattattttcatttgttatatacaagtattttaattcttaaggctaaaatttaaagttctatgaacaaataatgtatggtttttgtaaagaatacaagattgaggcgctcagaaatttattttacgttttggatgaatttgactttttaaaaagttaatgtggaatataaggttgtcttttggttgcaggttggctgatcaagatgacactgagtaacccttcagaactagatgaacttatgagtgaagaagcatatgagaaatacataaaatctattgaggagtgaaaatggaactcctaaataaactagtatgaaataacgcaagccagcagagttgtcttaaattagtggtggatagaagacttagaatagaaacttttagtattaccgatggggaaaaaaaaactactgttaacactgctaatgaaagaaaatgccctttaactttctaatgattatagataaatataatatgcgtctttttcacaatatcctatgatttttagactaggctctagtgttcagaattcatgaaattatccatggtaaaaactagttataaaaattacataattcaaagataacattgttattcttaagccttatataatattgtaacttgcatgtatccatacctggatttgggatgaaatacttaatgatctttccattggaaataactggaagtgaagaggttttgttgcttgtacagtgtcagatgaggaacaccactatcttaattttgcgatacactgcatttgctggtgctatttttatacagtgaagcaacagctttgcagcaaaataataaaatacttcttcgttaatcatgtttgttttgatgttaatatttcatttagtaactctgctagtatttgtgaaagtgctaactttaacttacggaaagttactttttaaaaggaaatttaagccagaacaatgcaaagctccaagaaaatgttttctttagtcacaaatctggtttttcttaagccaagatctgtcacctttaacataataaaaaataaatcaccaactttgattttctatcatgcgaggtctgaagaaagaagaggaaagacagaggaaggtggaagttttgatcagtatagcacatggtgtttttaagttgttaaaccacgttcaggtttccacttaagtcatgggaataaaagtggacaaggactgaagctttatgagctcagataatggactctgatagtattctttgcagcttaagcatatttagagtgccaaaagttatttccaagtagctaatacacagcatacgctaaccaactgtaatatgctgataatattggggtggggggtctatatgcacatgcaaatatatatatacatacacacagagcaagaggagataaactcctgtatcattttctcagttactagaggaaaagagaagtattcatatagtaccaccttctggtggtgaataaacagcaaatataaggacttagcaaaagtaggtaggtaaataacatacaaatctttcctgctcctcagctgaagaaacttcattccaagcctctgccagtagccatatcactgctgaactatatctttgtacccttaaatcttaagtattggccaggtgtggtggctcacgcctgtaatcctaccactttgggaggctaaggtgggtggatctcttgagcccaggagtttgagaccagcctgggcaacatggtgaaaccccgtctctacaaaaatataaaaattagcctggcatggtggcatgtgcctctggtcccagctatttgggagtcaggtagaatcactttgtgtctgggaggtcaaggctgcagtgagccaagatcacaccactgtactccagcctgagtgacagtgagaacgcatctcaaaaaaaaaaaagtatccaaggtatcctggatgattgtctatattgcgtaattgtcaatcatgttaattgatctgtctgctttgaaaatagatggggatgagtaataattacatagatttaccctttagttttgaaagttctctagacacatcgattactaccatcatttcacaggtatgaaaggtgataggataagaaatttgttaaatagttgggtggtcgtggtaatgattttcatatttcctggtctactcttaatcagtcccttagcaaattttactataaaaatatttaaatgggacaggcgcggtggctcacgcttgtaatcccagcactttgggaggccgaggcaggcggatcacgaggtcaggagatcgagaccatcctggctaacacggtgaaaccccgtctctactcaaaatacaaaaaaattagccgggcatggtggcgggcgcctgtagtcccaggtacttgggaggctgaggcagaagaatggcatgaaccccacatgcggagcctgcagtgagccaagatgatgccatgcactccagcctgggcaacagagcgagactccgtctcaaaaaaaaaaaaaaaattttaatgggaatctcagggaagagggggaggttgaatgttctaaataaaggtgggaagcaaaagtggccattctagagtatgaaagtccgtgagtggttatagtctctgaagaaggtgggcagttttttatttttcccttttcctgccaaagacacacataacttgctctgtaacaacccctcttttttcaaagagcagaacatttggcaacttgctcttccactatttagaacacagagccaaatccactgtcattgatgtcacagtgctgccaaaaatacaggctttgaatggccctccaaattgactgaatccagggaatttaattttcatgacctcatattccttt

SEQ ID NO: 17302 - DNA, 173791 bp, Human
tctgattacttttctactttctcatacagcttaacacctggaaacaactgtactggagccaccttcccgaaaggtgccagctgtttcctttgtcttaagcacaaacagaactaatgtcacatttccagagaagggtaaggatgaaataaggcgactacaaaccagctttcagaaatgcgaagtcagtcaacgttttcctctctgataaccccttatttgtggagcaacaggagaattacaacacattttggaaaataatttctattggaccaactcctcacttcgctggaagtagtcggatccaagacttaatttcaacacagtgttcgacttattgcttgaagctaccgcagcataaaactcgtcttcgaatggaaaatttgaccaacttctatgaggtaaatgaatagtgaaagtacgggtgggcgggagagacatacaagttttttcggttttttgttttttgggggaagaaagggcgcatacgaaaaaagtcctaagcaagcacagaactgtgtctcttaggatgtaaaaggatgttataccagagagctcaaaagctcccagggtcacggctcccctaaccgagggacttggggtttcactgctaccaggcacccggggaaccccggccttggataaaaagagggtaactggagtaaagccgtgcttctgaacgacccagcgcccaggaccccctgccagaccccgcctttcccgggaccccctcgggagcgcccccgaccgccccgcacgggtcggaggaggaggcagagaggtcccgcgcggacccaggcgcctcccgggccagtcgaggatcaaccaccccggggacccctgccgaggccagcgcaggataaactccccgaccccgaactctgcctgccgcttctcggcgctgggcctcagccacgggttcgaccgtcctcctcaccgcggctcccgcctacctcgcgcctcccggccccgcgacctccccgccgccggccgggccccgccgaggctgcgcttcccgtaaactccccgccccgcgcatccccctcctcgcctcggccccgcccccgcgggaccctgggcggcgcgtgattggcccggccgcgccgtcactctccggccgcgtcgcctccctcgctttccaccgccccaagaccggcagtgagattagtgctcgcggggccgcggcggagtgtaccgtgctgctctactcgctgccattcgcccgcaggtcggcgcgctcgcccacctgagccgcgccggggctgcgggaccgtgggacagcgcgctcagcccagcctaggaaagaggcagcagtctcagcgcggagatggggagcgggcgaagttgacgagtctcccgcccacgctgcgcccctcctgcccagaggtgcgctgcccctccccgaggtgctcgcgcgctgccctgaccccttcctgcgcgggacacccctcccctacccacgggacctgataacttcaccccaagtccagagagtgggctgcgagggcggtgcccggactggacaggactctgcttaaggggagcggtcctggaggctcgccaggagtcggagggcggagacccgctggaaactttatcatcgccgtaattactacgttttactgtttctctccccgcaggggctgcagccagcggtctgtcgcgcgtgcctgtgtgcccgaggagccgccccggggagaagacccggcgcggagttgttcccccagggaggatccgcagcccagccgagggggtcgggcggcctggctacgcaggacccagccccgcagccgcggactcccagcggcggcgaagtttggctgctgagcggcgcggcgccggaccactggacagcgggagcgatgcccgtggggggcctgttgccgctcttcagcagccccgcgggcggcgtcctgggcggggggctcggcggcggcggtggcaggaaggggtcgggccccgccgccctccgcctgacggagaagttcgtgctgctgctggtattcagcgccttcatcacgctctgcttcggggcgatcttcttcctgccagactcctccaagctgctcagcggggtcctgttccactccagccccgccttgcagccggccgccgaccacaagcccgggcccggggcgcgcgccgaggacgcggccgaggggcgagcccggcgccgcgaggagggggcacccggggacccggaggccgccctggaggacaacttggccaggatccgcgaaaaccacgagcgggctctcagggaagccaaggagaccctgcagaagctgcccgaggagatccaaagagacatcctactggagaagaagaaggtggcccaggaccagctgcgtgacaaggcgccgttcagaggcctgcccccggtggacttcgtgcccccaatcggggtggagagccgggagcccgccgacgccgccatccgcgagaaaagggcaaagatcaaagaggtgagtgggccgcgccagaaatccctcccgaccggccgtgtttttcagggagaaacggcaagcctttgaaactctgaagactgcaacaatgcaatgtatggggagatggaggtttgccccttccaccaggtgctgtgtcaaaagctctttcttttcctgtttccaatatagtagtagatgtgtccagtaagatctaaggtcaaatctcgttgcttttaatttgcatgctcttgctctggtgaccacaagccacacgaggtgggtataaatacatgggcaggtaatacgcaaacctcattctctggccgctacacggttaatcgccccaccagtaacagcgacggcactgatcagccccctggtaaggattggggacgtggctttaaagtgagtcttcacgcgtggtaaagctagccagcataccccgggttcagctgtgtggcccttgtctgccaggtggcattctgtgtgtactttcagactataaaggtgaaacctgagaacttcccatcatcgagggatactattgtttacttttttaaaaaatgaaaatataaaaagccagtcggctgcctcttgtatttctaatgcacagccagaaatagggtattccatgtgatgcaacaggtttgcctccacagcagcacaatggtgacaaagttaatccaggataaacatggactttgatacatctttcctaatttccttctcgtaattttcagttagaacttgaaacatgtgattaggtcaggaccagcttaaagctgaagggggccgtaaaaagtcctttcaggctgtcattttcaagatgaagatcgaagggcccagagctctagaacccgttagtgatgagtcaggacttgaagcccgaggtccgaacttcccccagtcacctgtcaccacgcggtctgtggacatgcctcctctctgagctacttccctgtgtgaaacggtgccagcctgcgttttacatagaaaagctgtaggaaccacattaaaagcatgtcattccaaatcttggttcaattttctaaaatatgaatggaagtaatatttttgccatttaaaaaataatacgatctgtgaaaataaatattgtattttcatattgggtaggtaatcaggagaggaagtccctgatcccattttcagagagtaaacagatttttgaggtggttgagaggtgtttagcttaagtggctgcagaatgaaggcagcaggattgtcatgggatttgtgactttgtattataagatcagctgaatttggttaagctgtaattgagcaagttaaagtggacttggatccctttcggtttaggaagaatgtcttcatccttcctatgcagatagcttccttccacagtccatcagcatatctgcttttctgagacccctcctcagggacagaaccctcccatacttgggggaatggattctactttccagaacaactgtctagcagtttcctttctccatgaaatcctgcctgtgctaccaaatcaggaaggtggaacaaagctctacctcttaccaaatcctcccagactccttaataatatccaaccaaaaccataggaaattaacccaaatgatctgtatctgcctgtgtttctgttaaatttgaacggtgtaattcatacatttcatgcctccaaagtcatacgagctgccagttagctagtacaaaaatcacagttgtccgaggaaaagattttaatacgaaagatacatagatgttaagctgttggtactgaccaagagtgattacaagtgcattcagagcagaaccagtggggcagtagcagtctcagactcaggacaacatattaacagtgtgcatatccatccagtagatccatgttgtctgtatgcctaaatcacaaggtcttaattaaccgtgtaaacgagatttacgtagtctctgtctaacatcttagcacctagatgttttgaaaccgctcagtcttgcataaagcagtggaactaaatgtgttctttaaaattccttgttgctgtgagaacccaaaagagccagcataattagctttagtgtttagtcaaaggctaatgggaagaaatggattatgattttccatcagattagttcaggcagatatattcctttgtaaaccaaaagaaaaaaaaaagaaattatgatgctgttctaaaaactgtgctgtaaatatttggctttagagaggcaagagtggttgcccattgtaaatagggcactggactttaactttacgtatttggattcagtttcaggcaccactgtggacattttgttatcaaccagtagatctttgccttagtttttttctttaccattgtgttttcttttctttctttttggagacagagtctggctctgttgcccaggctggagtgcagtggggtgatctcagctcactccaacctctgcctcctgggttcaagcaattctcctgcctcagcctcccaagtagctgggattacaggcacgtgccaccacacccagctaatttttgtatttttagtagagacggggtttcaccatgttggccaggctggtcacgaacttgacctcaagtgatcgacctgcctggcctctcaaagtgctgggattacaggtatgagccaccatgcctgacctgttcctgtattttctaattctctttatacttaggttctctatcacacctgaatgcaccaacacttatagttaaaatttagaaagtgcactcaagtctaacatgttggaagactggattgtaatttgagtcaacctgttattttgtacttggttcaaagtcagtcaatactattttttatatctatggcacatttatgttactagtactgcagtagatttttaacaacttcgtgtcttaggggagatactctgttaatttcaaataggtcattgtacagaatgcttcacaaaaaatgttaaatgctttccactactgatttgatggatgatgaatctttgatgtaaaacttcaaaatagaattaagatcttcctcccttcacctctgttaaaattttgtaaattaaccctgggatttctctgagatttatgatacatacatagtgtatatttattttcatgagtttgatcttaaaattgtactcaggttgtccttagctttaaaaagcagtgttagaataatgaagcacaaaagttaaaatagcagcatggaagttttagaaaaatagtccatttacttttttttttaatcagaaatcatttttagcttcccttctcccccgctccgcccccccctcaacctctcccattttctcaattagcctgtgctgtcctttaggattagaaccttaatccaatttggaggatgactttttttttcgtttttctgaaattaaggggagacctgagtaataggggctggggctaaagacagtcaggttgtcagaggggactcctttcttctcaggctggaatcctcaccaacctaagtgggggttaggggtatgtgcagactggcagccttagatttgtcatgtaaggctttaggaccctgcacctgtggggtcacagttttcttctctcagttctaaaacaagactttagtattttattccagacctatttgtgtaatcatgaatttaaagaacattttcatattgatggctagtagttaaaattcacatttattatactttatgctagccttaggcatatagcctataatttatattaactattgacagtttatacccttttggtaaagatcagatgtgagaataatctgccttggcaggttaaaacaaaacacttttattttgacacttaactttccagtttatttttatgggtagttctggggtggaaaataatatttacaaaataataaaagccatgatttggagacctgacccaagaagcttcaacatccttaggttgcttgcctgtgccactgtgccgtgacacattccctactgaacataggctagtgtgggattgctccacccagaggcccttccccagagcagggaggacatggagtgtttgtgaaggtttttctctccttaacaagtaggttagttttcaacagtttaagtactggagtaggtgctgactgttaatatacaaaagcaaaaaaatacatatatacagtaatgggtagttaattatgttcagcttcattttctgtaagctgttgatagtttctcctagaatattctgtcttcctcttatcaaggcaactgggattcatataaaggagcttcttatgtatatgggacttagaaactagttaaaagtgtgaaaagaggttttaaaaaatattttcaaacaaatgcatctatctgtacttcttaggtgagctaatgaactaaaccatcttgaaaaatttatcttagtattacacaaaatgcatttgtatgagatctgaattggttggaattcattgaagaacttacatatttgaatcagattatttcataagctgtggtggtacaaatttttcattgaagagaattttaagcatgtgtccgaaggtcagaggggaggaatgcctgcagatccgtgtgagggatgagggctgaatacacagggtagatcagaattgcactggaacctggttatacctcctaacccagtcaagcacctgtggtcttttaaatttctttctttataatcttgtgtatgttggtcaaagaagggtttgattagtcaaaataggaacagccactgtgggctccagagatactgtgaaacgagtggcaaaacaacctccccgccaagtagacgaaaataataaacaagatacctgtttggtagtttagggaagagattccctctttgaggaaataagtcttgacttttccctcagtattcttagcctagttccttgcttggtgttcagtgattgaactatatcttatccccacccccaacctctcaatctgttaaaaggccctttacacaaactctgcaaattatgccatgataactttaaatctcagattttaaaactaagtgtatgctccgagtcgtaaggtattgcatctgaatgagatctgagaggtagctcattcattttacagtagaggcaaccaagacacaaagatcattctggaaatcacatcaccagctagtggcagagttgagttgcagagggaagccccagtcttctgtgagtgttgcgcattgtctcccacatggtttgtctcctaaataaaaccccaaagaattgtataaattatccgtgcttactatttgcagaccctaatagagagtacagaaaacatacaattctgcattattataaatttgaccttatactaagttggtggtttttctttttttttttttcagccaacgatggatcaaagtagtttttaagtcaattatagtaatttttaaaaatcttaccagtggcatggtttagaaatcttcttctttgtaaagacacccggggaaagcttgataggacatcttgttttctttataaagatctctccaagaagcacaggcatttgtaatcattcagttaaacattctttatgaggaaaagtggggaagaagaaggaagggagagaagaagagagtgagttactgtatatacaaagggtgaaaggggatcacccagagaagggacatgtgatgactagaagggctgctttaaaattataaatgtgtgtgctcttctgatattgcaccatggataatagaagaatgacagctaacctaaaggatgattgttttaaaagtagacatgtaaaaatcacaccaatctatgggcaattctctccacccaagtaggttctggcgattctcttttgggatgcacttacctgtctctgatccatccatttgaagcaatgtagtggttagaagggtggatctggactcagataacgtgggtctgaatctggcctctaccattctcttgctttgtgaccgtctgcaaattacttaatctctcagaactttagtttcctcatttgtaaaatgaggttaatagtacccactttgttggatcctgaggcttaaatgtgatagtaaagcacttagaatggtatcagacatgaagtgggcacacaacaaatgctgcttgtgattattgctgttactggtcaccacctaaagccatcaagccaagattgcattgatccatatgctgtttaataactcaggaaagtggataatgaagtttcaaaagggtatcaaaaatagttaaaattgagttttagtgcttaaagggatacatttccagttcatcaaaaagatcttccatacctataattttattttgctacggtcaactctgattttctttgatttttaccaaattccaaaaaaacttaagtatctttagaatgatatacttactgcatatacatcttcagcttcttcagaatatatgttaaagaattaatttgtctctttctcatagtcaaatatgcctattcccgcagataccatctttcagagtagtcacagtcgagttatcttaatttctcttttttctaataaataatttttttatttacacaatgcagatcgggtctcactatatttcccgggctggtttcaaagtcctgagctgaagcagtcctcccacctcggcaccccaaagtgttgggattacaggtgtgagccaccatgccttggctgagttatctatcttaagtattgaagttattcttctaaatagagagagagatcgagtaaagtgaatttcaatctgtttcatcttggaggaatgtttttaagaagtgagaattattattttaggcttggcaaaaattatataattatgataaattctataatcagagctcagtccatcacttagtagtcaaagttagcataaatcagttttattttgtagctcagagagtttggtctttttgagaccttcacattgaatttagatttattaggattccagacccactactcattttacacatgagaaataaggcctgtgagctgtgacttcctgagattcccccagtgtacaaacaatagctgagaattgcttcttaggtgttgagaagtactgagaaccaggccccactccacctgggataatcttgactctaatgagaacgtgtgctttggtgactggctgaccaggccctccctcctcctcagccctaaatggcaggccaactgccagaagccccactgagaccatcctagagggaggtgggacgtctttgctgggtaggggattgcctaagaaagcaatactggctaattcctttgctccggagaatgtggcagcagtgccccgcccccactgagttttgataaagacttctgtgatcattaggtacttgaaaaaaaaccaaatgagattaaggcttaagagcatttaaaagtcacagccctcatttctgtcatgaatactctggtagttgctttaggtactttagagctgagcagtcctgcagataatccagaacagagataataaaattgaaaagtacacgtatccttcctgtttacttgacttttgtgactagaatgactccttctcgctcgtgtttctcagtctgctcatctccctggctcttaagtttatcaaaagcccagttcctgatttgctctgctgctttctcatcactcttgctctacatcgttcattcaagtgacactcagaacatattatattaacttttcatttgcattgttcatgtttttatgtgggtcactaattagatcgtcctgtcttgtgtgggagtgtttagtattagcaacttagtatgagagagggcatggagatgaggggataaaaacctgatgaaggacaccaagttctgaaagggtggtttaataacacagcattgctaccctctgaaacaacctttgttgctggtgcctgtttgtctgtgctaggagtttatgagaaagggggtggcagtaattggtgtccgaaggcctgtgaatgactatggccaagacgtgaactcaagccatccatagactacaagctattgctagtgtctccatttctgccaaatccttcctcattaaatggtcttctcaaggtcccttcagaacactcaattcttctaagtgacaggatgatctcagaaataggacaggaggccagggatcctagcctacactgggggtggcatgtccagcttcctgagctgatgtttaggtcatgattgtctgtccctagttcctctttcacgggaatacatgctggagctatgtactaaaaggggagtgtgtttcctcactgtatctctctctgtcggggcataagacaagagaacagacctgtggaatgattagggaagctcaggggtatctacccagtctcaaaatctcattcccagctgccagaaattcaccaccagtgtttcctttttactgtttttgttttgtttttgtttttgagatggagtcttgctctgttgccaaggctggagtgcagtggtgcaatcttgtcttgctgcaacctccgcctcctaggttcaggcgattctcctgcctcagcctcctgagtagctgggattacagacacctgccaccatgcttggctaatttttgtatttttggtagaggcaaggtttccccacattggccaggctagtctcaaattcctgatctcaagtgatccacccaccttggcctcccaaagtgctgggattataggcatgagccaccatgcgtgtccatttattgattcttaaaggcttgctttagaaatagatggataaagttgctcagcagaattattaatattatactttgagatttgtcttatcaaaggatagaataggtttgttgaagcaagtatcttccattgtcttatttcgctttataaactcatgtctgcttgggaaagaaaaatttgaaagcacactagagtagaaaaaaaaaaacaaatccttcatagttttatcagtcactaagtagtgtcaatgatgctcctccctaaccccaatatgtaagttcgttcccaccccccgacgccgggttataaccacactatatatactttttgtttttcattttctttgcaagtgtcattttatgttggcacagtatatccatgtcaaaacatgatactttatttaaccagtcccttggacctgaacatttagattatttccacttttttgtttttattaaaaatgctgagacagacagctttgtccagtaaatttgtgtctcactttttattgcacacaccctggtaagtgggattttctcttaaattcttaagaggggaaataaattggccaacagatagtacattttgagggataactttccagaaaccatttatactcccatgtgtcatataatgaatggagtctgttgattctttgtgaatttcataagtgatgaagcagtatatggcattttcagtttgcttttctttgatcaacactttctcctgtgttgatcatttgcatttcttccttgtgagttgtatagatagaacaaggaaattttgaaaggaggaagatagagaagatggcagagcttggaggcctaaggagtgaaatccaccaggggagatggatctggcaagccggctcaatgaacgtggactcctgtgggaggcaaagtcctgaaggcgagagttaggattttataaagcaaagttgcaagaaaaaaaatttttcccctagattgcacacttagaataaaatatcctttattgataggagctcttaccaggcacttgggacagcccacatccttcagctgagacctagccagctttaccagcgcatcttcatttttaagtgacagttgggattttgcctcagatacttgaggaaggtattgacctctctggagatctgcggaaggatctttctccttttggaatgaatcaggatgcttttctaatagttgaagatcaaaagtagtccaaatagaatttcagaagtgattttaatgatgccagaaaatggcaagtcttacacagctgaattcttaaagaagaaaaattaaccaaaaggaaatcatgagatttcctagaaatatttgttcttatgtgtgaagaggcaggctaatcttttgtatgtgagaggccttcagtgttgtaaataggataaatatgcattttgtcaaagatattttatttttaaagaaaagcatgatattttgtgtgtgaagtttgggcttttttttttccaccctaaatccttcaaatgtttttagtcatgttttttaagatagtgaagagctgcatatttcaaaatgtatttatattctgaccttggttcataaaagtctgccaagcgccagaactatttaaatttggctataacactgtgttaacgtgatgaataacgattgacataaatgtactatattatttttataaattgtggttagacatgatagtaattttagaatatttacagtgctatttttggagactttttttttttttttagtcaactagcagtgttgaatgttttatctagccaactacaggttttcagctcataattagaaatgcctgagaagtccatattgtgatttaaggagttattagcccaagtcagcaattttataaggcattcttattaggaagtataaaatgaactttatgtagtaaaaaacgtattttataattggcatatatctaatgcattgtatacattcactcatattaagcattttggttagtcttcattatttaatcctcctgtggttacttaacatagaatgtgtaatgaagaactcagtagctttaaaggtggggtggttgaggagaatagaaaatgaaggtgatttattaactactgttgaaagctgctttagcagttagggtgaataaaaatgatgatttattaagtattccatcagtaataagataaagccacagtgtagggttggaagtacttctgttttccctaactcccaagaatacagaatttctatgacattggctctttgcagtcgtccgtcccttccagaactatcatattgagggcaggagaaagagcttcccctattcatccatgtgtccaacagatcagttagctctgggccctgcccataatagggcccagtatgtatttgttgaatgaatatgctctttgaaataaacatgcctacaggagttactcaggttaagtgtgatttcgcgctaagtaatctggtattccagaagtggtgtccgctcatctttgaagtcctttctaatgtatatactcatgggctacaagtctttgtctttttgattttttttttttacaacagtcagaagtcatttagaatcagacctagtgaataaagagactaatgaatataggaaatgccttttccagttttcaagttgttttccagaatgatttataaaatgaaaactgcattcattttcttatatgactgtaaactggtgaaagtggtgccaaaaacaaaaaaaaatcttttgaccaaatacaacactgctgaaataaatgtagatgattgtgagattcctttaaaggtcaacactcgaatataaagattctgttattttattgaaaagtgtttatatctacagccagtattttttttttagatatgttatttttaaagtaggtagagtcttcatttattttctttattacctagaatactggacagtatttaataagggttgccatttttcttgtatttcaattttatacaggatatacctagagttggttttgttttgtttccattttggcaaaattttttgagagataaaggtgtcttaatgagtaatgcttacagtaccacactaaaatgaaaagtcataggttagctattattttccactagagaaatcagaattacataaacatgttcctccctaagaaggtgtgatattttgagaaagagaaagaagcttggttttctatttcccaatttcatattgtttctcctgaaaagtgctgtgtcatataaataattgcatggtagaggctcaatgaattttatgcatttgtcagtggtcccttttgcagtttattctacagatgactattaatattcctaaaacatcacttctctcgtattgcccaactcaggttttaatggtcctccatttcctataaagtaatgattcagacttcaacatgcatcagaatcacctggagggcatgttaaaacagattgctggtgccgggcgcagtggctcacacctgtaatcccagcactttgggaggccgaagggaggatcacttgaggccaggaattcaagaccagcctggccaacgtggtaaaaccctgtctctacgaaaaatacaaaaactagccaggtgtggtggcgtgagcctgtagtcccagctactcgggaggctgaggcagaagaatcacttgaacccaggaggcggaggttgcagtgaaccgagattgtgccactgcactccagcctgggtgacagagtgagactctgtctcaaaaaaaataataataaaaaaattttgaaagcctggagtttctgattcagtaggcctgggtgggccccagaatttgcatttttagcatgttgctaggtgatactgatgcttctggtccagtgacttcagctagaaaaacattttgctctagaatgaagtcacagtgaagtcacaaatgtttagcttggcatccgtagtcttctgtaaatctgcatcagtttatttgttgagttgtatctctgttacttcccaggaaggactgtgcttccacaaaacttacatagttactatctccagaacacatgtcgtttaggatttcaccttgtttactttatggttctcaaaaggagagtcttctcacttgctcaaaatccatgtcctcatgaagccctctctacactctcaaccttcactgatttctcccttctccaaattcccatgttattgattatttctatctttggcctgtgtgtcactgattttgtgtgcatatatgttatctttcaagtagatttcagacaccctagaagtggggacaccttttttatctcataggtccgtggcccagaatttgacaataaaaggcaattcatcctaaatgtaacccagattaagtatatcaacaaaatgttttataaatgtgaggcagtatggcagagtagaaacacttctgtcctccctttccacgcctttgaaatggagttaataattcctctttttcagagttgttgtaagaattaaaatagaaaatgtatgtgaatctctcagcgcaatgcctggcatgtatcattcattattcaatacatagtatgtacttactagcagctaggaattggtaggagtgataaggaaaggggttggtaggtaaattggattcagaaagtcatttccaggaaagaaaagtatgttttggctgcagtattgctgtattgaccaatagcttctattttctattgttgcctccccttttagttgttgttgccaaatttctcacttcctatggcaggaaagtaagcattattttgccttgttagaattgttattacacagaagggatgctcatcctcaggaaaaccatagagagggtgttgaatggagtggttcctcattcattcatcagtgtccagttacttctgacttctgggcctgctgtcacacaacactcagatatgtggggaggaaagaaagccagggataaagaaatctggagaaataccttcagggcatagaaagaaataatttttgtgagctgaaaagctgaaaatgtttcattcagagataactacatgtgtaaatttagctcaataattaggcatatggtgctttcattttaggatgtatccaccctttgtgataatatccgttgattattagagctgctgcagctttaactacattggcagcagagattcctagtgcatttaagacaagaattcaagagtgaaatggaaaactgaattaataatttgttcttgggtggttttaatctgctccttaaatgtagtttatgcctggaggattagatttggaaacagaacaccaactaatgttctaaaagtttacttccttttattggaacattatactcttaaagattttcagaagaacattttggctgttttagtcttaacatacgaggtacacttaagttcttatgattcaacctaaaacaatagaaagcttttaatctatgatataatttttaacttttaaagtatttcatgttagacttcaaggcaggaattgtttaataaaaaccaactaataaaaggaaagatattctttgttgggcacgaggatatttgggtctcttttcccaagctttttaaaatccccctaggtctatatttttcaatcttagaatttaaaatctgcttgctgttgatggtaaagaaaataggaaaattaaaatcaaaggttatttctgtttacttcccataccttgtcaaatgtttctaaaattgatcgaaaataaaccattgtaattttataaattgaaaaaagagttatattccaagatatagcatagtaggatgagctgaaataggaagtttaaaacaggtgtctttgggagagttggggatggtgatgctttccatctgcttcttgcttaaagctttaactacggtcctattagaatatacctgagagtctgggaagtcagtgtatttgcttctgtggttgtagttctccacccacctgtgatctgaagaattacaccctaggtttttataaggtaaaggcactagaatttagacatttagaagggacttctttgaaaactaggaagaagatgggcaaagtataataccaggtattggtctgagttaaccaggagtagattatttattagaaaactagtctgaatttatgtattcttgataaatacaggttttgacagaaattctccacttttgactgatctggtaatagaggttgaggattttatagccagatatgctgcaggtaatcaggtgttagttctagcttaataattagcttaatttagtattagctgtctttttctgtggtactttacccatgctcttaatcatcttccatccttcagtgtgttctgctggagagaggcggtactaatggtgcaaaggcagacatcaggagagttgcagaagtggtattatatatgttacacacgtcagaagactagtcaccttaatactcagtaattgactatgattggcagcagggaatgagcagccctctcgcttcctggaaccttgagaggtgaattccatacattaccactggtgttcagaaggatcacctttttctgacctgtgggcactcactcctaccttttagaattcctgagggaggaagctgtctagttatatgattagttagcatatttgtggacctttaattatcaatagaattgctcgaaagctgtcttaggaagtaatgcctttgattgatttgaaatctcatgcatcacccgtgttgctagtgttttccaaaacactgagggatttttgcagacagcattttcaggggctgatttgaaggtaataaaccaaactggcagggagggagggttcttcctccacctcagggtgagatctctgctcctttactttactctggagtgccctgtcttcacaaaccccgggggcacacaacacattagtagccataagtgtctgttgtgtgttatgcagcccggagtcttccactggtatataccaagtccccaagttagatatttctcttttaaaaagaattttgccttcatatttaaaataaaaattatattcctcaattggctttttttttttttttcttgagatggagttttgctcttgtcgcccaggctggagtgcagtggcatgatctcagctcactgcagcctcagcctctggagtagctgggattacaggtgcccgccaccacgcccagctaatttttgtatttttggtagagaccaggtttcaccatgttggccaggctggtctccaactcctgacctcaggtgatcctcccaccttggcctcccaaagcgctgggattacaggcgtgagccaccgtgcccggccagttggctcttaaacctcagctattaatttccaagtatttttggtttatgaataacaacagcaataatagcaatgtctgataattttctctttttctctaggtttaaaacagaggcaacagttaaaactatacttttaataaaaagtgcagcttctcagttatactccatcatgtattccctttttctcctaatagaatgtgtttgttattcttcctgttctgagagtggctccttaattgattttataccatcagttagtgttattatatataattaaggaaatcaataatgagatttttaaaatatcatcttggcatagattttgtctcctttatctgcagttttaattctggaatggtgaaaagtatgccagtaactacaggataccatttgttgagtgttcacttcctattagatactatgctcaccactttatgtacatattctcattaaattctcagaacaacaagtatttggtttttctcagaatatgggtatttgacattattctcctcattttatacataggaaattgaagccaggaaggggcaagcaaattgcccagggtcgagcagctcctgcgaggttgaaatccaggtctgtctggtccctgcccccaccctcttcttgtgcactcatctctgctgggttccccatatcccctggggccttggcaggctcagatcttacccaccttgaataaagaatcaggactcctgttgcagtcactcctctgcctgagaaggaagtaaagggaagtgaggtgaggactggcacaatttccaccccagcttgtggcagacaacatgctttaattctgaaagcaacaccaatgctcagtttgtttggaaaagcctctcaagagtaatattgtgctcaacttaacaactatatttactagtatgtgttcatgtatgtttatatccccttgattatatatatatatatatatatatatatatatgcataatatgtacatggttatgtgcgtgtatataattatctaaaataataccttaagcattaatgaaagttattgggggttctggaaagttgtttaaatcaagagaaaaacaattgtcactggaagaaacaaatctaaatttgcttcctttattctccctcatcttggggcaactatgactcctaaagtttaggatacataatgttacaattatttaatttttaagcaagagattctataaagtgtgaccacattaacaaaaatgcagtatgaattttaaattcacagtgaggtatatcaccaaaaagaattctatgagtcaaaataatatgttgttactgacttgacagtcaagttgtatatagaagtgacaacaaaggctctgtttaattgatcttaagagatccggacagtataactctttctgcaaatggggcgatacagttatcattcaaacccaaataatttttttttaattttaatattttcctttaataaatcagattaagaatcacttccaacaaccctcctacaaatatttagaagtaccaccctgtgcaaggcactggagagatgacagtaaacaagaccattatcaccactgcccacatggagcccaaaggggtagagagtaaggaggccctgtgacaagtaccctgggaggggcctagagttactatgggaacctggagtagaacataactctggcagattagggggttcaggaacactttctaaatgaagtaaagtattagacctgaggatgagtgggaattagccggttgcaggcaagatgaagagggccgcaggataggaatggaatgtatgaaggtccccagggcagccagaggactgagccagagtagtagtgctgagaagaggaagtgggccacagaaatgaagcagagaaggcgtctgaccaggtgtttagactttatcctgagatcatcaggaaccatgggagggtttcaagttgcagaaataatatcaaatctgcatttttggataagactggagtccaggacatgtgttagaaggctcggcagtaatccaggtgagagatgaggatggcctaaatgcataaaggggtagtgaagatagagaaagtgaacagatccttgagatacttaaaaccggaatttatagaactttgtgggcacttaaaaatggagagtgagagaggaaatggagataaagaggttcttgggttcctgattgggtcacgggttttctgatggttggaatcgtcaggagagagagaggagtggagaggggtaatggatgtggtttaggatatgtggcattagaggagaaagatgtccaattggaggtctcttgtgagcagttggatgtatacaacaagcactgcaaagagaagtctaggctagagatgccaatcttgaggccatcaaactatggaaataaataagatctattagggataatgtgtcctgtacaaagagtcaagggcttagaagcccaaggaacatcaacatttacaggatgtgcagagtaagtggtgacagagaaggagcaatcagagagatgcaggaagaaaactggcagagtgtggcactctggagcatttttagatattcagtatttgaaggagtgagtctcagcagtgtcaaatgctgctgagagtcaagataaggactaagaagtgttctgtggatttggtaagaagcaggtagaagatgacccttactggggctgattcagtgcagtattcagggtagcagctgtattgcagtggagctaaggaagggcacagactattctttcaagaaggtaactgtgaacgaggccagagaggtggggtggtagctgcaggatgacaaggggcaatgagaaggctgagtaaagaaacagaatacttgctgggcactgctgagcacacagttggagccggcagctggccccctctgctcactcgtttgatttttccttagcgggattcaaccactctgccatatttggacaaggcaaacaagtagattgacctatcaaggaagacacatgttcccaagtgcttttttgagaatctgatacaagagatcatttgttagtaagaatgtaaatccacttaatttggagtcagtgggtgggggggggatatttattataaaaaggaatctctcatggatttaggtgaagacctcacagaacctggaattacaaatgtgaaggtacagggaaccaagactgctattcctcatttcttactctgggctacttagtcttttgtcttcagtcatacatgctttattctttcctctgcagacaggctgtcttatgaatcagtactcaagtttacatagccaataagtttaaacactaatagactttgtaataagcatctcagaggctcaattccaaattcccagaatggagaatctgacccagctttagttaagtgtctaatcatctatggccaggggggtggagtattgatttttagtgcaaatgtaggcatggcacagagcctcctaagtgacagaaagaagaggattgcctggctgcacagaggttttctggcatctctgctgcatccagacatctgctttgctgtatttatcttattgaaaatttctctgttgtgggcctacttgtcagaggcaagttgtccagagttctgctatatattcattatggaaggttttaccttattgaaatgacagttccccacctttagcattttatattgttccattaactgtcatacaaacattcctgcaaaatatcagttcaggaaccaaacttactttccctgagatggtaaccgtttcacagcctctcatattgctgcttcattatgtgatgaagtctaaacacgtaaatggtgaccagttaaaacacacacctgcacacatcaaatcaagaatttgattccaaatttacaaaataatcaggtcttatcttttgaaatcctacctgtctatcaagacccaatttaaatcttattcattccataaattcttgcctgttcttatcccctgaacagcagaaaattatttttctctgtttttatgactcactttgttttaacctacttactactttcttagtgttaaaggcagcacacacaaaggcactgagatgagagagcttgtggctttgccacttattaacagtccaaccctgtgaagatatacagtgcatttgagctttatctcttacctgtgagagtgatgataatgcctacctttcctggatgtgaggagccagcaagtgagcggatgcacaactgtttgcatgctaggaaacctttgcagatattgattacttaaggaaatagttttggggtttgaagaccgggtttctaaatccctgtctgccacttggtaattcatggtgtggcagtgggtgacttactgttcttcttgggcatgttgtgtggtgtgttttctttcattgctctaacaaattatcacagagtgacttaaaacaatacaaattaatatcttacagttctaggtcagagtcagagtggccttgtttggtttctctgcactgagtctcataaggccaaaaatgagctgtcagctggcccaggctcttctctggctctgggggagaatctgttttacaagctcattcaggttgttggcaaaattcagttccttgccaactgtagaactaaggtccccatttccttgctgtcagtcgactctcagtttctgaaggccacctgcattcttcgtcagtttgctcccttcattttcttttcattcattcattcatttagacaaaaattgtatatatttatggtgtacacatttcaaaatatgtaaccattgtggaatggccaaattcagctaatcaccatatctgttacctcacatacttaccatttcttttggtgggagcacttaaaatttactttcttagcagttttcaagtatacagtacagtgttcttagctatagtcaccatgttttactaccatcttaaaaatatggaatgtagcctggccaacatggtgaaaccccatctctattaaaaatacaaaaattagccagacatggtggtgcatgcctgtaatcccagctccttgggaggatgaggcaggagaatcgcctgaacccacgaggtggagattgcagtgagccaagattgagccactgcactccagcctgggcgacagagcgagaccctgtctcaaaaaaaaaaaaaaaacaaaaaaaaaaaacggaatgcttcataaatttgcacatgatccttgcggaggggccgtgctaatcttctctgtgttgttccagtgttcatacatgttgacaaagcaagaactgaacactcctttttcaaaccagcaacatcacatggagtcctgttcagctgaatctctgactttccattctgctgcatctcttctgcccccagctgaagaatgttctttgcatttaagggcccacttattagattgggcccacctggataatccaggttgctctttaagggcaacttaattgttcttaagtaactttcatcatacctgccaactccctttgccatgtgaaataacatgtgcacaggtctggggattacagcatggaaatatttggggtagggtggtcattcactctgcttaccacttttggtactatgtatgtgtacagtgtgtgaagtcaagcacagtcacttgcatacgtagagctactcaacagtcagtggtaaatcatgtggtcttgatatggttaggctttgtgtcctcacccatatctcatttgaattgtaatccccataatccccacaatccccacgtgtcaagggagaggccaggtggaggtaattgaatcacggaggcagtttcccccatgctgtgctcttgatagtgagttctcacaagatctgatggttttataaggggctcttccttccctgccttgcttcaccttccaccatgattgtaagtttcctgtggcctccccagccatgctgaactgtgagtccatgagccctctttcctttgtaaattacctagtctccagaagttgtttataacagtgtgaaaacagactaatagaggtataatgtacatggatgcactttggtcaagagtaggccaaggcaggcatccgagcctgcatgactcagtgagtttagggcacaggtgcatactccatttgttataaccggtttgtgtaagtttgtacttggttctggaccactattgtctgtaaaaggtataactgtcctgctgacgctatacaggtgctcgtgcccagagaaagagagagctagagctgtccgtcttttccgtctttgcagacggacagtgaggagccaggacacagctcggcctgcttatgtccagagagagaaagagttaagctgctgaccctgaaggcagggagagccacccacacaggtatacgtgggagcagccggctcaagcagccgagacagagcagaaagtgtaagagagatgctgaataaagctgtatttcacctatctacggcccctgagtgttctttcagctatctgccattcatccacccactcccctcggacctcagcatgggctggaacctgaccctggacctaacaacaggtctgttgctgtgatttatgttcaacaaacataaactgttacccaagagatattttgtgcctcaggttgctggtaggagtaatgcaaatcaaaagaagctaggttgatagtcatacagtagttcctttgtatagtaacttctagtatatgcaaatagagaaggcaagcaaacatgctgtatccacatgtagggaatattgatcaataggaagaatattccatttttttcttaggacttttgttgaagcctttgacaaactatcttatttcaattccattattgttcgtattctgggctcaataggggtatttaaagtacccagtgttgtaagactactgaaaatccacatccccctgcccccggcgacggagtattgttctgtcacgttggggtgcagtggtgcaatctcaactcactgtaacctctgcctcctgggttcaagcgattctcctgcctcagcctcctgagtagctgggattacaggtgcatgccaccacacctggctaatttttgtatttttattagagacggggcttcacatgttagccaggctggtctcaaacttctgacctcaagtgatccacccacctcggcctcccaaagtgctgggattataggtgtgagccaccatgtcttgccagactactgaaaatcttgaatgaaaaataattctaatttttgtttattcaccctgcatcttagcaggtatagtgtaaaagttaggagcaaaaactctagagccagactccctaattctgatttcccgctctttgatgtgtccagtgaacttgggcaagttacttaacctccctatacctcagttttgtcatctgttaaggtaaatataggcccaactttgtggagttattattgaggattaaattaaatgtgttgatatatgtaaagtgtctggaattgtaactactatatagtgctgtgtgagtcttaggattattattttaattgaataatatgctttaaccattggctctaaactaaggctgttttgcttcccagggtacatttgccagtgtctggagataagggttgtcacatctgttggggtgagatacagacatctagtgtatacaggccagggacaccactctgcgtccaaaaatgcacaaggctgccctccccaaccccccaaacacaggcttatccagcccgaatttcagtagtgtcaagattaaaagccccagtttaaaccagtggccttttatttttttagtaacaacttcattgtcaaataaaatattcatgtatcatgagtgacttttaacaatgaggaaattcatgactgagagccatagggctctgagttctacaataaagtgaaaagtagaaaataattgttctggtgattataaaaagagatatcacaggaaaagagtgtgcttaacttctagaatatataattaagggtaagaaatactctgatcctgtgaatcattgaatgggagttctcattttctaattttccagtgaggttcttctggagattataaggatgaaattacaggtgacccttgaacaatgcagggattggggcaccaacccctcatgcagttgaaaacctgcgtataactttcgattcccccccaaacttaactaccaatagcctactgctgaccggaagccttactgactaaacataagcagtcagttaacacgtattttgtatgttatatgtatgatatactgtattattatggcaaagtaagctatagaaaagaaaatgttatttaaaaaattgttagaaaatatatttattcaggtggaagtgagtcatcataaatgtcttcattccttgtcttcgtgttgagtaggctgaggaggaggaagaggagaggtgttcatgctgtctcaggcagaggtggaagaaaatccaagtataaacagactcccacagttcaaacccatgttgttcaagggtcagctgtacttggatttggaaacttgctgttactgtgtatgttgaaacacagtgagagttaagataactatgcattacagttgcttatgtggaatttacctatattgtagtagtggtaaattttgcaagtccccaaatgtttttgccactgttatttttatttctgaatattatataaggcttatgtgtttgctctcttcactccgtctcatcccgtaggtatattgaataatttagaatttagggtattcttcaactacttttttctccaccacctctcctatcaattttagctatttgatttgtccatacaagattctgtaggactatctgagactctgttcattcttgtggttacagaatttgtccttttgatgataggtcacttaatcatcaacacttgcatgaccacagggtgcagaagctgttgagactgacatcctggatcatgtaggaaagaacctgggcacattcccataccttccactctgttaacctacttggagaaactgaaaatcacaagacacaaacaaaaataacctgcagttgttcatcattaagattaagcagaacactgatatgttgggcatcaactaagtgctaaaaatacttgataattgattacatgatacaattgctaagtattggttaaaaaaaatatgagattgtgatcatattagaaatacatttgtctcatggtatttaacaaatttgtggcttacatcaatatggcaaaaggaaggtgttaattgcagcgaggatgataaccactgcatcatttttgggtcattgtattacaactttgaatctataggcataaagggaaacacactgactccttatttaaaaggaagaaacaaaacctttttgattcagatcatgtctgccatatttttaaattagggctagaacctgggaaaagcagcttacagcagaactacattttataatgcgatcttttgttcaatttgactagtttgtttttctgacactctctaaagtggtgtaacagtgataagtacttcttcacagactttgtaattaagagagatcagccttaaatataattggcacctttcaagggtttgggcaaagtccagccagtgtcctgtgatgtcagggtattagaacagagaacgtcttctgtcagccaccaccttgctgtgggctcagttatgtgctgagcaccacatcaaagacccagctacgtagcggttgaaaactagttaaggccttccttctactttgaaatgattgttacccacagcttggtttgctacttcctaattcagagccttatgctgaagacatttttggaaaaaactcaacagttttatcagtgaaatatggggaaatacttaagtgtcttcatcaataattagttgatctggggaaaagagacggattaaacactggggaagagagacttggattatagtgaatcagtgtctatgtatattatataatttctataaataggactggccgagtagtagcaaatagcacacacaggaccatgtttcttgcctcgtttcggtgtacatagtggcattttattgtggtactctggaccagtgactagagggtcccaaagactagagctcatactaggaagacaattcctttacaataggtggttaccattagttctgcgaatagaacggagatctgagtctggattccaaagaatactggcaaggcatatcatagtagtaattggtctaagctgagcagggcccagtactgagagggtcaagcctaggagaagaaaaaaagcagaaatggaaccagaatgacaacacttagtaatgtggataagatcatcacagacatacagctgtacaccagtgagctccttgtggacaggaattgaatgcagtataggccatgtagctgtgggtgctcaagatgattgtggaaggaatgaatggttctgcctggcacaaaggaacatgggaatggcatttggtctggagagtccagtactaggacaggttccaccctgctgcccaactgaatctcttagggaatttgctttctgcctggctcaggaagctgtgatctccttccttctctgtgagttctataggagtgggccactgttatggagggctgcggcccctggaacatttttaccattgctcaaagtaaacatttgcagggccggggcggtggctcatgcctgtaatcccagcactttgggaggctgaggtgggtggatcccttgaggttaggagttcaagaccagtctggccaacatgtcaaaatcctgtccctactaaaaatactaaaaattagcgaggcatggtggtacatgcctgtagtcccacctacttgggaggctgaggcaggagaattgcttgagcccaggaggttgaggctgcggtgagctgagattgtgccactgtactccagcctgggagacagagcaagaccctgtctcaaaaaaaaaaaaaaaaaaattgcaggccatgtagtcaatccactagatttcaggaccttggttctttgtcagtaaaattcaaaggtgagtagttagttgttgggaaggtgaccttctgagacaggaccaaggaagcaggcgagagggacagatccttcataaatcctgacagaggatcctgtagaaggtaaaatatccttctggtttggaggagcattttacacaaggatattttaaatcaagttagagagtcctaagccaaggacagcattttatattcagtactgggaaggtattttctgtcaatggtagaaggtcatacttctctgtttggaacaacagtcttgtttccagaaatgaaggatatggaattctaatattgttcaaacattgaaaagaaaacagtgtgagagagtcagtttatatggaaatcgatagtagaagatcacaagtatactgacctattttaaataagatttcatgtagttacagtaaaactttggggagaaagttgtattctttcacgtatacatatttgagagtccaaaattttacatttgagaaagagaaattgtaattcagctatgataccctgtaaaattaggtaaaaattaaacatttcaaatagtattatcagttttgctgactagaaacgtagtatttaatgcaagtactattataaaatattttttaacaagacccccttttcacaaagctgaagctgtttaatgttattaacagagtggtatgtaattattggggtaattcagtttttactagcactacagataaattgtattatagaagatgccttaatatttgaggtttataccaagaaatatagccttctttgataacaatatttacttgaataatttatttgattttggtcaaatattttacttttttcaaagaaagtggagaaaaactcctcaaattattccatgatgttgctgttttctgagtgaatcctggaaccccgaccacatacctctttttttttttgtttttaaccgtttgtgccttcccccaagcccacatcagtctttaaaacttaatcagaggacttggctactgtaatttttttggtaaatcatactatttattattacacagttgtcactgtcaaacctttagagtagtttcagctgccaaataatatgaaaaatactgcagagaaaaacttctgttttctcaaattggggcaatagtacatagcccagttttgagctgatcactctagttttaaaaaaacaaccagagtataactacttaaatgctaaatgccttagtgattggtggtggttcaaactttagtttgaactttaaacacaactggctgacccatccttaagagaagatactggccgggcacagtggctcatgcctgtaatcccagcactttgggaggcggaggcaggcagatcacgaggtaaagagtctgagaccagcctggccaacatagtgaaacctcgtctgtactaaaaatacaaaaattagccaggcgtggtggtgagcgcctgtagtcccagccacttgggaggctgaagcagaagaatcacttgaacccaggaggcagaggttgcactgagccaagattgtgccactgcactccaccctggggacacagcaagactccgtctcttaaaaaaaaaaagaagataccactgcagttctcctggcttttaattcatttatgacagcagaacaaccactgcgacagcatatctgcatgtgccacaccttttttcaaggcagaaggaagagggaaagcaaagatacccattgaccttgacaaaagtcccattggctggaactttgaccaatagccacttctagctgtgaagaggccaggaaagaacattaggcttttacagttgtcagtttcagcaagaagcaaaggaaaaagaggtttggttgtggggtaaatatatctatattatctgcagtaggtctaatatatattcatatttttattattgttttgcagctttgtgtagtcttttggaataataaaacaatttcacctctgctgacaaacttgacatttcttttacttcctaaatttatggcggtctttgcccaatttttaagccataaaatagctgaagaaaattggaagtcattgcattcaaagctcatattaagtaatgcagtctattttaacaggttgctgaatctggcatatatttattgctggccacttgccatccatcaacaatagaatgaatgatgatgatgatgatgattattattattattattattattattatttttaccattttgaagaaaaaaaatcaggctctatcagattttaaaaccctaccagaagggttagagtaatgcatttgcaggcccaggaaatatttgccatcacttacaaaatacctcagatgatcttcagtccatagaaaatatgattttagggtggtaatgatacaggcatattagatgttagtgcttgccttaaagatggtactgtatcacatatagtctaaaataatcatttgccatttttagtgataatcttagtaatgtagaagtctagatgaaaccatagaagagagctttgaaaaataatccatatctcagtactttttttctgcatgtgtttaatgagaaatctgatattgccatttagtggcaatgtttagagtattattgacattcaagctagtaatattgagcaatatgtctcttttcagtaacacaaaatgaaattattagggtgttcttttggtgatgaaatacaatcctcaatgaaaccaagactcatggtgatgaaagaacccgtgtaggatgcccaagtagaggtgaacagatacctttcaaaggaaagaacttttagctattaaaatgtatgtaaagcaaagttctgtttcagtatatgtcaggtaactttttccctacagggtacagaagtaagagatactcatattttcacttttttaatatagcagtacatttaatgctttccctgtatctgcaaggttttcaaaaaaagaaagattggaagttggttttgcatgtcatgtttctgaaagcctcactcttaaacataatgtaaatttttccagaataatgagataagtaacagaaacatacaaagatatatatcaacagcacatgagtaacactttatttggaagccaagtttcccccagattgcatgggtcacacatttggctcaggacagtgtacaaggtaatatatgttaggcttcagactcaatctgagttcatagccaacctccaccaccaagatctgatgttgggaaaattactttacctcttgatttcttcatctgtgcaatgggactctctctggggagactaccttccttgcagagttgttgtaagggatgagcggagaaatgctttacatacttcctgatgtgtaagtgttcagtaaatgctatttctgtgacaaggatgatgataagaaaatacatttttgggacacaccaattatggattttaagtcttgtggaatcactagttgctactccaagattatccttaggaaccagcatttctggtagtattacatttcataagtaaagtccttttatacatttttattattgttatgcccagataataatttgtaaaactgttatcagcagtatgaaaggattactttcagaatcttacaagatcatggattctagatgacaacggatattccacttattaataatggacaattttaaggacagttacttcagaaggttttttttgttttttttttaggaaaaacaaattttcctataatatgtgacattttatggccaatctatttttatgaattctaccttcaaataataataacttacagaattacaattcataatcctttaattaagaaaatagtgatttctggccttaattcaaaaaggaaatgcttatactgtgcaagtctcttctttaacagctttattcataattgccaaaacttggaagcaacaaagatgttcctcaataggtaaatggataattaaactgcagtatatccagacaatggaatattattcagcactaaaaagaaatattattcaacactaaaaagaaatgagccatcaagcaataaaagggcatggaggtaccttaaatgcatgttgctaagtgaaagaagtaacatggctacaatataaaaggctacgtattttgtgattccaattatattttggatgaaacaaaactatgcagacagtaaattactggggattggagagagggatgaataagcacaacatagaggattttcatggcagtgaaaatactctatgatactatggtagtaaatacatgccattatacattgtcaaaaccattgaaatatacaacactaagagtgagccttaatgtaaatcatggactttgggtggtaatgatgtgtcagtgtaggtccatcagttgtaataagcgtacgattctcgtgcgtaatgttgatagtgaggaggttgtgcctttggggtacagaggatatataggaactttgtactttccactcagttttgctgtgcatctaaaacttctgtttaaaaaaaagtctgttttagaaaacatacacacacaaaagaaaggataaaagggaaatacttgtgccctacaattctcctcttgctaactgaagaatggggcttgactctagggatagcttgtttcaaaaaaaaaaaaaaagaataataataataaaaaaatgtaatttaaaaaggtaactatatctgactttgctcattttaatgaaattcaagctaattcattttcatcgatcactaaataattagtaactttattaactactagtaatactagtgataacctcatagtatttgtaaagtttaaaaaaggaatctaaaagaaaaagcttagtctttataaggttgacaaatctataaacaaatcttttaaagatagcacatttcaattttaaaaatcattttgtcactgctgcaaaaattaaaatgtgaaaatttgaagttgtggaatgatatatgtatgagttagaatgtttgggcttacctttttattacaagtattaaaaaaaaacttttgagattagacattacatgaaaatagtatttgttttctatggcacacttttttagctctccttaggatattaagggagcatctgtgatatcccagcaaggaatacctttttttggctgggcatggtggctcactcctgtaatcccagcattttgggaggccaaggtgggcagatcacctgagctcaggagttcgagaccagcctggctaacatggcgaaaccccgtctctactaaaaatacaaaaattagccaggcacctgtaattccagctgctcaggaggctgaggcaggacaatcgcttgaacgcgggaggtggagattgcagtgagccaagatcgcgccactgcattccagcctgggcaacaagagcaaaactccatctcaaaaaaaaaaaaaaaaaaacccacaaaaatgaatatctttttctcttgatcactaaagatctgtagttgctgatgcttcccatgttgggaaagccctgtaagatcttggcctggggaccaagtgagggagatcacctgtcaccacaggcctgcaaggggtcacttgctggcctcacattgaccacagaggtcttagcacagctaatctaatgaattcaaagtttccgtgttaattaaaaatctgccgaataaacagaccaaaaaccctgaggttaaacctttaaacacaaagtgacaacttctgaactcagtgacagcttctgcctggagaccatagtcatcaaccacaagacagatatttttgataaggaaataactacaaatggtagaccctaagctgatgccaaactgttctatgtaaggaaagtgttctcagcaatagtgcttccttccaaaaaggaatggactagatattcacctatgaataagcccttttctgacctctaacttttgagttgctaaattataatcccttagaatgttttagagaaatggacttatattttggtcaagtatttctttattctttttcttttcccctgtaccctctgccatttggtaacagcacaagagtttttataaaataatgtcaaaatttggccataaaaaaagagaaccattaaatgcatatgatccaatttttttagctagaactggaaacactgggttttccttaggagaacgagatacttcttagaaacagaacaatctgtccattacaagtagtgattactagaattctcattttttaaaactggctttatcagtcattctgactctttttctaaagaaattgctattgctaaccacgctttcatttcactggggaattaatgctcagtggcacattagaattcatgcaatagcattaaataattactgtttctttatatatctcctgccaacttagaagtacattaaaattggctgtaggagaattcaggacacctcaatctgaagaaaatccccatccatatatatatattctccactcagtagataagaggcaacctcgagtacctggcaacaaacgaattgcacacatagcaacaagaagtcgagtaatacagaaagaggaaagagaagctggtccacattagctcccgtggtggtagtaaacttcagaaaatatcagagctgtagacagcagcttggcatgaggagaggaattcatggttttccataaatctagtgacaggccaggtcgaataggacaacaccatcttgtctgccccagtagcatacagggcaggaggagaaaagttaggtacagagctggagctgagagccgaagtggaggaggaggaaggctgtgagaattgaaggatgtagggcaggcaaggaaaggtggtgctgtgagggtcttcagttgagccagctcccagtcctgattcggcatgtgtcattttggtgccaggcctggccacagcttctcagaccccagatagagctgccttctgtgcatggaggagcaggagggctcagaggcctcagatgactgtctgaggtttgcaagcagcaaaaaagtgagggctctgttcagtgtatagtggagaaaatcagcgtgagagagtttccagccttgctcttctctacactaccttgggcctcagcttcatatgtaaaacagggataataataccccagagagggtgttgtaaggattggatgtgttaaattatatcaaattcccctcacagtgcagtgtggtagctgtttgacaaagttaattcacttcctcctttacagcctcggcctccataacccatgatgacgacagctcctacagtttgatttgtagaacaaaataatacttctaaaatgtgaaactactgctcatccagtgaaagaattgttgagaagcttacacataatgctttatgcacctcagatctcaaagacttttgctaatttgtggcaaagagatagcacatatgttgctaccagagcagtccgggaagctggccctgaagggcagcctatgctagaagtggaatagaagctcctcacagagctatgggaaccagggctggtgggaagccacatgcccacagacctaaaaacagagtggttagttctagacgcgtgcctgtaaagtagaggttgcagtgcaaactgctgggctgtgggctaactgtggctcacggatttttttttttaacccttagccagcgtagttttgattttttttttttttttaaatagctttagtgaggggcttgactctcgttttgtcacgtttcccattcacttctagttgccctagacctggtggttctgttcctgtctggcccttcaaatgttctgacccctttttcgagcctaccacagaacagggcacaaaccagagagcagacagtggactcagaaccaggaactgaatgtgtcctatcccattgtcctagggttgccagatgaaatatagcactttcagttaaatttgaatttcagataaacaactttttttttttttagtataagtaggttctgtgtaatatttccatttcctaaatctggcagtactgctttattcccatttataattctcatcctcgcaaccgtagctactaagtagtgattgtcattgtaacattggggtaaagaatcttgaaaatagaacaccttgacagcctttgggaaagagagaaggggatacatttatttcagcatttgaaagagcaaagcatgtgaatgagtatttgaatttcatatggggtaaaattggaaactatcatggctagagggctttttttcacatactgggtgatgacagctagaaggtgactggaggtggccctcgctcactgaggaatgatgtgaggacaaggatcattcctaagactgtcttgggtggcatcttgatacctgttgcatgagagggtgctaaatactttcagatgtaattgtggtagactccaggcaggcagtctttgtgaaggcggagtcacatcaggctctgcactgtcacctcttggtgacattagcctcttttctttcctttcccgtaattgctctgcccactctgagttcagctaaaggtcaaagcatcaaaggaaggagaacttccttcctaagttctcccttatctgtttaacctcctgaagcctaggaggactctgaggaggtggcgtgagtggataaaggtcagccaggctcattgagtgtcttctagtcaggtgccctgtcacacctgatctcctcactgtgctgtaagggagataatacttacttttttagtaagctgtattttctgagcagttttaggcttgtagcaaaattgaacagaaagtatagagagttcccatatacaccctgtccccacacaggcacaacctcgcagtctcagcacctcaacccacagtggtgcatttgttaaaatgggttattctttttgaaagatgagagaactaaggggtagaagggcagaccctgaggcagctggcctcaggcttatccactgtgacctgctctgccatgtggctgtgatagaccggccttagtatcaggtctcttgctgcccagttgtccttctggccctccagatcttcattcccataaggaaatgtaggtggtggggatagcattagataagcggtggaaggggtggttagattgccgtcttttcttgatccatggagaaattctcttccaatggataagtgaaggtttggagaaattgtgaattaatttcccccaagttgctttttatctgtgtctctccgttctgttttccagttccaccaaagattgaaagaaataaggttaattcaatgaccctaaaaatattttatctgaaagctctagaagttacttttatatgacagccaagtaattttaagcaaagtttgatggaaattgctgtcaggcttttaaaatcactgtttttcaaagcatcaaccctaagtgtagttttaagagaaatggcacatcactttcaggtttaacaatcagtgagttagattgctcttccacctcagaccttgcctgaatcagacacagccccttgtgtccccaagaacagcagggacatgagtatcactggaccacagaacttcttccctttcatgacaaacagcggactgttatataagtgagccaaacatggcctctgtctgttggtctctaggttatttcctcactgcaggctgagacccgttaattcaagagcccgccaacaccaaactaatttttaatacatctaattattttaaaaatagcccgaacaagcagatttttagcatttagagcctgccttacacgttctgtgaaaccttacctagcatctgttggccattgataagatagagctttgtggttttaagacaccgagctgctactgcccttcaaggtcttctgataatagagttactccatcatgctgcaaagtgacatcacttagtcctaagccctcattccgatgcacctctcccttgggagttcctttgtcctcctccccttctgcatggtgacctcctcaccctaagcctctggatgccctcccatgcaaccctgtacaaagcaccactcattaaagcttgttgtgtgttaactgcctctgtggtcctgtctttttcccagatcaacctcaaatccctcgaacaaacccccactacacagcagtaccttggcacaactaagattttatgaaagctagtgtatgaacctgcatagctaaagattaccccacattgccttacacctggagaggacctttctactcttcctttcttcctccatcttttggataccaaatagttgtgtatatttttaaatgtatatattgataaagagcttgtgtacaatgtaagtttgcctggtttcacatatatttgtccctcctatttatgtgttatactaggaaaaattatgaagctcttttagattgcaaagatcacagacattcttaggtttttaataaaagtaattataatgcctaaaatgcattgagcacttaatgtgtgtcgggcaacatgttaaactctttacatgccttgttttatttaatcatcaccacaaccagtgaggtgtttttattcacattttgtgtgtgcagaaagtgggctcagagagattaattgccttgcttagagtcacactgacgatggcagagctcagatatggacccagtttctcatatgcgttcgcccgtgacccgcttttacgccttactcctcagtaaatgagaagcttttctacaagtacacatagggaagtaaacaaacagtctcagcaggcaaagaggaaaagggaagatgattcaccaacattcaggactccacagcattgttgatagttctatagctgctgtacaggcctaacacagttccactggggaaccatccaagtggcaaaatcatctgtacctcagcctcctcttaacttttttctccttgcctttcttgtcttctttctcatggcttttactgcttcacagccctttctcctgtgtatttgtacttctctgtttctgtgtcactctctggcctctaggttctctctgaatgtttcccagttacacttccctaggtagagtggatggttgggttgactcatcccatccattagtgagaactacacaccagggcgccccacgttggaggctcatggctagctctcagcaatctgcctttgagttgggcaccaggccctggttcattcagctgggccagcatcacatcctacaaactacggaaattttatgtaagaacccatagaaggaggccataagtgggacttgaacttgtaggcttcagtgaaatagggcaatgaaagcccaaagttttcctgagatctgtctggaaaaatcatgtaattttcaaagacttttgatgtgtctaatataaaaatttaaagattatgtgtttaaaacttcagcaaatggaagtatttgctaagagtagttctagcaataaatatgcaagatatgaagtctatgcatactagggaaattccaacgtatttctttcttcagcgtgcttgattagatcaggacattaaacttaatttgttagaaacaacaatagagttgtatacaacatttaattagttttcttactcttctatattcacaaacatttactgagtatgtaaacaggcagtatcttatgtttccatacattatcaatgagatagtaaatgagacagcatcctgtatacttcccttttagtcctttagaatcttttcatagtgtagcagatactcaataaatgacctggcctaattaatgagccctgatgccaattaagaagaaagtacaaatcaaagaatcttttcttataagcatggagtcaaggggaagtaatactatttctttaatgccttatacccaatttaatattttctgggttaaaataatgggttgcaattatgaaattttggtcctttgtttcctttcacacagcgtgtcagctctacctttcaccaggagcaaatatacgtattcaggaagaaaacatctttggcttgctttcagtttatctttttttgtgagggtttcactactgcatttgaaatttgggcccattttacttctacgtggaatgtcaggctttagaaccctaattaagttaatgaaagactacaaaagaaacctaaggagcctgtgaagagaggtgatcaattctgtccttgttagtagttaacttttagaagtgacttccttgtcctgccagctcatgagaactgggtctagagaaattaaatgactttatcctcatcgccactcagctgggtaatggcttaatactacaaaattaaaagctggtagccttttgatgtttcaaatatttgtgtaagtcgtaaatctgagttaacaagttgattttatatgtgacttttaaattgaagcttatagttattctatgcatgtgtacacacacactcacacaatgtcttacagttagctttaatgtggtaaatcatttccagaagtgatcagctggtggaattggttaacaatatgactgttcctctttataattgctggataaacccctcccagtgctttgttcagggcattttgaccacatcattttcgtcttttctaactttaactcatagaaatcccatgggatcaggaacccattttgagaaatatgtcagcaacttttgaaatgtaggaaactaaccaattagtgtcagcttttcccttgagggaagaagataggaaaagttaatatatactacagaggttactttaggagatcctttactagtggtacattgtataagtgatcatttttgacaaagctgaaacaaattatcgtaacttttttttctgttttgatgttcagtatattccaaaagcttttgaatttataaagtatctttggaaatttacaggaatgaagaatttactaaatgtagtacatttaatggaaaaaccaaataaaatcaaatataatctctaggtgttctgtagattttttatatacctagtctttcagaggctcattggtttctatttttctgtgatgtgaatttaattagttttaatatagatttaaaatttaataaacgtgattacctgccatctgtcaagcagtatgcaaggtgcaaaaacatataccacgatcatgtattccttacatgcatcctgtaaggaattatcccaaattttcagataagagtcacaaaaactgtgactcatccttaagtatgtgactcatcagtggcgttgtagggattataaatcaagtcatgtgaccctcaaatctgttttacttctcaacaaaattaatgtataagaaaaaaatcctgaaaacactaccatatacacattcttttgattgttgaaagatcaacaatctgattcagtaaaggaagattttttttgctgactcattaaaggaaggtgatgcaatgtgttggttaatgccatgggctttggagtcaggctagcttggagatgaaccctggcaccttgtctgtggaaaaatgtggtgactgagtaaagttgttttttaacttccaaacctcagtttcttcatctccctaacaatggtaataaaacatatttcatagggttgtagcaagaattggttacaatactaaagttatagcatttagcagagtacttagcagatagtactgattcttggtaactgttggtagtaatagtggtgagttaggaaggtaatttacaagttggttaaagatgctgattgttgtgttcaggaacatatgaaaactttgttattaataaaatgatactgatctcaatgaagattttgagtggtaaatggcccgtaaataatatctataactttgtgtgatgctttaagatactctaaaatatggagcctgattggaacctttttcaattatgtccatattttgattactgagttctagacagttgaagagtcccaatccttttaaaaaatatgcatacaaaaataattatatgtgttctttgagtcattgaaaaaagtttatacaactaatttatggcagagggatttggcttttaaaaccattattggtgtgtagactctgaattaggaatatactggatcaatcttcagttacatacatatacacacatgtatccaattaaagattgattacattaaaataaacaagtttttccaaaatctaggcataatcacagtgttattttttatttcctgtaaatattttaaaatacttctccatatagtcttcgtcaggaaacatcaaagtggtttaaagggataacctgaatatttgtctgtatgctgtgaggccaacaaagtaagaagaactttgtgcagaaatataaattttaaagatagtctttgcagatttaatctgttatgaaaatgaactagataaatgtagacatggttcatgcttttaagataagctaaattcctgttgttgggaactgacttttgaaaatggtatttgcattaaataggattaaatggactcaaaaacgaaaacttcccatttgtaaacataaaagggtagtgtgtatgtgtaccagcatgtttgtatgagcatgtgtgttctggtttatataatcataattcttttacttagtcatccttttaactaatgaattttaatgttttagcctttgctcttcaatatattacctattttgtagcaaaaacatctccattcaaattataatcctgtttttattttttttttcagatgatgaaacatgcttggaataattataaaggttatgcctggggattaaatgaactcaaacctatatcaaaaggaggccattcaagcagtttgtttggtgagtagatgtgctttggtttcttagtgacgataacttctccccaattgcttgagcttatggatggtggagaagtctgtgtaacatggccctccaggccatttggttaggaaacttgcacacctgatggaattagataaggattgtgcatagtgtgtccttcagctagagtagtggctatgtgttcgaataacctgctggaataacctgcgtaactttaaagagtactgacgcctggggcatacttctaaagattctcacttaatggttatagggtgcagtatcataaattttagcctctggggtgattcctagcatagaagcacttggtgggctgcactaactgcttcctgttaggtaaaagctgtgcctttatagataatctgggcaaggcagccagccatggtgatcttcactgtatctcaattttggctataggtttctcctgtttgtaccatggaagagaaagtgaggatggattaggttaattgaacttccatttatccacttttgcaagctttattgcatttggttcccacagcagccctctgtgactggtagtgtgggtattaataacattccattgtggaagtaaggaagctaagtaacacaagggtgtcatggattctttgggtcacagagctgcccagtatcctcctactgcacttgatttctttctaatcctcaaaatttgtctgtaagtaacaggatgaagggaatacagtgttactctggaacttctgaattcaacaatagaacactttctatactttaactgaaaatgttaaataatagcaattcacataataacagtttcagcacacatttattgagcacttactgtgtgccaagtgccattcatgcattatcttatttagcctcattaaaatatacattttataggtgagaaaaatgaggcccagagaatagttttcccagagatagccacctactaactggcagagctgggacttgaaccctggtgtggctaacattagagtccatgctcttaattctgacattttgcttttccatttatttagaaccttccatgtgtttggctttacttgtagcactggtgataatgaaaataatacgagtctttgcacaggtctttacacaagtctttgcctagtacacagcatataatatgtaaatagtgatttatcaatgcgccaggtggttcaatatatacttccatgaaattctgaggaaccagtaggacctcaggttgggagaaaggcattgcagggtttgcaagaacaggtagaaagagctgggaaaagtagaagaaaagagactgttggtctatcagagtgacacagttttgagatgaagagcacctatacctgaagtagaggcagtagaagtaattccagacacttctaaagtagtgtttttaggacccagctaccagttaacatgggtaaggggaggtatgaattgaagagagaaactctgaaacctcatgcagagccagaggcctttattttttcattgtttattacaacattttttgaaaaaattataactccattttgcttttatctctataaaagtctttggtaccattaagaaatcagttaatgtgttaaattgccataatctttatcagagggactatttggttctctgttaaaacatttatgattttaaaatttgttattgaacattaaaaatatactaggtctcttaggcctgacgtttgctttttggttttcattggctttttcggtaaaaaacacttttcataatcaagaacttgctcttagaaaaagagcttcaggtattagcataaggaaatgaaatattaataattcaaatggtatttaatctcattccatcttcaaattaaaataagatacataatgattttcttattatagaaataccaatacaatggaacttgttacaaagacatacaaagttttcatttttatggatgagaaatgatttctttagcccacttctcagccaaatttcttatctgtgtaatatgtagtcccgtatattcgctcagcaaaccagggagaggataggaaaatgtaagttctttaccacctggcttcttaggaaatagtttttagtttgagctaagttattttgagtcttgaccctaaaaacaacctttttggagaaagtattaggcattatgaatcttttcccagttattagccgttggggagctcttcaggtctgcttccttctcatggttgtttctcaccagctatgttgaagcatccatctttttcctagacagagtaagactggttccttcctaaacaactttaatgaatataaaaaaaatcttaagtattcatgatctcccaattccatcttaagcaggaaactagaactatttatttcaagatttcagtggtacaaaagatttcaagttaaactgtacctcaaagagaggtattttgtgcttgaccaattatactcatttaaagctaaaatacaagaaatacaaatattaacttaaggctcttaataacttagaaatgaaatgtcaatgaaaatatgaagctgatatatttcaaaatgcccactttaaaatattccctccagtgtctctctgaatccatagttctagcttcaaaaaatttaaaggaaattggattacagtaaaacatttcacaaaatgcaagggtcttcaggtttctttctcattattattagataagatttacaacttttatcttttttgaaaatcaagtgttttaatattctattatttatagtttcctaatgataacttcttaacttggcatttgaaaggcatgtgccagtgaaataattttcacttatatttatagatttggtcttggatcgtccagagtgctaattacatataggaagtgtagtgcccagtctttcagcagcaattcattgtgctcctgagtgcaggatcggctgcctgccacttgcacagccaataacaaggatgaagttcagtgaaaggaaaatgacttttatttccaaagctaggagtggcaggcttactcctctagaaactgcttcagacttgaggctgggaagagggtcttaaaaatgggacttggactgggaggcatatgggaagggtgcctgagtataagatctgcatgtcttgttctggtggctgtatctagctgtagtctacctggagtgcggctgacatatcaacaatagctgggttgctgactaactgccttgaggtagtctctgaagttttgcagctgggtctccatgcttgatctgtcacaagattagcccctggaacttcttagtaagcacatattagatccaagtatacagttacgtaaatgttcatggggtgaaggagtgcatagtgggaaaggggagtgaagtttcaaagcatgtttcaaggggatattttaagactaaggaaaaaggtttctacagtttgtttcaaggttacatcttgagactggaagaaaggacaaagaaaaacattttaaactgcgttttgaagctaaactactcaattacaattgggcatcattgtcacaattccacaggacaccataaggaatctggagataagacatgacttgtttgttctaagtttataggctaagtgcatgcctcatgactctaattctagtactctggaaggccaaagtgggaggattgcttgaggccaggagtttgagaccagcctgagccacatagcaagactcatctgtacaaaaaaaattttaaaattagccaggcatggtggcacacacgtataatcccagctacacaggaagctgaggcaggagaatcacttgtgcctaggagtttggggctgcagtgagctatgattgcaccactgtactccaccctgggggacagagcaagaccctgtctcaaaagaaaaaaaaagtttatagactaaaagatgcacacgtgtaattttaatacaagatagaaggtgttgaatgccagggcaacaggaagtctccatgtcattggaattcagaggaaataaaccacagaggtcaggacttgtaggggatggagggtagttagcatcagtcagaattcatacgggggtgaaatttcattttagagtaatgtcttcttagaactatcactaaacaattttagatctaattatatttaaagttttgcacaggtgcactttgatgtaattacatcagtcttaaaaagtctgttgctccttggttttaggcctattcttttcttgctagagaatgcaatcacaggccgggtatggtggctcacacctgtaatctcagcactttgggaggcctaggtgggtggattatgaggtcgagagattgagaccattctggccaacatggtgaaaccccgtctctactaaaaacacaaaaattagccaggcgtggtggcatgcgcctatagtcccagctactcaggaggctaaggtaggagaatcacttgaacccgggaggtggaggttgcaatttgctgagatcgcgccactgcactccagcctgggcaacagaatgagactccatctcaaaaaaaaaaaaagagagagaatgcaatcactaatgaaatttctaagagaagtttctgagacatttatttttataactcagaagaaactttaaagattagtatatcagtcgatagcccgtgataatttttagtttggtgctgttttatactttcattgaaagaattttagactatgtttaatattattgcttattaataaatccagcattaccctctccctttcttagttatggtcaatttacatatattttatctaggcaaagtattttatcaaatatttttctgatcttttcaggtaacatcaaaggagcaactatagtagatgccctggatacactttttattatggaaatgaaacatgaatttgaagaagcaaaatcatgggttgaagaaaatttagattttaatgtggtaagttaaataagaatttctaattcagtccttaaatttcagttaacatggataaattctgtagtgggccctattattgtattataatgtaccctaacaaaaatattgcaactttaggtagtacaaatactattatcttatactatattcttaaattgtcctcactacacaaatgtgtgtctttgttttttggcaaatgaagagtaagagaaaagaagttagtatttattgagacctacatgtgcctagtattcttgttcagtcccactgcaactctatgagatgggcattaatttcacacctttgtatattaaacatcttaacctcagaggcttactccagattgcacagctggttgtgtgtcaagagctgtgattctgatgtaggtccatggggctccagtgcttatgcttttacactgtgtcatggtgtatccagcagtagcagcagcattcattttcccgtaaagaaagattcaaattttgtggatcttattcatctctcagtaaaaataaattgattatatatgtgatatattttttaaattctgtatgctatcattcttagcaaatatttcatggcccattgtatactgagggaaagaatcagaattaaggatagtgaatacttctaatacttcttgataattttgactggggaggactacgtcttatcagctctaatttgatagtcattgttttactttataatgatattgacaaagaacttatactaagagaagaaagcatgtaggccatggaagtttttagtcgttcacttcagtgtgtgttatcagtattatttctaatctgagactactttgcagaaattctcgtaaagtctcttgtctttcgggtaagcatttgatagtttctgtaaatcccagtcaccacgcacaagtaacatgctgtgtgttgaaagtggacaaagagaatttccctgctgttgcctctgctttgtggcactcttgttctctcagagaccaaatgaggacaccagtgttaggtagaatattaaggatcagtaaagctaagtctttcccccatctatttcaattaaaaacttatataaattaaaagtttaatattttgtttctactcccctaattaattgctatatataccgcatttgggagacctaaaagacaggcagatgagtctgtgtttaatttgcctaataattgaatctagaatataaaggagagaatattccgatcaatattaagggaccttggggatcaatgtgttaaacccttctattttaaacatgagagagcaggcataaggagctagtgatttgctcaaggttatggagctatttgattagaatgacctgtggtagtgctgatattgatagagctaaatatgaaaaattaaagcactggaaaaaaacggtttcattttggaggcttgctttcttaataatacttctgtggaccgggcgtggtggctcacacctgtaatcccagcactttgggaggtcgaggcagttggatcacgatgtcaggagtttgagaccagcctggccaacatggtgaaaccccgtctctactaaaaatacaaaaaatagccaggcatggtggtgtgtgcctgtaatcccagctactcaggaggctgaggcaggaggatcgcttgaacccaggaggcggatgttgcagtgagccgtgattgcaccactgcactccagcctgggcagtagagcaagacgccgtctcaaaaaaaaaaaacaaaaacaaaacaaaacaaaaaaacttcagttctaccttcttattaaaatcagctcctaccttcaaaaacctgcaggcttttctttagctatgtatgaaaccgactgatatctgtcttttcaagaaagggtaggggaataataactaaattcctctgaaacactaatgatggaaaactggaaagcatactttagtaacacttgacttatgaatagtgtccaagtttcttactgaatcttgggttggtccatctggtaattgtagcattgttgccccaaacctcctcaaatataatagcggtttttttcttttcacgacctgtgcaacctgtggtagtctgaggagctctggacttggggccagaggttggggttggtggaggatgaggagcagttttatttaaaatgactaagtgcaaaggtaacagacaagatgttactgtaacagaaggcagttggctgtcctcagaccaccacaggatgccttgaatgtgttccatgggtcctggagacttgggagaaggaaagatgaatttagtaggggatatcagactatgtagaagagaagaatttactgggcttccttacttgtaaggtgaaaggattagactaacattgagttattgctaagatactgaactttgaagttttctttatttaaatttttattttagtttttaataaaattttactcaattagtatgcagacttttgcatatatattttaggcctgttaatgatagttttgggttatacctttcaagatataattttaaaatatatacaactgttatgtattcataaaaattaaatatacatatttcaaaaaattacagccatatttctcaaatgtctttattatactattttcttaatataagaggtcttgaaaaatatttgttgcaggtctctttgggtattaccatgttttccttttaaaaaatatgttgtcaacaatatccaaacaataatgtttcccatattaaaaatagtaacatacaaattctggagaggtatattgacttacttttctaatcattacattgtgaagttttccagcttactgtattctagttggttttaatatgtcacattagaatttgtcttatattcacccattctatccagaaatccaaatgattatttttaaaattacaggatttttcttcaaaaaacattgagaaatttttctcatttatatgaagaaaggagaaattgaaaaagccttagcaaaaaaaaaagaaaaattatactaaataacatgtagtatcattctagcttataaatattattacttatattttagttaacactttttcctgataaggtattctaattgacagtgtaagggtattatttaaaaagttggccaggcgcagtggctcactcctgtaatcccagcattttgggaggccgaggcgggtggatcatgaggtcaggagattaagaccatcctggctaacatggcgaaaccccgtctctactgaaaatacaaaaaatttcccaggcatggtggcacacgcctgtagtcccagctacttggggggctgaggcaggagaatagcttgaacctgggaggcaggggttgcagtgagctgagattgcaccactgcactccagcttgggcaacagagtgagactcagactcaaaaaaaaaaaaaaagaaaagttaatgcatctaaatttattgcaaagggaaaataaaaatgaaacaaacattattgttgagagtttgtttatcctatggtgctcctaagtataaacaaattttacactcaagaataaatttgttaatgtgaaatatccaatttatatcactgaaaagtataaaataaatgttttgtattggtttatactgtaattaactaaaactcatttccttttcattagggcataggaagtcgattcattttgcatacttggtagcacaaagttcaaatgactttaatatctggcttaaaataagttgggataatatgttctggggagtaaggaacaaggacttcacagaaggagcttgtattcagttcaagtatctgtagaggcacatagatattagcagaaaaccctaagtattgactccatgaatgcattttctaattttaactcaaagtaatcttaggacaaaggatctaaaactgattcttggttagtcactcttcattcactcatgtgttatttactaagtatcttctaaggatcaggcatttacccttatggagcatttagtctagcaggaaaagtagtcagagaaccctagctaagccaggctatctcaggagggaagaaatgaaaagaggtcaactactatttggccaggcgtggtggctcacacctgtaatcccaacactttgggaggcccaggctggtggatttcttgaacccagaagttcaagagcagcctgggcaacagagtaaaaccctccccaccgccgccatctctatttaaaaaacaaaacaaaacaaaaaaactccagcctgggcgacagagcgagactccatctcaaaaaaaaaaaaaaaaaaaaaaggaaactatttagtaatatgtgatacataccaagtattatgataggtgatttttttcatgggtgtatcgtgtttaatctttgtgacaagcatacagagtagtaactggtatttttccctatatttatagatgaataggtggttaattaggctgtcccaaattatgcagcaagatctctggtttgaacacagtctgcctaactcaatgaccttgtgtttttttaattggagaagaaatgcaaagagttgagaaatatatacgcagtcagagaatttgagtcctctgaggttaggcatgtcatcttaatattagattactaattagagtttattgttcaatagtgatttgataaatatttgttaaatgaatgagaagttaagccatcttatcctacttcctgacagtctgtgctatactcagctggaagaaaagctcaggtgcaagggtagctgtattgtgtcatctgtttatatagttacagatgatctggagttcaagtcacttggtctacctgttattacctaacctatttccagaacagatttgtagtggcccctgataacaggaagatcagttgcataagaacaaatgatcaagggtttcctatttgggcatttctaatttcaattgtgttcttttactggcacttaaaacattattggttacctagaacctcacatgagaaatattgaaaactatcttctgtaatgaattttatggaatatgtagaatttttctccagataacaatttcttatattaaccctctgtaaaagctaaagctgtgttaaaattttccttaaagctgtatttctggactgcagtaaagcgatatctcagtatgagaggcagagccttgagaatggcaaaggatagatgatcagcctgctgtggacactaactagcaacaccctgtaattgtgatctttggcaagcatctggatcatgcctttagttgtaatgaacactttgtgttttggagaacagaagttctggtggcaacagtgactttttttttttctttaatgttaagatccagattgtttgcatacccagttggaatgccctcctacttttcaagaaagtaagttgtagggttccctgtcaggaggatatatgttgacttcaagaagcaactttggatcttctcaaatgcatgactgagtactggcttaggtccagagttccatgccatagagtatgaaagaagttacttttgccttagtgttgctcctgagaaaggtctgttttagagccacattacatcctgatgggcgcagataactaagttaattatcctgttaaatgaagttattgagtgtgttccatctgaatgctagggaatacctaccaagagtgatgatttgggttttggttttcagaggatactgtgctgttctctctgatggtaattaggactgctgcttgagagcctctggacctgcatggtaaaaccagtctattaacatagagaagagaggtatttgcatatctttgtggcccacagaacttggactttgttagcagtcttaagagatttgtcacgttgcttaaataggaaaccaaaggctgccaggacacactgtgacagactgacttacactgtgaaatattgcaatttaatcgtttaaaggagttgtatacttttaatcctcaaagtgttaatccagcacacactttgaagtatcatttataaataaaggtgtatgctaagcctaaacataggcaaggcttattggtagttaccagtctttaatcaatggttttgaaaagtctcatgttgcttctaacaaagccattgattaaagtatcgttatcatgtgttagtaatggagcagttgttatttacattggattttggtgaaacagttaatattaaacagaaatattgcattggtatgtagtgggcagttattaaagcttgcttgattctcatgtatgataatagtcccgtaccccaggctcataattcactaagtagaaagctgatacagagtttggaggaatagctagcaaaagagtagtctctgattgtagagatcggagaattgtccttttaaaaacaaaaactattacacttttagttcactctgaaaatcaaacactcagaatagaatttaaatatgtctgataagttcttttccaagaaatatttttccatttaatgcaatcaatcagatctgtcatgctgtatggaatcataagataataaggagaattctaatataagtgtgactctaaataaacatcataaggcttgaagatccaaagaaacaatttattatctgttcctcgagcttgcatctcgatatagctcctcaagcaaaaggaaactggctgaatctgctccaaaactaaaatttgttattttcattgtcaagcctgttatttcacttagtgaaatctattaaaatacgtcatcgtatagctaattttggtgaataagttgcctataaaaatatcaaatttcagagttgtttaaagtgctgtcttgtctagtgtgaagaggttggtctttcaggtactcatttggaaacagattttgacgtgttcattttctctgttgcctagatggggttagatacttcctgtccatgatctcatggtatgttggtttagaaaaagcctttctgtgcagagagatggagcatgatgttaggattgaaggagggaagcatacaaaataatttatatattagactctctttttcatgttagcagtctttgtcactttatctcgtaaatttacatacatgtatagtaaatgagtagacaaaaacatatggaaaagggatagatctaaggtggaagttatcaatctcaaacacccaagacaataatagagattagtactgaggcataattttttcatgatttgtaatactcatctcttgattttaggtgtaaatttaggcataccatgtattttattcaatttatatgaattcaatttagatgaatctggtttagtgtgttctttgattaagtggtcattgctataagtaaatcaaaatgaaagaacaatttctccaattctgatttttttattggttggtcttaaccaaaaacttccaatctcctcttgcttatcagttgacattaactaataggtacatggaatttaaataaaagacgggatgtacttcttaaactgccactgatgtaagactgtgtactagaagccactgaatacatggggcatactggaatgcaatcctaaagatttaaaagggaagttacttttattttaaaacaaactcagataggtagactgcaaaattcacattaattgttaggataaatctcacaagatttagtgttacaggctgctttgtctgcctactgtcttccccctgctgcaaataccccctctgtcattagggtaagtcggtagaaaacttttagaacattatgactattaataagaatgtattcatttaaatttattatttaatggaaattagaatcagaagtttataaaaatggcctgagaccctcatttgtagaaattcacttttgaaaatccagatttcatacaaaatatatcaagccccaaaggaagttggtcaacttctatatttcaaaagaggatttttaagcccttgagaaataagacctcatatgggccaaagaagatgagtatttatgattctaaagtttctgattttccagtgaccctgggaaggtaggttttagttcgtttaggctgagctgcacagtggtagtggcaacagctgtctattgagtgtctgatgagtgcgttaccagctattgtgtacattgctttacatcatggaggaattcattgtccctttctacgtatgacaaaaccaagactcagaataaattagttatctgggacctcaaactcagatggcttccaaatcagccttcaatcccaggtctttctgatttctgcaggatagccaaccaatttggtgtggtgggagaatttttatcttcttagtccttttcatctacgaatctataaagagttaactaaagggtctaaatttcaatcttttggcctaaaaacataatacaacctagaatactgaaagagacctcaaattaaggtttctaaattatttaaacttaactttgaaaaggagagagaaagaattatatgttggaaattcgaatgtggttctggttttcaaacagagaagatggtgacttgagaactagtgatggtggtggtgtgatgttccagagcaagatttattaaagacaaggacatagcagtcactggtatccttcatggattaactaacaaaccagatttgcttcttaaacaggctcactggacagactattagatccatgaaatccaaagccatagcaagtgaccttgagtatggcaccttgcagggtcatttctcaatatcgtacagtacaagataaatagaatttaggttttagaatatgtaattggatcaataactggttgaataactgcatccaacagttgattgatgtctagctgaagatatatttctggcagtgtttgacatgactcagaccttcaccttggaataatttttatcggatgtctacataaaggtcttgattatccaaaattttcacggcaggaagagaaaatgcattatgtcaagaacctatagccagaataagaatataagatcatcttaacagtcttcaataggcagaaatgtgggaaactgttaccaggtttaaaaactgaaaaacacaagtactaattgagaggaatatgatttgagggtttaagtttattagattttattattagatattattactcttaaacataggaaacgtagtcacgtgaaccaaactaaatacatgggttagcttcgcttttccttatcagtaattttgtagaatattaaagcctttgccaatatttatgtaaaattcattcagagtgatagacctcaaagttaaattacacctatatatagtacttttaatcagattatatcaggtgcacattacaaattataaaatacagttaaacacaccagtcttattttgtgatgtttttgcctaactttgacttagtaattctgtctcctaacttgttttcataattgtccttttataggaatttttttgaatttttttaacttaagcaattacttgactttaattgttagattcttaaacctttttacagagagcatgtaaggataaaattaatacatacctccttttttttctggaaatattttatcccactaaaatgtagactcaagtgagcttgaggaccttatcagtccttattgccatttccctatcacctaggacagggtctggcacatagtagttgcttaataaatgcttgttaaaggaaataatatcccatgattttgactaagtttatttgccagatattgactccatatattataaattgctgtgagtcccatgattattagtgaatggtttgatgttaggcaaaagtgcagtaggcccaatgaacatgaaaagaagctaactaaagcttgaaatgtgctttataatctaaatagtaggttagctattctaacttacctagtaacagaatgtaagacagatctatttactaatcaagtataaaatattagcagtaattactaattatatgaccatgaataaagagacttggtgcattatcctgtgaggtatatagaagtcagaatagcagagccctgaatcaggagccacagtactcaagttcaaatcctgcttctaccaattattagttgtctgaacttcaaaaagtcacattaaccactataagtctcagcttcaacattttaaaatggatataagaatagtaattaattcataaggtcattgtgaggactaaaagagtctatataaagacattagcacaggacctggcacgttgtaaataataaaagcaagctattattggtgtaaataagggctatttcagcatggtataacatacatgattattatcatgtcctttatgcgaagatgaaatatcttctcagagatgagaagaacaatcccaagccaaaggcaaaaagttggaaaccagcactagaacccaggtcctcagacttcaaatcctatttgcagtccagttgtgcatcatgatgaaaagattcctagactaatgttgaagtaccagcctaagtataggctgaatagcctttcaggaagaaaaagcagacaaatgaataaaataaaggagaatgcagagcagaaaaaaaaaatgccctggccccattatgtttacacaaatagagaatatcaaatattgtatctgctgttgaagagagaggaaagaactttatttgacaaatatttttgtaattttgtttaggagtcaaaattatttttatctcttgcattagtccgttttcacactgctgataaagacatacctgagactgggaagaaaaagaggtttaatggatttaacagtttcacatggctggggaggcctcacaatcatggcggaaggctaggagcaagtcataacttacatggatggcaacaggcaaagagagaaagagcttgtgcagggaaactccctttttaaaaccatcagatcttgtgagacttattcactatcacaagaacagcacaggaaagacccctccccatgattcagttatctcccaccgggtccatcccacaacatgtgtgaattatgtgagctacaagatgagatttgggtggggacacagagacaaaccgtatcatttattttaagtatgttttttcctttatttttaaaaattgtcatataatgattgtacgtattttgggggtccgttagtgatgtttcgatacgtataatgcacagtgatatttaataccttaattttaaaagggagaacatttccccctgtatataaacttctctgggcaagcataagatttgaacaaaatttaagtatttagtataatttatcacaataatggttttctgaattgtgtactatcatcatgtttgaattttttttttccatagaatgctgaaatttctgtctttgaagtaaatatacgctttgttggtggactactctcagcctactatctgtctggagaagaggtaagatgaaaagtggtatataaatgtgaattataaagtgtcttaaactacatttttggtaaaatatgccattcgtgacatatatttagaaggaatctatggaatttttatatttcaatgaagctgtagcttacactgagtttcttacaatatgtactaatgaaatgagcaagctgggaaagtttggcagaacatattgtcagggaatgttaagtaatgcctttagaaactggctctattatgttatgtatggtgtgattatagctacaaattatatgtgcctatggacaaattaaagaagtttagtgtagtggcgggcttgtggatgaatttttttctttgagaattattttaatgttaatacaaataaaaacttttttaaatgaataaagcctggcaagtaagatataaaaattgtagtttttatgtaattaagggggtgagacacttagctaccaagtaaacagtcctaaaggccagcatccctgtatcaagtgctttggagctcttcctgagtcaaggcttcattaattatccactgcttggagcaaagcaggaattttaaatttagctgccttttattgatagattaagaaaggatttttgtatcatcctcataaaggtcactgatgctattttcttgaaaggttttggacaactttatgaatatcgtttgagtgtccactaagggttgttggaatgggcctcatctttaatgttgacagtgttaaatgttgacattatggaaaaactgtcacatatttcagttgcacgtcagtcagatttgagttagcctcagcattccggctggggaaagagtagatcttacccaaaccagtatttcatgtattgctatgctccttcaaacagatttaagcacagcaataaatgtttaatgagaaaagctgcttgactttgttcctgtctctcaagtactttcttaaccaaaacatacaaccttcacaatcttacatttcctctctgtttagattttattctaccttagatcttttcaaagtatatagatgacttctgtattcatctatatctctcctgttttagtgttaaatgttgttcattgtgaactctgttaccttctcagccagggtaatgtgatcccctggtctgttatgcctcttcctcccttttttctgtttttccactaccagataacttcatgtgttcagttcagtttagggtatactaaggattaagccaaaaccaaaaaaccctaaaaccctatatttttaaaaagttatgtttaaaattaactaatgttattttagttaacaggtttctgcttttagaatacttgtctttgagtatccaatgccaggatgttctcattgctttggacataatatgctaagatgaccttggttttaactttttccataatctatgtggaggtgagacaatttggaggaaataaggattgcatccttttgtgtctgggctcaattaggataataaagcatacaaagaaaaacacatatgtatctattctaaatatacatcatgtttgattaggatacgttttcactcagtgttttaagtttacatacatatatgtgtttctatatatgtgtatacttgatatgtatatatatatataattataatacccacagatattatagtttgcctatagataaaataatttgcctaagactttgtaaggatattttttaattctgtatagtgaactttagtaaacaaatggctacaaagaacacttccattgcaaataactattctttcagtctgttttgccattatcactacacaaacatgtttttattacatgtaggttttctgtattttaaattttatgataaaaatttaagattttttcttttatttttctatctgtagagtgctttagttatagggacccatattcttagcatgttttttcttatagtttccagaatgttgaacagttagattattttcagtatctttttattttgaataatattgctataatcaatgaatatttattctctgaagtggtgttggcaagtgagaagtgattaatactggattgttttaacatcatcacttgcctatttctcccagttacttagaccctgacaattgattttcatttgatgaatgcattcaggggaattggccattaggaatgtgatccggaaaattttttaccccaggtctgttcttgagctatttgtattcatatcaaaatttttttaaatgagcattcatttaatagaacaccaacatagcaaattatgaataagttggttttaaatagttgataaagttttataccacacactttttacatagatcagacaatttactaaggtgtctaggacaatttgtctttctatgtatctcatagagggacttttaaaccaccataatttaacattctgatttcatcactgaggctcaggagtattttaagaacaaatcaccatcagaagtagatagaccccacattgatatcagctcaagattgttaaatttgtatgcaaaagcaggagaagaagtactactgatttgtgatatgtgtttcaggaaagttacagttagaaacactggacaatagttaagaatcccagcagaagtctaagctaccaaaaaaataatagaaacatgaagtacctgtagtaaactttgattacaggcacatattcaaaaatttgaaacctcgtagctcagttaaaatattttgtagcaccataaaaaagtcaagcatcagtattttcaaatgctatataagaagctcaaccacaagaattacaaacagataggatggggataagatgaatattaaataggaagaatcagtattaaaaataaatttaaaaggtagcactgctctattataagctggaagggagctaaaattctcactggagatagtaaatatagcagcatctagaatatgattacccaaaatatgttctaaagaccactagtttcttttgatatggcaggataaatctgtatctgtatacatactaaaaataagtttgggaagagctacatcctgtattctttcttggaaattcagaatgcacaaaaaaagaagtgaattaacttttatttatccttgcattttccacacttacttaacaatagccttcctctattaaaaaaaaaagtgacatctgttaacagtaaattagaattatttttcagaacaaattttggaaatactactacagaataagagtaaagcaaagatgatattgaaattgacaagtgcaaaacgtgtaaaatatgacattgcaagagaagatgacacatgtagaaaagaatttatgtgactataccatgtaacattatttgttttacaacagaaaccaatagctatattgagcagaaagtgaatgtaataggacatagaaatgttacagaatcagagagagggctgaagagcaacttggaacaaaaagtgtcaagttggcataggggatctctatagctgtactatcaccttgggacaccctgcaattagtaacatggactatttcttccacccttctgttactctactcaagacacaaagtccctgaagaaagaggctaattgtcagagtttcagttacatgcagcctctttggggatcttggagaatgaaaaaggatatgctagaagtcttcctcaaagtttggattcatatcccgtgaagactgagtagtataaggaagtatagataattcctgaacaggaaatcgaggccctgtgagaagagtagggagataggacgtgtaggagccaacaataagatttcgcccactatggtgaatataaatatggcagagaaaatagacaaaccacatggaaactgacagttgaataagatacctgaaaaaatgtaatctgatttgcaaaaatattttgtaagctaagagacgacatttagaatagaccagagtttttaatcctcaaagaaaatattctgccagtacattttaactttgtaaaatagaaaaacagtagccaactcctggaagccaaaatgattaagaactagctttcaaagaaaaaagatgcggaagacatcttatccaagactggtaaaagacacagaatggatttttacagtagatgagtttactatgataacctctcattttgaaggcagcaaaaggatttttcttcagattccccctaaaagttatccactgctgcaaacaccagtatgaaatactgctgaaagagatttactcaataaatataatactgccaaattttaagactaacaaggaggaaacacagaggggagtaggattgtggagtagggaggagagagagaagattaagaatgtcagttaactggtgggaagatgtagttgttttttcataatagggttaagacattcggagtatttgggggttagaaattgattttttagagtttgtttagttatggataatcgtaaaaatgtttagaaattctctagaaaattaggatatatgactggttacctttcaaactcaatgtctgccacaattcattagaaagtgagtcatctcccagactacccatctgtctcctgcctgattctgcaaaaaaatcagagtgccagaaaatgtgtatgattcaaacagagctgtggaaaaacagagaataaagttagggcatattaaagtttcagataaggttagcacatagcagtgtattctgccagtttgtaaatcatctgggctttggatggaaatgtatcttccggtttcctagtgaccagagcaaagaatggaagagcattaacagcaatctggttttgctatttttatgaatacaaaaaatttgataccataaaataacccacatatattgcttatattgaattttccataaaaggtagaaatatgtggtataaacaagaaaaatccaacaatacatttggatccaccagaaatacattagcaccctcccaaatcctgcctaaatactaaattataaaaattgagctcacatttatcctgctttcttatatatggaaagaactttaattatgatctctaattaggtagatttaaatccagaaagtagagatatcaacaaaaggcctaattggaaaaaaaaaaaaagaattgaaaacagtgatcacaataccttaaaataaaaatatatgttaatcccatacagtgaagaaataacagctatgcaatatagttaaaaggaagaattgaaatagtgatacagtgaaattaaaaatcaggtaatcgatatagttcggatgtgtgtcccctccaaatctcatattgaaatgtgatccccaatgttaaagatggggtctcatgagagatgtttgggtcatggggccagatcccttatgaatggcttggtgccttcctccagggtaatgagtgagttctcactctattagttacagcaaggtctggttgttaaaaagaatctggccggacatggtggctcatgcctgtaatcccaacacttggggagactgagggagggggatcacttgagcctcaggaatttgagacaagtccaggcaataaaagccagattctgtctctactttaaaaaaaaaaaaaaaagtctgctacctcctttcccttcccctgtctctcctgctccccctctggccatgtgtgacacctgctccctcttcaccttctgccatgattgtaagtttcctgagggccccaccagaagcagatgctggtattatgctgcttctatcatctgcagaaccatgagccaaaataaacctcttttctttataaattacccagcctcaggtattcctttatagcgacacaaaacagactaatatagtaattaaattctttacaatatttttcatatgctgtagacaatgaaaattttaggaaaatatgtacatcatacctccaatcaaaatataacattagaaatgtacacatatttaaaatggtaaaactacttgaaaatttaaaaatctctcaaataactagatcaaggaatgagtatacaatattagacaacttaacaactacagtataagcatcacattaaatttgttggaaagcagccagagttatacttaaaaaaatacataattccaaaggtctgcattaagaaaaaataaatatgtggttaagtctatatttcagtaatttaggggaaaaaaaacaaaaagacgtaacaaaaataagaatataaatagattgcaaaatgaaagaaaagctgataaagctttctctgccccttctcaacagcgtccttattgagacagtcttctgggaaagaccttgagagcagtaagaaccatgtttttcacttattaagagacagaaagttttgatgaccgtgagtttgagtggccccctcagcaggaagacccttctaggcatgtttttatatagtgtcctcacctgtacagagtggcacatggaaatggtgcttatcagattgggcggtgattgggaaaaaaccgtgagagatgtgctccagatcacaatcactatttggaagaaatcaagtatcccttcagcagatattggatgagtgccaactatatgtcagacactgctcatggcctcgagatatgcctgagataaaatagcccccaatccctggccttgtggagcttacattttagtgattaaatgtagctcataaaccaaaactggaaaacttgatgagacctgtaagaaaaaaagttgatgttctggttggtcggttttgttattggaatgacaggccagtacacagggagaaaaccgacagtaatgttcatccaactgaccttcgtactgccagcgtctcccctcttcagtctcttccccactgtggcactaaggaaagttgtcatcactccacacagtcttcttgcaaaccaccactggtccatgtggccttaaaagttgagtcgttttgatttggcctacaaagcctttgtaattcagcctcagcctaccttttctggtttccttcataacagtcctcatggaccttccactgtataacagaccctttttcttccaaaaaacgcaccaagcccatctgtgtgcttcttaaatctgcattccttctacctagaatgtctttcaccctgctccttccacccaccaagatagatacagcccctccgaggccttccctggctgcacaacactaagacaccccctccccaccttcacttccttttctgcattctctgcatacgatattattatagttcattgtttatggctctgtgagccctctcacctactcactcccttttccccagtaggatttgtacaactcaaaaatgacgtttctgctgttttcatatcctcatgcttaacactgtatgcctggcactagaaaacatttagtaaatgtttagtcatttagtcattgactaaaactcttcaacaggttttctgagacctttactttttaaaactgcaacagaaaattcttccagtgacttttaaagtaaaatctgtacatggataatataaataagcaactagcctggaaggcttggggtaggagatgagaaggagaaaatgtaatgtagtaaggtgatggacaatatgcatgatctctaaccacaaatagcctctgtggctccaccttcaacccccaccccagctagcaaaacatcatcctttttatctgttctgtacatcctgattctctgaaaaagaaagttttgaaaatcagctggagactatttgtagattatatcattactaaatacagtaggtcatttattgtagacctttaaaatagatttaacatagagcattctgaaattataaacctaagaagaaattataagaagtaaatgtgaaagtgattctacaaggtacatatatggtccttaatttgaggaaactaactaaaacttaatgacacatttatgccaatttcctagaaaggaacaattttaattatatttatcaggtgatactgattgttatattaatgtaattatataattatgtaattgttgtatattaatatgtttggccctttgatttcttagaggtttagatttagccttacatatattttaaatgttaatttactatttggcattattgaaatttttataagaaaggaatgtaaaatactgaatagctaatattttcatttaaaagtttaattcagtaaaacagagaattgtaattttgcttattatgtttataattaaatttccatggttaatgagttatagctgttacacattgactattccattatgattggtaaatttaatttgtactttaaaaggaatataggagtgtacagagttgattcaaaaacaacacatactttagtcaaaagaaattactgctttttcttgtcctagagtgaattacagaaatcatacctaccccttaactcagatctgttctgtttgtccctctgcataagccctatcttgtactgataattgtttttgaaagcatagttttataagctgtaaaaattttatctccacaattcatgagcacatttctacatttcactagtaatcccagccctgaaacttatttatacttaatgtgtaaatggtagaagctggcctagcccttgatctcattgccaagtgagtgcttgaaacctaacggaaagggaaagtcagaaaattcagttgttttgttttgttttgttttgtttgttttctgagacggagtcttgctctgccgcccaggctggagtgcagtggtgcgatcttggctcacttcactgcatactcctcctctcaggttcaagcaattctcctgcctcagcctcccgagtagctgggattacagactcccgccaccatgcccggctaatttttttttttgtatttttagtagagatggggtttcaccatgttggccaggctggtctcttatctcttgacctcatgatccacccaccttggcctctcaaagtgctgggattagaggtatgagccaccgcacctggccaaattcagttgttttttaacgaaatatttttatcccttttagtttagcatagttccctacacatagcagcaaactacaaattcacatcagtgagaaatagacctgtgttatcattcagcaacagcctgaaatctcagtggattaagacagcatgttctaccttgactctgcttctcatcatccttccttcagagtccaacctgctggggcagctgccatctaggtcatttctagttgtcatggggaagagggagtggtggcaaaagagattctggcaaatcccacactggcttttaatgcacttgtctgaaagacccatgttacttcagcttacatgtcattggccagagcaagtcatagggccactacaacttaaaggggtgaagaggtggtgatgaacagcattcatgaccaccacagcgaccactgacttgggttagactgtgtagccctcttaactgcccagagtagcagaagataagaattactgagaagataactttgtcaagagtccccaaactggagccagccagtctcactggaaaaacccttcaataaagtggcaccaaagtagggtgacgagtgtgacttgggatatgaatcttcactaacacacatcttcactaaattttcaagtaaaaagcacttgtttacaaagtttcccctctcctgaaaataccttctactctgtaggcttctccccggccttccagatttgaaacagtaaagttgacagacagacatatactgccctctataccaccactgctgttgtctgtggtgggagccagttgctgtttggcagcggcctgccgtgttgcctggatgttaaagacctggtgcttttccttccaccactttttctttgatttcagtgctcactaggtcagtcacttctcatttttcaaaagcctaatgaaagagatgaggtaatatgttctattttgatttatattgaatcactttataattcataatgactgttgaaaccaatacttcaaatcatttttattgcctgagtcatattgacatggatttctaacacagatttttgcctgtgagtgaatgtttttcaacaaaagttatttttttcaggaatgttcttgcaaattatttttctttcaaattgtgatctcctttagaagggtatataagatagctgtagcaagaaatttaaaatttaatagggctagcagaaaatgcctcagaattgtgataatataccatctggtaatttcattcattaagtgaatcagcagatgcttattgaatacctgctttgaggcactgcagttggtgccgcagaaacaacagtgaataagagaaacacagtccccattgacaaatgttaattcaaatattaatttcacaacaaccctataaagtaggagtaggaactgtttttattctcattttatggaggaagaaacagaggcacagagtgttatttgcccaaggacatgcaaagtagcagagctaggcttcaaacttgggcattctggctcccagctactgagtagcagctagacattagagatctcaagcacagaagataagatattgataggcctgaacccatgagtcatcaacaactaaatgataattgaaagaatggacaggagtaagattgtccagggcattatacactgagaaaataggccttaatatttaagtgttgttgagaagaaagagctagaaaaggagactcagaagtcgtggtctgggaagtaggagggaaactagtagaatgtgacatcacagagtccaagagaaaatactattttgaaaacagatgttcagttctgtcaagtgctgctgctagaagttgtatatggactctctttagcatcttacaacatggaggtcatggatgactttatggagggtacttcagtagagtaataggatagaatccaaattgtttttgattgaagaagagaaggtggtaaggaaataaagattagttcaaggtctttaagcagttaggggaaggtggcattcacgaagacagatggcctttggggaggcatcctttgcaatatgagaaagcggaggagaaggtaggaatacaagtaggtaacttattagacttggtggcaaataaatgagatagttattctctggtggatcctgttaaatacaagacaaggatttctgctgagactcgggaagaggagagatgtttgatgtgaacgtgtacattttaaaattgtcattctaaagggttgagtacagaaacatggtagaggttctggacagtgtctaggctggtagccatgaatttatggtagcctcaatccttataaatgtatgatgctttttccaacagtgttcggcactttaggtacaagcatggagaaggcagttagttggttttagttgaggtttggtagccaggtaacacagagagaaaggcatggattttaaagtattggcagaatttattgaatgtatagaccatgcagtccaagatgaatataaggcagtaggaaaaaggcaggtgagtagtggttagagagaaaatggactgattgaattgcttgaggtttagctgaagtagcgtaggagtagtagccataatttaataggttattggaagcttttaaagttaaggctatatggtgggatgtatgaattaaaagagttttttttaatggagcagttttaagtgatgtcataatctaggataacatgagattgaatggttgaggggggattttgccagagtctatctgcatggctgtgttagtccattttgtattgctataaaagaatactgaggctgggtaatttataaagaagagagatttatttggctcacggttctgcagtctgtataagcaaggctccagcatctgcttggcttctcatgaagcctcaggaagctttccactcatggcagaaggcagtgggggagcaggcatgtgacatggtcagagaagggaccaagagagagaagggaggtgccatactctaaacaaccagatctcatgtgaacttgcagagcaagaactcattcatcaccaagggaacgccaccaagccattcatgagggatccacccccatgatccaaacacctcctactaggccccaccttccaacactggggggggcacatttcaagatgagattttgaggggacagatatctattatcactgacgatgcaacatatttcaattttaaaaataataagatgtaaaaattgctgtttaaaaaaaaactaagtaccggtgaagtgatctttaatactgctaaaatataaacactttctataaaattcataaatccatactaaaatatgtactgagtaaaggttgctgcttaaacaaaaagcagagggaaatattcatgcagaatgaagtttaaatatgtgattgttgaacaaacattatgactctagagccttaagaagtaagtcagataattagagttggcagtagaaatgtaaacaaaatgaatatcagctaattagctggattttaatgcatctatacctgtacagagctgtttcttctaaactatactggaattttatctgcatagataaatgtagacagtttgattgtggtgctgtgaatttgttttggatttttgtcattggtttttgttttgttttgttttttcagaattgagggtctctctgtcactcaggctggagcacagtggcacgatcatagttcactgcatccttgaactcctgggctcaaggaatcctgcctcagctctctgaatagctgggactatatatgcacaccaccatgcctggctaattactttttatttatttatttatttatttatttatttatttttacttttttttttttttttttttttgagatggagtcttgctctgtcgcccaggctggagtgcagttgtgcagtctcggctcactgcaagctccgcctcccaggttcatgccattctcccgcctcagcctcccgagtagctgggactacaggcgcccgccaccacgcccggctaatttgttgtattttttagtagagacgggttttccccgtgttaaccaggatggtctccatctcctgacctcgtgattcacccacctcggcctcccaaagtgccgggattacaggctactttttatttttttgtagagataaggcctcaccattttgcccacactggtcttgaactcctgacctaaagttaccctcctgcctctacctcccaaagtgctaggactataggtgtgagccactgcccctggcctggatttattctataaattaagtcttacctaatgtatgaaactatcatttgattcataaaaaaatttgtttttgttaaaaatttttatggtctgggaattaggtgccttctaaaggaagtcctctaaagatttcatttgccagactttcttgtgttatcactttatgatgtagatttatggtttatgtatttttttaagtttttttctttaaaacattttagaaaatagttcactgacagatcatagggttaaccattttaataataataacgaagtcacttctgctacatgatgaaatgttttcccaagagaggtcatatatctgagtatgccacaatttgtttgcatttgaaagcaaacagctccagtcttgtaatttagctgaaaattcatttaaattgataataaaataaacataagccttgagggcaatgtttgtttttaacttaacaattgatatttattttataataatttgaagtatccgattcctctgaagtagtacaaatagagattctaaggtccttcaaaaacaaggaaattccagagctttaataggataggcatagaacagaagaatttttttcgtggctctttattctaaacacttttgtttttcattcttgacattaggtagaaggctagggttagaaaagataagcagaagagattgtcatcttagttttataaataccatttaggttgatgcatttacttgtgtaatcatattttatgttatttttagttattgacaaaacaatacccacagttgctctaatttataaattactgctaacttatgtgtttcagttcttaagtctaacttgatattatgattattaaatagtgacttccttagttttctctgatgtggttactatagtcaggtagaaagaacactgtataatacagtttaggtttagctattaaggcaaataactccagcatttatgagtttctgccgtctaatgctttataactaaacttggaataatactaatttagaattgagccctgaataactagttatagtagacttctctctatcatctggtcaggcttccaatttttaacatgtctagtcccttatgattcactcctttattcagcaaatgtgttaagcatctgttatgttccatgccatgttctagtctctggaggattcagcagtgaacaaattagacaaagtttctgctttcgtaagatttacatgataagggggtaaaatgttaaacaagttcacaggataattttagatggcaataagagctctgaagaaaatacaatataaccatgtgataaagtgatggagggtgggaaagggagatgatgaggactactttaggccaaatcggagccacagtctgaataacatagaagggtcaaccatggaagatttggaggaaataacattctaaagagaggaacttaagagttctgtattgatggttcatttctttctttcctttggaatgaagaagaagagaaggagggcagcaatggtgataaaactttttttatggtttattgtgtgccaagtacacagtatcagtactggggtaattacgtcatctccatattgtagatacactgaagctctgagaagctaattccttagccatataggacatgacagaaatgggattacactctgctgtctgtagcaaagcacatgaccgtgtccacatattattcccaaaaccagtgttgccagggttggtaccacaacttttcttccttttctgtttacttgcttatcagttacatacctaaatctcataaaaatgaactagcagttgccgggcacagtggctcacgcctgtaatcccagcactttgggaggccaaggcgagcgaatcacctgaggtcaagagtttgagacgagcctggccaacatggtgaaaccccgtctctactaaaaataaaaaaattaggccgggcgcggtggctcacgcctgtaatcccagcactttgggaggccgaggcgggcggatcacgaggtcaggagatcaagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaaaaaaaaaattagctgggtatggtggtgcatgcctgcaatcccagctactcaggaggctgaggcaggagaattgcttgaacccgggaggcagaggttgcagtgagccaggatcatgccactgcactccagcctgggcaacagggtgagactctgtctcaaaaaaaaaaattgaactagcagcaaccttctagcccatgaaatcttccacttcttgggcaacaaagaataattaagttatgaaaactaaaccataatcacactcgtaatgcttatgagttaataatagatttttgcacaagttgtgtttgaaaacatttattcattgcacttaagtctttctcaaaacacaaagctgtccttgaatttttaatatagttcattaaattgaaaaaattctcattttctttcccatgtttttattcttcaatctctgactcttttcatcaatagagtaaaatggttttcattatccagtgagtacatataacaaaaactttcaatatatataaagacagccatgtgatttcagctttaatctctctttttattctgaactaaagtcagatacacttcaaaatgttggtaaaatgtatatattttggtgtgacattgtgacagttaaggtatacattcagccttttctcaggcatattgaaaatggtagtagttgaggtagttgagacactgaatgaggtagatgttcacgatttagaaaaaaatattattttcaattttcaaatcatatctgatataaatgaagggaaaaggtaataccttgtcatttcagatgaaactaaaatattttggctttatcaacagacataaattttgaaggcttaccaatacaattggtatgcttttatgtaattagagaactccaaaaagcacttagaaatagctcgtaaatctaccatatgttgacagcactttaatgaatttctctagactgtgaataaaaatttggactccagtgctctttatattttattcacttagaaaaagtaagacaggattgctcagatttattgtcatatatcataaaagtaactacaaaatatctactcattatagttaaagatttacagtgaacattttatagtatgttttctcttaattatgttaattgttcacaaatgagaacactcaaaaccagtgcttctaagattaaactaagattagatccagtggcctggcatctctcaggagtttttcatagggatccaacccatagtgaaatctcaggaggtcctctcaaataatggagtttaattattactcataaatgggcagttttccacactaacagatgttctcaatctcatgcaaccccactacttggtgttgcaattcccactacttttccttatccattcaatactttcccctgtgtccagatagttgctgaatcagcatttacccactttatgaatactcagaataaaataccaacacttagactcctctcccccaacctttttttcctatcaaattaacaaagacagaaaatcatgttaatacctagtttggtaagagtggggcaaaaatttactctcaggcattgctgttgggaatgtaatatgataaaagtgttctggaaaagaaaaaaaacaagtgctgtatatatgagtagatccttttagctccagttactcttatcctgcattggggaatctatccaaaggaaataatccaaaaatgtaattatattatgccagaagcaggtcttggaaatattttatatatttagtaaataagaagaaacatctcaaatattcagcagtaagggagtgcagcagatcatggaatgctcacataacagagtaatatgcagccattaaaatttatgcttgtttattcaagggcatgggcaagtatggatatggtaaataatgcaggatactttcatgtatgatatgatttcagctatggaaaatatagagaaaaatgatgtggagctatttctaaactataaacctaatattcctaaatatttgcttccggttggtatgtgatccttccctctgcctgtttttctgtactcatctgaatttccatactgaacttgtaatattcttttgatcagaaaatattaaaggaaaatcacaacagatttggaaaacaatcattaactaaatttctgccccagtcttactcaggattcagtttttccaacctctaaagatttaaatttttttaacttttcatactagaattcagcttataaagtcttgaaagtcacctttttccctttctgacatctgtttcataaagaaaatgacttagtggtaactggatttccttctttatagtcaatttatagatttccatcttagaaggttgtttatttacaacaacatctattagctgttaatattatcctcagttcacatggaaatggaggtgacataaagcttaaatgaagattggtcataaatccttgcacagtctcagatccaactactttgtctttatattatccaaagcagttcaaaaagacaaaggctgctgatagtaacaagatttctccgttgaaaacacacacacattcataaatcaatcgaaagtgtggtacaaaatagtatgtattttgtattctttaaaaaaaattgagcatttctaatctcttcattttccttaaccatttagaagtcaaaagttgaattatttgtgataagtgtatatgctctattaatatattattgctatagataagcatataataaagtttatatttattactaacatacatggaaattttgggctactgagatacctggcacagtcagtgactttgtctattcctacaggatctaattgaaaggtgttaggaaaggcatagcaaagagcctttttcctgttgttacaagcagtaaatggcccttaagaaacttcaaaaagaatgaatgcttgcttgagaaagaagggagtaagagaaaagcttttcggtaatgagcaggagaaaaaagaaaacctggtctgagagataaaagaggtgactattaaaacggaaggacacagtctaccagaaactcgtgaggctttacaaatcaaaatctagactcactttaccatggaaactgaagacaattagaaagtatatgtttacaattttgtaatattttactttatttttaattatccaaagcaaatataagactattcatgataggaattgatagtttggttatgactacaccgatattgaagccatgtgtaaatttgaaatacttaattttttaaagctgtttcatggaatctatagatgtgacaaaaagctaataatgtattctgtcactttacttccttgtcaccctaagactgtgtttctccttccagtaataggatacgagctacttgtctgagaacatgtaactggagtagacttttatgtagtgatctgaggcccttactagatctctttctttctaagggaaatcaccaaattttgagcctataggtaaatcatttgtaaaccgggggttggctgggcgtggtggctcatgcctgtaatcccagcattttgggaggccgaggcaggcagatcacctgaggtcaggagttggaaaccaggctggcaaacatggtgagaccctgtctctactaaaaatacaaaaaaaaaatagctgggtgtagtggtgcatgcctgtaaccccagctactcgggaggctgaggcaggagaattgcttgaacccaggaggcggaggttgcagtgagctgagatcacgccactgcactccagcctgggcaacagagtgagattctgcctcaaaaaaaaaaaaagatggggctacttgaaataatcattgtattggagacatccagctaatgaacttaagaagtagctcttatagggtggaaagaacattacctttagaatctagaattctggtttctcaggctctgtttggttattaggtattacctagagcaaaccctttatcacattgtttttttttaattgatttaagtaatggaatatgaaataaatgtcttttaagcattcctttaaatccatttttctagaactatgatacactaacattcaagttcacagaatattataaattaggggaggggtatagtgggataaatttccttcctgtaactcaaaacttcttaacccatttttgtatctaaacacaatgactccttccagtgaaatgtagagttgtgtttcttgccatacaatgcttaggtagtccagatatgtatacgtgggaatgaaaaagaagtagaaaagttgggcatctttttcccctggaaaaatattgtgttctatggaagagaaagtagttggtggatagtggaaagaagatgctaagaagtagagaagtcgttcaaggaaaacagtaaactgcaatattcacagaaacagttgggaatatgtactgattctttacttaggggatgaccatagttttaactcatttcttaccccaaattcgcagattgcattctattgtattataaatagatctctcattttaatgaccaactcaagggatattctggcagccgtggtgagaatgagaaacaaagatttttatacccagcaaaactgactttcaggtgtaaatgacacaagcgggctattgtcagcatgcaagaacttgggaatattgtttccaggaccctttcctgatgaatatacctgggaacaaacttcagaccaccaaataaatactgtatgatgtccaaaataggcatattcatagagacagaaagtagatcagtggttgcctaggacaagaggggttggagggaaatggggagtgactgctgatgcacacagcacttcttttttgagatgatgataatgttctaaaattgtgaatcaactcagtgtgagtatactaaagccactaaagtgtatactttaaatgggtgaattgtatgatatgttaaaaagaaaaacactatagttctgagttttaattgaaaatattaatatgagcatatgatatattgtattttaaatatacataaatatgcatatatatgtatgtcccctgaaaagacctagaaacagtatgaaaccagtagctatgagcatctctaacacacagagtgcgggcttgaattaatattttccactaaccagggcttcttggagaagagactgaaattggaaatgtacaagatgagtctgaaatatcaaaccaggtaacaaagaagctaacaaagactgctagagtaaggtcaaaggactcaggagccaactggaagaggcttccattggccaaaaatgagaattttgagtttcagtaaaaataagaactataatagattaaaatccactaagtacgtttaaattgataagttcaagccatgggcagtgaagcatgcatgtaatcacagctacttgagaggctgaggcaggaggatagcttgaacccaggagttcaaaaccagcctggacagcatagcaagaccctatctctaattaaaaataaaaatcaataaatggataagttcatcataatgaaaagcaaaaataattggtcaccttcaaagaatgacaggaaagcagttatcttgaaaactggtattttcccaggcagctgccaaagatggaggggcaggtcctggtgctcactggccaaggccaccttctggtctgcctgacagccgtcctggataggcaggtactgctgggccagaaggtggtggtcgtgcactgcaaaggcatcaacatttttggcactttccacagaaacaggttggagtacctggccttccttcacaagtagatgaacaccaacccttcctgaggccccccatctgcatcttttggcagaccgcttgaggcatgctgcttcgcaagaccaagcgaggccaggacgtccctgaccaccccaaggtgtttaatgggatcccactgccctatgacaagaaaaagtggatgatgcttcctgctgctcccaaggttgtgtgtctgaagcctgtgagaaaatttgcctatctggggtgcctggttcacgagtttggctggaagtaccaggcagtgacagccacccaggagaagaggaagaaggccaatatctgctattggaagaaaagcagcttatgaggctatgtaaacaggcccaaaagaatgtggaggagaaaacaattacacagaggtcctcaagacctatggactcctggtttgagcccactaaagactgtttattccttatgattggcctggcctgcccttccaccgttgctgccgtggggtgtagaggacccaagggtggcaatccaggtgccacagacagcctggtacttaggaagctgggggtaaggaaacggcattattcaactgcctttctatattgttactttaaatgactctaagaattgttcaggcgtagtttgtctatggcctactcgttcatgagagagttgttttagaaaaatgagggccgggcacattggcttacacctgtaatccgagcactttgagaagccaagagatcgcttgagtccaggaatttgagaccatcctgggcaacattatgaaaccccatctctaacaaaaatgcagaaattagctaggcatggtggcacatgcctgtactcccagctacttgggaggctgaggtgggaaggtcacctaagcccgggaggtcaaggctgcagtgagccaaaattgcaccactacacttcaacctgggtgacagagtgagaccctgtctcaaaaaaaaaagtaaaacaatagtaagaagagccagttaccttggtttcaagattagcaaaagggagctggaacatgcattggagggagccctaccttctgagtgggccatctgttttaacttcccaccttatcctatactctgcagctgtgataatgtggaaaaaaaaaacacttggggacagtatgagcttgctgttttacaaagagtatgtatagaagcatagactgggaagatgtgtgaccagggcgttacagggtagcccttgctccttccctgtattttgtggtccgaatcaaataaattgcttttaaagaagaagaagtctggtaaataaaggaaaagaatcaggcatttatcttgcccctcctgtatgaactatatcactggtaactaaatagtagataagcaatgtttctcttaaaattatacctgcttacaaatgaaagtgaaatgataaaagtagaaaatcaccatttttacaacccctgatgaattaatggatctggaccatggtcaccaacagctgcttgcttctcaaaaggagagcaaaccacatagtgcctcctgataacatatcacctatagtcttgccaaaggcatcaagtctccacatccagcttccaatttgtcataaatacagaaggaagaatgtgccaaactccaccatacatatgcagtcaggaacccatagaataagtctcccacagttcaaataacccagatttgtccacataaattataaggaaaagaaaagaaaaaatgagatgcctgtggtttaaaataagaggcttcaaagtcatccttttttgaaatgatcatgactgtctatagtgtctaatgatgtagatttggttgctaaaaccatataagatagtaaatgccaggatgtggttactttgggggagagagaaggaagtatgattgggacaaggcccacgtagggtttctagggtggctggcaaagtcctgtttcttgatctggatgctgcttactatggcatgtgtcttataatgttacactaggctatacagctgtatgtttgtgttggagagttcatatctgtgtgtgtctttttaattaaaaatattttgaaataactacataatttttaaaaggttatttagaaagtcaagcttagtggaatctgccttacatcttgagatatattttggatctctctctgtaaataatacttaatgtactgagttatcttgatgtatgtaaattacagattatatttcaacataaaacaagcataattcaaacatgtacatgtaagtattctataatacatgtctgaaagtgctgctgtaaacatctgtgcagttttttgtatggtcataaattttcagttcgttagtttaaatactaaggagtgctattgctgtatcatatggtaagagtgtgtttagttttgtaactgccaaactgtcttccaaactatctgtactattttgcatttccacctgaaatgaatgaaagttcccgttgtttcacaccctcaccaacatttggtggtgttagtgttctggattttgaccattctaatcagtaggtactaattagtatcttgttgttttcatttgcatttacttgatgatttgcgatgtggaacatctttccatatacttatttaccatctgtttgtcttctttagtgaggtgtctattaagatctttgtcccatttttaaagttggaatctttgctttctcattattttgaagagttctttgtataattttcattaacagttctttattagatacatgttttgcaaattttctcttaggccttggcttgtcttctcattctcttgacagtgtcttttgcagagcagtttttcattttaatgaagctcagcttgtcaaattttttctttcatggatcatgcttttagtgtcatacctaaaaagtcatctccaaacccagggtcatctagattttatcctgtattatcttctaggagttttatagtattgcattttacatttaggtctatgatccattttgagttaatttttgtgaaaggtataaggtctgtgtctacattcatttttttttgtatgtgtatatggatatctagtttttccagcaccatttgttaaaaaggctatcttttcttcatttaattgtctttgttcctttgtcaaagatcaattgactgtatttatgtggatcaatttctaggctctctattctgttccattgatttattctttcaccagtaccacaaatcgagacaagattatcttcatttctgtatctctatagaaagtcttgaagttgggtagtgtcaatcattgtcagaaattggctattttgaaccttttgcttctccacataaacttcataatcagtttgtgtctacaaaataacttgctagaatttttattgggattgcagtaatctattattccaagttgggaagaactgacatcttggtattcaatcttctatctataaacatggaatatctccatctgttctttgatttttttcatcagaattttgtagttttcttcatatggatcttgtacatattttgttacgtttatatctaagtatttcattttttaggtgtgtgctcacaatggtattgtgtttttaatttcaaattccacttgtccattgctgatatataggaaaacattgattttctatattaaccttttatcctgaaatcttgcaatactcacttattagtttcagatttcttttgttgattcagattttctgcatagaaaatatgtcatctgcagacaaaattttatttttcttctttcctaatcagtataccttttatttccttttttattttttcttataggacatctagtacaatattgaaaagcagtggtaagaggggacatccctgccttgttcttgatgttagtgggaaatcttctatttctcaccgtattatgatttttcaaatgtaaaagctgaaccagcacaaaaccaatatgtttattttcccctgccttctggattctaattaatcattggtagaggaagtttaggctgtgtgaagagtttggaaagaccttaggaaatttttttaaatgtttatttatttaaaatttttattaaactttattaaaatgttcaagtttcctgaagtgtttagacatcaagaaatatttacatacatctctagtttatatttccatcctgttgatttccctattaagaattttaatgaggccaggctcagtggctcatgcctatgatcccagaacttttggaggccaaggcaggaagatcacttgggctcaggagtttgagaccagcctgggtaacaaaacaagaccatgtctcaaaaaaaattaaaaattagctgggtgtattggtgcatgcctgtagtcccagctacttgagaggctgaggtaggaggatcactggagcctaggctttcaaggctacagtgagctatgattgtgtcactgcactttagcctgggtgacagagtgagaccttgtcttaaaaaaaaaaaaaaatttaaaaaaggcacttaaaagaagtccaaaatgtatctcaggaaagttgtacaaaatgtatctcaggaaagttgtacataaaataagacaggcctcattttacagatgtttctcaattatgttattccaaatctacagtattggcatagctttcactgttgaaaggtgttttcatttcttaaaaatgtttttaacctcctatcaccagtcctatgctaaaacagggtattttacccataaactaccacaaatagataaaaatagctactttacatataaatggccctttaaaactggatactattgtatgccaatttgcaacatagtctgtatgaaaagagaaaacagtaataaatgctgtgttatggaccaataattagattctcaatgtggtgtaaagtactcacacaaggttcattcttggcctcataaatttgaccatatcttttcattctaatgctcttaaatgacttagagacatgacttaacagtaaaataagctcctaaacaacaaccgcaagcacataaaaaacaaaattatgcagtgatggcatgccatttgttcaggaattggctgtcctatttactcttaaatataacagcaaatggagagttgattgttaaactgcacattcaggacctcatggtttaatatctcatgtgctatttgccagactaaagattattaacaatttttgctttgttcactgcaggaacaatacagtacttgtattatacaaatattttgattaaagtattgtttccaatcaatttatttcccattcctttcgaattacctgagttaacctagttcagtggttctcaaatgtagtgtacatcagaatcccaaggagagcttgttaaaatacaaatgtataagccctgctctcagagcttctgattcagtaaatctgggttgggcctgttaattggcatttcttagtttctccataatgctgatgctgcctgtcttgaggaccacattttgggaaccactgacctattaccatgaaaccattctctctacaatgagcagaattcttttttaaaaagttagctaaaaacaaaaaatagaccttatgatttggctgtcaccactctttaggaaagcatgttctaatttactgggtcaagaactgaaggaaacatttcttctataggagatcatagtaaagcttcttcttgaagtcttacaaatgttgtatttatcaaatggagtgttaaactattcgaggtttcatttatatttgggaaaactcttgttaaataaaacaggtagaagagccctcttaaaatccctgaagaatgtatgacacaaatttctatcattaatatataataaagattcttttttttgtattttgtttgttgttgttttttcctgtattatattttgcttaatctccctggctgcataattgagttacctttatttttaacttttactttaggttcagagatacatgtgcaggtttggtatataggtaggtacatggcgtgtcatggaagttaggtaaacagattattttttcacccaagtaataagcatagtacccaataggtaacttttcagtcctcacccttcttacacccaccactctcaagaaggccccggtgtctgtggttcctttctttgtgtccatatgtactcaatgtttagctcccacttacaagtgagaacatgcggtgtttggttttctattcctgtgttagtttgcttaggataatggcctccagctttattcatgttgatgcaaggacattgtattagttagggcgctcttagagggacagaactatatatctgtagatctacatatatcctgtaagtattaaattaatacttaataaaatataattattaagttaatatttaataaactataagtattaacttaatacttaataaactccccttttacatataaaacttacacgatcacaaggtcccacaataggctgtctgcaagataaggagcaaggagaaccagtccaagtccccaaactgaagaacttgaagtctgatgtttgagggcaggaagcatccagcacgggaaaaagatgtaggctgggaggctaagcccatctctccttttcacgtttttctgcctactttatattcactggaagctgattagattgtgcccatcagagtaagggtgaatctgccttccccagcccactgattcaaatgttaatctcttttggcaacacccacacagacacacccaggatttatactttgtatccctcagtccaatcaagttgacacttagtattaaccttcacagacatggtctcattttttatggctgtgtagtattccatggtttatgtaccaccttttctttatctagtctactgctgatgagcatttaggttgattctgtatctttgctattatgaacagtgcacaatagatacatgcatgtgtccttatggtagaacaatttatattcctttgggtatatacccaatactgggatttctgggttgagtggtaattctgttttaaattctttgagaaatcaccaaactactttccacaatggctgaactaaatttacattcccaccagcagtgagtaagtattcctttttctccacaaccccaccagcttctgttatttatttatttttttttttactttttataatagccatataatgaagttttttaaacaggcttttgaaatcttatttccttaaagatccatgttgacctttaccagaattgtttatttgtttttattatcactgcctaaaataagatagtttctttttcccatggttatcagccatttgccctcaatggtactggtttggagtgactaaaattagggccagagtaacagtacctcacttttactctattttatagcaaatgaaatgttcagtattgacattaagtttttaaacagtgtgttgctgtatttgtttagtgctgaaacagcttgactccatttcttttgcaccttgattctgtgggttttatagacagccggtgtttggtgcctggccccaggacgggactctgcactgccacccatctgccatcacttctgttactcccttttacccttgccttgccatccaccatcacttctgttatttcccttttaacccttgcccgcctatgttttttccacttagagctttggatcttttttaaacacacatgctgctatctcactctttcttttagaactagtccttttcaacaaatctaatagatcagttacttcactacttaggatgattcttgtctgaacaataaccttcaggatgttggccagtctcagaagaaaacatatacatgtaatgtacataaatcatattgggtaaagtcagttttatctaaaactgagtttaagatcttcaaaaacacttccatgaactttctttacagttttgtgctattctctttctaaatttgccaattgtatgtggtaaggttgatggtgaggatttatctgattaccttgtggagtattcatagtatttgtcttcattttctttttgaagaggagtggaagttattacttgatccttttcctatgtatcacatttttccagtgttacacttcaaaaacaagtgttattatgagtcattgaccacagctgtcatgtttacttacgtatcccaagtgtttgtgcaacttggtgcctaagtacataggcactaaataaatatttgttgaataaatggattaacatttttaaaaggtcaattatgcaagcaattcctttttgaaagtttgtaatttagaaagtttcaactatgttgaaatatgtgcgtgtgtgcaatagctttaaaaagcaataggcggggcgcagtggctcacgcctgtaatcccagcactttaggaggtggaggcgggtggatcacgaggtcaggagatcgagaccatcctggccaacacggtgaaaccccgtctctactaaaaatacaaaaaaattagccgggcgtggtggcaggcgcctgtagtcccagctgctcaggtggctgaggcaggagaatggcatgaacctgggaggcggagcttgcagtgagccgagatcgcaccactgcactccagcctgggcaacagagcgagactccatctcaaaaaaaaaaaaaaaaaaagcaataaaaaaacaagacatttagatagtgcatgagtagctacaatggacaacataaattatgtttcttgttattatttgtgtttgtattctaaagaggcatttgcctgccaaactatttcagtctgatattttcaaaactcttctaataaaaaagatactgagttatgtgacattttgatgttctgatgatgatcgttattaaggcagggcattgtttcattgagttgtttatagtactgtaagaatataacactgatctattaaaaacagatgcagtgttgtcatgaaatgggatatatgaaaatatgttaaagcctctaaatgaaaaaaagataaagatgctttcaagtaaattagcaaaattcagggattagcaaagtatagccaagcccattcattcacattttgtctatggctactttgaccctacagctatagttagtgagtgagtgaatgaattgaatgaatgctgaccagaaattgcactttcaaacatttaacctgaggaaatagttatatatacaaataagtatgtacagggatgttcattctaagctgtttgtaatatcaaaacaagggaaacctaaatattgactaatagaagactggctaaataagttctggtgtatccttattataccagaactagtgtatgatacagctatttttaaaaagatgttacagaaatgtatccagtgataggaaacaagggtcagcaaactacagccctttggccaaattggctcaagacctgtttttatactaccagagctgtgagtgggttgttaaattttaaaggattattaaaaataaacgtgagacagagtatgtgactagtaaagcttaaaatatttactatctaaccctctatagaaaatgtttgctgacccctgatatagaatgttgtatacaatgtagattaaattggtagggatgggtttaaaacattatgaaatagtatatatagaacaatatctttttttaaaaaaatgcaatcaataccatttagacacttaagatgttaatagttatttctgggtagacaagattaataagattctatattttatgtctaattttgtgatttttcaataatgagaatgtattcattgtttaagaaaataaaaatttaatattggcatggggaaaaagagaacttctctaagtttcaaggtgtacaaatatgtttttccattttgtagatgaggaaactgagactaagagtttaattaacttgcctggagggacacaaacataagacaaaaattgcattgatgccaaattttctgtccagcagtgtcaccatttgataatttaaaatgctcatctgtcagctgaaataaaactatatactctgtacccaaaggcaatttaaaggtatcagtgtataatatatgataaaggaggattatgcagaaataacaaaccacctgcctaatggtattaggtgtgtactggataggtttacatttgcttaaatagaatgaaaaaatgagtagcttacattttacattttttaaaagaaacaaaacctgtatacataggtattcagttgactttgtaaatttgcaaactattactactacataatatggtaattaattgctctttcatacctatagagtttaattgttcaaattcaggcatgtgacacaaaaagggaccatgtcctgaagcttgtgcccttcaccgtaagatagaggaaggacatttgacttatcagatccttgtgcaggtaactgtttacaaaatgagtcagcaactcagaaggagaatgaatacaacagtgagaagtctcattgtaatgaactgatagctagtaactcaaagaagcagtaggactatagaaagcagacatgaaagctcagcagcttttggaccatttagtgtgtggacaaaaggcctagtatccttctattattcctgaggaaaccactatcttatagccaagaataataactattgttgctcttttaaaaaacacttgttcctttaattataaccatcttgtgatttgggaagattattctctattcacttatttagaaactgaggcacagaaaggaggttaagtgagcgttcaagatcgtacagactgttcaagtgataatggaaaactccatcacctagtcccagctctgtatgcatatgatggtgatgctgagtaaaggcaggatcattctacatttcaccgaatcataaaaaaaagataaacgtgtctttaaaacttatataaattattaaactataaatattttgatgctcttcagagatgaggttcagttaacaggaaaaaaattcactagtgtagaatgcttcataactaaaatatgtcagggaattatgatatgcagtcatgcctaggtatctgtgggggtaggtttcaggaccccctgaggataccaaaatccacagatgctcaagtaccttatataaaatggtacagtatttgcatataacatgaatacatcctcctgtattctttaaatcatctctagattacttataatacctaatataatgtcattgctgtgtaaatagttgttatactgtgtagtttaggaataatgacaagtctatacgtgttcagtacagatgcaaccatacatttttttccaaatatttttgatctgcaactggttgataccacagatgtggaacccacagatacaaaggtccaactgtatatgcacagatgaggctatcattttttcttttgtctttttcttgaacaaagatcaccaatcctggattttgtatattttaatgatttctgatgtctgaaagcagtagtaaatagaacatccccaattttaaccctatgatgtcacatattaacatctatgtagtggagtccataaattcagttagaaatcatagccagatagagtatgtgtgctttcataattcccatctctttagtaggcattatattttttaaaatatgtcttccttttgatgtgaaatgtattttcagaaattatttgtcatatttagtgtaaacattattcactatatactgcatatttttctaaatgtcatgttggcgatttgcccattttttaaacctaaaattgagatagaatgagtagctttaggcactgtataatgacttggattactgtggtgttcttgctgtaatttattattatttatcattcttgggcaggtattttagtaattagaaagcctacaataacacatgtggtacacttaagaatagtttgaagcactagagctgtatagccattgggtttcctctcccttttttaacttccatattgaatgcatattagaaggacatgtaacttttatcatactatttccttgctcccagcccgctacttatttatgtgtacaaaagcatatactttcttcttgaggaaaatttttttaaaggaccctaattatttcttaagatttattttccttctatcaggtagccaatacagtattttttttgatgttgtcgttcatatatgtttgcctcttacactcagaaaagtcccataaccaatgagagctactgcctttcttcctgccctatttctcataaccttgatgacccagaaatctctccacttaccataaatgggaggcactaaagtagtgttaggacttccttaagacatctgatgtgctcttttaaccatcttttaaacttctcttcctggtatttaaggccatgagcttatcttatttaatctgtctctctctcaccattttctagaccctagtaatctagctctccacctgctcgctatcatgaaaagcacttcctcttcccttttgctttatctcttgtcttcctccacattaatccagagcacatacacaaacatgtacataccttctcccaaataagtacatacctgcatctatataagtgtcacgtcttcaaccttacctctccccctagacctaactcactttttaaaaaaaattcccacagttacagcatgtatcacttaatttattctctacctatggtttgtattgttttgtgttgtatatcttatgcttatatggttttatatggctgacttaccttcctggttgtaagcttcttgagatcagggatttaattttttctcatgtatctctcgtatagcccttaccacgttggtaaatatgtagtaaatgcttattaagtcttaaaataagcctgtcctgtggagcagaaacgttcctcaggaagtgtcttatcgagtgttcccattttacaaaagagaaaattggaacagtgaagtgacccattttctttatgacataactggtgagtagcaagccctgaaccagaacctagggctcctgactcttagttcagtgtgcctgttcccaggcagccttgaccacgctgatgctcagggaaacactgccacgagaacatggcatttactgctgctcacgtggacagtggtgatatccatgccctgaacaacagcctgaagttcttcccagcattccccatttttcatcttgcctccttaactttataaaaccctctctattcaggaactagggaatgaatgagagtcctctctcatgaaaaaaaaaaaaaaataatgagatacaattttattcattcatttatcaacatttactcattttgactaggagatagcataaaagccacttctcttcactacctcttattttttcatgagaataaatatctttaaaaagctagataaatctaaagtgcctattcactagaacattctacatttagatttttaaactatgcttacaattggaagtgttttcctttgtttaaattttatgcttttatatattagtaaactcaagactaaaggacagctaccttgattcttcttggttataattgatggttattggcaggatagcatgtgtagcctttttattttgaaaaaaaacaagttgggaagatctctgtgctttaatatttcaggaaaataagcaacactcttctcatctaattgcctgaaggctaaaaattgaattgtattgaatcacaggggagaaaaacaaagtaattgacaaaagcagtcatctaattaaatatattttttttaaaaaatgaagtttgtaatgaaatttgacaaatacaacacataattttttttaatttaaaacttcggttttaggttttgatcaattacagaaacagaatgagaagaaagaaagagacggtgaaagaaagatgtgtgcccacaggggagagtccctctggatcaaaaggatcacccgtctctgagatgacaggaagctggtattcacttgggtgtagctggcagtaaaccatcccacatcagagcatttaactaggagaataggccctctctgaacttcagtttcctcatctgtgtatcagattatggaactagatgacctttgatgtcccttccagctctaagtttctgctggattagttatttttacatacctttattctgatatttaaatctttcaagggtctactctaaaaagccagaatagcttaataagtacttactggtttagtgattgattttggcccatattatgtgcaagtttatcaactcaactaacagtatatgggtttagttatttgcagccaaagatatttgttgtgtctatggcatcttgtgctgaaagctttatgtagtgaaaatgagtaataggtaaactgtacttgtacaaatggtgaactagtgtttgatcttttaatggtgaagttttcaacatgagcatttgaagaaaagctttgatattgattgtgtatttcaaactgaagcatgtctgaactgaaaatatttccttccaaagccatctgttcttattcatttcttttttccttattctttgctctggcatgtatatattcctacatagttctttagggaactgcaaactaggaaggcaaagaaaaccatatgtcttgtttacagccttgtctgatactatctgtcagggtaaagtaaaaagataaatgtgtttatttgatagattttaaattttgaagtttttaaaacgttgatcaaaaacagcaataagactgatgatgttacttacgtgtaaagaaaagatacagttttcatgtagttattttgaaattcttaactttaggctataaaagtttttatttaaagttatttgttagttacatgctcgaaagaactgttgcatcgtattttaccacccttctttcagcaagttacattgttttgacttttgttatgaatgtaatcagaatccttagaatgcaaaatcttttagaaaattcttgttggatcattagatgtctgcccatcccaaactaattgctagttgtacaaaaaccatattttcttttagtggacatttaaaaatatcttctattagcaaggattacattttatgaactgtaatttttcacctgactctcttaactttataaaatcctccccaccaaatagaggtaccaacaaacaccagaaaccaagattggtgaacaattggttggcaaattaacatttcctatcttcaaaagatgatatttgtcttgcttttttcccagtcacattttagtactagttttgtagcttctgagtacttatttttccagtgataaatcaaaaacagaaatgatcagccttactctccctcttttttctggggaaattgagaaccagaagagttaactgaccagctcaggcctcacatggaaacagtagtacagccagtccaaggacctgggtccggggctctctccatcatgcctatccccatttgaagtagcactaaagtgccatttagtgtactttttgtaaaaatttgcttttcagcacatcatctaatatgtgctacttaaaacttaattgccctttagaatgatttgtgatatgcctccttcattctctcaacaattttaattttacaagctagttttattataagctcaccagtttaggtagaaggatgttctctttcagaatctggattcttcctctagtaacctcatcagagctcaggaggagataacaaatcaaacattgagattgaagttgattcagtctcgggtatgatttgactcaagtatcaatgagctaattaatatttttatctaaaaatattttgtaattgtgccaaaggttgagactctagaatactggagataattattttcagacagtagcaactagtggaacgggatggagcactttgcaaacaatgtaatatcaatggcttcttattacaatgccccaggtatgttattaggttgatgcaaaagtagttgttgttttggaccatgaattttaaatcattataactaggctcaaacacatctttattaatcaaataggaaccattacaatcaacacatttttgccaacaagaaataagtttgtttattcctgtagtgtacaaatctgtgctttgggattcgacaaactcttggaaagcattttctgcatccttctgattgtggaaatgttttccctgcaaaaagttgtcgcgatgcttgaataagtggtaatgggttggcaagaggtcaagtgaatgtggcagatgagacaaaacttcatagcccaatttgttcaacttttgaagcggttttgcaacgtgcagtcgggcgttgtcatggagaattgggccctttctgttgactaatgccagctacaggcattgcagttttctgtgcatcttatctatttgctgagtgtacttctcagatataatggtttcaccagggttcagaaagctgtagtgtatctcaccggcagcagaccaccaaacagtgaccattacctttttttggtgcagatttggctttgggaagtgctttggaggttcttctcggtccatccactgagctggtcatcactggttgtcatataaaatccactttttgtcgcacatcacaatccgagaaattgttcattattattgtgtagaataagagaagaagacacttcaaaacgacgattttttttttatgttcactcagctcatgaggcacccacttagccagttttttcacctttccaacttgcctcaaatgcaaaatgaccatagaatgatcaacatccagttctgtggcaacttccgatgtagttgtaagaggatcagcttcaatggttggtctcaattggtcattaccaacttcccatggctggccactatgctcctcatgttcaaggctctcgtctcctttgcaaaacttattttttttatttttttttgagacaagagtctcactttgtcaccaggctggagagctgtgacgcagtctcggctcactgcaactgccgcctcccgggttcaagtgattttgctgcctcagcctcccaagtatctgggactgcagccatgtaccaccacgcccagctaatttttgtatttttagtagagacggggtttcaccatgttggccaggataatctcgatctcttgacttcgtgatccacccgcctccacctcccaaagtgctgggattacaggcatgagcccccgtgcccagccacaaaacttcttgaatcaagactgcactgtatgtttgttagcagttcctgggccaaatgtgttgttgatgttgtaggttgtctccgctgccttaccacccattttgaactcaaataagaaaatcactcaaatttgctttttgtctaacatcctttccatagtctaaaatcaacataaaataaacaataattcattaggaaaaaattaataaagcgagaaatgcccattaaaattatatgtaacataaccacatttaagaatgtattccagtatcaaacggccaattccaacaatgcaaaaaccacaattacttttgtgctcacctaatcattaatcttaaattgattcatttatttattaaatgaacatctattgagtgccagctgcttccatgccctcgttgagatcgtatctagtggagttatcaaacaataaacaagcaaataaaataattaagacatgataaataatggaaaagaaacaaggtgatataataaataaggatggccaactttgtgtggggtggttaggaaaagacctctcgaggggacatttacacagattcctgaaggtaagaatgagcaaggcatacagagggctcaggaaagagcattgcaggcagaggaaactgcaagtgcaaaaaccccgatatgggaaggggccgctgttcctgtctgttaactgagaatattaatatcttcctgcctactactcataggagccctgtggtgatatcagtaaatttaaataaaaaatgacttaatctgggttagatctgtataataggcagtgaaggagaaattggggtctttttctctacttctaggaagaaaaattattgggggatatgagagaaaacacaataaaacgttcagagatctctctcttgccttctgtatcttgatttagagatctgtatcaaagactgcattgtatggtactagttatcagtgtgggagttcacagaaggcaaagatcttgacctggagtcttggcctggacttgactttggccttaaagaatgggtaaatttggatcagccaaaaggaggcagaagagagtgatttaaaatgagagaatgtgtaaataaagttgctaagatggactgaacatgaatgagaacttaagaccatgaagactcaaaagctggagctggagccagagccagatggacagaaaataattgaagggtctgattcatagaggtggttgaaccgttagtagagcagatttgacccgatgttagacaacacaggaagtcattatcatttcttgaacaagaaaattgtgtggtagaaagttggtaacgtaaatacagattaatggaaatgaggaaaaattattaatggaaataaggaaacaagcaggctaaataggaggaccttcttttttttaaatcgtgcatttcatagtacctggcaatgagaacatggcctatgctcctatcagagaatgaactgcatacaagacatttcaaatgagttaacagtgatacttagtgactgatggaggcggtaaatcaaaaatcaaaatgcctgttcacttgagtccaagggactgaccagaaaataatgtcagtgatagagctggggaagtttgcccagaatattaaatgattaattccatgttggacatgttaagtttcagaaaataacaagacacccattttgtgatgtgtgtacacaggtagaagtactgaactagagctaaaatagaaggttgaatttgagaatgcaaataggtggtgagaactgaagccttagctcttgagaatgcacacacatgattaaaagtgtgtatgtcggggaagaggcaggtggggagtaactgacacgcacacacacacacacacacacacacacagagagagaacaagagagaggagtctgaataagtagaaggcaccaaaacaacagttggataaaagccaccttcttgaggaaataccattatcattatcaccataaaaactacaactacctgttagtgtttactacgtgtcttaaagtctttaaatataataacttattatttctttccacagcctttaaaaaagtaaatgctgttgttatctccattgtacagatgaggaaggttaggacagagaaattaggcaagttgtacaagattgcccagtttggagaagctgagctgagattcaagcacaggcattgtgcttcaaagccctcaactgtgccatatggttatatccaacttggtgttttaattacgtggtttgacttcgatcttatgtaagtttcttgaaaaggagttaattaacagtttttacaagttgggtagaaaccagaaagtcaacagatggctgggcagtgattggataaatccttgtagcagaagacaacatgaaatttctctggggtaaggcagagaaagggaaagaagaatataccctttgctctacttttttttctcctctccatacactacaagttattgatacagggaattgtcccctttgacaagagttacaataatttgtggagaaaatggcacctctgttttttagcattttctatatactacaaatgtatttccttatttgtatacaaggaatgtcaatttatctaaattgactgtcaaccaaagtcatttctttattgacttccactactaaatgagagttagattccaaaagatctgtggtatgcatgaggaaaattttaaatttaaaaaaaatttttttttaagattccaaaagatagggcttgggaagtagcctcaacattggtattactggattaccttcagtctgggagcccaagtgcctggatgtctcagtggagaggctcaggacttagagcaggagttagacactgaagcccttccctctggagaagccacacgtgacttctttgtcgattgctttagtgaatgcttccccagtggctgacagagaactttgcctccattttccatgctcttcagggctcctccagcctctctcacttcttccttgtttgaggaggaaatggtacgcttccagtccaccatgctcagtcatacggcttaaaggagaggggaacaggtacctgcttggtgccacaactatagcaggcctttcttcagtaaataagctagagcttttctttggacctaaaactgaggatgggcctcatctaattaatcttcctaaaacacagttctgcacactagactttcattatttttccattctaaccagaatgaaagttttagcctcgcatttgtggccctccatgttttggcctgagctgtggatgcctgacctcatttaccagtatcccctttttgtcagggaggctgccccattccctgtttattctgtagggccccacttgccgccttctgtcgggaggaggctgatccctcagggattccctctttacttttcaatcttcactccggtctgtggtattatcggccccagttcaatgctgcgtacagttctcatctaaatgccatctccagcatacagtctcactgaactcacctagtattttatctccagctctcattatatctgtgttctagatatttatgtgcatataattatcttccctagtaaactctgggcagactctgtacctaatttaacttagtattttttatatcacttacacttaacatcagagaaagttaaagctgcaagggctgaggagacacacagacctgtgataatgtctttttcaaacttctttctctgtgctctagtaaataatagtgctgaaggtaggatagaccagatctcctggttctcagtccgggtcttatcctccaacaacagtggttctcccactggcttgcacattgaaatcacctggcgtcgcctgtgatgcttttaaaatcctgatccagaagcttacaaccatagaaattagaatctcaagagtaagacgttcacatcagtagcatccaaatctccccacatgattctaatgagcaaccaagattgggattaaatatcccccagtatgatggcccctggaccattgttgctttactgggtaattctgttaatttggtaaactttttgtcagatattaaaagtagaaaatactaaaatattaaagtagaaaagtggtaactattagataatagtatagttcatcttgttttgcttgcaacagtagcttacagttaactgtttgacttttcagatttttcgaaagaaagcagtggaacttggggtaaaattgctacctgcatttcatactccctctggaataccttgggcattgctgaatatgaaaaggtaaaactcttcattttcaacaacatgttttaaggtgaaatattccagattgttgcctaataagtatacattagatagataattacttatatgatactggtgactaacagactccactgggagtcttgagatctgtctttttgttggcagctattagcttttcagtgttccatagcctcagatatgtccccattgtgggatggcgtgacctcaacagagtcattcaggccagacacgattggaggtttacactgtttcatagtgactttgcatcaatgatactgtctccataaataccaaaagagtcccgttatcttttaattgtcatcaaagcatttcacttccaaagaagcaaattcctaagaacctttatttaagttcagctactggtcagaaatatggcagaaatacaatatttggcctaatcagatcccccataaaagcagctggtataacggagactgggagcacctgtggttacccagcccccagttgtaagaagggaaggcagccaatgcactcacccagatcaatccaaccttctcatcctctttggtggagaaccctgatatgccaagttcttgagaatgtggctccaattggaaaagacacacacacacacacatcccaggctgaacagactttctggtgttctcccagagagtagttggagttttcataacttaagcatttcattaataaacgattttgtcttaagcttccttcttaacgccttcctgcccataagttattaattgcctgtacctctctgtgataatgatgagacagtgatgatagctattattgtcactataaaatgtgatgggctctttagtcctcttaccacatattatcctcacaacaacccagtaaggtcaatgctgttatctccattttaccaataggaagctctagtcacagagagattaattaatttacctaatatcatacagtaagtaaatggtagagctagaatatgtacttagatgtctatacgcacatcgatgcatatgtacaaatgaaacagctttctggtttagaaacaccaagagaatgcatagcatggtttggcaagattaatgcacatttcttcctaattatttattttagtgacattctgtccaaatattaatcataaaaccatgaaattaatcagtttattttatttttcctttaacaaatttgtgagatgccatgctttagtttcatttgtatattatatatctacaccttgaaatcatcctgtacctatctataggtgtggggagtggggtggggagagttcacacctctgggccatgttaaactgagatattaatcgttctctattgcagaatgtgatgcctcaggatctgttcttcctttaagggtcctcaggctttctctgtcagcttgaagatcatacatgtactgtagggccttaatgcaggggtggctctgagcttggcttggaagcagcttggtttgtgtttggaggcccatgagtatttgactcctgtagaccttctttcttaccttttatatcttcagaatttgtatttataggtagtattctgaccaagatactactctcttacctaaaacaagatctggtcacaaaagcaccgtgcacaattaactcatttttttccctactgagaaaagtgttatgggcatagtagtacactaaactaattggttatcaaaagacctgaatctaggtctttacagctactcgaggtttgtcttgcagcagtcatttaaactctcttggctaatttgtaaccaggaaggtaggtgaactcagtagttactttgtgaacattttggggttcacagaccactttcagattccgatgaacatatgcctctcataaagtgcatattcctgactacatggatttttacacaatttccaaaagctaacagtacaatggaagaccaccaatgaccgccagtttacaatcctagagcagatgatcactccagccttctcttaaattctgtgaagctagtttctctcgtttcctggaaggtaatgaaattggagaaaggcctactaaatctaatagaggtgtgggctacatctttgcaaaagtcgagtccatttttatgagatgctgatattgcttaattagtactggcctcccttgaaataagcataagaaattggaattcaaaatatactattttgaaatatatttaactttactgtttatttccaactgccaagtagatttttccttagttaaatctatccttagtgtaccatggagatatttttcagtacataaatacttaatttattaaattactaaatcctctagtatctttcatacctatgtctgtcaagaatttattaaccagggcattcaaattttttataagacttcattttgcgcagtattttacattagaatttatttaatttcagagattacagaaaaattgcatgtggtgaaaaataatgtgtcattttcatttatgtattcactgatgttttgaagttaaactggatgaaattgagcaaccatttggcagctgataataatttcttcttggcaacatgcatgaatttttaattatatattgtatccactctcaatcccatttactaaataccagtgacttacccaaattcacacaataagcactggcaaaattaatagtgatattagttcactaaaattccccctgttcctttgcctaatcaagtacactccttgaatcagctgtacttccagctgtgagactgatttatcatcttaagttttcctgtagggcaagaagcgacatttcatatttatctacaagattacttttcaaaatgtgctgttggtgtcatttgtacatatatactgttttgcgaatcactttattttcacagtatggtccaaggtatagggaacagctggcctagagctgctttcgtagttttggaaggctgtcaccagcaaaagtttcaaaggagtggggaaacatatatctggcaaaatcatattttcttaattaccttctcagaataagagaatgtagaaagctgcccaggagaagaaaaaaggagggcttaaagatgctttttagactagctgtgcattcattgttgactggctttgaaactcttggcaagaattaccactggagagacactgaatgtgctggctgtaatatcataattctgctcttccctctcaattttgaatgtgtctctttgtcaacatctctatgttaacaacagtgtgaacttattggtattatctgttcacattcctctggtattctggttattgcctaaagataattggtttctttaccttttctttgtcaaaactaagcatttatttgagtctctcctgtgataaagatttcttactaagtcctgggaagagtttctacttctcttcactttattcaagaagataacagacatgttctttccctcaggggactcacagcctggttggtaaagcagaatttatttttgtgtgttacacactcacacatgtaattgacaaacctaagatggaccaaggagagataataagtactcaccaggttgaatttgaagcaagcagcattttgaattggggaggtttatgtatttggagacaaaacatcaataagtcaagttgtatttcagtatttgtgcaagctgaatatatgcagagaacctaaataattcactcatatactacatgaggaactctatcccaaaagcggttcagaaaaaaaaattttaattgtcttttctgccacatctatttaaattgttaatccaataagaattcttaattcaatagattctgaaattgtgatttaatggaaagtactcatttaataacctagatgctatacagttcctcactagactaacatgtttccttcaccaatatgatcatagaatgagaatgcataagttacacacctctgctaaaagaaaatcattgcctttctaatattaggttttggtagaactcaatttctctaatgtgaaaatgtcaaagtttggtgtctattcttgttattactattagcaagaggcctatgcttttttttctcgaacttgaagcagaaaaattacctctgtgatttgtaaaatcaggcatttcaccatttctgtatttgcaaaggtaattcaagtctaggtagagtagacttagattttgggttttttaaagtgtgttcttaaaataatgtagttaatgttcccattattcatttctatcacagggcatacagtctgggcattcctaataatttttctgtctttcttgataaatgagttagttttagctatacactattttatcacttctctgtatggatttttctgacgcctgcttggtgttacatttagtagagctgtctacagtgtgtgcttttattgcacaccatgaaggtgtgtataggaaatgactgatcttcattcagactctcattagtcagtgaggtgatgaatgaggcacaacccctcacctgttttatttcctgctttgtaaagctttatttactgactattctaattatctgatgaaaatacatacgatgtcattggttacattacagtttatattattataattaaattgcaggttgctctactttgactgaaatagggctttaattaagaatagtacatagctgcctgtcttctaatagtgaaagattatcctagggaagcatataatgtgtatattttaagaaaaggtgatagcccccttgttgggtttattaatactttggtggtataaaatgtttaaatattacattatagttggttaattttaataaacacaaactatgaaagatgatctgataggttaaatattgttaaagtgttttcctatatctccctatgtttttacttgacagttaaagcataaatttctgcattattaaatttgctaacagttttttaaagttcctggtttcagatttgaaagaagtatattatattttcaaatgaagcagaatacaattccatactttaatataatagaaataatatgaaaatatcaataaacaaattttctgaacataagatcaaattgatttaatggtgctagtattctatgaggcaaaaatattgcttaattatcctaaaaatgttctgtagcagtgatataagcctgagtataaaatcagagctccatcttacactttatgttttatttatatactttatggatctattaagaagtcagagacaagtttagaaactgtagaaaagttttttaaaaagaagttacatctttctaagtattttaagttaaccttctttatggtttctttttcttcccccagttggattttttttaaatattgggttccccacttccctcttttatctattttaattcatttggccatttgtagtcttctggaactagtaatcaacaatactttaagattttaatagtggtatgtagttattaatgtcaaacattagaatattattaccatagttaaagctgctattagcagtctgtctctggaaaattcacttaacttttcataagtaaaactaaaataatagcaataataatgcctatcttgacctcataaggcttttatggaaatctggttaatgtgcagaaggttaaaccttgcagagtgctatgaaacagatggacattggaatttttcttaatttatggttctattctcaatatttcattatgaaagagtatatatgaatatggtatatgataaaatagtatatatctagaactgactaacttggttctgatgtcctttcgtggacatcatttcatttttaagctatcagtgctcctgacctgttcaagctggagttgtattttcctctggcagaaaagagatgatggaaccaattggatgtgtggagagaatgtctcaatgtggtttatgtaggatagtggtggctccgtgctcaagcttttattattttttaaattatttgggatccaacctataggatcaaaactaaatttgctccctaaaattatatttattagtgaattatgtactaaaaactagaactgttcagccgattaggttttaaaaggatgcgaggcaatccagagttatgttcttatcctaagtcttacatgctagctagtgcctaattaatgtggtacaaacccagtctatgaaagtgtgtgtgtctgtctgtctgtctgttataaatagccacatagccctgtttcctagttcttggactgttctgctaagggtctgactgttctggttgctttgtatcagtgactctcaactttcccatgcctcagaataactgggattctaatatatatatacacacacatatacacacacacacacacacacacacatacatacacacacacacatacacaaacacacacacacacacacacacacatataattgctgccttcatctttcccttcccccagtctgtttcaattggtttggggataaaattctggcattttttaaaaacctcccaggacattctaatattcagctagggtcaagaatcattgttttaaatccagcatttatatgctgaggttagctttatttctcatctcagttgcatttgaaaacattgggtttaaaacgtttccctattcactgatggtcaatttaattattgaaattttaaaatcctagaaaattactttgaaaatacccagctttaatagaacagtgcttctcaaactttagaatatataacaattgccaggagagatcattaaaacataacattgctggatcataagcagagagcctgattctgtaggtatttactaagaattgataatttgcttttctaaccagattccagctgatggggaagctactgctgctgctgcttgcccaacgaccacactttgagaaccactgtaataagaaatgactgagccatcagagccatgtagttaaatctcagagccgttcagtgaggcagccaggtccactgttggggaagcaggagtagggcctgtgttctgtttctatcatttgtttactttcattaatagttacacaaagtttccacttaactctaagcagtttgttgcttcttctggaaagcagccaattccaagcagtaattacccaaacagagtttgcatgtcctttttccccttgtactttttttttaatccagtgagactagaaagtaaactttaggcatttttagcatagaggggaaaaaataagcatttttaattagaaacttctgggttactgtttaaaagtaaagctatttccataaagtcacactttgtagcttcaggcaaaatggctttactataaacagctggtaacctggccctgtacctaagggtactgtgaagaatgaagcagaatcagggattaccctcccaccagatgagcaggagggaacagaggtcacttctgtgatcatttaatcctgtcaccaaactttggatcactacagctctgccaggcactcaataccttgaccaaactaaggacatttatttattgcaagtggacagttataacaggatagcaacacttaatttaaatgtactttgtgtatagccacctttatggagacattacggacaaggaagtctgaacaaaggatgttcttagtcatgcattgtgaggcggtaggaatttgaagaacctcaggatgcctgaacctcaggatgcctgaacagtttcctttcttcccacttctctggtcataattgaagttaacactcaggtaaatgggttttttaagtgttttttattctctgaaggcaggagcagaccatatctgcctctgaacacaggctgtagcggtcctcatttcttctgcaccccaccctcccgccttttccttgaatttccatctgctcaggctcctgctgtgtttctgatagggcaagagcaggaaattgacatgaatggaatgaccaggttcacgttttactcaacaataaattagatattttaaaatatttttctatactttcagaaagttctacaatttaagggtaaattgtagcatatgaataattaaagtggaaaaatttatccaaggtgatgtgtagagaatttagaggcagtttatcccgagagttgcttaaatccctttttaaatgacttgtatgtgggaagtctgttaagagggcttcctcacccttcaattttgggcaaatagaaccttggttcaaagcagatgggactggattgttaaatatgaccactacttttcccatagcatctaccacagtttaagcagttaactcaccaggaaaatttcatgtaaggacaattatagttattttaatgcaacaatttcaaagtggctttcatctcaagtttttcaaatgcacagaactagtgttttacagattcagctttgttcactctgttcacacaattggttgcgaatcagcctcagcaatttgaaatttatgctgtgtacagaacttagattgggaacaagtcagaatgcgtaaattcatatacctccctcacaagctaacaatggaataatcttttcaaggaattgaattccccaggtttttaatgacccagcaatcaattttcctgtgattaatctcaaaactggtcttacgttgttattgtgggacaaacctttcaaatatctaattagtaaagtttaattttaaaatttatgaaatagtttgaatacatggttgaaaatcagcgcaggtatcaaggcactttatcagccctcataattgttaatcattgtaaatattcaactaactacattgaatctttgggaattggagggtcaatataaaatatttaggctacagccaatagttttaaaggcctcacagtctcagtggatacattaactactccatgtttcctgcttgtgcagtaatagttatagttgatatgttctgaaaaatgggatgaagaattattaattgcagttctttttattaactagagaaaaaaagtgatggagcaatactgagaattaattgtaatttacaaatctggaaattaatgtgcagctgcgcgtaagtacaggcagtgcaatttggtgatttagcaatcatgacaaattatcttcatctataaggtggagaattgttaggattcctttattcatcttttaataatagacccagtttcaggccgggtgcggtggctcacgcctgtaatcccagcactttgggaggctgaggcgggcggatcacgaggtcaggagatcgagaccacggtgaaaccccgtctctactaaaaatataaaaaattagccaggcgcggtggcaggtacctgtagtcccagctactctgcaggctgaggcaggagaatggcatgaacccgggaggcggaacttgcagtgagccgagatcccgccactgcactccagcctgggcgacagaacaacactccgtctcaaaaataataataataataataatagacccagtttcaggaagactttatgtgaatgctcatgttgcccttttatcctgaaaatgtgagtgggagtttaacattataaattaaatcttgcttcctctctttgtcatgtcatgctatagtttttatggaacatttgtacaaaacagtgattactgcatatgttgaataatcttaagatgctactgagagtttaatgtaccttgtaaattgagaggcttccaattaagtcaagttcttaagataatcactttcaaaactgatcaagtaataggacattagtaaagctcttattgacttaattgtgacaaattaataaacagaccctgtgcaattactataatggtgaacagtttttcaaaatttaagcataaatctattctaaccccccaaagtacattaaaaactatatatgccattttaagatgggtatcatttcaaatagctgtgttcgagttcattatacaagtagtatgaatttgtatgtttctttcttttaaaatatgattacatttgtttatttcaaaggtcaattaatctacttgcaaagcccttagagcatataattttacaagaggtcttccgtatgccatggacaaaacaattacatgttcttatgtgttctctcatctctacttttattatgtcctgtgtccttggtgttatctcttcactgagaactatagaatatcttgtcttattgtctctttgtcccctttggggacaaagtcagcatggtacctttttatacattgaaaaatgaatcaattatgaattacatatttgccataatttttaatatctgacagtgccaattcctataactgtgctgactgtgtttaagaaaaatcagcagaaaagaaaaggcagaaagagcagggatgtaagtcttgcttccatcactttaagaataatgtgacagttacatatatttgcctaggtccatctaactgtgtgtatttaaagtgctgtgctttattgaatataactctatctttttaagtgtgatcacatatctttttttatttaaaaaaaatgtagcatgctacccagccattagtcaacataccttgtttaagcatggattttcttatttgttaaagtaggactaataagtagtatcagttttacaaagatcacatttatgacaggacctagaaagttgaggagctgagcaatattttacacccaagagaatggatcattatggaatttcaggacttcatacaggttgctgccagcatagtgcccatccagatttcctgaaatcatcaaggggccatccacactatgtttgatttagaccttagccagagagggagagggagagggagaggagaagaaaagaaacgcaagacaaaaccaaaaagcaaaaaaggaggaagtattactgactgacggcagcagtgactccctcttaaaagtaccacggacgcaaacttgcagtggggctgaaaaaaatgtaggagagggagttccgtgtggtccagggattacaggtgtgagccaccaccacacctagccaataatgaagtttactgctttaattcttcccttcatgaaagatttctctgtaacatgtgatactcttttatggcattttccacacggtaaaacttctttccaatttggagtcagtcttctcaaaccctgctgctgctttatcactgtgtttatgtaacattcttaatcctttgttgtcatttcaacagtgtgcacagtgtcttcaccagatcccatctcaataaaccattttctttactcctccataagaagcaactcctcatccatgaaagttttatcatgagatggtagcaattcagtcatgtcttcaggccccacttctaattctagttctcttgctattttaccacatctgcagttacttcctccactgaagtcttgaacccctcaaagtcatccaggagggttagaatggttagaatcaacttcttccaaactcctgttaatgttgattttttttttacttcctcccataaattacaaatgttcttaatggcatctataatggcaaatcttttccagaaggctttcaatttgctttgcctagatccatcagaggaatcactgtctatggcagctatagcctaatgaaatgtactttttaaataataacacttgaaagtcaaaattccttttttttttttttttttttgagacaaagtctcactttctcgcccaggctggagtgcagtgtcacgatcttgactcactgcaacctccacctctcaggtgtaagccattcttctgcctcaacctcccgagtagctgggattataggcacccaccaccccgcctagctaatttctgtgtttttaatagagatggggtttcaccttgttggccaggaggtcaggagttcgacaccagcaagtgatccacctgcctcagccttcctatgtgctgggattacaggcgtgagccaccacacccagctcaaaattactcctcaatccatgagttgcagaacagacattatgttagcaggcatgaaaacgttaatctccttgtacatctccatccaagcttttgggtgaccaggtgcattgtcaatgagcagtaatattttgaaaagattctttttgtctgagcagtaggtctcaacagtgggctttaaatattcagtaagccatgttataaatatatgtgctatcatccaggcttttgtcttccatttatagagcacaggcagaacagatttagcataattctttttttttttttttttttagacggagtcttgctctatcatccaggctggagtgcagtggtacaacctcagcttactgctccacctccctggttcaagcaattctcctgactcagcctcctgagtagcagggattacaggagcacaccaccacacctggttaattttttgtatttttagtagagatggggttttgccatgttggccaggctggtctcaaactcctgacctcaagtgatccgcccaccttggtctcccaaagtgctggaattacaggcgtgagccatcacacccagccagatttagtgtaattcctaagggccctaggatttctggaatcataaagtcaccagctgcatttagaccctaacaggagagtcagcctgtcctttgaagctttgaagctaggcaatgatttctcctctctagctatgaaaatcctagatggcatcttcttccagcagaaggctgtttcatctacattgaaaatgtgttagtgtggccactaacacattttagtgcggtagtcttagccaagtcttctgcacttctagcacttgctgcttcaccttgcacttctatgttacagagacagcttcttctcttcaccttcatgaaccaacctctgctagcttcaaacttttgttgtacagattcttcacttctgtcagtcttcgtagaattaaagagagttagggccttactctggagtaggttttggcttaagagaatgttgtggttggtgtgatcttctgtccacaccacctaaaactttctccatatagccataaggctgttttgcgttcttatcattcatgatttcgctggagcttttaatttcctttaactgtttggcacaagaggcatagcttttgttctgttttcacttttgatatgccttcctcactaaacttaatcatttctaggcttttgatttaaggtgagaggcatgcgattctcactttcatgtgaacactcagagtccattgttgggttattaattggcctgattccaatattgtagtatctcaaggaatggaaggtcctgaggagagggagagaaatgcgaaacagctggtcagtggagcagctcagaacacacatgcttacaagttaagttcatcattttatgtggacgtggttggtggcaccctaaaacacttagaattgtaccatctgatcacagatcaccataacagatatcatcataatgacaaagtctgtaatgttggaagaattaccaaaacttgacagagacacaacgtgagcacaggctgttagaaaaatggcaccaatagacttgacacagggttgccacagaccttcaatgtgtaaaaaacacagtatctgtgaagtgcaataaagcaaagtgcagtaaaatgaggtatccccgtatgtaaattttttaaatgtataatttttaatatgtagaattatgtggctgggtgtggtgactcatactctgtcatctcagtactttggaggccgaggcaaaaggattgcctgagcctgggaggtcaacagcagcctaggcaacaaagcaagacctcgtctctacaaaaaatttcaaaaattagccgggcatggtggcacatgcctgtagtctcagctactcgggaggctgaggtggaaagattgcttgagtccaggagatcaaggctgcagtgagccatgattgtaagactgcactccagcctaagtgacagagtgagaccctgtctctcaaaaaaaaaaattttttttaatgtttattttgcatacatacacacacacatatacaaacacaattcttaaaaatgagttcagaaactcctgaaacttttcctctggaagattttaaaataaggtagaaaaactcaatttttaagttaaatgcaaacatgaattttaaaggtgaaccactttcacaaatattttcattaaatttagtttccaagtaatcttttcttagaatgagtttctttcaaaatgcagatttgttctattgttaaattgtcacctcctttatcttgaagtgggagatcaagtgtgttgttttcttcttttcaaattatctggtaggaagcatacttgctgacaaccacttgtcacagaaaaaaaatcagcaaatgtggggatacctttctattttgtgaaatgacaactcttgattaaatactttgcctcaagacaatccaaaaatctgtttggtgcagatattattgtggtcactgtccagctctttacaaagtattgtgataatgtaataattctactgtgcaaaggttttggattttaaaattaattgcattggtggcactctataactcataatccgcaatacatcaaaagcctctgaaagctgtagaacagtgagggtcccattgccaacttcttattgtggagtctctgcaagaatctctagcatctcttgtgtgtcacctttcacagaagcaccaagggatgggagcaatgtatgtctgaagatttaagaaagccttttttcttgcttttagatttaagaattagcagctttgatagtttcctcttgtaccctgtgcttattgcactctaattaagagtcctgcatttggcttcaaaggctgctgccataaacaataaatatctaaatgtcattcacctttaagcccagaccagtttcttatcatctgacagtttataatgggcatattgtctcattacattaagtggactttgatcctctttagattactcttgagaatatttttttaattggcttaaaggaaaattctaaattatttttaactagatgtaaatattacaagactaaatttgcggcacactcttatttgtattaattttctccactttaaagtaggccaaactgtgttcatgtgcccagagaggttattgattagataaagaggttttcttaggtggttttcatgtgaaatcgcttggaaagtacttaaacacattactctctaatattggttgggtaagcaataaagtggtggagggtgtcaatctgtactaaaagagtgataaatgaacaacatatttggtgctagtatccaaaatttttgctagattcaaagggattcaaattatagaattcactaatctgagtttctgagtctaatgagcaagaaagtgataatttcatatttatgtttgataaagaagtttcaaaaaatggaatttgtggtgtaagcataagcactatatagaataatccttaagaattataaatttgcttttcaagtttttctaaagaagggaaaataggtcccttttcaaactgaagacgttacaaaatacattattgtgttgattctaaaggaaaacagagtaaaagagaagaggcaggagtcaggaaaattatgaatttagaagctataggcagccagataagctaatattagtgccttatgcttctgtaattttctatagcctacaaggatttccaaatatacacacacacacacacacacacacacacacacacacacatatatatgtgtatatatgaaatctcattaatttgatttaatctaatctggtacaagcatgaatatccaattttataatttgaatttccttttgaaatagtttggaactattggaaccgaaagaaataattttatgcttttaaacttcccaatactcagggcaaaggcagggaagataaaattatcttagtattttattggcattgtaggctatcactcattggcattgtaggctatcactctgtctatttgtagtatattgatcattaagtaattccaatgtttttcttttttttttttttttttttgagacagagtctcgctctgtcgtccaggctggagtgcagtggtgtaatcttggctcactgcaagctacacctcccaggttcactccattctcttgcctcagcctcccgagtagctgggactacaggtgcccaccaccacgcccggctaattttttgcattttttagtagagacgaggtttcactgtgttagccaggatggtctcgatctcctgacctcgtgatccgcctgcctcggcctcccaaagtgctggattacaggcgtaagccaccacgcccagcctccagtgttatttttaaaagttttccatgggtcaggttgaattctacgtacctaccagaactatatttcaccagtaatcctagggtttgatatatacaaccacctttcattaagcttattctcactatttaaagataaaaaataaatgtaaagttcaaaatctttctctaaagagttaaaagtggcaactatatacatagcacctttcttgcctggatgtgaaagctaggattatagaacctgaattcttttaaacatgttttgttagaactgattctccttcctttatgccatctttttgactccactgctcttctgtcttctccccgtctttgtgatcatgtgatcaaacgtgaaactatattcagtgagagcctcagtggtaagagtgaaagcatttccccccagtccaggggcttcatccttccttcagtgccttggccaggccctcagggaatgaggagacctttgctcttccctccaccttgtcctgactcctcaagcctccagccttgaggaggcttctctagatgaaagctcctcagtaattgtattagtctgttctcacaccgctatgaagaaaaacccaagactggggaatttataaaggaaagagatttaattgactcacagttccgcattgctggggaggcctcaggaaacttaaaatcatggtggaaggcaaaggagaagcaggcaccttcttcacagggcggcaggacggagtgagtggcagcagaggaaatgccagatgcttataaaaccatcagatctcatgagactcactatcacaagaacagcatgggggaaactgccccatgatccagtgacctccgcctggacccacccttgagacgtggggattatggtgattataattcaagattcattgtctcaaaacatattagcactctgcttttcatactttttccctttaatcaagaatctttaatagttttccaaaagcttcagggcttgtctttaagtaggcactgcactctgtaaccctatgttcatccacatgtagcccctttgaaggactttacctccaacaaaaccctgctatttttaaaggttcagttgtgtcatctcatctgtgaaagatgtcatcatctctttctctcatccttgtcccttccccactttggaaaagtaatcaccacctccttctcataacacttggtttcccattgccagtataagctatactatggagttgagggactccacaaagttccattaatacataactgtgttgaaggcaagaaaatgaaagctcttgggagaattaaaaagtaatatgttcacttggggttttttccccctaaaacaaaaaaatgttcatattcaggaaatatcaggtgaacacccttctcctagatcctggaccaggtgcaggagataagtggtaaacgttttcttggtgactctcacagagtttatagtctagggaagagacaaacattagttaatcacaaaaacatttcgaattgcaggatgtgaagaagtcatttttgagctgggatcaaggggatgtgtagatgagagctaggggaagagaagagagtggatggtccaggcagcagagcatgtggagtgtcaaaactctgtattgaaaaggaacaggacaaggccaagaggctgaaggatggcaaagccccctggggcagagagcagcaggctggagagcgaacactgacagactctgtggtggggtctcaggtttgtcttggcatcagtgggaagcactcaaggtcctgaggaggacatggtcgtgtttgtgtttaattaattcaggttcctgctcatccctgtctcaagagccataaagcattatgaccaaatcatgccagctatcaggagcgatcgttttagattgtcatgttttacctctttgatatttgtttaccttttcccaaaaacacaagcctgcaatgcaggttcctagctggataggcccttgaaatgttgggtatagtattaaactctggttggtctcctggaattggtttcaccatcaagcagtaaagatttcatttgacatcatctgtcatcagatcatttgactagaaactgctaccaaaacaaaggcctgacttgtgagaaagagcaggtatttgacacagctagcaagtttgtattttttagttctgttcacttgtttcagatagtcaaaaataactttaaaaaaagaatcttcctttaatttgaagaagagaatgtcgtgtaaaatgggttcaggttcacaattgctacagcttagaatgagtccagttaccaaaaaactgaagtcagaacgggcagatatatgtacatatctttatctgtttgttttctttatttttaaaacagagaagaggggattgcctgagttgaaaacatgacagagggattagcactgtaggaaaccaagagaaaggttcatgaaaaatgaaatgttctgtgctagtattgttaaagtatttacactcagaggacataagtggatgccattgattttcagtcaaaaatgcttgaagctcaactgcatttgtgaaatatatacctacatatttaagctaacataacaatttatagataagtaatatttcccaaattgcattacccagaatattatgtccatgaaatattaattgatgatctatgaaaagaaaacagctctatagataaataagtttgtcaacactggatttaaaaggtttcattactgtaaacttctcagaactattaactggctaatgtgcaatgtacattgctcatctctgggatggagctttattataacactgcttcccaaacttttttcaccatggaacctcttttatccaaaacaattattagtatttctgatctgcattttttgttttttttttttgtctcagaacacagtttgatagtcactgattctgataattgttgttatatgtccttcaaaatagtcatcttaatatcattaccctagtaataaagttcttgcctcaaatatatttgaaaataatttgaggtaagtcatttattacacgtgtatactagttactaatgagaatactctgtggtgtgttatatgaaatcttaaaaagtacccactgcagaaaattagcattattgctgtgtttatgcttctttttaataaaaataaaaaagcaggcttctgtttgccctcaatgagagaattgaacgctgggaggccaagtagtgagaacaagggagggtcacacagagttacacatatgaagttttgcaatgggccgctatataagggcccacactttttatgcctatattttgtcattttttaaaaagtataagattgacatactataattataactatttattttcatttatggataggtacataatttgtatctttatttagaaaaattctaacatttccttccaaatttgtttttttaagttcttcagatttattctgaatttcatatcattgtggctaagaaattaggggtttttctttaaaaaaaatagttttctaaaagagtctgagctattttgtgataaaaatttaggatgtatagtcatagaattctttttctgaattacaagggtcttttgtgttctaataacgtattccattatgtatatttgaatggcaagtctagatggttgagtttctcagtgaaaaatttggtgaaagaattattaagatttttgaaaattatcactatatattattaaagaaaaccctaagtcaataataccacaatgtcatgatatttgcattatgatcatttgtgttacccaaagcttcggattcattataaacacatgaaataccactagggttggagtgaagttaatcacattctttgctcttaaactaaaggtaaaactttcttcagttaagttattgaggaataaatatgctggtgaacaatcaataagtaattactacaaaactgtattacaggggtctctctgaaccatatccctttcacaagtctaataaatttcaacattgtttaacttttagttgaatatgttaaactaagaactaggatataaaatgttttgtttcttgtctctttttctctccagtaaatactttcatattttttaaaaagttttggtttcctaagcatttcaatgaacagagcaatgaaatattattgcagatgtatttctctatatatagtgcattctcttaaaattttagtgagtaaaactttttgttaaattcactttataaaacagtttcttttttctgattatagaaaaattttcatgggaaaaaataatcactcgaaatttcaatccgatgttaacatatgcatcactcaattctcatttttaaaaaacaggccaagtgcaatgacacatgcctgtaatcacagcacttcaggaggccaaggcaggaagatagcttgagtctaggagttcaagactatcctgggctatgtagtgacacctcatctctataaaacatttaaaaatagctgctcatggtggtgtgcacctgtggtctcagctactggagaggctgaggcaggagaattgtttgaggtcaaggctgcaatgagccattattacaccactgcacttagcttgggcaatagactgagaccatgtctcaaaaacaaacaaaacaatgaaattgtatacttccgttccattcgtttttgctttgtatccactttttggaggcataatttacctgaagaatacacccattttaagtataaatttcagtgtattttgacaaatgtatacgtctgtgcagacactgccacaatcaagatatacaacttttcgttactcacaaaactttcctagtgaccctttgcagccattcatttgccatcatctgaccccaggcaaccactgatatgttgctgtcagtatacattagttttgtcccttctaaattttatacaagcaaatgtgcaatatgtactctgctgtatagttttttttggtacagcatggtgtttgcggttcattagtaagtattctgtgtatactagttcaatcctttatattgctgagtagtatttcattgtatgaatatactatagtttattctcctgtttatggatgtttgtgttatctctaattttcagtgatcataagtaaaactgcttatgaaaattcacgttcaggccgggcatggtggctcacacctctaatcccagcactctgggaggccaaggcaggaggattgcttgaggccaggagttcaagaccagctgggcaacatggcaaaactctgtctctactaaaaatatataaattagccaggcctggtggctcacacctgtaatcccagctactcaggaagctggggcacaagaatcgcttgaacccaggaggcagaggctgcagtgagccaagattgcgccactgcactccagcctgggcaacagagtgggactctgtctcaaattaaaaaataaaaagttcatatccaggtctttatatgaacattttatatattcttcttgatagatgcctatgaatggaattattgatcatatcaatttttattccctactgtctttttcaaggatgtttattgaacagcgtgggaagatgtgtctaaaatatcatcttttaggacaatgggcagttttttgtttgtttgatttcatttgtttttagtttgtttgctgtccacaataatgatgtttccttctggaacaaagattgggcatgtttcctagcagcaccttttaaagattagggttccctcggctgtaacacaagccagtgtcatgtgcagcgtccacccaggctgctgtgcgtcacccttgtgtaaacgtgaaaggcaaggggcactgatgcatggatgaagctcatgctgcctgctgttcctttcactcctttcctgtgctttgtgtatgtgtgttatggcaatcaaatatttttagtattcattttgagtcctctttagacatgttagttgtctgtcttcatattagtttcttttctcatggctgctctagggattacaatttacttagagttagtattgtatttcaagtaaattataggaactttaaaatggtagagatctttttaaccatcttaccttttgcgaaaaaattcagatagatgcatggataggcagacagatgtactttatatctacctacataatttgccattttcaatgcctttagttttttcctctgtagctattccctgcaacctaaatatgttcttctagtatttcttttacagcaggtttgctggtgacaaattatctcattttttgccaatccaaaaatacttccctttcacttttgaagaaaagtttcatcagatatattgttgtttaaaaaatatataaagaagggttgttggttttcagattttttatcaaattttgaagatgccattcttgcgtcttatggctgttcattgtttctgagaagtcagccattaatcttgtcattgtttccatgtatgtaatgtgttatttattttctgggtactttcaagattttctcattatctttggctatcagaagtttgagtttgatgtccatagctagggtggttcttgttatagttatcctgcttgtgtttgctggttttttaatattggtaaattcatggctttcacaaaatctggagtttttagccagtacctcttcagatattttttctaccctttctcctcctcctcttccttctcctccttctcctcctccttctctttctctctctgtctctctctctaagagacaaggtttcactctgtcactcaggctagagttcaatggcacttcatttcagcctcaaactcccaagatcaagtgatcctcccacctcaacctcccaagtagctgagactacaggtgtgagccaccgcacctggctccagttatacttttctttgacccctaaatgttatttcacaagtctccaaagctctgttcatttatatttaatcttttctgaatattcttcagatacaattttttttttattgagacagagtctcgctctgttgcccaggctggagtgtagtggcgcaatcttggctcactgcaacctctgcctccctgcaacctctgcctcccgggttcaagcagttctcctgcctcagcctcctgagtagctaggattacaggcatgcaccaccatgcccggctaatttttgtatttttagtagagacgggatttcaccatgttgagcaggctggtcttgaactcctgaccttgtgatctgtccacctcggcctcccagagtgctgggattacaggcatgagccactgcacccggccccagatacaattatttttagtgatatcttcaagtttactgtttcttctgcccatttatttagcacattttctttgaattctttgaatgtatttaaatagttgctttgaagtcattgctaaatccagcatctagacccactcagagtccatttctgttcattgttgttcttcctgagcatgggtcacgttttcctatttctttatatgtctggtaactttgtgttaaaaactggatattttagatatgttaagtagcttttgatatattacgttcttctgagaattattttgttattgtttacctagccattaactctcttggattcaaaccataaactgtgtcccctgccaagtgtgacagctggtatttctgctcagttctttccatttccagctgttggtttttaacctggcaccctggggatcttctccgtacctgtgcaatttagcattcagtcaaggattttggcaaattttgtagacattgctaagctctgtcttctgacacttcagtaaggatttcgcttcctgtatcctgagtagagcatggattcaggagtactcagtctataaaagtagcaaacatgaaatcttgtctagtgcagtctttctttcaaaggtagctatccctctggtttctctcagctattttggtgatccccagtgtctcccttatagcatgtcttatttagtggtcatccagggatttcagcagagattatacccagtgttttggtcccacctcttctatggcttacttgtttccaggattccaccctgatctttcagctaccctgccagcctttaactctgtcctgtgccatcttaaaatataactgcaattttttaaaatcagatttttttaaaaagcctttaactcaaattcttactaattgctgttggtgtctttcaatggttaatgctctgttagtttgtgcctgctttttggtcactttctaatgcctttaaatagttgagttttataatatatatatataatgcccagattttataattgctattactggagtatttggtaaccaattttcttcaccattactagaggccagaagtccctccatttttaaaatatcctcaataattttctgtcattaagcattctctgacctttagtagctgcataatatcagatctcctaaataggccataatttttaacctgtctcccgtttttagatatccaaactcttttcagttttataatagtataattagtactataatgtataaaccatttttacttgggaatataagttttattggggataaaattataatttttagggcaaatttctagaaatgaattcagttagtaagtatgaatattaatacatttgatacatttttccaaacatccctgcagaatagttgtgccagttttcagtgccacctatgaaatgtaaggttacttttttttaagtcaaataactttaaacttatgagatttggtggtgtttggtttctgctaaaagaattatttgatttgttttataagcaaaaaaattattcctgattgttttataaactgcataggctatgcttacattaagaaaaatatcacttgtaatatggttatataaccaaaatagtagaatgagtaggagctttagtttatttagtttaattattagacttatttcagtaaatacaaaaacagaaaatttttaaattccactatagggaactaattttgttcacaaaatattttagaatgaatattctaaatattcattctaaaatattcttttcctgtttcttatttcttcccttcccccctttttaaaccactttgagatataattcacataccatacaattcatccacttaaaaggttcaattcagtagttttgagtatattcacagagttgtgcaaccatcagtacaacaaatttcccttcccttttgaataacaaaatgggagtaccaaatggaatcccagtggcaaggtcaggaaggagagagattatggggcaaggagaagagagattctgccaccagagaagctggatttttctcctcctcactcccaaacactgcccaggatttcagctgtgattatataaataacattttaaaggcaattttgtgcatttttcaaactgtagaaaactagtcatggtgaagaagtttctctgtgctaatgtgaaaatgaaatcaagatcattttgtgttgtcattgtttcgtaaagatgaaaggtggaccgggcatagtggctcatgcctgtaatcccagcactttgggaggctttggcaggaggatctcttgagctcaggagtttgagaccagcctgggcaacatagcaagaccttgtctctataaaaacttaaaaaattagccagccatggtggcatatgcctgtagtcccagctacttgggaggctgaggtaggaggattgcttgagcccaagaggtcaaggctacagtaagccatgaccacaccactgcagtccagcctgagcaacaggacaagatcctgtctcaaaaaaaaaaaaaaaaaatccttaaaaaaaaaaagatgaaagatactataataacaacaaccaaaataaaaaacacttcagggtgtttattagctaaaaagtattatccgtaatacgttttatattagccaaaatataatatttatcttatgctaacagtactgtagcaaaaatgaactctggaaaatatggctcttcacattttgaagtcagttggggaagtttgaatatggacaacatactaggtcatttgaggaaattattgttctttgtaatgttctttgttgccatatggtattgtggtcataaaggaggatttccctactctttggagatgcatagtaaaatatttagtgaattgatatctgtgacttcttcaaaataatttcccaaaagtatattaatatggagaaagaatattatgctttatatagataggtgaaggcactacaacaaaataattactaatatttgttaaatctaagtggtgggtatatgagtaaatttaagtgtttatctcactcttgctgttactttttcatatatttgacatttttcattaaaaataaagttttggaaaataggtctctgaggccgggcgcagtggctcacacctataatcccaacactttgggaggccaaggtgggtagattacttgaggtcaggagtttgagaccagcctggccaacatggtgaaaccctgtctctactaaaaatacaaaaattacctgtatttttttgtattggggaggctacggcatgagaattgcttgaacccaggaggcagaggttgcagtgagccaagattgtgccactgcaatccagcctgggtgacagaaatgagactctgtctcgaaaaaaaaaaaaaaaagaaaagaaaatgggtctctgaatattctagacacaaaacaagaatatgtgtttagtttgctagtattaggtaacatgaggaagatatctattcatatttgtcagtatatgcaaaaattatctttaaaatgcgattgaagaaacaagtaacagtggttatctgtggagagggaataggaaaagtgtggatggggcaggaattggaagtaaaatttgtggttacttttttatgctttttaatattttgaaacattttattatctaataaaaattacatattgaaagagagaatattgtcattaaagattggagcctaaaaaaatagaaaaatttattttatgctcagaaattttttcagataatgctaaagcactgggcttgtaactgttgttgacctgctgataatacatttagaatttgcttcgggggtattaaaaaattggacttctttttctttgttacaacatgtcagcattgtttttcttttattgtctttttataacatgttttcactggggacttttaaagaaaaaagtatattatgagtcagttttgtacatattgggtttttttaatgccgtgttgtttcaaataaatatagattggtgatatctcaattttcagtgctaataaatttcctttgctctccttggctcaggaaattggctaatttaactgctaacctatatagaagtatttatatgaaaaatgacatcctgtagtatctgaaaaaagcagagcacacattgttaaactagtcagacctggtgtggaaacccacccacccttgccacttaataactggagcaagtcacttaaccttgtagagacccagtttcctttgctaaacagtaatatcctaccatctacgaggttgttgtggtgattaattgaattacataaacaactcttacttgtagtgtcctcatttaaagaaggtgcctgtttatttttttaatgtggattaccaataagtatgaagggctagaagtttaacattggttatatgcattgccttatttgtttacaagtcattctaaagagaaggaaacttaaaccattttacatataaaaggatactacgtgaaagtaatgtttaattaaattaaaatttaatcaatgtatctttaaactcaccaagtaaaataaattcctgtgttatcaagtttttacctcttggaattaagctttaaattttctatttcattttaccagtgggttcactggtgattggatcagcaactccaaatatcatgatgtcctttacaaaccttatatattgtccatagtaaagtagttgtcgtaatgaacaagttttggcagaagaaagatttctatggtagtcttttgaaaatcattctaaaatgaagattgtggtaaaagtcctcttatgatggaataaagagaacaacttttattaatttcctgtgcatgtggatattcaaaagtgtatggattttttaaatgatgattctgtaagaactcatagttgattacttagccacctgcaagatattcctttgaggaaaaaaaaaaaaatcaccagacaagattttcctagcttttcttactaagttgtataatgtgtcattgatgtctgtggctgtctcttactattagaaatacttttattacctttttctagaagacgtatgacatgtaagagctttcttaaaatactacatatttggtagttgtgtagcaattacattgctttaagaaagttggctgttaacagtagcaatttgttacacttttaaattttgggaataccttacattgtttcattactacttgtgttacaattctatctccaagtgaacatttggtgaattttttttttttgagtagatgtctaaaattgaagggaaaaaaaaacaaaaacagatctcttttggttagctaaatgtcagttgcttaatccaaaaagataaaaatgttttgctggactaatccctgtagtttcaaagcattttcatgtgtattattccatttgatcccactaaaactctataaggtggggtaggtaagtggtactttgttttatagatcaggaaattgctgtcaaagacttgaagggacatgcccaagataacacctgaaaattctgtaagtgcataaatgctgcttaatgattatctgacccattccctaatttacctttagtctctctattgtcaaaactcctctggataaaatgttctctgttgtttaaatgcaatgattttcccttctctttatggagaaatattgatgaaaacactaaatctctataaagaaaaaataaatcagtgaaattttgcagtaagatgggaaaagagaaagaaatgccaaagtgaaaattaacttcagaatacagtaagtcctcacttaatgtcatcagcaggttctttgaaactgcagctttaagcaaaatgacatataaccaaaccagttttacccttggctaattgttataaacaagggttaagtttctgcagcacattcatggtcacaaaaacatcaccaaacttctaaagatcaaagcatttctaatattaaacattgaagtacatatgagctatacttaacatttaagaaagattaattaaaaaaaaaacagataattatttacccagttattccagttcaaggttgctggttgccagagcctaccttggcagctcagggtgccaggtgtgaaccagctctggccagtacgccatcccagcgcggggtgcattcatacatacatattcattcattcattcagactaggaccatgtagacatgccaattcacctaacatgcacagctttgagatgtgggagaaaagctggtgtactcaaaacccatgcagacatgagacaacatgcaaactcagtacaggcagtggccccagcctggaatcaagttttttgtgtttttttttttatcgatgttataagtaaaggacattgaaaagaccttatttgaggatcttcggtggtttaatatttgatagcaataattagctaagatattgtagaggtgagcctaatacaatgtgttatctgatgtgaaaaacaaaaatatttatagcttaaaacagtaaactttacatactgtatatactactataactttctctcctgaacctaattaggaaaaaataagttattgtacagattttcagggtcttttaaacataatcttaggtgagaggagaaagctttctaaatagggtacagaacccagaacacatatggggaaaaattgaaaatttttatcaaatgaaaattagtataacccaaaacatgactaaaatcaaaagacaacaaatcaagaaaaaaaattacaaaacataggacggataaaaggcaagttttcttaatgtataaaaagctctttctaaaaccattaggatgaccactggtggctaatgtggcatgattgtagaatttttaaaaattaggagatgtctacctgtttgtcaatagaggattggtttaatgaaatgtgattcttcacttatggaatgtaactatgcagctgttaaaaattatcctagaaaagtgtctgtgatgagctactactaattgaaacaggcatgttgctaagtaatgtatacaatgtaatcctatttattagaaaaacaacgaactccctttctagatatccatatatgtgtgtgcatgtggatggataacattggtgaactaggattggcaggttggaggcgcaggaggaattgcaatggggtagggatacagtgttagatttttctctatcatctttacattatttcactcattacaatgagtatgcattacttgtgtaaatttttttaattataaagcataatagaagtgaaagagggagtaacactcaatatgtaaatgagacattcataaacaggtatacttctcagaaaaagaattccatttgctgccgagcgcagtggctcacgcctttgggaggccgaggcaggcagatcatgatgtcaggagatcgagaccatcctggccaacatggtgaaaccctgtttccactaaaatacaaaaaattagccaggcgtggtggtgcatgcctgtagtctcagctactcaggaggctgaggcaggggaattgcttgaacctgggagggggagattgcagtgagccgaaactgggccactgcactccagcctggcgacagagcaatactccatttaaaaaacaaaacaaaacaaaaaaaattcaatttgccattcaacactggaagcttatgattaaataaatgcaagttaaagcagcattaaggtgttacttttaacctaaaagattgaccaagttttaaaagtttgataaatgcccagttagtgagcaactagaccattctcatgcccattaagagggaatgtgtattaggacatactctttggaaggcaattgggtaatgtttattaaattttaaatacatactttatgacttggaattagacttgtaggattttatcctggagacctatccatgcatgtgcaacattgtttatcgtagcaaaacttgaagcaaaagaaaaatgttgaataagtaacctactgtacatccacagaatactgtgcagctgtaattaggcagagcaccaggatactttctgttttcagcaaacacagtatacaacaacatgtatggtatacttccattcatgtttactctgagaaatgacagtgggatctggagtatgtggcagattcatttctgttacataatcttttgtttcttttcaatttttcaccatatgtatgttattgttatactttttaatgatttcagaaaagccattgcagaaaaaatgttcctcaaattgaacaaattgatctttataaataactaaaaaaggaaaattaaaatgcatgaatttggctttttccttgtaattgtgggtgatagttattatagcaaactctgaaaagagaacgcatgcttgtctttaccacacctgctcctacttcactcttccccgtcttaaatgctatcagtacttacccagctgctagagctagcaaactagaagtcatctttgatcctgtcttcccttatccccaaatccaattcttcctgacaactcttacctcccgaacatcgctccagttcctccacgtcagtccatctctactatcagcacccagaccaggccaccaacgatctgccttttgcctatacaatcatttgcttgcttgcctacactcctccttttatgtaacctattcttcccacagtatccagagtgaactttagaaatgtgaatcagactttatcatcccctgtttaaaagcctggaatgcttttccactgcacttagaataaattgaaacgcttgatctggcctagtgtccctgtgtaatctgcccctgcatcagctctccagaggccctggcactggagtcccctcactgactgtcagctacaccagccaagcttctgttttcacactttgcagactcatgcctaacttaggacacttgtaagagccactcccaggtcttcactggcaggttcattcgatcgtttctggtctcaccttgaagatctctgcttctacatgttcttcacaacaagccagtctaaagaagcttctcatcagactccatcacatcaacctgttttattttctattttgcacgtcacacattacaagacagttttgccatttttcacattggcattccacttaactgaaataagtaatcttaaattctaagaatatctgttttcccccttgggatccaagaaaacattttcattttgaataaagagaaaaatagcccaaaaaatattgttattatacttaaattgacattcaaggaaaaagaaggaactcatcccaaccataagatatattttgtgccaagtgtagacccaatctataaattgtggaatcttcccactggctcattgctttatttctcaacagttcatttcacaccagatctatctggaaaagtctggtattagtctagtgtaaacagtctgaagttcagcctctctcctgctgtttcagattcatctatctcgtagagactcttcttatcacattaccagtctctaaccctaatgattccctagaagtgagagttttgggcctaattattacataaacttttctgtatcctttgccatttacctcatactgtatgcttgatgccatgtaaagcccagattccattagcagaacataaagaagaaaggtttttattttctttcttccttttccttaaagataaaatgagaacgattagtatctctaatttgttttttgttttttttttctttttatactttaagttttaaggtacatgtacacaacgtgcaggtttgttacatatgtatacatgtgccatgttggtgtgctgcacccattaactcgtcatttaacattaggtatatctcctaatgctatccttcccccttccccccaccccacaacaggccccagagtgtgatgttccccttcctgtgtccatgtgttctcattgttcaattcccacctatgagtgtagtatctctaattttaaaatgctattctgagatttttattttagcattttataatgctttctaaaaaatacagtttccaaaagttaacagttttcttgtgtcagcattcatttatctgagtatttccttaaaggcaaaataatgacggtaatttgtttcaaaatactgtagtgggccaagtgtggtagttcatgcctgtaatctcagcactttgggaggccaaggcaggcagatcacttgagctcacaagttggagaccagcctgggtaacatggtgaaaccccgtctataccaaaaatacaaaaaattagccagccgtggtggtatgcgcctcaggaggctgaggtgggaagagtgcttgagcccaggaagaagaggctgcagtgagctgagatcatgccactgcactccaacttgggtgacagagtgagaccctgtctaaaaaacacaaaacaaaaatacaaaataccatagtgatgtttttactttttgcattttacaatttaaaaacttattttataaactgcagttatttctgtcaacactgacatattttgaatatttcttctagaaaatatgtagttttactatcagccagttactttgttctttgaaacattttttaatgttagtatcattattaagaggctaccagaagttcagagcatgaaaaatagccccattttgattattcttactttataaaggtttttagggctgggcgcagtggctcacacctggaatcccagcactttgggaggccgaggtgggcagatcacgaggtcaggagttcgagaccagcctggccaagatgttgaaaccccgtctctactaaaaatacaaaaattaagccaggtgctgtggtgcacgcctgtaatcccagctactcaggaggctgaggaaggagaattgcttgaacccaagaggcggaggttgcagtgagccaagatcgtgccactgcactccagcctggctgacagagcaagaatccatctaaaaaaaaaaatgtttttaggcatttcattacatttgcaatatatttatctaataatataatcttaatcactgaaaatgtataaacatgtaaattaaaggtaaacataaattgaaagtatcaatacatgaaaatattttaactcttgagtaataaaccttgttttctatttcatagaaaatataatggattaccgtgatatgttagaaatggatttgtcgctgccttattacaaatgcagcagttataaaatggcatctattatgtaactatctttttgagggagcggtggtggtagtaaaagaaacagaattgtttttctgcctttagatcggcatgagaagttgaaacacagaagatgtcgcaaggcagcaaagagctgattatatgcagattgtcctttaacgctgactatattttatataaaggtgtttctaaggaccaaaacagggtacacattgacttcgttgtagtagtttatgttctgttgaaaagattatctatctttattgctgagttttcctcattttttattctttattgtcctttttattcttttgtctttttctttaatctttatgtttttaaaattttagatgccaaagtgtttcataacacagcatccaacaacctccaaaccataagttgtaggcagaaggaaggaaaatgagaatgaagtagtttggtagctttattcttcagcatctgtttgagagtaatctctgaatctgtttgtttttatcacaagctatgcgcacatttttatttgtgcattacttctttcataaaaaaaaccaaaagtaagaaaagctaccattttaaattataagatggtttaattaactgtctggtttcttttggttgggtagatgcatttaatttgaagagaaatatctaaacttacctcatgcagcttaaaaattacaccctaattattgatcctgattacctagacatcatctgttttcctaaactcgcttcatattaattcatcatttgggaatttgaataccattttctcccggtgggttccttaatagcatccattttactgatcctgccttaaaacagttgattacccactctgaagtgtagtgataaagaatgtattaggcatcaaggaatgaatccgttccatttaatcctaagtagtttaatatccggaaaagacctacagtaaggatctgctgaaatgggtaataagatatcagtgtgtttcatataccagtcagatgaagttcagtttattttatagaagtttaattagaccctcttgatcttggctaagtaatgcccagaggaggaacagaaatggttttccaaaaactgtttttcctctactcagctgccagaacaaaatttaattgagttgcaattgagaccccaatcctccagcatttcagggtaggatatcttggtcatcaaaaataacctgagcatatttcctagggtgtttggtgtttggatggcacggtaacgggcatagagtaagcactcagtaaattatgcctgactgactggctcagtcttaagttgctgagtttggcaagatgcatccccgaagtgcttactttttaacctgttgaacagaatcacttaatattggcctttatgcctcagaatttctgccaaaaactaccattacttttggtataattgatagtaaactgttctttccaatagtaattgctctggtaattcagctgggccctgagactaatggtgccagacttgtagctttcatgggcaaggtaaaaattttcctaattattgagagattggccttaggttaccaatgtttttatttcatttaaaaagtataccaaaaaaaaaaaacctactattggccgggcacagtggctcacacctgtaatcccagcactttgggaggctgaggcgagcagatcatgaggttgggagatcgagaccatcctggctaacatggtgaaaccccgtctctgctaaaaatacaaaaaattagccaggcatggtggtgggcacctgtatcccagctactcaggaggctgaggcaggagaattgcttgaacctgggaggtggaggttgcagtgagccgtgatcgcaccactgcactccagcctgggtgacagagcgagactccatctcaaaaaaaaaaaaaaattcctactattatttcatttaaaaaaaaaagataagcttaacatcacaaaagtaggaaggacagagattcagaataaaagacaatcatttaaattgaataaaatttaagccttcataagaagttaccaccctgttgttattttcctcatttcaccttttcttgactcttagaagtcacttcagaccattgcaaatttgtgatggtaaatcatgggatcagcctggaagaggaagttttccttaaattggctataagaggggcatgtatgtggtgacactaaatatgggattagattatctagatgtaagtttagggtgggagccaatgacacaacctctttgtttttgcttttcggttttattaaattaagcatgtattgagcactgctgttttcttggcactgctgtagactttgggataaaacatgtgcgtgatgcacagatatctgttgctgatgatcttagaaactaggagaagcaagtaatactggccacactggctacagtaagagaccataggacagaatttggagagttactaaaagcctgaagtctgtactgatttcatgtgtcttaagccatagatgatccacagacccatagaatgaaagacagagatggaaaacatagccaaatttcactatggtgttagtgtcttaagtactgtcttgaaatgaaaatatgtgtttaactcttacagtgatgggacagttgtatctaaaatcaaagtaaggggaaattttaagagatgtttggcaaactaacttcatatattattattatttccgaagatggaatatactatgcttctattccaacttgaagcttattagaaaaatatcttgatataaatgattgtgtgtagatttctcctccccagttttaaaaagactcaatatgatgatttacaacaggtggatgtgcaatatcccaagggctatggaggctaccatatgaggtgggatatcattggcccacactggaaagagaaatagctctgtaagtagtggatgtttatgtctctaatacacattcccaagtccttcctcattatcagtttagataattaaactgacatcttccagctggcatctttgtagacatttttgtctgaacataagttagctttaaaaagaaatgattcataaacatgacaggaatgaaaaaaaaaagaaactagacaccactgaattgtttatagtggcaaaaacataaaaataaattagcttcagtgtccagtgctgcagtgagtttaaataaatcggaatatatccttggaaaatttttttaaataatgtatctgtttagtcagatagtatgcactcaacagcaataatgatgtatgttgattggcatggaaaatgtttgtgaaaaatgcagtatatatttaaagcagcatgtaggactgatttttttttaagtggtgtatatgcatgcccatctaaatacaccaaactgctttttcatcagttctgctcgcctttttggtggtgttctctgaagctattgatagaatatcccaacttgcccagtaactggacagaaactgcactcgacttatctgcaatttgttgatagaagttagcaaggagatcttacccaaaagatagatgggaacgagaaatgtggcatctttgaacctctcaggagcaggttatttgtggaatcagagagtgcctctcgccatctttgtcttcataacccccgtcttcccgcacagcccaagatagtcagatgtaagaacagcagtactgcgagtcaagagtaaactaaattgttacatcttcggtttcagctctgtctaaaacaactacccgtgatgagatggagcaagatatgactaattttaaacattattttggcccttagttaaaaagttgtgtggagatttaccctgctgctgtttgaaagcaggaagctggggtttatgggttaattcagtaaatagctgccctctgttatccacctttccccagagagatagtcattgggaaatagtcctccacagtcagtttctgcaagctgcaatagaatcgtggctagtcttagaatgccagtcccctggaattgttattccaggtcttagtgaggtcctaagagtgtaaatttgaaagatcagcactgtgcaaaccttttcaggaaggacgcgtttgtaagtgaagctcaaattgctttatctaaaaatcaattcactttgagaatacagctaaatgacgcaatcgttgatgaaatttctgattattctttcccaatctgtgctaaaatccaaaaggaataatgttggattatctgctcttttgaattaaatatccctgtttgccattctgtttgcatacatgactgaacctttgcaataattgtatgggatgtgagggagtatttttcttccaaaaattgataactgtataaccccaaggagtcagctatattctggactatgaacttgaatgaagtttgtttacagctcagaaattattcaaaccagaattctcaagaaaattatttttggttcatttcccattttgcataaaatagcaagcagtgaggaagaataaatcgaaagtcatagctaatcaagactttataactatttaatgctttgtttatatattcatctggcaatttttagaattgcttcagttctataaattatctggtacatttgatgataataggtagccaaatatatttgttaatgatccaaattgtatcgggacagtcactgtaacctataccttttttttttttttttttttgagacggggtcttactctatcaccctggctagagtgcagtggcaatcagctcactgcaacctccacctcccaggctcaagtgatcctcctgcctccacttcccaggtagctgggactacaggtgcacaccaccatgcccagctaatttttgtattttttgtagagatggggtctcaccatgttgcccaggctggtctcgaactcctgaacccaagtgggctggctgcctcagcttccgaaagtgctgggattactggaatgatgcatcacacacagcaacctgtaccttgagttaccttaatttaagattattttgaaagaatacaccatcaatccagagcaatcctccaactagttgaatcattacgggctctaggaaaagagttagcatctctcccataggattcagatatgaatagactagcaccattagtactgtggttccttcctccagccctattaaccattcccagaagacaggaggaaaagcacataaagcccattgctatcagagctctgaggtctgtaaataattatgccttcttgtttttgagtaaagtaggatgaaatgtattaccacagttaataaactacattcaaattatagcctccaaagcaacaaaagcattccacactttcaaaagatcatagtgactcaattcctttaaagagatgtttctaattatagttgccaaaatctattattttagttgtgatatatttctttttaaatatttattacctttatagaatactgaaaatttaaaaattgaaacatatacattaagtaatactccaatttaaaatggaagaagtaggaattggaagaaacagaaataaataattagagtgatgtagaagttggaagttctgctgcagaatcctttgaaccaaacacttggcagctccccagaccacatttattgcctttttgtgtatatatttccactggccaacttgtcgtcttggcttgaaatgtagtcattgtaacaagattggtaatatttaaatatcttttcctttcatgcctgtcttatggaactaatggtttctgaacacaaattattattttatctttaaaatatttttctaaatattattagtttttataaaatagaccagataacaccatagctgtctttaaaatactgtcataatggaactgaagttagagacattttaaatctcccactgccatagataaaattcgtttttggcccagcctcacctttggtaaccgggaatgcccgagacactgtgaccccctctccaccagaccaagggagctgaactcttactctggcctcatttccctttgtcaccaacccccccatttgagtgtcaaatgcccatgtccatacatcattctaaacattaaagccttataaacacatagattcctcagtagatttatagaatttaaaagacaaaaatgactttagaaatcattcagttcatctccctcaatctgtgagtgaccaaagcttacatgcttgctatgcaagacaggaggcagccatttctctgagacacacagacacatttcagctgtggcggcatgtggtagatagatgtgtgccccatgtcctcatctaatgtctatagttgtgccatctctaatttcttgaaccccttccctgacttataaagagccagtagaaccgttgatctcataagtaatctaactgaaatacattaattctgcagactgaatgaatggtaaccaaagatgtcctttcatatgaacatactttatattctaaatccagttttctttctattagtataacatttcctctgctagtgattttaatgttcttgcttccgtggttgggggttgggggggtggtgacagaaaagagtaccattttccttctgatatgaatgtgtacaaagaggaaggaaggataaatttaaccctttttaaattaaatgttaagaaatgtttctaaacgtattgaatgcttttccagtatatctctggatttttctcgattcaccacattaatggcagagaacaaatacatggatacaaagtaatttgaggtttcatttagtacatatatattgcttaactttctcatctgagtgtgctaccacatgctctaatccccaaacttaaccagtccctgaagatctggaaggcgggctgggcttcctcaacactgtgttctctttcttttccaggataaagtcatcatctcctcttaccctgatattgccttatgtcgcagctttgtttttaatatttctccagaccacagaaatttgtagttttgctaaataggcttattgacgttagtcagtgatggagtgattggaataaaacagtgatatgtcatgacaactagttaatgaccaattaccatgtgcatttgccatatgttagtaaactttgaaagtagctattcatcctatttggatgattggaaattcttttttataagccaactatgaaaataaaacctgactcacattcccagagcctaataaatttagggcattttgtaaaataaatgaatatatcattttcagatctctgtgtcttatttctctttactttttcttagatgtactgtatatcagtgttttggaggaaactctaggttttgctgtagaaaggagcaggaagtgagagtgaggcgagcccaggactgcaagcgccagtaatcctcatggtttctctcttcctcagcagcctggcagcagacgccaggacaggactgaaagggtttacccagagctgtgactgatacatggcaaaaaacaaagtgggggtggacaccaagagcattttgatggggtctaccttagaaagagaggaaagcaagaattccacaagccattaagacctggctccagcctgtccttccagccttctctcccaccaaccttcctttcctccattctgcagtgtaacagctgcctctggttcctggccagcccctctgctcgtgtgttctcccttgcccagattctcatcattttttcctcaccaactcgtacttgcccttcaagaatcaactcaggagtctcttccttgaagaagtcttctgtgatccatccccactacgctggattgtgtgtcccagctttagatgctcagagaactcttcacacatttatctcggcattcatcatgtgtgattggaactatttatgcttagttcttgttctgtcattgcactattaggtctttgagaaaaagtgattgattatcataaccatgcttgtaacccaatgccatgtatagtcctagcaaatagtaggcatgcactaaatgtgcatctaaactaaaagtgtaggattttagctatcagaaagggaatttattaggagaataacgaactttattcttttgaattaccacatctttcttgaagtgttaagtggctcttcagaaataaactgtacccaagagtactgccatgtctcaggagtcactttatgtgtatttgtatgtatgtatgtttataacttttttaaaaggcctagttttttaaaaaagcatttctccaagaaaggccatgaagcagtaatttctgaagctcatggctttcacctttccagatttttataacataattttgttgagattcttgatcataggttatatagagtacagaatgagttagcaccttaggtaatatgcttagaaaaagataaaatagtgtgaagatacacgtaagaaaggaagtctggtaaatgcaggaagatttggagagggatgaagtgagtgtataattagtgaatctttgaaatttatcttctatccacataaaattttgtatataatgtgaatgtccaaaattccttggtctcttaggctgaaattaaaatgttgaagagctttatgtggcatttgggcatggtgggagtgttttggtcagattttcttttatattctatgtggaatggttatgcatctatatagcacctgtattttccaaaagatttgtgtgttcaccaacagcaagtactcagcagcttttttctaaattaagtcaacagtaattttcaatttggagataggagacaaaccctaaaactggtagccaaagaagacagtgcttggttttataatatctagagtggactattagctaggatgcctttttttaaaagctgtctatttcatgtctgctatttagatagtgaaaaacggagttaatctgacccataactcttcgacgtcatctcttctttagtggtattggaaggaactggccctgggcctctggaggcagcagtattctggcagaatttggaaccctgcatttggagtttatgcacttgagccacttatcaggaaaccccatctttgctgaaaaggtgagattcttcaatgtgccttggcctgcaaagcaacacttatgagaaacagtattgtctctgagaaggtttaggaatttttgaagtggaaataataaccaaatttgttatagctctttctgaagttttgcaacatgcagcatttcatttagccaaactgtaaacctacagcctttccagtgcaccactctagttcaggatgtgagggcacagcttccacctctggttccctttaccttaagttagttacttaactcatctgaagtttgtttccttatctaaaaatatttagtaataaatgcactgcatgagccaactatgtgaaagacagactgaaagtgtcgtacaaatgtgatgttgcagctgaattggtccctcgttttccgaaagcaaaccaaatatttggataaattcatgttccccccatcactctacttttattttcaacctgctttttggcttccctttacagtaaaattgcttgaaagagtcgtccctgttgtctacttttcaagtctcttgaacctgctccagtaggacttttcccccagccacacctgtcacagtgaccagtgagcacaacagtgccaaagccacttaccattctccccttcatcttccttgccctcttagcattcgacacagtcagttcttcgttcctgagatacacttcgcgcttggcatgtaatactctcccagtttgtctcctcttttgctggatgctccttctgtcttttttgtgtcctcctcaacaccccaccctctaaatattggaaagccctagcactcaatcctgtgcctctgcttgttgatattcactccctacattgttgcatctagtctctgggctttacataccatctctatactctagactccaagtttattatttcagtcccaacctgtcccctgaactccagactctatatctgtttattaaacatctccactaagaggcccgatagacaagtcccacttaaaatgcctcggacttaacgcctagacgtgcttctccagtctttgctatcttggtaaatgacatctcactgtacccagtggtctcctcctggttcttcttcttggtaaaccccaggcccagtccactaagaaatcctttgggtgtctcactgcctctactgctgtcctgatctgggatccatcaggtcacctggtgtactgtatgtacaccatacagtagccacctgaccaccccttcctcaccccctcagccttctcatgacactcagagtaaaatatgcccttattgtggcctgtggggcctgggtgacctgggccctggctctcctctcctctacctgctgacattctcccctttgtctcctcacctctggcctcagtagcattgcaaacctgctgtctcctcagggcctttgtacttgctcctctctctgttccgagtgctcttcctccacatttccacgtggcctactccctcacttctttaatattctgctcaaacacctccgccttgccaggccactctgactaacatgggatagcctctccacatcaccctgtcccgttaactctcaatcagctcgggttaccataacaaaaatgcagccagaaacaaccgaaatttatttcttacagttctggaggctgggaaatccaagatcaaactgcccatgaggtaggttttattctgagcctcttccctgggcttgtagatgacgagaactgtcccagtgtgtgttcacatgatgtcttctttgtgctctgagggagagaaggagtcacagagagagagagagagctcttgtgtctctcatgagggcactaatcccatttaaggctctaccgtcataacctaattaccatctccaaataaatctccaaatacaatcacactgggaagtagggtttcagcatatgaatttaggggtatgcagttcaatccatagcacccttttatttttttccacagtatttatcatctcctgacatactatacagttaggtgttacttaacagtgtttattcaacagtggaccacatatgtgacagtggtcctgtaagtttataatggagttgacaaaattcctacggccttgtgacatcatagttgtcataatgtcgtagtgcaatgcgttacttacatgtttgtggtggtgatggcataaacatactctactcccagtcacataaaagtatagcacatataattatgtacagtacataatatttgataattaaatgactgcattactgatttatgtactactatggtttttattgttattttagaatgtaccactttttttttaagttagctctagaagcaaggtccttcaagaggtattcctcttcaaggcattatcatcacaggagttgacagctccatgcgtgctactgcccctgaaagaccttccagtgcgataagatgtagaagtggaagacagtgatattgatggtcctgtggagtcctaagctaatgtgtatatgtgtcttagtttttaacaaaaagtttaaaaagttaaacaactttaaaaagaaattttaaatagaaaaaacttataagaatataaagaaagaaaatattttggtacaactatacaaagtgtgttttaagctaatggttattacaaaagagtcaaaatttttttaattaaaaagtttatcaagtaaaattacagtaaactaacgttaatttattattgaaagaaaaatacttttataaatgtattaataatggctaagtgtaccatgtttataaagtttacagtactatacagtaacgtcccaggccttcacattcacttattactcacttactaactcatccactgcaacttccagtcctgcgagtttcattcatgataaatgccctatacaaagtgccctgtatttatgtatagggttataaaatgtataaccctatagaaaggtatcatttttcatcttttatagtgtatttttctgtgtttagatacacaaatacttcagtacagtaacatatgctacacaggtttgtaacctagaaacagtaggctgtgccaactacatttgtgacagtgtgctctatgatgtttgtacaagaattaaattgcctgtgtttcccagcatgtatccctgtcattaagggacacatgactagacttattgatttattgtctgtcccgtcccactaggatgcacaattctaagagtgcggtgactttgtttatccactggccccttgttcctagtatggcatctggctaatggtagataactaatcagtgtgactatattcacttactgccattatgtttgtaataataagctaacagcagttatctttgttctaactctgcatcatttaagtcaacttgtatgttcaagaagaagaagaatggcatgaaaattgttttttagattttcacggtaacattttattttctattataggtaatgaatattcgaacagtactgaacaaactggaaaaaccacaaggcctttatcctaactatctgaatcccagtagtggacagtggggtcaacgtaagtcagaagatttgcattattatagctctttttggtactgtactcgtggagagagaggaagcacaaaagcagcacagattttgttgagaaatgtttagaaaaggagaaaggggcatggctcctttaataaacaggcttctgtcatcagattgtgttattaggaaactggattgtgtatttttcatatataactccaagtgtgatgacatataagcacatttacagctattaatcagaaagggaagatctggccagagtagtgtggggatgttaatctgtaacaagctggtcatgtggatagaaaggaaattcattcctttgtactaatgactatgagggttttatagagagtaggtagaccattctgcttcctaacattctgtttctgcatggctatataatgagagaggagcctgaatttttaagagttgggaaattggaagagcaaacagcctgtttttctcttcttaattttaagctgccagatataaaggtttcttgccagtagaattacctttaggatgggagaaagtattgcacaagaacttttgatcctagaagcctgcacttaagactcttcagacgattttgagcaggggcataaagattcagagtagttgaaagaaatgttctcaagctgatttggaaaaacagtagtagattaaatagctgaaaacaagtgaagaatattgagatacccaactgtagcaagagtacactgccttaagattttactctaatttgggttttttctttatattttaatatcatgttcttagatacctcattattactttagaagtacttttcttaaagaatagtttaataggaaagtatatgccaaaatccatatgctaaaatatgtctgtagctctggaaggcctagctgttgaaaccttaggactataatcaaggttaccacttacctaagtgtggtcaacagatcactggaagtccttgagacctctgaggaggcccacaaggtcaaaaatatttttattataatactagtataatgatatataataacaagacatataatacatgtcttagtcatatttactaagccagtacacagtatcttgcacttagtggatgtttacttacttaaattttgtgaatacatatgtgctctgtatctcatctctctttctgcctctgcttttaatagtggtactttgaaagactttctgccttttctaatgtgttgatatttacacctacagtgttaggtgatactgctgaagcctcactgagaacaaaggcgaacaaacaccaaatagtactaatattcatattttttcttttttttttcttttttgtgggacagggtcccactgtgtcacccaggctggagtacagtgtcataatctcagctcattgcaacctctgcctcctgggctcaagctgggctcaagctatcttcccacctcggccccccgccccgagtagctgggactacaggtgcacgatgccatgctcagccaatttttaattttttttttttttggtagagagaaggtctcatatttcccaggctggcctcaaacttttaggcttgagcgatccctttgccttggcctcccaaagtgctgggattacaggcatgagccaccacaccagcccccattgtattcttaatagcattttaaaaaaggatactggtttcacttatgaatgtgcttactgaaacagtaaaaaaaaaaaattagtgattctaataaataccaacctgtgagtacacacctttgtcatgttctgtgaggtgaaatggaaaatactcataaatcactcctgctgaattatgaaaaatgatagttgcatcaaggaaaagctcttgggtgttttgagttgcaagctgagctagccacttactgtttcacagattcaacatttttacttgaaagaacaatttaaaaaatgattatttaggctaggtagtcaggagccatgttcttgaaaatgagcttgtcacttcaagaaaaagtcacagtatttgtgccaatgattataatccaagtttctaaataaaaaatagaattttggaaaacttgtacatgctaccatgagcttgacacaaatacttttcctgttagattgatgatgatattaacaaatgtggttttctgatattgtataatggaatgggtcaatatttgaaagatctgcatagttcagtgagccaggattttccaaatgaccaaagcatgatattataagatcatatatggaaaacaatctgtgtaaagtacaagatagaccagtggcttttaatgtaacaatacgaaaattcattgatgtaatttctaattttacaatgcaattaacctttaaaaaagaaaccacttgttgactattgttgtaatatcaaagaaaaatatccacaattgtgtgaaaagcctgttaaaatatcctttctttttctgactgtattactgtgtgaggctgacttgtcttgatgtattacagccaaaacaacatatagcaaaggattgaaagtagggcagacatgagtatccagctgtctcctgtcaaggcaaacaagaaagagatatgcaaaaatgtgaaattgtgtcagtcttctcactaattttttgttttgttttgtaaaatataacttttttgaaaaattgtatatgttaacataatgggcatgtaattattattttaaatgaggtaacgaaaatatttttaaattattttaattttccaatgtagtaaatataggtattatttacataaattatttggggtgtccatttcttttgaagattacaaaagggtgctgagactcaacagtttgagggccaccagaggactagggataaaacaacttgtgtatatttctgttttgttgtttgagatgggagtctcgctctgtcacccaggctggagtgcagtggcacagcctcagctcactgcaacctccctgtcccatgctcaagcaattctcctgcctcagcctcccgagtagctgggactacaggcatgtaccaccacacccagctaatttttgtatttttagtagagatgggggtttcaccatgttgtccaggctggtctcgaactcctgacctcaggtgatccgcccaccttggcctcccaaagtgctggaattacaggcgtgagccacgctcctggcccttgtatatttttctaagtataaggtgacaggatgtgattctctaaaagcacaagcatttttggagtattcctcaccacacatttcaaaagctgaagaaaagtctccttcatttactgtttccttcctatgatttaggatttagaagctgctatgaagggggacagaaggagccagttgtgctggaacatctccgcttcaccttctgggtcacctgtatgctatgtatttggccatgtttcctagtacaaagagccctttatatttagattccttatgggccaatttcctgatggaaaaaaaaaacaaaaaacaaaacaggattgatgagtcttagctctctctcctgccccaacccccattctgtgttctagccagaggaaaacacacttatttttttattcttcaatcgaggcctgcttggccatgttcaggtctttgcttgtgccatttccttagccctcccacctctcaagacccagctcaattgccatttcttccaggatcccctcttcagtgctccggttgggatttattagcatccacttttcctctattctttccctgccccagcgctttgagtgctttcctatcacaaaccttttcctgatgattcacatccatatgcatcttcctaaggatccaaagcttttgcgggtagtaaccatgtcttagtcatatttactaagccagtacacagtgtcttgcacctagtaggtgtttacttacttgaattttgtgaatacatatgtgctctgtatctgatctatctttttgccccttacctttttttttttttcttttttggagacggagtcttactttgtcgcccagggtagtgtgcagtggtgcagtctcagctccctccacctgccaggttcaagcgattctcctgcatcagcctcccaagtagctgggattacaggtgcccgcccctacaccagggtaacttttgtatctttagtagagatgagttttcaccatgttggccaggctgatctcaaactcctgacctcaggtgatccgccctccccggcctcccaatgttctgggattacaggtgtgaaacaccacgctggacctgcctctgcttttaatggttgttctgcttgttctcttttagcagttgcccctgctcctcagttgtggctgaaaggcagtatccggtcctggtcactgataatatgaactgatcttgttactattgaggccagatggcagggtttcctgtctgtacacagagtatttatcatcccttgatttctataacagccatccatctatctatatttagtctagctagctatgtgtagtgtcactagcatcattgggggattgtttcaaagagagaaattcagatgaagtcaacaaaaattttaaaagggagatattgagtattttaattcttctttgtcttgattcttttgctacttgctttttctcttttttagatattagaaatccttttatgggacctattcttatgaagaaaagaataaattactccttcagagaagagcgtaatatttgactgactacagtacacctcacctttagagcagttggacataaaaataccatattatgttatttccagaagtaggttgatcctttcctgctgataaattcgggcctgctctccccgacatccactaagatgtttacacaggactgtgttgagaaacagccatccaggcctgaaggaagcttagtgagtgacatgctaaattaatgagaagacctgtttctcttctacgttcctttgtcttgttttttttttttaatgtgaaatttttataggcaggaaattttaaaaatagaaaactagcacttaccaaaattaattaaaacaaatgtattcttatataacacttttttcttttttaaaaaaaatccccagctgctcaaacttgcttcttccgtctattagaaaatcataacccaaggggaggaaaacatcaagctgcttctggccattggttttcagctctcattgctttaactccaaatgacacgtctggatcctggccatcgtttcctatcacttcatcgagtcagtgttgttttgacaatgccaaaccatgatttgcttttccacgcatcacttgcatgtgtctcctacaatcatgttgataacaacagggcttattattgatgagttcgtacttagtctatttagtttgtaaatgtcagaggtttctgtgttgatttaggaaactgtaaaggtcacttcaagaatcagacttagaatttttaaaatatatttttacactaaaatttaaactataattctacactttctgcaaaaagaaaatcacatacttaactactttaaaacatggctctttagcttgagtagttacagccctttattaaggttgacatagaagaattttgctttgttcgtcagttatttgttgagtacctaccatgtgcaagacactttccaggggctggggtggactgggaaacataataggtctggtctctgccctcttggttcataatcttgtggaggagacagaagaaaatgttaccacattatgaaattacaggtgataagtgtgtgctaccaaaaagtgtgtgacaaaggaacctagtggcattgtcagagaacactcctttgaggaagtgtcatttggtcccagatacgaagtatgagtaagaactactaaagaaggggaagggggtcctagggtccatttcaggcagagagaacaaggcctatagaagccctgcctgagatgagatggaacctgatgtttttgaggagccaaaagaagggctttatagcaagtgagcagagagcaagtggagcaagactgaatggcatagagaagattgagatcttgcatggcaccaaacacacaggattgaaaggcttcgagtaaagggtgatctcattcatgtattaagagggctattctggcattaatgtggggaatagattgaaggggcactgtcattagaactctgggccaggcgcagtgcctcatgtctgtaatcccagcacttttgggaggctgaggcaggcagatcatcaggtcaggagttcaaaaccagcctggccaacatggtgaaaccccgtctctactaaaaatacaaaaattagccaggtgtggtggtgggctcctgtaatcccagctactcgggaggctgaggcaggagaatcgcttgaacctgggaggcggaggttgccatgagccgagatcgcaccattgcactccagcctggtgacagagcaagactccgtctcaaaaaaaaaagaaaaaaaatgaagataccttatcctacagttgtgagattgttaatacatgtagtggatctggcatgataaatggcagtgaaggtggactataggaatggagtattaggaggaaaaacttcttcttctgccccatatcctttctgactgcccctgtcccataggtatttgacccttcagattcatagcactagaaaatttatcaaataataataggctgagcacagtggttcatgcctgtaatccctcttctgtgagaggcccaggtgggaggattgcttgaggccaggagttgtatatcagctgaggcaacatagcaagatgccgtctctacaaaaaatttaaaaatgagcctggcgtggtgatgcgtgcctgtagtcccagctacttgggaggctgaagcaggaggatcacttgagctcgggagttcgaggttatagtgagctatcatcgtgcctctgcactccagcctgggtgacagagtgagtttagaaataataataatggcaagaacctgaggagcttcttgttttatttattacaaaccaccttctaaaaaagatttgctaatactcatagctttgccagaattttatattattcagaactaaagcaaataaaaatgtatttaaatatatactgtgaacattttagttgggtgtttttcactagagaaccagatttttagaattaggggtaattacatatcttttatcttccatgtttacaaaactactctggtaattatttagagtatgttacattagttaatagcccatctgctcatttcagaatatctttctgaaaataagagatttgttggaatttaaatgtaacagtgacttgcagttgacatagggttgcatcctagttgctaatgtgattttgctgcattatctgaattaaaagctgaatcactctaaaattcatttccctctctttccagatcatgtatcagttggaggacttggagacagcttctatgagtatttgctgaaggcctggttaatgtctgacaagacagatctggaagctaagaagatgtattttgatgctgttcaggtaacccaatatttaaatcatctttgccactcagccctaacttataatttgtatattaatcaagttttaatgaataagtggtatactacatgagtgagttacaaagtatttccaattaggtagagttcgatatctgctaatatcatcgtaataatggtaatcatatttgatgtttatttctaatagggccgttaaagtttttgcatggtttaaacctcagttaagagtcacatatctgaaaaagtagtattctttgataaatatgaattctctccttaggaccacaatttaaattatgcagggggaaatcctgaatttgtattctgacaattgcctaagttaaaattgcctgagaagacagacagtcccaatggctacctccatgtgaagtaaacttgtccccagagataaatggacagtactctaaggaaatccacacataaaaatctgaacaaactcatatttcagggaagatcattaatagtatcaaagattctttacagtggagaagtaagaggcaacagttgagtgttgaattgcctaccatgtgctaagctgtgtgttaggtagctcctttaaatgaagcggtggagttgggtttttttctctctcacagtacttgagattattacccagttttacagataaagttgctgtacctcagagagattacatgtcgaaccaaaattaagattaaagtttgtctatatcagcacctgttccttttaactcatccactgtggatttatttgtaagaatttccattctacacttaaatcttcatttactaatttgcaagcagtaagttagtaaggtaagttagaaactacttaaagtctctaggaggaggctagtataaaagtaaactaagaaacacctccagttaagcctcaatcaaaaccgaaaataaagttagaaagtaaataaagttagaaagaaaattactttatctaaaatatttgtactcttcaggaacaaaattttttagtggaatcaggtgcttttgcgattaagtattttatgtggtaatacatatattcttttaatattattatcaaggcttctcaagtagtgttgtaaaatagtggctcagtcctcagaaaaattttatttttcttgacagcttagaaattttttaataaagtgttaattcataggaaaaaaatggaaatttgtaatcccaaagatgtagccattataaaattggtctttctaacaagaggtctgggttattttgacataggcgtacttgtttatttaaatataaatgcagcttgctttgttctggttaactacactgagtatgacattggtttcctttacaagtcttcactacttcacacgtaggaaccagaagcgccttagtgagaacgttggcctacatttggcacagcctttataaaggcacatgattaacatcaaaagcaaactaggatatgatccacatggcctcttttaggtttatttttcctcattgctgtgaggtttcagattttaacctggggagttctccatattttatagtttccattctgtcatcctctaattaccatactggcagacattttaattattctaatcttaaattggccgtctaagatcttgatgttcaaaaaaagacagctttaaaacattatttgaaatattttcttcctaattcctaaaaccatacccacacaacttttagtatattgtattcagacaaatcattgacaggaaaatccattaagaacaaataaagtcaaagtgtttcctgcttctcttagtagtaaaagctaatttttcaatccactgtatattttcaacttagaaagcaaagctagaacaactaaatttctgttttgagaagtagcattgtcttatacagcaaagtttatttctgctaagttgtactttagaagattattgtaaccaaggggaggatgctgtacactattgttctggacaattgattactaaagatatggctactctgttgtagtttcaagtagattttgggaagcatttaatcccagagtgatatgttttatttgattattttaataacaaaatattttgagctttcaactggctatcatggccctatctggagactacactaggaactcacaatggcaaatgatacctgggcagatgacatatcagacacttacgattctgaaggcttcatcaaaccagttttttaaatcaattatagaaggattaaatcacaaaatatatcgtactcttttttctaatcaattatctgtatccttgacacagttttttcagatctactaaagactatccttctttgtatttatttatatttcccatggccacacaaaattattgtttgaaggtcttggaatttcattgtagtttttattaggaggtagcaacttggtccgaatcatgccagaaatactttatttaggatccataacagggtaataatgtttctctaattcatcctcaaaagctactactcttgccatgtagaaagaataatttcttaggtgatgaacaagtatctgcttgaaggactttattgcaatttgtgttatgagaagtataaatagctaagatattcagtcgcataaaataagaatgaaatattaatgtaataactaaaccatcaataacattagcttaaccacggttaatgagcacagtaatatgttcatttatttcttaccatcttggtttcattcgtttatttctaataaaggtaggaaaggttttagcttcctgtgtgttcattttcattcattcttctctatcacaagtttttttctgtgtctattattcccaaatgtgcttcctaacaaatccctctctcttgatagcagtgtacaggtatagacacagtcatgtcctttttccttccatgaagtaattgtggggcagtggggagaacattttctgttagagtaattggagattagcaatgccaaacacactttatttttgctttttaaaatataaggcatattttacttacctgtctagtttaagagaatatcaacagacctgggatagaaataaaagatgttttataaatcatttttgtaaacattatcatttctcccaaatttaaagatttttctgatttttaaaatatatacatttattcattatataatagtgtgctttttaatagaagtattagagaggaacttgattcaagcgtcaccactttggagatgtaaatgataattataaatgacttttatcaagtgccacttgcattagtgactgctttataaacaaaatgtggcagagtcgtatcaggagatcctgttgttcccatttatggattaggatgctgagatttagagatatagtaagcaaattgttcactcccacaaattagagatagtgtcagagctggaatttgaagccaagtcttccggccccagaacacctcctctttgccactctattttgttatccctccaagcctacggaagtgaaaggaagagttctgccaccatcctggatctcatgcacaaatatgctgtgttcttcatccaccttagggcctgggctgtgtcatttcaccacttatggaaatgaaaatgtaccaaaccaactattactgctgcacagtggcctgtctttgggaaggggaaagttttttgaatatgaggaatacaatgtttggtcacagaaccaagcaaaaccaaatgtgctggcgcagcagtgttaattctgactaatcaaacaaataaggcataaactagaggaggaatacagaaagcaatagcatgtaatttcaggttgaatggatttttaacaccaaactctgattgtcaggtgtattctattcttttttttttaatgttgggcatatttttagtataaatttgagaagagattacaaaatgttaaaaaataagtgtttttcacaggctatcgagactcatttgatccgcaagtctagcagcggactaacttatatcgcagagtggaaagggggcctcctggagcacaagatgggccacctgacctgcttcgctgggggcatgttcgcactcggggctgatgcagctcccgaaggcatggcccaacactaccttgaactcggggctgaaattgcccgtacttgtcatgaatcatataatcgaacatgtgagtacatgttattcttcatttatggtctattcccacatgctttgatttaatgcagttttgtcattgctgccctcaaaagactatccactctgcctatgaagcttgatgatcgtgattaatgtctcaaaggaatgtatattttattttaaaaggcaatgcttttcttcctaaaaatatctacctttagtttaccaagaaacaaaaatccaggccataaagagttaaagccagcctaatttactgacttctgcttttgccaataacattgggcaagggtctctatctccctgcaaagagaaacttagcattttattaaccattattaatcttctccacatcccccatgaaacagatcatgaatcccactcccttcttataaaataggaatttgaaacacaaagtgtaaataactggccttctgttacgaaattacttaggattgtcaaccactaagtttctggctaactcaaatggtatttcatggtgccttgtatctgcctggtgggtgctcagtaaatgggggttaaatgaaaaaaataaattgttaatattttctaaaatggactcttttcaatgactaaattgtttaagtatatgaatattatatattacatgatgtttataactcgtttttaaaatgactactttgacatttctcttcagtgttgttaaagtacagtcagaccttcgtatccctgggttccacaactgcagatcagaaatgttcccaaaaaatggatggttctgtctgtagtgaacatttatagagtttttgttcttatctttattccctaaacaatacagtataacacctagttacataacatttacactgtattaagtagtataagtaaacgaggtgatttaaagtatatgggaggatgtacctaggttgtatgcgaatactttgccattttatataagggactcaaggatccatggattttgttatccttggagggtcctggaaccagtccctcatagatactgagggatgactgtactttctagtttcatttaagttattgactgtaagcactgtccaggaaaataacccttattcattcattccatgtcctttagttatgaaactgggaccagaagctttcagatttgatggtggtgttgaagccatcgctacaagacaaaatgaaaaatactacatcttacggccagaagttatggagacttacatgtatatgtggagactgactcatgatccaaagtacaggaaatgggcctgggaagccgtagaggtgatgttttaatttgcatgtttcttatagataaatttcatagtaaaaaatgttcagtgatacccataaatcaggcttatcaacttttctataatttttaatgcttcgaccaggattttttccacccaggactgtgtattttcattgaagtcattttatatccctggcttcagctttgctttgtataacattgatatagatatatctactgataggcttagatattgaaggagataactagaaaggcatagtctaaaattaagttcccattaatacaaaaatgatgatctcttaattccacctaagggttgttggcagcttggggtattcacctctatttcaataaaccacttcatgtttttttctgtctttgggctttaaaatgctagtatatgcttttacttagagtaaatagctacttagatctaacttttagaaagcacttatagaagaattactttgtataaggatattcctttaccagtctcaggtttcttggaatatctataagctttccatctgcccagtgtgttgttttgtctgtcacctcttgggtctcttcctgccgaggatagtatacttccttcctaaaccaatctagtgaatgctttgtgtgccgaatgcctgaggaggcaacctgcaggatatgcatctaacaatgtctgtctaattgtaagagttattattcctcaaggagtaggagggaattcaggggataagaacaagcaaatgctttaattacactctcattctctagcactctttgttagaaagttagctatctttaaaaactgtccatgaggaatgacttctctcaggaaatctaaaatgaatattgcctttggtaaaatttaactaatatcttaggaagccatcggtgaatcttgcttattatcctcttcatttaatatgtgtcttatcattaatcatcagtcattttaaataacagcaattctctaggcctctttgagggggcagttttattacatttaatcagtagtcattgtaatttctttacatttctgtttttttcctctggagaaaatgttaaagttgaagcttttctaaactttggtgatagggaattgttttggtcttcaattggccagcaaatgaattgaatattttaagttgaaaatatcaggaatggtgtgttccatcaaatctaaaacaccataattagtaagaagcatcattattttatataccactaagaaaaataacactaccaattaagttatgacatccattttatagatgttagaatgtacaaaatgtatggccgagaaggtatcaaaaatgggaagtaagcaaattcgtattgccaggtagacaggatgctttggtttgctgtgttcttcagggggttgcttgtttatgagatcataaggttggtttatgtgttatgatttttatttcttgtcaactctttaacataatatatgacctgaaatcgtttccctgtgtcacaacactgaggtctcaattttggggatgcccccagtaacctctgctagaacctgagctatagtggtgagccaggagtgctgtagggtcttgcattttttaaaccagaaaaactgggacttcgaaggcatggccgcacgtttttcccctggtgttatgcccacccccgtggcctcctgtgtttcagcagcagccccgcatatgcttgcagctcccacctccagcacttggctgttctgatgcatacttgagaccacagctggaaaccatgtcaggaaaagaaggtggaagagcttttccctagccagctggctgtggtctgggaagtgctggggagttaatggctgtcaaccaaggaggttttggagttggtggataactgtcccagtcttctttccttcaagaatcattctggaatgcatgctacatggttcttcagagggtttctagcaggagtgagcctcgttgcacacagttgaacaatatgattcattggctcttctgtccctgttttgcttttcccacttgcccacttcctgatgtcacctccctgatagacttcctgcatcctgcgtccaacccttgtctcatgctttatttttaagggaacgcaaactgaaacatagggggtcttaaaaatcacctcatccagctttccgcttaaagacaagactcccctccatatctttgcaagatagctgttcctcatcaacccaaggactttccagcaaaggggaatgtatcacctaataaagtaactcattccaattggtaatattgaaggtgttagaaagttatttattttgaagccacaatttacagtgttctgtgctctgggggtaccagagggaaaaaatctcccttctgcatttcagctcctcaattatccgaagacagcaggttctgccatctcttcctttcctcatccatcatttcccttgattttcttctcctgacctggtttccagctgtggtcttttagggctgaatagtgtgaacctctcttctctcttcgcagtgtgattttttcacagcttatggtccaacttgttcttttagtagatttatatttaaaaaaaaaaaaaaaaaaaaactgggaggccaaagtgggtggatcatgatcatggtcaggagatcgagaccatcctggctaacacggtgaaaccccgtctctactaaaagtacaaaaaaaaattaaccaggcgtggtggcgggcgcctgtagtcccagctactcaggaggctgaggcaggagaatggcatgaacccaggaggcggagcttgcaatgagccgagatcacgccactgcactcgaacctgagggacagagcaagactccaactccaaaaaaataaagaaaaactggcttatattgaaattatggtcagtgttagcttctccatttgctaccgttgagtcacatctcctttgcactgtgctttttcacccatactttcagtttgtaaagtatttgtaagccgtcttcctatcttctaacaaagcactcccttcccagccttctttcactgatacacttgagaaacctgctttctgtgtcttaattaaatttctaataataatgtcaaataagatgtgaaaaggtatataatccagcagtacaacactagagagttcttttgtgggttaacagcactccattaatcacaggtgttcaagcacttgtgagtctgcctgacagaaataatatttaactgataatttcttttgctttttctcaaaaatgtcatgaaagccaggcgtggtggctcaagcctgtaatcccagcatgttgggaggccgaggtgggaggatggctcaaggataggagtttgagatcagcctgggcaacaagtcatcaccctgtctttacaaaatttaaaaattagcccgtcatgctggcacactcctatagtccctagctactcaagaggctgaagagggaggatcacttgagcccaggagttcaaggttattttgagctaagatcacaccgctgcacgccagcctgagcaacagagcgagactctcttgaaaattttaaaaaaaaaaatcatgagaaactgacaaattccttccatttaaacatctgataacttacagcatgagctttatcagaatattgtatgtatatattcacatagattatataatgtctcagctgatctatggtaaagggtaaagccttacctagggatttgggatttttttttggctttagggggtttttttttggtagtttcaggttttttggttttgtttttttgcacagacattttctttgctcttctaaacctaaccttttccactcagacatttcgactctcaggaagtgacttcttttcctccttcctactcctgcctcctcaggcttcatcctgtttccaaaccctctttgatttgttcaaggtgcctgattctctgtgttctatccttgagttcagacgacactcaagcagacagccttactccacggatcagccatttatatatctggtaggcaagagaatactcttctgtcctctgacttaggatttaactcatgatgcttgctattttcttacctacccttcatcctttgtttagagctccaatcattataaacattctcatatcctgttctctgctatttgcacatcccagtcacataggatcactaataatagaagcatttactcaaaaccaaggtggtccccatgcctagaggctgagaatcccaagaacagattatagtacaatgatgatctggttagacttagtcatacaaacacatgacagcttccactgttgagatgctgatagaatcagggctgttgtaagggcccaggaaagctatttgtccccagcttcacgttcctaaagtcttaaaatctagacttttgcgtaaggggtgagggggagttcttgggtgcttttcctttaaaaaaaaattttttttttttaatttaccaaaaacttcaaaagcaaagtgactgggcctctctaaacctctgaagcccttgttattgtctaagcatttcttcattttgttttattctcacgtacaaccccatgttgagaaggaagatgctgcctgggacatggaacctctggggccactgataagggggtctcaagctggaagttggcccactactcaaaatttttggctgtgttcttgaatactatagcttaccccaagaggacttgtggggaacaagaatgagagggtgaactagaaagaaaggtgattaggcattgtccaccccaaaagcaactcctctaacaaaagaaggagcttagagcagtttccatggagaggaggagtggctgtttatcatggctggccctctcattagctcattaccaaaaaacctcaagggaacaactaagaaaaggttttgggattaaaatctgtttaaagaaatatccggaaatagggtttcccataaaaaccttgcccattttttctaaattctgatttttttcctttttttaaccaataatttttggcttattctacatatctggtatttgactctttgtcaaaaaaaaaggaggaaagaaaaaataataggacttgaaagtttctttcttcatgctcatcctccatttgacgcactgtctggaacttagaatttaatcgaagcatctgtttttaagttgatcggtcttattttcttcggggctttttaaaagtatgaaatcatgaggcattttctttattttctttattcatgtggcctgctggccagaatttctttaaccaggtaattaaatgcttctcctcatagtctctctgctctctcccttctgtcctccagccctgatgtgaaaaatcaataacctcattatcagtatctgcagatgggagctgagctctcagtgcaacatctctgctcatgagaatccgtggctggtacttactttccctcgcctcttttctgggctctacattcttagagccttattttcctccaaaatcctttctagccagagaaggtttttctcaactgataaggcaaagtctatgctttccatcttcttggtagttggattaaatgggagaaaaatggggtacaattatatatgtaaaaaaaaaagagggacagaattatgatccacaggggaaaactgaaacgtaagtgaaaaatgacatgagaaactaagagtaagtatatcttgtttacattttctttatttcactataaaatatattagggttttagtcttaaactttattatttttgtctacagtcaataaatgagaaccagattgcagatggcaatttttgtacgatggaaatttttatttgaccatataattaataggattagtaggatgtgatggcagaaaataactttcctagagatgaatatgcctggtaactagcagagcaacaaatgtaatttcaaaatataaacagcacaaaaaaaaaaacaactcaaaatgaattaaagacttaaatgtaagacctgaaaccataaaactcctaggagaaaacaacaggggaaaagctccttgacattgagcttggcaatgattttttggattcgacccaaaaacacaggcaacaaaagcaaacataaacacatgaaactacatcaaactaaaaagtttccttacagcaaaggaaacaatcaactaaaaacacaacaaaaatgtgtgcaaaccatatatctgataaggggttaatatccaaaatatataaggaacttacaattcagtagcagaaaaacaacctgatttcaaaataggcaaaggacctgaagagacatttttccaaagaagacgtacagatggccagtagtgaaaagatgctcaacatcacaaatcatcagggaaatgcagattagaaccacagtgagatatcacctcatacctttttaaatggctattatcaaaaattcaagaggtaatcagtcttagtgaggatgcagaataaagggaacctttgtacactgttggtggcaatgaaaattgatatagccattatggaaaacagtatggaggtttctcaaaaaattaaaaatagagctaccatatgatccagcaatcctaattcttggtgtatatccacagaagatgatgtgtatccacatcagaagatgatgtatatccaccacagaagatggtgtatatccacagaagtagtgtatatcaaaacatcacactgtacaccttccagtatatactatttgtatttgtcatacatcggtaaagctggaaaaaggttaaagaaaaatagaaacaaacaaaagaaagaaagtgggctctgaaagggaaaaagaaaacacaaacagcagccatcttagtggtaaccaacaaagtggaaggcaggttggtttaggttgttacctaaatgttcatcctcacactgcccaacccatctgttttccaaatattcattaaattcagacaactacagaaatgtaggatcatttctctctagagagttgtcagtggagtcatcccatcttcttccatactagactgaaaaaaaaaaaaaacatgtattttaggaatagatcccagccacatgtctctcactgtctttcattttcttcttttagctctgttaccaatatcactgatgagtaccctacaatcaattttcagaaactcagatactctgattatagaagcagctgattttgttccagtacggtttctcaaccagtggtttatgatcccagttgacattagcagtctctccaaactaggggtcagcaaactctttctgttaagggccagacaatatcaggcttgggggacagccagctagtctcttttgcatctacttagctctgtcattgtagtacaaaaacagccacagacaatatttaaacaacatggctgtggtttaataaaagtttatttacaaaaataaacagtggactggatttagcctatagttcatactttgctaaaccctgctccagaccatagggggaattggtaaaaatcagtgaaaaatttttccaaaactaaaggcagaagtgtttcaaattaggtaagatatgtggtccatatgttctatgacttcatttttaatttacatttagtttatggttttaatttttttttacctaaaactctataacaaactttcatttaatttgaatccaatttgtaaaaaataaattttgactgggcacagtggctcatggctgtaatcccaactctttgggaggccgaggcaagcagatcgcttgagcccaggagtttgagacaaccatgggcaacatggcaaaaccctatctctacaaaaaatacaaaaaattagccaggcatggtggcgaatgcctgtggtcccagctacttgggaggctgaggcaggagaatcacctgagcccaagaggtagaagctgcagtgacccatgatggtgccactgtactccgcccaggcaacagagtgaggccctgtctcaaaaaaaaaaaatgttttatctgaacttgacaatctaataataaaaattagtgacaatcagtttactgaaatgtgacttttttttttcctcctctataatttaggccttggaaaaccattgcagagtgaatggaggctattcaggcctaagggatgtttaccttcttcatgagagttatgatgatgtgcagcagagtttcttcctggcagagacattgaagtaggtgaaaattattctaaaaccatgtggctaaggtacctgaacagatctttgtagatgtctttatcatgaacacattcaagtaatatcaagtatgcctgattcagaatatcaggcatggctataattgcaggtatattctcaataactaggttcagtgacttggtactgctaacaccaaagcactgagtagctgctttaccccatgttaatgagtataacccctcagggttttgatatatttgactcttgtccatgtttcttggtaagatgaatgcagacattgatgtggtttttgctgtgtgtttgtggtttcactgcctgcctagtgtcttgggcctcatatacttatgtttctctcaccagatatttgtacctaatattttctgacgacgatcttcttccactggagcattggatcttcaatagcgaggcacatcttctccctatcctccctaaagataaaaaggaagttgaaatcagagaggaataaaaagacattttatattttattctgctccattcccttcactgtataccttaataattccttttctggtaatcaggcacatgatgaactttgattagtaggtctgtgattaagttcttaaattgttttgcagtcttttatgtttattatcataggtataggtggacctaaattccttatcatatcctttattaattcagccagtgtatccaccagttttttgtttatgtttttaagtaacctattatctctggatttcatgaaggtgtaatatcgtttttgttaaactgaatagaattgtatagcgatgacctcttaattataatttgatttgactgcaaaactttttcctcctctaagaggagatgatgtctgctttaagctgtaatgttttgccatgttgcaaaaagccataataataagtataaaaaagctttttcctttacaatttcatgttaatctggtttgtctgtccaccagagacagatcttctgtgacagcctccttatgcaggtctatcattatttgatagaatgtcttctaaaatacttcactcacattgtaattcaaattagaaagtcattccaaaaggatcatgtcatgttgacctcatttcatcggaactgcagtatatttttgttggttaattatattagtgttttctattttgtaaatgtgtcctttaattttactttaaatgccctgtgtcatttctggattatatactagttaatttcttccattccccactacacagagaggtgagctttcaaattttgcagagctctgctatcactgaattacatttatctgaagaaaatagtacaacttaatggattagcttttgggtttaactgaatatatgaagaaattgggtctgtctaaagagagggtatttcatatggcttttagttcacttgtttgtatttcatcttgatttttttctttggaaaataaagcattctatttggttcagatttctcagatttgaaaaaggctctatctcagatgtagtaaattatttcctttcagtttgtgaaagcaggatttgactctgaaagaagctttgccaattttacttattcgtgatcaatcaaggaaaatctaataaattttaggccaaataagaatatagcatatttagtatggttatagtcaacacagagatcacaacttagaagaaatataaagaaatggccactccccatcccccacagtcctggagtaaatcaaaatcaatatatgattcttttaaacattaagtttgaaataggaatggttttctcaagaatagatttggtgtgataccttgtgtttgcttacattggcccactatatatacatatatatttatgtagatatacttccatgaaagggctaatacgatgcatatactgaagggcaaggactttgaccatgtcaattttcagccgagaatggtcagaaagatcagtacaaccccatggattaggctgaaacatatgaaattgctgcatttgtagtttaaaaactgtcagcagtttcatatggttccacctaatattattgaagacaattattttcttagctatcaataggcttaatagttttagttattttagcttttgaaagtgttttaaaagatttcctttatcggacaggaccatctttatgacctgctttctgtttttcaatatcatacattggtgtatgtcaaagaataaattagtaaaattagtaaatgaaaaagactcttccgtacatcattatttccatgctaatgtgtgtctgtgatccagaataacttctcccactcatatcttcagttcacctaatgaaatgaatggatagcaagagccctttgttcccaggactttaaggcaaaatattaaaaattattgccaaaattaagaatataatgtttgtataaatgtccttgaatttgccatttaaattaactcattttcttttcactttgatttgaaagctgataagtatttctgcagcagatagaatattaaaatcaggttgtgtgtacacactgcactatgaggtaccttggtgtcctggtgtgaatagacaagaagctgtactatatgttgctctctcagtggcaacaatgaagtttttgcaattctagaacttggatttttttttaacaaaagtcccaaaacaccaaaaatgtaaacaagataagagattaatattgtagtgatgtaatttaattaaagttatattttgggttaattttaacaactgaagtcttattgttgaaacttattttcaacaaaactgtgcagttaaatttgtatacgtattcacatactgaaagatgaaccgttaaaatagcacttaattttgtgtttcttcaatatgtcttgatatactttgtgcaattaatattacacatgtaagttgtatggcagtttacagaactcaatgacttgtcatgaggttttcatatgagctacacattgtgtacattgattgttttttatttttacataaatccattctgtcattttcaactttatatataaatctccaatgttatgggaaacaatagattgacacataatttttaaaaattatatttgtaaaatttctctattgtgaataaagtcttttaatatatctcctcatttgttatatttttctcctttttagtaggcttttgtatatctaaggggtgagt

SEQ ID NO: 17303 - DNA, 9556 bp, Human
  misc_feature (1)...(9556): n = A,T,C or G
caccacacccggctaattttttgtatttttagtagagacggggtttcaccgtgttagccaggatggtctcagtctcctgacctcgtgatccgcccgccttggcctctctaagtgctgggattacaggcgtgagccaccgcgcccggcctatttatttttatttatttatttatttatttttttgagacagagttttgctgttgttgcccaggctggagtgcagtggcgcgatctcggctcacctcacctcaacctccacctcccgggttcaagcgattctcatgcctcagccttcccaagtagctgggattataggcatgcgccaccaagcccggctaattttgtatttttagtagagacggggcttctccctgttagtcaggctggtctcgaactcccaatctcatgatccacccgccttggtctcccaaaatggtgggattacaggcgtgagccaccacgcccagccaacttcatgtatttaaatggactggtggattgaaatctgaactctactgcctgaatttaaaggccctccagtctggcttcacctttcccacgtacctagcattatttcttgctattgcctaggagactcttatatccaagccttattttctctgcgtctggaacacactccttctgctcccaaactgcccatccagctcctaactgtcctcaccactcatcctttaagtgcatatgttgtctctactactcattgtggcatataatcaaacccgaatatgtgtagaatagtggtgaagaatgcagtctagacccagactacctgtcttgggcaaattacccaacttctcagtgcttcaatgtcctcatttgaaactgggtatagtaatagtatccacttcttgggtttattcttatttatttatttatttgccattgttccataagaaggtttattttattttttttaattttatatatattttttgagacggagtctcgctttgtcaccaggctggagtgcagtggcgtgaccttggctcactgcaacctccacctcctgggttcaagtgattctcctgcctcagccttccaaatagctgggactacaggcgcccaccaccacgcccagctaatttttgtatttttagtagagatggggtttcaccatgttgaccagggtggtttcgatctcttgacctcgtgatctgcccgcctcggcctcccaaagtgctgggattacatgcgtgagccaccgtnnnnnnnnnnnnnnnnnnnntgcccgccacttcttgggtttataaggattaaacagttaacatgggtatagtgtttagaagttccttctacaggccgggaacagtggctcacgccctgtaatcccagcattttgggaggccaaggcgggcggatcacgaggtcaagagatcgagaccattctggtcaacatggtgaaaccccaactctactaaaaatacaaaaaattagccgggctggtggcttatgcctgtagtcccagctgcttgggaggctgaggcaggagaatggcatgaacccgggaggcggagcttgcagtgagctgagatccagccactgcactccagtgtgggtgacagagcaagactccatttcaaaaaaaaaaaaaaaagttccttctacataactgagtatggtatgttaactattatttatggccattgcttttcttattgtttcctgtatatacattttgtttctcaagcatgattgcaagcccctggggacagggagctaatgcatttgtttcactgcacatacctgcgtctatcacaaccacatgtgaggcctgtactacataatggctaaagttaaactgacgaaatccctcagctaccttttgctgtgctcatccatttagtctcccctcttctaggtccaagaatgcctcaggatggatcagatgacgaggacgaggagtggcccaccctggagaaggctgccacaatgacagcagcgggccatcatgcagaggtggttgtggaccctgaggatgagcgtgccatagagatgttcatgaacaagaaccctcctgccaggtaggcctggggatttgggataatgagtccttgtagaaagttcccacaggaaaacaagttccctggcagacttatgattccctacctttggaaagggccctggagttgctagctgtaggggaccaccttgacaaaactggcccatcctcaaaggaccactgtgagtaggaatgacccagcctcaaaaaacattgtgtccttatgtccatttgttgtacaactgcccagttgccagggaaacagttccaggccccttttacacctctggggagagccatcctattgcatttggttttggtattcttagtttttttagcggtaagctcaacttccttggacaagtcttcatatcctaagcttcatttaagccaaggtttttcaacctcagcattattgacattttgggctgggtaattttgtgtgtgtgtggaggctgtcctgtgcagtgtaggaggtttagtagatatctctgatctctacttctagactccagtagcaaccttcccccagttgtgaaaaccaaaaatgacatcagacattgccaaatgtcctctgggaggcaagactgcccctagtcaggaccactaatttattcccatctataataaatgctagctccaaaacatgcaggcatttagactgcctgtggtcaaactcctgagcccataaattttggcccttgggagtggagtctaggataagggtcctcaaccagttcattctgaccctgtgatattaacataatggtgtccctgatactttaggctgttttgggctaatgcatctcattgctaatcatactataaaaggacagggaggctgataaattctgtggcagcttatttgaaaatgcagaatgaagaaatgaaaatgagcccctctcccagattgatgcctaacagttgaaatatatgtcataaagtatgtacttgggcttgtccccccagagagcctctcaggttctcactcagcacctcataactcctacttcactgataatgctgaccaatttagcagaatgcttttccagcttgtagtaaatagagtagacaagctccttgaagtaatcagaactcctggcagtcgtaagaaatgatagctggcatcttcagaaagcaagcctagatccacatgaattcaacaatcagaggccatttagtttgggggcacattataaggtactataaagcaccttaactcaagacttccaaaaacctgagtttgactcttacccccacctgacagctgtgaggccttgggtgagttattaacctgaggcccagttcccatgtctgcataagtttccgtgtcctataagtgttgcgctgactctaggactgaaaagtcccaaactcagtgcctggcattgagtaggacctcagaaaagaggagcagtttgttttttgttttgttttgtgacaggatctcactctgtcacccacgctggagggcagtggcatgatctcagctcactgcaacctcagcctctcgagtagctgggattacaggcacgtaccaccacgcctggctaatttttgttttattagtagagacagggtttcaccatgttggccaggctggtctcaaactcctgacctcacgtgatccacctccctcagcctcccaaagtactgggattacaagcgtgagccactgcgcccaactgagaagcagctttaaatacatttcagtctgggcatggtggcccagacctgtaatcttagcactttgggacgccaaggcaggagcccaggagtgtgagaccagcctgggcaacatggggagaccccatctctacagaagaataaaaaactagctgggccttgtactatgttcctgtggtcccagctactcgagagactgaggcgggaagatcgcttgagccagagagatagaggctgcagtgagccatgatggtgccactgcatgccaacctgggcaacagaggtagactctctctcaaaaaaaataaataaatacacttcagcagcctctgaagatgctagtattatatgacagctcaaggcgatggtaattctgaatcattaagataagattatgtttgatacacccaacaatactgtttaaggaggctgaaaagaatataatcagtcttagaaatatttccatagataacgcttactgtgtactgaccattccaagtaatgaacagacattaacttatttaatccttccattaatcttttaaggtgggtaccgttattatccctattttacaaatgaggaaacagaggcatagagaggtaaagtaacatgcccaagatcataccagggagtgggtgagccaggatttgaacctgggcagactgacttcagagttgaggttcataataacctccgtacaactgctagctttgtcctaaatggaatgactttcagttcctttgcaccctgcagtgattctgtctgtggtggatgaatgggcacagagagagaactctaagctgcatatcccagcaggatcgcagtatggcggtgctcacaggggactgtggggagtctggagcttcctggacagtgaccacagtgctccttgccccctctctcccctcctcttggcacttcccctcttaggcgcaccctggctgacatcatcatggagaagctgactgagaagcagacagaggttgagacagtcatgtcagaggtgtcgggcttccctatgccccagctggacccccgggtcctagaagtgtacaggggggtccgggaggtaagagctgagaggggagccatggtggaagacccctttgggggctgtgggctcctgccacaggcttttttgccttttgcctgcatcgcatactaaagaagtcatgggagtagaaaacagacctaagaggcagagtgtgtgggttcagattcctgctctgcctgtaaatgacttggcatccttgggtcggttactggaactctcactggtcatctgtaaaatgagcataataatggcacctccttataggttattgtggggatgcaatgagttaatatattaaaagcacccagacaagttcctagcccacagcaagcttgccatatgtggatgacgatgattgttttacctccctcatccctaggtattatctaagtaccgcagtggaaaactgcccaaggcatttaagatcatccctgcactctccaactgggagcaaatcctctacgtcacagagccggaggcctggactgcagctgccatgtaccaggccaccaggtagagtagctgggggttcgggggccttgggtttataggtgcaggctgagtttgggacggacaggctttccttgcctctggccccagggcatttgagctttgccccagggccctctctgtgctactttatagcatcatttttctagcttttcctgtgtcattttttggggccaagacccagttagccagttaggaaccctccgtgatgaatttctaggggagaggcttttatagctactgggatacaaccctctgtgatgaatttctaggggagaggcttttatagccactgggatacaaccctgtagcaggaccctcagaagtctgtgactgcccaggcatgctcagggctagcagaatcgaactgatgctgagtagccatcagtttgcacgagctctggctctcccacagacaaacggtgctcctcatttgggtatatctcattgcccctcctattctctctctaagctgatgggtgttgcatgcacacagctcccacacatcccccactgaaagaaaggtcccatattttactttaaaacctcttgtatgcactatccatggtgatatttaatgggccgggtccagactgtcgtgtgagttggaaacttcccccgcttaactcccactaggatttttgcctctaacctgaaggaacgcatggcccagcgcttctacaaccttgtcctgctccctcgagtacgagatgacgttgctgaatacaaacgactcaacttccatctctacatggctctcaagaaggcccttttcaaacctggagcctggttcaaaggtgggatcccagaggcacggaagaaagggaagggctggagcttctatggggaacacagcaggcctggtgtgggaaattgctagctgtccctgggctgggtgggaatgcttcctgctgtaactcctttttctcatcctgggctcacagtggctgccctttgactctccctagggatcctgattccactgtgcgagtctggcacttgtaccctccgggaagccatcattgtgggtagcatcatcaccaagtgctccatccctgtgttgcactccaggtagtattgctgggggtggaagggggctggtcagtggatatccagatagtggaattgccaggacttgggaatgggcagagtggagaaggagctaaggaaagccttgggtttgtgcttgtttaagccaatgagtaggtgtatcattatccccctcaatgtaagttgtgcaacaacagggcccgagtgcctggcataaagtaagttctcagtaaatagataaacaaatgagtaggaaacacaggaagaaagtagttagggtggagacgttgagatgtttggaccatactctagttggttactgaaacaagcagtctatgctagagatagagatttgggtggatccctgtagagatggtgactgaggtcaagggagtataatatgattgtgtaggtgagaaggtccctggggaataccatagtgtaagggccagcagaggggaagaaaaaaaggggaaagcatagagggagaagtaggatccttcttccaatgttttccctgcttactctaccccacctccctttcccactagtgcggccatgctgaaaattgctgagatggaatacagcggtgccaacagcatcttcctgcgactgctgctggataagaagtatgcactgccttaccgggtgctggatgccctagtcttccacttcctggggttccggacagagaagcgtgaactgcctgtgctgtggcaccagtgcctcctgactttggtccagcgctacaaggccgacttggccacagaccagaaagaggccctcttagaactgctccggctgcagccccatccacagctatcgcccgaaatcaggcgtgagcttcagagtgcagtcccccgcgatgtggaagatgttcccatcaccgtggagtgaggaaaacagtcagctgtcctggccaaaggggtttggaaggacaccaagacccccgttggtgactgaagatgacactgagctttaatggctgaagacccagatcagggcagtgacagatcacagggacatctgtggctcccagtccaggacaggaaggactgagggtctggctggttccctcttccattctaggcccttatccctgtttagttctgagagccaacttgagataccatatgctagcattcccagtccccagctggggcttggtgtgagtactttttctatggctattgtgtcaggtcactgtggataaaggcaaagacagatatttattgaacctctgtgtttggtgtagtcaatggaggtaggcattactcctgttagtatttggaggacggaggacattcttgtcctgtttatataggacccacctcccttgatctccaagcttgtttctccaggctgcactcaccttgttagcccccaggggacacatcctctgccttcccccatcacaggctacagcagccaggagcaggttgtccaaagatggtcgtgtctcagcagtggatgaaaggactacaagagaaaactccttggggaaagcagagataagagtcaagaaaggccagagaggctgggcttggtggctcacgcctgtaatcccagcactttgggaggctgaggtaggtggattacctgagttcaggagttcgagaccagcctggccaacatggtgaaaccccttctctactaaaaatacaaaaattagctgggtgtggtggcgtgtgcttgtaatcccagctacttgggaggctgaggcaggagaatcgcttcaacctgggaggtggaggttgcggtgatccaggattggggccactacactccagcctgggccacggagcaagactgtctcaaaaaaaaaaaaaaaaggccagagaataaggctgggcccaagaatggttagatcagagctagcatcaaacaggctccctttctggcttttcagccaatgaaagctttagactagtgactagtaaactagggccaggtgcccctttttttgttgatttgttttttgagacggagtctcgctctgtcgcccaggctggagtacagtggcatgatctcggctcgctgcaacctccgcctccatggttcaagagattctcctgcctcagcctcctgagtagctgggactacaggtgcgtgccaccacgcctggctaatttttgtatttttagtagagacggggtggagaaggggtttcaccaggttggccaggctggtctcaaactcctgacctcaggtgatccacccgcctcggcctcccaaagtgctgggattacaggcatgagccactgcacccagcccaagtgcccatttttgtgtggcccatgagctaagaatgatttttccatttttaaatggggaaaaaattaaaacagtattttgtgataggtaggaattacatgaaattccagtttcagcatccataaatagttttgttggaacagccatgctcacccatttacatgttttctgtggctggttttgtgctacaacagcagagtttaagtataatcctgctataacccttgttatttgctttcgaaattgcgcatttgttccaacccatttaatatatttgggaacagtttgatcataacgcagacttcatgtttgcttgtgtgtgatttcatcctcgagaaatagtaggtgaatatgggaaactgtatctagctgaaccaagcctaagtagtacacaaaactcacacctaaacatgtaccagctacctcactcatctccccacctgtgttgagcaacccttccgacgtccacttccaaaagcaaagtgcatgtcttcaagataaaaggccatatttattgtgatataatttctcaaccatttgacatatgtaaaaaccaagctatcctttttttttaaatgtgtcactcatttgagtgttgtgcttcaagccccatttttcccatgagacctgtggtctttattgtgcaattttgcatggcatagtgatttttaggaacgcataggtcacattataaagcagaactgactatatttgggtcagagaccatgtaccccacaaagcctaaatatccagccctttacagaaaaggctcaatgatccctgctttagaccattgacttccacctccttacctcatacagtgcagaaatagacttacccacacaccaatccaagaagccaaagccagttttatttcacaatcatctttattacagtaggatgatggtcctgggccaccagcctaaaccttgcagccttaggaaagacctgtgtcaacagg

SEQ ID NO: 17304 - DNA, 38575 bp, Human
  misc_feature (1)...(38575): n = A,T,C or G
gtttatacacataagaaaatttcagagaatgataagtattaggcttaaaataaaacagagtatttcaagtatgccttggagaagaggaacgcagaattggagtagtgagagtaggcctttctgaggactttaaacctgaatgatgaaaaggggacagccatgcaaagaggctaagcagagagcattccaggcagagaaaaaagcagtacaaatgttctcaggtgtgaatgaacttgataagtttgcagaagagaaaacagaccagtgtttttagagcagagtgaacaaaaagggggcaatacaagaagaggaggttggagaattagtagggtcaaagcatgagggttcctgtaggtcacattaagacatttggatacagtgtaaaaaatatatatatttttttcctttggtgtatctgtgttatcttctcagaaagaatataagcttcttgaggatattgatattgatgctcaatatatacacattgtcacagaacttgggttaaaactctgaagacttggattctaatcccagctccctgaactagctgcgtaacctttcgggttgtgtcatttctttgtttccttatatgatcattgaggagataggatagctcccttttagtgctaaaatttgatatctttatgaacattgaagaacattgtaagtgctatattaatgcaaaatatatattacaaacatagtaggattatggataaattatatgtattgtcctagaagttccagattatgccacagaaatagctgctttatgtcctgcatcctggcatccttctcctttcaaaccttccactatttagtatacttcattcaggttcattatcatcacctagtactgttctatcttatatctcatgtaatcatatcctcttgccacttctttaataaggctttcacctctcccaagctattttgtttattttttaaaaaattatttcatacaattcaaatagcttcacatgcaatcctgttttttcacacactccacatatatcttctaaagatatttattttgtgactttcagaaaaactgtcttctcagattactctcctagaggctcagaatagaactggggaggcagacagagaagtcagtgaggtaagtgatgtgttcttaatataaccagaacatgagctagattaagagaaggtagcttcatatgaaaatacgtccataattttctagtgttgccagagaagtacattacctatagagtaagatctattaaagagattcataatggttattatatctcatttattgttacttgtttctgaatattaaaattcattgttctaaagcaacacaaatacagtagctactaatttgggatttgataacacatttttttatactgggttatcatctatctcaacttctttgttcatctcagaaaagtttctcagtgaagagattagataagactggcatagttttactaagattaaataaaaagggatctttggagaatgatccttttaataatctgaaaattactataagaagggtatggttgcttagtatcattctgttgatttaagagtattgttagctgcgttttgtttagttagctgtgtttttctaatcagtaagtcagtgatagaattatacatgcccttgaggagtaatgtggcttcctaacaaaagtatctgcttactttttaaaaaaaatcaattaggagttttattctgaaggaaaaaaagcttcttatgtaaggaatatctagaaaatgaattcccaatttccttaggtcttatgaatagggcttgacttcagtgcaggattggcagagtgcccttggaggtccagctgggagatacaaactgattttaaaaggatttagcagtgttatggtacaaagaaggttttgaccaaaaagtctgaagttttagaagatgaaatacaagtttttagttgggctatttttttaatgttataaaacatttgattacagctttttttttcttttttaaaaatagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaaggtaatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtgttctaaaggatcaacttagacagatgtccatccatatggaagaattaaagattaacatttccaggtaaatgagtagtgaatttttcctcctccagaggtaacttcaagcaaagaaagtctctaaactatttctgtttccttttagacaatgggactaattttggcataaatgtccatggaagatatattctctctcacttctgacttttttttggcaaacaacaatcctgctacaactgcatgaacatgaaaagttcgcatcttctcttcccatctttctattgagagatttctgtacttctgttttgttttgtttaagatggagtcttgctcttgtcacccaggctggaatgcaatggcacgattttggctcactgcaacctctgcctcctgggttcaagcaattctcctgcctcagcctcccgagtagctgggattacaggagcctaccaacacgcccagctaattttttgtatttttagtagagagggggtttcaccatgttggccaggctggtctcgaactcctgacctcaggtgatccacccacctcggcctcccaaagtgctgggattacaggcatgagccattgcacctggcctctgtatttcttttcatttccatttcaactactcttgcctggatttttaccacagtactctcaaattaattgtctagtctcgtcttttcttcttcctttagtccacattaattcatactgcatatacctcttagagttattttttctcaaatttcaattttctgtcactttttaatctatagaactaataatgtctctcatcctttgtattccttacttccaataggacccttctgttctaaaacagattttctcactgtctttcatatcaagattatcccttagagaagccaaacgttagcttgtctggagcaaagtagaataaaataggagaaaatgttacttttcagtgttgaaaaccatgtcactaaaataagtgacatattttggagtttatgacttaaatatatgaacccttaagtatgatatacctttaatacatagcactcagtagataaacatgtaggtgcagagaattaatacctcttcagtaaaatatttaacacctgttatgaatgttaattcatttgtaaatctattgagtacatgttatagtatttgttccttgggaaacacagtttttttcttgaaatctgtaactaatgaccttctctctgtttcaggcttgaacatgacaagcagatttgggagtccaaggcccagacagaggtccagcttcagcagaaggtctgtgatactctacagggggaaaacaaagaacttttgtcccagctagaagagacacgccacctataccacagttctcagaatgaattagctaagttggaatcagaacttaagagtctcaaagaccagttgactgatttaagtaactctttagaaaaatgtaaggaacaaaaaggaaacttggaagggatcataaggcagcaagaggctgatattcaaaattctaagttcagttatgaacaactggagactgatcttcaggcctccagagaactgaccagtaggctgcatgaagaaataaatatgaaagagcaaaagattataagcctgctttctggcaaggaagaggcaatccaagtagctattgctgaactgcgtcagcaacatgataaagaaattaaagagctggaaaacctgctgtcccaggaggaagaggagaatattgttttagaagaggagaacaaaaaggctgttgataaaaccaatcagcttatggaaacactgaaaaccatcaaaaaggaaaacattcagcaaaaggcacagttggattcctttgttaaatccatgtcttctctccaaaatgatcgagaccgcatagtgggtgactatcaacagctggaagagcgacatctctctataatcttggaaaaagaccaactcatccaagaggctgctgcagagaataataagcttaaagaagaaatacgaggcttgagaagtcatatggatgatctcaattctgagaatgccaagctagatgcagaactgatccaatatagagaagacctgaaccaagtgataacaataaaggacagccaacaaaagcagcttcttgaagttcaacttcagcaaaataaggagctggaaaataaatatgctaaattagaagaaaagctgaaggaatctgaggaagcaaatgaggatctgcggaggtcctttaatgccctacaagaagagaaacaagatttatctaaagagattgagagtttgaaagtatctatatcccagctaacaagacaagtaacagccttgcaagaagaaggtactttaggactctatcatgcccagttaaaagtaaaagaagaagaggtacacaggttaagtgctttgttttcctcctctcaaaagagaattgcagaactggaagaagaattggtttgtgttcaaaaggaagctgccaagaaggtaggtgaaattgaagataaactgaagaaagaattaaagcatcttcatcatgatgcagggataatgagaaatgaaactgaaacagcagaagagagagtggcagagctagcaagagatttggtggagatggaacagaaattactcatggtcaccaaagaaaataaaggtctcacagcacaaattcagtcttttggaaggtctatgagttccttgcaaaatagtagagatcatgccaatgaggaacttgatgaactgaaaaggaaatatgatgccagtctgaaggaattggcacagttgaaagaacagggactcttaaacagagagagagatgctcttctttctgaaaccgccttttcaatgaactccactgaggagaatagcttgtctcaccttgagaaacttaaccaacagctcctatccaaagatgagcaattgcttcacttgtcctcacaactagaagattcttataaccaagtgcagtccttttccaaggctatggccagtctgcagaatgagagagatcacctgtggaatgagctggagaaatttcgaaagtcagaggaagggaagcagaggtctgcagctcagccttccaccagcccagctgaagtacagagtttaaaaaaagctatgtcttcactccaaaatgacagagacagactagtgagtagctagttctttctttctgatctgtttaagagtttttgaacctttctttaaatttatttttatagaaaaggataaacacattcttatacatattatctgggaacgcagggaaagtattatgtatcccacaggttctgtttggtcttagagaagcacagaaacatgatttaaattgctaaacctgccaataccattagaaaaaaaatcagaaatttccttggcacaaaactctccattggttataaaaggactaagaggtggagaactgttttatatattttatatacacaaagacatgtgtaaatgtttccagaatttgtcatagcttaactgaaagaaagtaaaaggatcacttagtgccttcttacagtgaagtataaggatcatttagtgtcttgtttacaatttagcaatagattatctggtagaatttggagcagaaaggactcagttcatctcatgggtaactcaaccctaatttgtcaaaaataaaaaaaagtgacgtaaaaagagttcctttaaataagttgaaatgactttttagtaaagttttatttgcaggctgaaccatttacccacttccttttaatacccaacatttccaatgggagaaaaagctaaagaggcttcctaatgctgacatttgacagcttttagtaggagtcaggagtttaatccaggtctcccaagattcaggggcaaaactggaactgtatgagccaagccaggttgtcaggattctactgctcctaggctcaagcagtcctcctgcctcagccgcccaagtagctgggattacaggcatgagccaccactcttggcttgttaggggattctacttggcaacattactgtcttcactttcatgatagtctgttaactctatcaaggctttgtatttgtaggaaaataggccaaataggaaataaatggagttttgaaaggctaggctttccattttgaaatgtgacccatacccagaatctgaaaattctaattttttttttttttttttaattgatcattcttgggtgtttctcacagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggccgaagattttttcttagtacagaacaaaatgaaaagtttcccatgtctacttctttctacacagacatggcaaccatccgatttctcaatcttttccccacctttcccccctttctattccacaaaaccgccattgtcatcatggcccgttctcaatgagctgctgggtacacctcccagacggggtggcggccgggcagaggtgcccctcacctcccggacggggtggctggccgggcggggggctgacccccccacctccctcccggacggggcggctggctgggcggggggctgacccccccacctccctcccggagggggtggctgccgggcggagacgctcctcacttcccagacggggtggttgccaggccaaggggctcctcacttctcagatggggcagttgccaggcggagggtctcctcacttctcagatggggcggctgggcagagatgctcctcacctcccagacggggtcgcggccgggcagaggcgctcctcacatcccagacggggcggcggagcagaggcgctctccacatctcagacgatgggcagccgggcagagacgctcctcacttcctagatgggatggcggccgggcagagacgctcctcactttccagactgggcagccaggcagaggggctcctcacgtcccagacgatgggcggccaggcagagacgctcctcacttcccagacggggtggcggcggggcagaggctgcactcttggcactttgggaggccaaggcaggcggctgggaggtggaggttgtagcaagccgagatcacaccactgcactccagcctgggcaccattgagcactgagtgaaccagactccgtctgcaatcccggcacctcgggaggccgaggttggcggatcactcgcggttaggagctggagaccagcccggccaacacagcgaaaccccgtctccatccaaaaaatacgaaaaccagtcaggcgtggcggcgcgcgcctgcaatcgcaggcactcggcaggctgaggcagaagaatcagggagggaggttgcagtgagccgagatggcagcagtacagtccagctttggctcggcatcagagggagaccgtggaaagagagggagagggagaccatggggagagagagagggagagggagagggagagcgaaaattctaatttttaagatgagctctagtgaaaagattattacccctaactgtagagtgagtttttcctttttattgtaggtaattgtattcattcctatctcacttaatatcccatatttatagacagtctttccccttttgtaatccgaacaaagcctctctgttcagttatggtttttacttccaacatacacatacttgtttatattttttaaataatttgagtttagctgactttgccctgggagcttggccttttgtctgtcttttcagaccgtaaatgcaaaaggttctattcatcaggatggtatgtgcctcaaagctgtaatttatgatatgctggtattgattatcttctaagtcaaaatcttttttcatggagctgttaggatagattctgaattagctaactatgtttaattcagtgaattgctttattattcttatctgttataaacactaggcactaaactttgcacatttttgtctgctggatagttacagccaagccaacttttttattttcgtgtttctgtaattcagagtcatattattctgttcccaaatgctcataactgtgattttattttaaccatcaagatgtatcactcctttattcacagtgtgcctcaagtatttttattttccatcttcaacatcctaagataagctctaacactttacccttaaactgttctaataatgttgcttccaggttatcatctcaccagtattttcagaccatcgccatataagtctttctgaaactctactgtattactgcactactcaaaaatatttaaaagttgtactatctctagaatagacttagtattcaaaccccctttagtctggcatttaagaccctgtttttttgtttgtttgttttttgagatggagtcttgctctctcacccaggctggagtgcagtggtgcaatcttggctcactgcaacctccgcctcccaggttcaagcaattctcctgcctcagcctcccaagtagctgggactacaccatgcctagctaatttttgtatttttagtagagatggggtttcaccatattggccaggctggtcttaaactcctggtctcaagtgatccacctgcctcggctcccaaagtgctggaattacaggcgtgagccaccacacctggccaagaccctgtaatttatccatacctttccagcgttcccttttactgctccctactcatacccttcattcacaccaaactgatctactcagtatgcaataatcacacctggtacttcctacttacccatattatcttcagcagccaaaatgttctcccaattgctttccttttttgagtgtctatttcccactatttaaaggtcattccagagctcagatcctcttcttacatttcgtgattgcctgattgtcttttgcctttgtacttccctagtattttacttatcatttgtcccatattgccttattgtgtgtgtgtgtgtgtatatgtttaatttctgtacactattttttatttccccaattagattgcaaactcctggtaagtgtcatgtcttatacttatttgtacatctttagcatagaactgactaagcagatgacatatctctaggggtgcctgtatttatctatactctcctcattctgaaaatgacttggggtagcatataaagatataaacaatttttcaagataaaataaaagggactgagaaggaggagaaaaagaggataggctagaaaaagatcaaaccaggagtaaggttagtgtcccaaggggaagtcaccatatcctgtactgtgttagaaagagggatccatagtttgctctgaggtttctattagccatcagaaagagggaatgaaaaccgcatgcatgaactgcagtatttatagtctaggagaaaaggagaaagaaaaatcacctactcaagacaagaatagtctttaagtattgaggcctgtaagaaatttcttctgtgttcccataaagagaacactgtgcagttgtgaaacatccattacttctctacagtaaatataataatgtgttttttagggtttttatttagctgtcccttaatgtaagtgcagagcaaaagaattacgtccagttcactaaaactaccactccaaggagctaaaatgcagtcccaggcacacagctttctgatggtccattctaggatacctctagtctagtatctagactagaggagtgagtggattgcataaaggaatatgtttttaccttaaatcaaaacaaaaatatgttttggggtttgggttaaaaataaagttatatgacccatatttaattagtcactaaattctacaatgtttggtgggaaaagctaagagtagcactacctcaaccccatttcttctgaggcaatttgctttcaacccttttagcttattctttcagtatttcctgtgtatgtaaatatcatgcttatattgcatttttggctctttgttgcatcaactattgattttctttacactaacagggtttagctctctgtactctccctgctttcacagtaaaccctgttagtgtatgcacttttttatttatttatttatttatttatttatttagaaacagagtctcgctctgttgccaggctggagtgcagtggcgccatctcagctcactgcaccctccacctcccgggttcaagcgattcttctgcctcagcctcccgagtagctgggactacaggtgcacgccaccttgcccggctaatttttgtatttttagtagagacagggtttcaccatgttggccagggtggtctcaatcttttgacctcgtgatccacctgcctcagcctcccaaagtgttgggattacaggcgtgagccactgcacccggccagtgtgtgcacattttaatacaaaccccttcctcattttcttgatgtaatttaattttaattttggttaaatcaattcagagttacattttttatgactacaaatgctactagagcgttagagacatgttacttttattttcctgagtctttctgtttttcccagattaataagtttttgttattgttgttccttagttttctttgtacttaatgtaatttaacctcagatttactgccatttgtccacatctcctttcaagatgtttattcccatcaatttcatcttcaggaagaaaattctcctggagtacctgatttgctcctatatcaaccagtggccctgtactcctaggataccctttctatcccagaatatttccctttacctttctcctatattagatctcctatttcatctattctatgtattccttttcttggttttgtgccatctttttcctggaataaatcattcagtagatccctaagaaatggtatgtggaaggtaaatttattgaaaatgtctttttatctctcttatctgattgatagttttgctggatatagaattctaggctgaaaataatttcccttcaaaattgtgaagacattggtttattgctttttagcttatatgtggttcacaagtctaaagctattctgattcctgatcctttgtatgtgatctgtttctcacttcccttcccctcaccccaccttccctccctttctcccctattctgaaattttttgatagtataatttggtataggtctttttttcttcatcatgctaactagtcctttgaatctaagaaatcatactagcagctttttggaaatttcattaaattattttttaccattttcctctatcctttttctctgttgtcttatttctgaaatgtttgttatttagatgtaggaccttcttgattgcttctctaattttcttaacttttccctttttttttttttttgctgtaattctggaagattttcttgccttcgtcttttgattccaacatttttttcatttttgccattatattcttaatttctaaggattttttttctgtgtctcatagacagatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttcatttcctttgtgggggaaaggccttttaccagcactcttcaagctcagtaggggaaagacttcaagcactcaggaagcatgcattcactttatttggaacaatacccttacttgtaactgtgcctcaggtgccatagtccacagagacttcttttacctgtccagagaataaaattagttgtctgttggggtaacaaaaagtgtggagctgaagagggtacctataaatgaagttgttttctggccgggcgcagtggctcacgcctgtaatcccagcacttcgggaggccaaggtggagggatcacttgagtccaggagtttgagaccagcctgggcaacatactgagactccgtctctccaaaaaaaaaaaaaaaaaaaaaaaaaaaaattaaaagaaattgcttcttaagcagctttcatctagacctccttatctcagctatcacctccctcccacccccatcaccatcttttccagaggtgcctgatgctgttaattcctgagccttttgaagattctgcagagtaagttccactgattcttggattttcttactaccagctttagattctgctttctcagatctgttaagtcagttaccacttactcatctgcttttcagcttccaaaattaattttattgctgctgattcctctattgtttttcctgttcttgtgttttgtgctttaaaaaatgctattattttagctttagcgatgtctctaagtgggtgaaagaggtatgtgaacaagacccccatctttgcccagatgtcctgatattatttctcccttactaagcttttaatgagtattggagataaagaagttgaaaatatatctgaaatgtaggtaggcagtgttgttaattaaaggcaagtctgtcatcatcactaactttatgtgtgaagtgcattaatttgctcatttacttctcatattcttatgaaaaaggtactataattatcttcatttaatagatgaggaaaattagcctgggcaacagagcaagactccctctcaaaaaaaaaagaagagtatgaggaacatgcattgggtcacacgtccaagaagtagtaggatatctaactccagagcctaagtgtccttaaccactgagcagcactgccttctttataatcagtatccgctaagctacagttaagattgatagccctgtaggaaagttaagaaccctaacaaggacacatgactagttcttgttttaggatgtgaccacccacagtgaagctctaggtctcttaagtctaccccacgtcagaattgtagccctaaagtgaacttaggaccttaggagccaggggaaggagtagaagttgcaggaatagtcacaccctgtagccttgatggcagctccatgggtgatttccaccagcctagctgcatgtatttcactactttagagacttatgttgcagtgatatgtcatcagtggactgttaggtgctggtttcatgttgtggtgtctgactacttagtagggagctaccaatgacttacagttagatgaatgagatgtgacaaataatcattttactttccctttggttaaagctgaaggaattgaagaatctgcagcagcaatacttacagattaatcaagagatcactgagttacatccactgaaggctcaacttcaggagtatcaagataagacaaaagcatttcagattatgcaagaagagctcaggcaggaaaacctctcctggcagcatgagctgcatcagctcaggtactatatataatccctccttttcaactcttttcattttaactttttattttgaaataattgtagatttgggaaaatagtgcagagagcttctatgtacccttcacccagtttcttccagtggtgacatcttacataactgtagcacagtatcaaaaccaggaaactgccattggtacaattcgcggaccacattcagattccaccagttttacatgcactgatttgactatctgtgtgtgtggttctatgcaattttgtgacatgtatatttaagcaccaccaaaaccaaaatacagagctactccatcaccacaaatacgtcctttgtgctactagtttatagtcacattcctcccttccctaccttcctcacatccttaacccctagcaaccactaatctgtgttcaattttgtcattttgagaatgttttctaactggaatcttgcagtatataaccctttgaaattggcttttttcatgtgccataatgcccttgagatccatcagttttgttgtatgtatcaatagttcattcttttcagtataaataatgtttcatattatgaatataccactgtattcacctgttgaaggacatgcatattgtttttaatttttagctattctaataatactactatgaacatttgtgtataagtttttgtgtggacctaagttttcatttctttgggataattgcccaggagtgcaaatgctagctcatacaataagtgaatgttttgttttttaagaaactgcaaaaccactttgcataatggctgaacatctttttaatgtgtgtatttgacatccatatatcctctttgatgaaatatctgttcatgtcttttgtccgttttctaattgggttaattttttactgttaagttttaagcgttctttatatattataggtatgcattctgtgtttgatttgcggtttgcaaatattttttcccaatttgcagtttatcttttcatctccctcaacagggtctttttaattttgatgaaatccaatttattattttctctttatcattcagatttggtattttctatttgattttcaagttctctgcttcctacctccattctgctatggcacccagtgagttagctttttattttggatattgtatttttcagttctaaaatttccattcagttcttctttatatcttctatttctttgctgaagctttctatactttttccagtatgttagtaatcgcttgtttaagcatttctatgacagctgctgtaaaatccttgtcatataattctaatatttgtgtcacctcagtgttataaactgttgatttccttttcttaatcaagttgtggttttcctggttcttggtatgatgagtgatttttagttacattctggacattttggagattataagactttcagtcttatttgaatcttctgtgttagcaggcttcactgacaccacaccggcaggggaaggaagacactaggtggatggtgaactccaggcaccccattcaactttcgttgatacccctaaaaggaagggatgccctgatactgccaggaggaagtggaagtccatgctccccacatggcctccattgatactgtgctggaaggagtggagaggggcacctcattattgccaggtggtggtaaaagtccaggctatccacttagcctccactgacactatggggaatggttaagaggggcatcttgttaccactgggtagtactcaaagtccagaatccccacttgatctcttctgataccacctctgcagggacaaggaagagtgccttattaaccttgttatggtggagggggatgtccaggccccacatgttgcctccactgataccacagtgggagtgggggaggaggggcagtcggagagaggcaccttcttagcactaggtgattgtaagagtccaagctccatacctggccttttctgacactactccagtaaggagggtgaggtgtaccttgttaccaccagccaagaatgtacctagcttatctaccaggtctttgttaatgggagtggtgagatactgtgttttttccatgttgtttgcctggagtatggtggttattatcattaatggctctgtctagctagactgtcccttcctggtcctttggcaagactgagtaaacttggtactcattggtgtttccgggtcatggaattctccagtatccggtttgggatatgcagaatacaaatggtaaaccaaagaacttgccaccatgtcattcctcaagtctggggatccctagctggtttgccaccatctttctaaattttcttatgtttgtttttatttataaggcccaagagttttatctatgcaggttaagtattccttatctgaaatgcttgggattggaagtgttttggattgcggatttttttggattttggaatatttgcattatctaatgagcatttcctttgagtgtcatgtcagtgctcaaaaagttttggattttgaagtatttctgattttctgattagggatgctcagccttagttggaagaataaggagaaatgtgtctattttattttgtctagaaccagaaatcctagctcttttctttttaaggaacagaacaataataatgctatcatggcagaagaaattaagataggagctataattctgattttttttttaattcagtttttctgacaaatttaatcccaagattaaacacttagtgtataaaaacaggtctagttgttgcagcctcatttttgggaggttgttactgtttaacttaagatggttcatgctgccttaataaattcatacttggctgggtgcggtggctcacacctgtaatcctagcactttgggaggccaaggcaggtagatcatgtgaggtcaggagtttgagaccagcctggccatctctaccaaaaatacaaaaattagctgggcatggtggcgtgcgcctgtaatcccagctgcttgggagactgaggcaggagaattgcttgaacccgggaggtggaggttgcagtgagccaacatcatgccactgcactctaacctgggcaacagagtgagaccctgtttcaaaaaaaaaaaaaattcaaaaagctttcaagatttgatattaaaaggagaattaccatgttggacattgctgctgatcaagcagcacctgctttgtttcaccaatgctagaggacaagaggcaaatgaatacagaaaatatgagttggaatctcaatttctatccagcttacaaggggccattagaatgacaactgtcaatatagtataaatatcataacatctctaagagagttcttaatgttcagacacaggagatttcaaaccttaagcaacattgatatagcaaaatgctttttggaatttaatgatttaaactttatggagtaaaattacatctaaaagattttcatatttaacatctttatggacttgattataagtgaacatttatcaagctcattgcatggagttggcagcttccccagataatacaagaacaaattttttgtttaaacaaatgatgatgattgcagagcaagtaaaaagaaaatggcaaaacaactgagttttgctctctagaaatataaatttgtttcttcttttgaaattgaatctcaagagaaaagataaattgctccattttaacctccatttttcttcagggaatagcaccccagctttattctgttagaatcttaatttatcatcagaagtttaggtgcttgctgtgtccttcagatgcacttgaatttagggccctccaaaggtgattggtaccgtatcagagcatcgcttgatgcctctcatcttatctccacatcacctagaactacagaaatattaaagtgttcagctactagtgtaaacctaagaagagctgcaaagctctaaaggcttatttcctgcagcctttcttctttaaatttcctctaatggcaatctaaaaggatatttattttccttatttccttatataattgacccttagggaagagaaaaggagatagagaaaaaaagattcctgttttttcccccacattttctctctttccacctttttcttagcctttctttctttaccttccagatttgagtaactttgaagataagcaaagtgctgaggttacaggtgcgagctaccatgcccagttacaagtatatttttacctgtgattgtgtcatgttttttctaggatggagaagagttcctgggaaatacatgagaggagaatgaaggaacagtaccttatggctatctcagataaagatcagcagctcagtcatctgcagaatcttataagggaattgaggtcttcttcctcccagactcagcctctcaaagtgcaataccaaagacaggtgagtaatttcaatgctgattgttactcagagataaatttttaaacaaatgatgatgattgcagggttttgttttttttttaagacgctacccagaaagcatcagcttcctacaaattaagtgcccatctgccactattaagtgcccataagccaccttatgacttctatggggcggacaggatttctagagggaaggaattaagcatgcgcaatcttaggagagaatctgatcaatgtttgtgtcctggcaggcatccccagagacatcagcttccccagatgggtcacaaaatctggtttatgagacagaacttctcaggacccagctcaatgacagcttaaaggaaattcaccaaaaggagttaagaattcagcaactgaacagcaacgtaagtgtttcttgttagactggaattcagtttcttttttccatgactggaacaagaaggcaagtagaagccaattcagcatagagtcccagctgtagcatatcttagggtacagaagtttcacctttctcagaacctgggtgcttattccaaagcactggacacagggccatttcttgtcctttgcccttggtgagtccttgggaatgattggataaatccagacagtaaaagtaaagaagccaactactttaggaagccttccccctgacctgtatcacttgtagtaatgctgaggctactccctaccccaccctcttaagaattgtcctcctgttgttcactgactattcaaaatattctttagtggcacctgccctagttctgccctcttgagaggaactcagctaagtagtctatgatagaactacaagatatttagagatcaatcagaatcagaagtccagagattagctttgaggagagccaagaatgcccaaaaattgtatgcacaatagtgtgtgtgtgcgtaagcttttcatcacaagaactcatcagttgaccaaggggtctgtgatccaaaaattaaaaagatcactaggctgttttcacagatgaggaaaaaggccctggagtagtaagtaacttgcctgaggtgttaggacgaagtcagtctgaaataaacgtgatcatgcatgtggaaaagcacagtgcctgcatatgtagagggtacttattaaatgtagttaaattcaactaattgacactgaagtatcagagaggagacatttgcagtttttaaagtctgcaggcccaaatgaattagttaaactgtagactctttattggtagatttgtctgggagttttcaaagggactccagagcagctcccatggagttccccttccagcaaatcagctatttccggaagttccaccctttacagctctagcctgtctcttttttccgtcaactaactcccgtctcaggcctgttacatttgctctccaaacattagactctgaatcacattgggcatttgtctgtctaggacagtgttttaaactgaaattcaggaccattaataaatgatgaaatcattttggtgggcaacaactaaaaaaaatttttaatgttttattgaagtaaaacatacagaaaagtaaacaaatcataagtacagcatgatatattttcacaaagtgaagatacccatataatcagcacccagatctagaatcagaacataccagaactccagaagtcccttgtgtcttctgttcactcctacccacttagaactacatataaatggagtcataccttttcttttatattgcttcatttattttgtgagattcatccatgtcgttgcatatagtgtcatttttccactctcatgctgtgtagtattgcattttaggcatataccacaatctctattctgttgaaggacatttgggcttctccagtttggggctattacaaatagtgcagttggtgtttttacaaaaaaaagaaatgaggtaaaaacacgtatgtaatatataataaagaatatgtctgtctttggaaaactttagttttaattgtatatatttatatactgggttctaagtcataaagttgtgttttttaacacctttattgagatatgtaattccacttaaagtgtgagaaacactgcataggtcactgtcattctgagtgagaaacagtttttcctttagaactcaactgtaagaaaggcacctcaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaattagccgggcgcggtggcgggcgcctgtagtcccagctactcgggaggctgaggcaggagaatagcgtgaacccgggaagcggagcttgcagtgagccgagattgcgccactgcagtccgcagtccggcctgggcgacagagcgagactccgtctcaaaaaaaaaaaaaaaaaaaaagaaaggcacctcattcctagccttattcagtcattaaaacaataactattatttgtcttccatgagcctggctatatgctagatactgaggatatacatattccttcatgagcttagcctcactctgaatgagtcccagctaaataggagaattgcttcttgggccccagaatgagattgtagtagatgggctgtcagcatagattgttcttctctaagccacttccctaattctttcttcagatgttcaggttttatatttatagttggcccttcatattggtaatttctgcattcacagatttaactaactgtagattgaaaatattcaggaaaacatgaattttaaaaatacagtataacaactatttatatagcatttgtattgtattaggtattataagtaatctagagattatttaaagtatatgggaggccacaggtaacattgtactgaacagggaaaaattgaaggcctttcctctaagatctgaaataagacaaggatgcctactttcaccactgttattcaatatattattagataccctagctagagcaattaggcaaaaacaaaacaaaaaaaaaagcacatccagattggaaaggaagaggtcaaattagccttttttgcagatgatatgaccttatacttagaaaaacctaaagaatccaccaaaaaactgttagaactgataaatgaattcagtaaagttgcaggagacaaaatcaacaggcaaaaatcagtagcatttatatatgccaacagcaaacaatctggaaaagaaatcaagaaagcaatcccagtcagccatggtggctcatgcctgtaatccttgcactttgggaggccaaggtgagtggatcacttgaggccaggagtttgagaccagtcttgccaacatggcgaaatcccttctctactaaaaatacaaaaattagccagccatggtggtgcacgcctgtaatcccagctactcgggtggctgaggcatgtgaatcacttgaacttgggaggcggaggttgcagtgagctgagatcgcacccctgcactccagcctaggtgacagagcgagactgtgtttcaaaaatagatagatagatagatagatagatagatagatagatagatagatagcaatcccatttataatagctacaaagaatttaaaatacttaggaatcaatttaaccaaagaaatgaaagatttataaaacactgtgaaagaaattgaagaggacactaaaaaaaggaaagatatttcgtgctcatggattagaagaattaatatcattaaaatgacagtactacacaaagcaatctacagattaaatgcaatccctatcaaaataccaatgacattcttcacaaaaatgggaaaaaaaatttaatatgtatgtaaccacaaaaactcctaactagccaaagcaatcttgattaaaaagaggaaaactgggtcgagtgtggtggcttacgcctgtaatcccagcactttgggaagccaagatgagtggatcacctgaggtcaggagttcgagaccatcctggccaacatggtgaaaccccgtctctactaaaaatacaaaaattagctgggcgtgatggcgggggcctgtaatcccagctacttgggagactgaggcagagaattgcttgaacccgggaggtggaagttacagtgagccgagatcgcgccactgcactccagcctgggtgacagagcgagactctgtctcaaaaaaaaaaaaaaccaaaaaacaaaaaaacacacaaaacaaagctggaagcatcacactacctgtttaatgagcatgatactggcataaaaacagacacatagaccaccaatgaaacaattagaaacccaggtataaagccaggcatttaggggcaacttgtctttgacaaaggcaccaagaacatatgatggagaaaggacaatctctctaataaatggtgctgggaaaactggatatctatatgcagaaaaataaaactagactcctatctctcatcatacaaaaatcaaatcaaaatggattaaagacttaattctaagatctgaaactatgaaactactagagcaaaacttgtggaaatgcttcaggacatggatctagccaaggctttttttgtgtaagtcctgaagagtacaggcaaccaaggcaaaaatagacaaatgggattacagcaagtaaaaggcttctgttcagcaaaggaagcaatcaacagagtgaagagacaatccacagaatgagagaaaacatttgcaaactacccatctaacaagggattaataaccagaatatataagggactcaaacaattaaatagcaggaaaacaaataactcaacttaaaagtgggcaaaagatctgaatagacgtttctcaaaagaagacatacaaatggccaacagatataaaaaaaaatactcagcatccctaaacatcagagaattgtaaatcaaagctatagtgagatgtcatctcacctttgctgaaatagcttttatcaaaaagacaggtagtaacagattctggcaaggatgcagagaaagggggaactcccatacactgttagcaatgtaagttagtacagccactgtggagaacagtatggaggtatctcaaaaagctaaaaatagaactaccatatgatccagcaacccacgtatctacaagaaagaaaatcaatatatcaaaaagacatctgtactcccatgtttattggagcactgttcataaaaaacaaaacatagaatcaatgtaagtacccgtcaacagatgaatagattaagaatgtggtatatgtacacaagggaatattattcagcttttagaggtatgaaattctgtcatttgtggcaacatagatggaactggaggacattatgttaagtgaaataagccaagaacagaaagacaaatatcacattctcactcgtgtgggagcaaaaaaaaaaaagtgaatctcatgaagatagagagtgcattggtagttactaaaggctgggaaggataaaggagaggagggaatgaagagaagttgattaatgggtgcaaatacatggtttgatagaagaaataagacctagtgttaggtaaatcaataggtgattatagtttaccacaatctattgtatatttcaaaatagctagaagagaagaatttaaatgcttctagcgtaaaggaaagacaaatacttaaggtgatggatattccagatacactgatttgatctttacaaattatatgaatatattacattatagcatgtatcctgaaactatgtatatctattatacatgaattaaaaaattttttaagtatctgggaggttgtgtataagttatatgcaaataccctgccattatatataaggaatttgagcgtcctcgaattttggtatactgggagttgggggtccaggggtggttctgaaaccaataccccatagataacaagggatgactgcatttctaccagctgtttggatgttagtatgtaatgtaagaatgtgctagaaacttaaaaacatgagatggatgattagtgacataatgtagtctaaattgttccctcctattttgtttttacaggtatagatacagtgaaatatagtagcttataagctagaggagaggtcagcaaacttttccttcaggctcagacaatattttaggtttgttgactgtatggtctttgttaacaactactctctttgcagttgtaacacaaacgcagccatagacaatatagaatcaattgggcggttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaacttcctcttaggttaagggaagaacatgttgtgccctgtctcagaatccaatagttgtcattgtacccagttaactgtcttcaaattagtatcacttcccaaatatttatatcctttcctaactattcccacctcctcccacaccccccccccccaaaagaaaaccctatgattttcttagctttccttgctagactatcagactggacaccatcagatagtagatagagctctagacttggaatcaagaaccacacttgagtcctggtttgacatctactagccatttgtaaacaaggacagaaatcctttctctacctctctcaaataagatgatactggtgaaagtactttgtaagctaacattgctcttcagaatgacaaacacaaaaaacaaccctacatctgaagagcaattttcagctaacagagcacttttacaagtatgtatggattatcttgttctaattttctatttgcatcaaatgcccttcctcacagttgtctctagaaaactgtcgtctctcctctaaaacattgtttgtttcaactttttttcacaaaaacttacaaaaaagaatcatcaagaaaaaattgaacatgcaactggtatactgggttcctctcatataatgtacatggtcctagagtagataacttggagagacatctccatggttattaatgtacctggaggctaatcacagctaaaacttaaaacttgacagcctgcaagtgagagaattatagttccagagtaccaaattcaaatcaatgggtagaagctacaataggtaaatttttcattcaatataaaaatgaattttcagttttttaaatggtttgggttgctttgtcaggcagtgggcgccctgacactgaacatgttcaagggaagactgaacgatgacctgttagtcatgcagtagaggagagtcctgctttaagggactgaaatgtttctacctgggagaatctatgctctcaacagtttctgacatatacatatacatgttgggatttattctgtttctcccttctaccacatattataattttttattctattctctcagtaacttataactctttatggcattgaggaatctgcctaggaatattattgcacagattttggggtgacagctctctccagccatattgagttctggagattatagtcatttgttagtaccatgaactttgaccctgaggtactgccttctccctcttatgtacccagaatagcctatgtaattagattgcttatggacttctgcttcatggtttttcagttaatgtactgggcaccatttaaaaaaacaaaacagaacaaaacaaaaaaacctttctgctactcctccagaattgttttctgtcttggtcaaaaaaaattatgctttttccaactttgaaggcacacaaagtgctattgttgctgttgctgaaacaaaggtcttccataggaaaattagatcctgaaaactcagaacatttcacctcagcactgcttacagtactgcaggatgatgcttatcctcgcctctgtttcagttctctcagctactggaagagaaaaacaccctttccattcagctctgcgataccagtcagagtcttcgtgagaaccagcagcactatggtgaccttttaaatcactgtgcagtcttggagaagcaggttcaagagctgcaggcggtgagtaaagagaaggtgagagactgggagaagtgtgatgaaatttagtgcaagtggtgaagcactacagagcagtatggaagaagttaatgtaattaggggtcagggaagaaagtgggagagaagaaagagttaattgagatgggaataaggtctgagaaaaattacagtgaagcaattagaagaaaaaagatcagtgagatggtgggagagaaatcaaaacatgagtaggaaacagtgatgactgagacatttggtactctgaaacagagaaagtgttgattttgctttaagttataagaaaattgtaggaaactttggatctgagaacaaaacaggcagcactgttgacagccagggagaggagtacagcattgaagttggaggagactgagaattagtatggagacgtataggatacggaggaggaaaagggggttgggaggggctggacaagcaagggaaggatcaaagtggcttctggaaaagccataagcatccacagcagacttaactttttttttttttttttttttgatacggagtctcgctctgtcgcccaggctggaatgcagtagcacgatctcggctcactgcaacctccacctcctgggttcaagcaattctctgcctcagcctcccgagttgctgggattacaggcgcctgccaccacacccggctaattttttgtatttttagtggagacagggtttcaccatcttggccaggctggtcttgaactcctgatcttgtgatccacccacctcggcctcccaaagtgctgggattacaggcttgagccacggcgcccggcccagacttaacttttaagaggagaaattcaagaatgagaatctgggagaaaaatctaatcaagacaagagttttatgtaggtgagtaatctgctagagcagaagcttctcacttctaaatttggacttgagaattataagcggggatagtcctctgtaaacgagctctcattttgctcaaatacactttcttaagagctttcatcactgaattactaagcttattcttcttccaggggccactaaatatagatgttgctccaggagctccccaggaaaagaatggagttcacagaaagagtgaccctgaggaactaagggaaccgcagcaaaggtaggggagtggctctctaaaccctggagcatacaccagagtccagaaattgggcagtaatctagatttaactggagtcctttatatggatttaatatgtcttgttatcttattagcctcacagaagtgatgtgaggatcaaatagtaacaataataactaacatttgtgtgtgaaaagtttgtaaaacaaaaagagcaacaccaacacacacacaccactaacaactactctatgatagtaaaatgaaagataatcagttcctgaaatttctttaggtattttctgcagcttcatttaatccctctacagctttgcttttaaaatattgtgtttagacaagcttctatggattttcttgctttacaaccttatgaagactttgaatcccttgtattagcaactgttttctgcatctgatgatgctttttgttttcctctcatcctaaagcttttctgaagctcagcagcagctatgcaacaccagacaggaagtgaatgaattaaggaagctgctggaagaagaacgagaccaaagagtggctgctgagaatgctctctctgtggccgaggagcagatcagacggtaaaggctgaaggagatagcctctgttcccttccgatcctttctgatcaaactcatgtacatttcctgccagacttaggatttcttaagatctttttctcatcttgaggtagttgctgcaatgagtttaccaacattgtggtcacccaagagaacactgtacttttggagtataagagagtcagtgttttctaaaacagttgttcttagagaataataatgatatctaccattactgaaagatattttatttcaccctaaccataactatatgaggtaggtgttgggttctctagaggaccaaataagtgacaacctcattttctacctgagatctgaatccatggaaatcttttttaaaagattaaaagattgagagattaaaagactgctttataaatgatgttaaaagaatgtagctttttatttgttggcaaatgcacttcctaaccctgaacttcccctcccagtcacagacaatgttgggccaaggtagacctccttcacagaaaatcctgctcttgccaaacaagagtattggaataacagagtgaactgtgcttcctatgagcagtttgctccaagtgtaatttggaagggcagagctacacatccctagttccttattctcatcaaaagaatcactatgcatgagaggatagagagttgctacaagtattttgctgctggaagtccctttccacggaaaatatcgttaaaagcaggcacttttattatattttgggagaaagccacctatgtatatgatcactttcctcagagaatgacatttctgatattaatgctttcttgtaaagtttatgtggcagaggtgacagccccattgagcaggtcttacttgagatacctttctttccaatccaacatattcacaacttcttaattttcatcacctattcaggccttgatatgcagctttgagggtgggccagctttgcttaatgccttgtgtggtgtcttgccatctctgccgagcattttcaggcctgtgccctcatgactgtttctcttctacttgctattgaattgtttagaccggtgaaacctggccaatggggaggttgatctccctcttgtgtaactaacctgtcccaaaccaactgagactgcatgtgtgggatgatgactcttgagcctgtgggcaagccgtattaattcaagccacaattccctctttagctctgatgcagaatggaagttggggtagctaattaagggctgcctgcctagtccaggtactgccattgtaatgttagaatctcacatgtactctaaagagcaggtggaactcagtggccctccagtttaaaggcagccagtaccatcttcctcatcaatacctacagacttctcatccttcctcagcatagcctacattgacagactgacctccatagtaacagaccatgctgttccagatcaaagctgcttctgaaaagcttatcacatggaggaatagacacagaaggtgtattttttagtcagcctggctctcaggagggaagcaggaaagaaggagctaggctgtgcatgctcagttctctttctagactcacaaattggattaaggtgtttcttctctcccggggaaaagaatgtgtcctgcagagagcccaagaatattaaactaatagatatcctttcagaaggagaaaacacaaagagtagaggcaagagtttcatcctctcttccctattgaaaaagttcatccctataggcaaatgcttgatcaaacgtgctgtgttacatgcagctcctttgtttgtttgacataaccattgagtgagtaatggcagcttcttcattaaatggagaagttccagtattaaataagcaaatcagcaaaaactgagccagaaggcagtggagactgccaattcaatttaattttttttagttcaatttaatttttaaaaccccacagaaatcttctttggatgcttttgcctattagcctttaataaaagaaaaaaatgtaatgagtttctccaagtcaggtgtggtgtggtggaaaaaagaacgtgaggcttgaaagacaaagttgggtattgaattctggctctgccgcttactggctgtgccgccatgggcaagtaatttaacctctgtaagccttagcactttgaagataataagaccaacctcagaacctgaggattaaatgtatgtaaagcacccagcctagagcctgatacatagtgagtaggcagtcaattcctgatagttattgtcacattttgctgctgctgaaggaaacgtatctgctggtaccccccttgcatgggtttgggtttatgggagcagcttttgctgcaagtctcctcctgtgctgcattgtgtggcaggatgactgggaagactgggcctgatcagcctctcatgctatgaaccaatgctatgcctcttttttttctcaactcaggttagagcacagtgaatgggactcttcccggactcctatcattggctcctgtggcactcaggagcaggcactgttaatagatcttacaagcaacagttgtcgaagggtaagaggaagaaggataaagagagggtgttttattatctgacagggctggctatactgggggcaaggagctgaggagaaggaatgtggaagtccagccactgagcagcgaatgagtctaaggctggaagggcgtggaagattagaacctggtggaatttgccaagttgttgactctgaggcaactttcctctcagaatacccctttctacagtggttgggtcagctttgcttaagtgcaagactagtaggagggaaagcaacatagccctatagggtgaaaactctctgactttcacatttttctttcagacccggagtggcgttggatggaagcgagtcctgcgttcactctgtcattcacggacccgagtgccacttctagcagccatctactttctaatgattcatgtcctgctcattctgtgttttacgggccatctatagacttagttgttactctttggaccactcccctcaaaacttggaattctctcacctctaacatcagaacatcaattccagtggaacagtcttcccatttacaggtcttctctccaactcttcacggaaagtgcctgcaaaaacagaggtggatacgaggacaggttggagctgcagggactggcgagtctgctttcttctactgccctgagcctgaacgcttctgcttaatctgagaatcacatttggtttgttgagcctaatatttgttgagattttgcaggaccctgatcttttgtggtcctgtaaaagatactgaggaatgtctttcagccaagccaagaggatggtttcaataaacctaataatctgaagttcagtatcattttgattgataactttctttgccttgtttgcctgtattttctcctgtttcagggggaaggtggctctgccataaacagagttcagggaaatgaacatgtcacctcataggacatctgatttaggtctcttgcagaatagggtggtgaaagctgaaggaactccctaggggttttagctgttagatcacatgggaggacagcatcttcttccctgccaatttcagatataattggagggagaatttcaggtcttagactataaggatagaatccctttgcttttgcccttgatcacatgtatactaaggtattaagtggcccaagtctttcctttcaccaaagggcagggagaagtgtctatggacagcagggttccaattcttgtcattccaggaatatctgaatattcctggaatgtggaccctgagacagtgctcaggggccactgggagccaatattaggcattgactctcagccaggagtctgactggtctaacaccacactgcaactcctgacctcttgaagtactaagctactttgctgttagtgacagttattacagtttctcagccccattgtctctgccctctgtggcaatggaaggagaatatagagaagacaaaattaaatatagatagacctgagaaggacagccaggatagaattccatttgtgcctattccctgcctcccctcccctcccccatcctaccagttggttattttctcattgcatacgtgatgtgttcactgcctagcctctccctaaagaagagagaagacaagtgggctgactgatctgctctaaatctactgtggtgattaaatcttggttacaacatcctgggaagtttcctgaacaactgtaaaataataaaattattttcagaatgaagagtttgtgtgtatgtgtgtgtacgtgtgagtgaatggatatatgcacaggtgtttcggtacctgtgtttgcatgctggggggtggaaggtgggtaagggaagtagggaaaggaggtagccaggaatggttataggggtagaaagctctacatattcaggctttcttctcactggccaatatcagtgacagctgcatgcatttttccagccttagctgctagaccccaggtgatgaatgcagtgaggaaattctatcctaatactgaaccaaataagctgggccttagggcatgaaattgatgcaggtccatgcatggtcctgggagaactcttgtctggcacatagtgaaaacattaggcccctagggatccctctgggtgggaatgggagaagagaagcttaatagcatgtagcaggttagataggcattattatgttttgttttgttttgttgggttttttttgagaccgagtttcactctttcgctcaggctggagtgcagtggcacaatctcaactcactgcaccttccgccttccagtttcaagcgattctcctgcctcagtctcccaaatagctgggattacaggcacctgccaccatgcccggctaatctttgcacttttagtagagatggagtttcactgtgttggccagtctggtctcaaactcctgaccttgtgatccacccgcctcagcctcccaaagtgctgggattagaggtgtgagccaccgtgcccagctattatggatttttatattaagttgctgcttgagagaagatagctcactttctcaaagtacaataagtggtttaattgaaccaagtctgtctggcttcaaggcccattctttttctgtgtgatacacctcactacctcatcagtaatgaacttgtgacatttgctaaggaaagatgggacttcttggtgtcatctctgattaatttctatattttctctagagaactatgtacctggatggtgtgtcacatcatctagtctaaatcgtattttgacactacatgaggattccaagtgatttttctcttgtacaaacgtactcttccttatcataactttggtaccaccatgataaataggtaa

SEQ ID NO: 17305 - DNA, 451925 bp, Human
ttggatggctttgaaggttcattgtgacctcaaatacttgttgagtgcttactctgtgacagccactctaaatgttttgtacatgctaacatttattctttattgcaattctatgcagtaacctcccttgtcattcttctttcagagatgaggcagctcagactgaggttttaagcaactgcccaaaattatacagatagcaattggcaaatccagaatgttaaacccggtctagctccaaataaatgttatatataagggtagagagtaaagaagaataccactgttcttctccacatacacagaaggaatctaggttagttctttacacccattagacacatataattattatccttttgcttaacataagtcaccaaagacttcaaatatattgagtgccatttcacaagttgattgttttagtaagtacacccttaaattggttaaaatccagaataagagaaatatttcaaatgaatatggtatcaaataatattttttatcttgttcctgaatgtaaatttgcctcacccctctagtctattctgagtcctaattcctcatagttagaggaattgttacaacattacgacttcttactaatttataataggtagtttgctaatagtatagtcacctgacattcatgtgtcaaaatatctttgatgaggtatgaattgctagatgtggaatagcttattcaagaaagtttaatttatgaatgactgtacggggagtacatggtgtgaaatttgaaaggaagaaagataaatgttctgcgtttttaaagtacttgtttcctaaggacagaggttggaggggattaggaatcagatgctccaccttttatttcattattcaaaccaacaatgattcttttggaggcaaaggcctcagttgggtcactcccagctaacgagagagcaatgatattagagagaaggaaggttgtgacaagagtgagggaactggaatgagacagagctggtggaaggtcacaaattgaagggacatattttaaaattatactctatggccaaaattatatactagttttattcattgattaaaggagttgcattgttttggagaggcatccttcataaatgtcaagtgtcttcttaaaagggacttagaataaagcaactagcaaaatgctaactctcttttctcgcaagtaagatgctgaaatttgcaaataatttgggcttttaacacaataaatgcacggtggctcactcctgtaaatcccaacaatttgggaggccaaggcaggcagatggcttgagcccaggagtttgagactagcctgggcaatatagtgaaaccccgactatacaaaaaatacaaaaattagctggaaatgatggcacacgcctgtagtctcaactactggggaggctgaggtgagaggatcacctgagcccaaggaggtcaaggctgcagtgggctgtgatcgctcctctgcactccagcctgggcaagtgagtgactgtcttaaaaaagaaaaaaaattgtttaaaagaattttgatttctgaatggagacggaatttaacacatttttttcaatgcttaattttatagtatatatcaatgaagaggattgattattctggaactgtttacaaattttgggggggataaatttcagtacttaagtcaagacctctctatacctaggccctaaaataagtaataactaaagaaaaaaagtccaaatcatatttgtatcatgttaaattttggcagcaatactaaggcaattttaccagtatggctgtggctaaaagagaatatcccaaagttcataaagtaagcacacaccccatgtacttaaatctctccctctctctctctctttctctctctcacacacacacacgcaaatgcacttgcacatatataaaagtacagaaaacttctgatattttctttatcttgtgaaaattatgtttattcttgtaaaatttatgatttttctctttctttttgccaggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaaggtaattgatagatttttaacatctttgtttcctggaattcaaatttctaggtattcttaagagatttttttatttttcaacatacagttaataagttgttaggaatatttgcatgcaaagatttattttcaaaatgcatataaattttatcagagaagataaagtataattcctcttgcaaaaaatctgcttataacatgaaatacaattacatctgttagtgaaattttttttctattgatccttccatcttattatagaagcattcctatttttaagaacccacaaatataaaatttatatgagtggattttaccaattttgcaatccattcttacatctttatttgcattatctttcaatcccattatattattactgtggtctcaattgattggctaccttgaaagttatgtggttctaagtgacttcaaaatgtcagcatatattgaaacttaattggaaaattttaaacaaccattagtttatgtatattccatgctcatattttaaccatctaatatttctttttgtaactgaaaataaatggctgattatgtaaaaactgaattatataaggacataattagaatactttatgagttttattttcatgttataactgttgtaaatgtcaaaaatatagaaaaagaataaaaagaaaaataatttggtggaataaaaatttaatatttatatatgaaggaaggcaatagagaaaactattattaaagcatttattttaaccagacagctgtcagtagtaaatgtgtttgagaggtgcttctatagtcttatgtgggtgatcttttcttatatatgtagataatcttatagtaggtgatcttttcttttgcatagttagcatttatataataggaattaaattttataataaagatttttctcaaaggaaaaggcttataaagtgtttgttctaacattatattttaaaacaatgtttgcctttctgtaatgctaatatggttttactgtagctaccttatattggtggaaatgtacataattatttataattccaggttagtgcaaattgtttaagctcattaatattaatggtagctgacaaggtacagtatttctcgagatgaaagtatccttcttttcccccagcagctaagtagtgtttatcaaagccatactttgcatgccctttgaattcatatctttatgaatacaaataagtttccacatttcagagcctgtcaggtgatgaaaggttttgaagactgagaaaaaggttaaaggtaactgtgaaatattacatttgtcatcataattgcaaaataaatcattaattcaagactattacatttgattagtggcatagttcatgattgtttccattaggaagaagaagttctgcctctaatgaaagcattttgatcaaagaatatggagtatgagtgcagtatagataaaatattagtagatttcttaatggtgatttcaaatgaacagcataaaaaaacacaggttcggatgttctcacaacagagtactatcctgggaatgccctagcaaaattatgaattgataaagtcatgtggtttgaccaaaatattataagaaatttacaagctttgttacccaataaaaactcactgggaatcaaatccatcatttcactttggcttgaagctaggaaaagctgaaataagtgtatgaataactgtctttgtgaatgtcatggtttggattttatcttctgaatctcttgtttgttgagttattactgcttggaggacacagcaatacataaaaacataatataacagagccaatatttttttaactttatcaagaaatgtatatattgataatattgttaatgattaattataaaataactttagatattttaaaaatgtaattatttatccaatgcaagaaaataataataaatgagatgttaccttttgacattttatctaatttttttctgttatagttttaaagggtagtattgttctgctcaattaataaatactttgatgtattagagcttgaattattgtttgaatcatatatttttaaataactcttctgataaccgaaagctctaatcttgcttgaaacacacttagaaacattctaaataacttaattcagtgtttttagcttttcttggtttgtgatttgtcacaaacctggtgaaggaagatcatttatcttcagtatatatgaattaaaatctcatgttgagtgaaaaattctcaagtctagccaccatttatactaatttagaattccacatgttatttaaaaagtaagaatccatgtatttaaaaacaatttatttagatcatattgatttttaaagaatgtttaaacaagtgttctgacaataatttacttaattattaaatatttccatgcttaattcacgtataatattatattttatggagaaaactgagggaaaatagcagaaattttcacacggtagaataataaactatccattttggaggaattgagtctgaacacctaatttatgcctaaagctcagtaacaatccttctctgtcctttaaatatttgcagtgatgggcaaaccattgcctcttggggaagactatttcatttttcaacatggtttactttttttttgacacacagttttggtctggcacccaggtaggccaggagtggcaccatcatggctcactgcaacctcaatgtcccaggctcaagtgatcctcccacctcagcctgccaagtagctaggactataggcacacagcaccatgcccagctgaatttttttttgtttctttttgtttgtttgtttttgtttttctttttgttttagtagagaggaggtctcactgtgttgcccaggcaggtctcgaattcctcgtctcaagcgatcttcctgcattggcctcccgaagtgctgggattacaggtgtgaaccatggcatgaggccattatttagaattaaaaataatagccgggtgtggtggctcatgcctgtaatcccagcactttgggaggccgaggcgggtggatcacgaggtcaggagatcaagatcatcctggctaacatggtgaaaccctgtctctactaaaaatacaaaaaattacccaggcttggtggcatgtgcctgtagtcccagctactcgggaggctgaggcaggagaatcgcttgaacccgggaggcaaaggtcgcagtgagctgagatcacaccactgcactcaagcctgggcgacagactgagactctatatcaacaaaataaataataaataaataaataaataaataaataaataaatatgaagtgggtaaaaattcaggggaagcttctattttttttctaattcccctttgcccatcaagtgaaacaaacttaagcttctttcacatgccaggtcttcatatatttaaagataagttttgtgttcccaataattactcactttctaggcccaagctcgctatttgtgtcagtgtgccttatagaaagttcaggtcatggcacagtctattttaatctgaataccctctagtttgttcatgcctttcttaattactgtggttattattgatatgaataaaattttctgtgagtaaatacaaactttaaaaaatagaataatagaaaacacttatagcatccaaaagccaaatatataaagatgactgagtacttgtctaatgacttttctgtttttctactcagtgtgactgatccatatgaaatcactctctaagagctatagcaggttttgtgtggctgagtgttcgcataacccgacatgtatcatcagataggtggaaatgttcatctgtgtgtgagcatagctaattgcacgagtaaagggggaaccatgtggcttttgattaagaaatggaaaatgtaaaaactgttcagtgaatttgagaagctgcactattccctcattcccctcatataaactagtcttccaaaacaagcactgcccccttaaattaaaaaatattcatcctctctctccttgcctgtctccctcccctgacattatttatagaattatttgaacattgagctgcagggtgagttaattcccttgtaacaaacggaaagtgttcagagtcagacaaaattttaaattagtgaaaagtagatatatattttttaaaaacacaaatctttcttgagaatgatacctttgggtttaaaataataatgtggtatctgttggcacactggcacctctcctctcattattgacagacctttatctcctcttcagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtaagaaaaatcagtatcttttggagctatgctttaaatatagataattttctgaagcccattccaggttcttattgtattcttatgtgctttattttgagttttgaaaattcagctaaggggtagaaagacagaatcaaacaccaatcctaatttcacatatccaaacaaagaatacctatgttgaatacttcttctctgtatttgtaaaataagcatttttttattcctgtgaaagatcagctagtttggtaggttggatgaaagatagatgtagtaaacaatattatagatagatagatagatacacacacacgtacacatacacatacacacacacatatgtatatatatatttagaattccagtcatttaaaaagtaagaatccatgtattcaaaaacaatttattcaaaaacaatatggtctaacaatttagatcatattgaataatgtgtgtgtgtgtgcgtgtgtgtgtctctgtgtgtgtgtgtgtgtgtgtgtgtgtgtgtgtacatagacagatagatagagtcactctgtcgcccaggctggcatacaagggtgcaatctcagcttactgcaacctctgcctcccaggttcaagcgattctcctgcctcagcttcccaagtagctgggattacaggcatacgccaccacttctggctaatttttgtatttttagtggagtcagggtttcatcatgttggccaggctggtctcgaactcctgaccttaaaagattcacctgccttggcttcccaaactgctgggattacaggtgtgagccactggacccattctgaaatatttatttaaagaatttttctgctatgaagtttttgctagggtagtttctcaaggcaaagccttgtgatgagtcagtgaaacttgccaagaaattcagaattatgccttactattttatctggctgtttatgtgcaaagaatgcatataaaacgtaacaaactttataaggcatgttaaggttagaaaagtttttactcatatgtggaacaatataatattcactgaaacactcaagtttgtggaactgcttttgtgtagatgtcatttagagacttagaaaatagaatttactaaatgatatttatttcagtgagttaaaggaatattttaataaatatttgctaactacaggttgtctgctttcttatgttaatgcattttattatttttgcatacaaatggttatcttgaattatcagttaaaaacaagtctcagagaaatacaataaagtaacaaaaatgaaattttaattttcattgaaagttacattggtgatgcagctgcatactattttgcttactatagagtgataattaattttactttaagatgtttatcaacaatataaacagtgctctttaaattagaacataaaaacattttattttaggacacttcgctatactttcataattacattgagattgaatttcatttgaatttaaattctctcaaagtatgccaggagcacattttgttcatgcatgcagtatatagaactctgtgcagaaatttgcccatttgccaataaaattggtcatctgcaaattgacagataagaactctttcaagggaataggaaactgggagctacaggattaaaaaaagggaaaataatttcaaaaacattttcaattagataagaaagagtgaaatgcatctagatacaaattagagtaattttgttttcttatttaaaatgtgaaatatttataaataattaaaaattaggaatacattattaagagtccttaaaaataagtatgtttgatctctgttagctcaaattaaacctattaaatttattatattgctttcttcctaaatcattacttctttgtcattggtaaagttctgtgttccaattttgaatgtcaggttctatatgaatgatttctgtgagtatgtgtaatcaaatgatccaagggatcctcagttgcaaattggtccacttatgtttatggatggtcatctacaaaactatataaatatagatacatgtgcattgttaatctgtggattgtttacttctccattccttcctgatgtaattcatgtataggttgtccaaacatcatatatccttataatgtatacattatatacatatgtgcatgcacacaggtatgtacatcatacatgtgatattttgtattaattatcatccttaaactcctcataggaagaagaaaattgacaagtattcaaaatgtctacagacatattaactttattcacaatcctacgtgtatgcacatgtgtggcatttttatttaatatatgtgggtcttaagtgattcactaaatagataatgggatttgcaatcaggtcctacaataatttggtaaaatacagcctcatgtatttgttctattcctgctttaaattatattctcaattatatcattgaggcaaatataaatagggacatatgtatagctagttgattatatacatttaatggagtcctgacctcaaatttattaaaatgcttactatttagttactcgttactatttaaaggaaactttgccactcccttggctttgaaggtgacatagacagttggatatttgaaaagtctgattagttaagtggtaatgctaacttagaattgttacagaattattcatagaataaatatgtcttgaaatcctctgaagaataaaacatattgctgttccattttatgcaacatttaattcaatgaattttgattatcaactgatacatgccagggagagttaaatgccacgaaaggaattatatgccactaaaggaaacaaaggcccagcccttgttgagcttctaatccctattgagggacatgtaataactcatatttttaatactatttgcaatgggataattgcacttgtaacagaccaattgttgcctcttactttacagcatttttgagaactttgattatttaatatgatagaactgactcgaaggcagaaaagtccctttgaaatgtatttataaatatatagtagactttttgtctttttgtttatgtgtcaaagtctcaaggtagaatttttttcaactttcattttaaaatcagggagtgcatgtgcaggtttgttacaaggctatattgcatgatgctgagcattgggtacaactgaaccaatcacccaatgaacagggtatccaatagatagtttttcaacccttaacctcttctctccctccccacgcttgtagtctccagtgtctattttttcctagatttatgtacgtatgtaccaaatgtttagctcctacttataaataagaacatgaagtatttggttttctgttcctctgtaattcacttaggataatggctttcagctacatccatgttgctgcaaagaacataattttgttcttttatatggctgcatagtattccatggtgtatatgtaccacattttctttattcaatccacaattgatgggcatcttggttgattccatgtctttgctgttgtgaatagtgctgcaatgaacatatgcatgcatgtgtctatttgatagaatcatgtattttcctttgtgtatatacccagtaatggtattgctgagtcaaatgtcgttctatgtttagctctttgaaaaatctccaaacttctttctacaatggctgaactaatttacattcccaccaaactgtacaagcattcctttttctctgcaacctcaccaacatttattgttttgacttcttaataatagccattcagactagtgtgaaatggtatctcattgaggttttgttttgcatttctctgatgattagtgatgctgaacgtttctttcatatgtttgttggctgcatgtacatcttcttttgaggagtatctgttcctgtcctttgcttacttttttaatggggttatttgttttttgcttgttgatttatttcagtttcttataggttctgggtattagacctttgcttgatgcatagtttgtgaatatttgcaaggtatagttttaatgatagaattcagcaaagagaatttgtcagcttctcaaaagagcaagatgactatttgatgatgtgataggaaatttactgtgaactgaaatgggaaaaactccacctcatacacaataaaataaacattactgtctttatgatggacttatgtatctgcttttactgcaaaacacacatgtgcttttttttttacatatttcctttttcctttccatatttatttattatgtatgctgttgctcccatttgtattcatttcttttttgttgtgttgtccagtttgatacatgataattatactttcatccagtctttgttcccacccccaaaacagatgggatgataaatgaaatatagtgctggaataggataaattcttaaaatgatgttaacaggagctatttattttttacgataattagcatttgttgttgtcatggatgaatgcttttaaacacgctgaaagtctgttatagctctgaatgatgtccaaaaatgatggaaaagaattggcttcagaaacaaagctgtgtttctgtcagtcattttggaacatatgattcattttaaatataaactaaaaataagttggctagatgacagcttgtaagcaattccagaataagttgttcatatttgctttaaaatccctgtgtttcatctttgtttatagatcagcagtccattaacaaaaaaactctggactggtaaacagaagcatgggattctattcccagttttgctactaaattactggtacaacttcagaaaatacaagaagggaatggaaatgcctgcagaaatgagctataatgcactatgaattgacattgtgttagttgctgtcacgtaaactatttcacttaatcttcaaaacaattctgtgtgtcccaaaggaaacaggtgatcatgacatcatacctgttatctccagtgactggctctcctgctcaccagagcctaaactagaaacatgaacatcttccttgattcttttctttttttggctcgacaacaatcggttgtcaattctatacttgtatgatctctcaaatcttttatttttttcctaccccctaccacttcttaggtcaaaatcacctccctctgtcagctggatgattaacagccttctaactggtctccctttttctagtctctccattgcagttagtgtaatttttttaaaaatgcaattctgatctgtttccctcttaatagcttctcattcctctaaggcatttttaagaagacttacaatgcttagtgtgatgtagcccctatacttgtccagtgatatttgagtccaaatcccccactaatttatttcaaattgagccagtagacaccttttagttgttgaaaataatcttctgtttacctgggaagctctctttctgatcctattcctcctagccatgaagtgcacacgtacatgtgcacatttgcacaaacacactcaggcataccatccggcttgggtgtcacaaagaaaggctgccctgacccctgctttcaagtctggaataggtctctccaaacacatcccaaaggaccatggaaacacccatgaccatccccacccccatgagaactcttatcacactctgaatggcttttcttgggtggatcttctactggatcaaccacacatctgagcagggtgaaccctaaggctgctcactgttttatcaccagcatctagaatgttgcctggttgtggaagtaccttaatacttcttaataataggaagatgtgttatatccatttttaagcaagataattccaatgagttaagtattctgccaaagtcaaatttggttaagtagcctttaactacttgccaaggaataaatagattcagccataattttcagatatatggacatgactcttttatgatttcaaaaattttataagaaagctcgagtgaattgtgtttctttgatttcaactgcagttaaacatatatatgtgagtatatacatatatatgtattcttatttgagcaattattaaatttctgtataccagctgctatcttaggcagaggggacaagaattatagataaaactttgaccttctccatgggctcagagtagagtaagttaggagagaataacactacactctagtgtaacaagtgcacagagaggcaagaaaacagcatcatgacatctcaggagaagaagggctcaggagaagaagctgcctggaaaggatggagaagagttttagagaaagtgacgttataaaattatcatgaaggataagtaaaatgctgcaactggagaagagtctacagtgtgcaacatgtgtaaatgtgaagatgactgagggagccagtttgtcaggaaattgcaagcacttcattatgactgagtaacagaaacaaggaagatgaggaatgatcaatggattttataaaaagctagcgtaggagagatcacagagagctttgtactaccaagtccaccttttcttgcccaccctgccctggaatctacatggttatagcaatatcagtgatgtttgtgtgatgtgagcctgctttcaaaccaccatggaatgcctcaaaaattggcatatatccattcacctttttcctggaaactcagaaaaagacatagagggccatctgtcagcctagactattgtggttactacggtctttggtatcaggacattctagactgaaatcctgaccctgtcgtgtagtttttagcaagggatttgaccactaacagtctgagagttgatgcatgtataaggtgaggataatatgtgtcatacttcacaggattgttgttgtgtaaagtgcctcatagaggaaacataacaagaatttaaaactttcaacaatataaatgctatgggccatgtgccatttttcttcactaaactctatgataaagaaattattaatctcacaatttttgaaattgatgcttgtttattataggaaattcaggaactacaataaagtttaataaaaataagataaaataatcaagattttttgctatcaagttaatcattttagatttctttccagtctgtttctctacaaatacacatacacatacacacaaagagcatatcatttagagttctgggaaagaaacagaagaaacacgtagcttgtaatcccactattttaatatgagaaaacttagatgcagtgagttgaagtaatttgcccaaggttacatacatagcacataagtgatagatctgggttttgaaactaggcagtcaactttagaatctactctgttaaatactgttacatgatgttagttgttgttttattttgtgggggttttttttggctctttttaaaaatcattattttaagcaagataatggcaagattagaactatttttggtaatggctttctgactgcagtgtggagaatgtgttggggatatgagatatggagagcaatagggcaacactggaagcaggggaattcctgaattagccaagttgaaaagagatgacagtttcaattaagaagattttgatggaataatgttgacatgaagaattctaagaggacttaggagatacagattgtagaatttagtaagtggttgccgggaaggagtgatgaagacaggaaataagaattactctatgttcctagttggggatactaatcagtggcacatttacctagaaggggaaaacaagaaaaacagcttcaagagagaagacggtgtctgcttcttaacatatgaagtttgaaacatctatgaaatattcacttgctatcattcagtggtattgtatatatcataaattcatcttaaaaataggaacttggtctgggcaggcatataatgcttccattggcattttgctgtgcccttcatttgaacttctttgtagtattaggaaatgaagaaaatcaacaaaaaacaatgaaataaaaatagggtgatagtacaaaagaaatgagttagtaggtgggcagccatggagataaatatagacatgagaagagcttacagacagaatgtacattcttttcattagtgaaggaaaagcagtaatatttttagaaatagtaatatttaccaaattgagcctagactaatttctatgatacgatcacaggaaaaaaaaaagccaaagcttttatcttaagcaaaaacacaaacactttcttaaaacactaactttattcatttggatgaagtatacttatagattgctttagatacatttttgtgtgcttttggagttagcataatataatggaaagtcaattaatagtgaaaactcattttattttatcttgcacgtatatttaaataggataaaataaaattaaagttaatataaaaatgtatattcctggaagacactaatttttgaataagataatttttatattatgaagcatacaatcaaataatttccattttattttagggagtggggtaatttggatctcagatgattatatgttgtacattttaaatacaagcttcaagtgctgtgttctctaattccaagtgcaaatacaattagcaattatgagttaaacttaattatttggatatacttgattacatagcttggtgtagtagtatttccacacagttggttatgcttgaacttatttttttattcctatttaagcaatcataaaaatttttttagaaaaaagttaactcaagatggattaaagacttaaacgtaagaccaaaaaccctaaaaaccctagaagaaaacctaggcaatacctttcaggacataggcatgggcaaagatttcatgactaaaacaccaaaagcaatggcaacagaagccaagattgactaatgggatctaattaaactaaacagcttctgcacagcaaaagaaactatcatcagagtgaacaggcaacctagagaatgggagaaaatttttgcaatctatccatctgaaaaagggctaatatccagaatctacaaggagcttaaccaaatttacaagaagaaaaaaccctatcaaaaagtgggtgaaggatatgaacagacatttctcaaaagaagacatttttgtggccaacaaacatatgaaaaaaagctcatcatcactggtcattagagaaatgcaaatcaaaaccacaatgagataccatctcacaccaattagaatagcaatcattaaaaagtcaggaaacaacagatgctggagaggatgtggagaaatagcaatgcttttacactgttggtaggagtgtaaattagttcaaccattgtggaagacagtgtggtgattcctcaaggatctagaaccagaaataccatttgacccagtaatcccgttactgggtatatacccaaaggattataaatcattctactataaagacacatgcacacgtatgtttattgcagaactgttcacaatagcaaagacagaatcaacccaaatgcccatcaataatagactggataaagaaaatgtggcacatataaactatggaatgctatgcagccataaaaaaaaggatgagttcatgtcctttgcagggtcatagatgaagctggaaaccatcattctcagcaaactaacacaagaacagaaaaccaaacaccgcatgttctcagtcataagtgggagttgaacgatgagaacacatggacacagagggggcacatcacacactggggcctgtcagggggtgagggagtaggagagggatagcattgggagaaactcctaaggtagatgacggcttgatgggtgcagcaaaccaccatggcacatgtatacctacgtaacatacctgcatgttctgcacatgtatcccataacttaaagtataataaaaaaaagaaaagaaaattatttcttgggttctgattaaataatagtgaatatttacaaatatgtttataggactaattctcaagttttaaaacctttaaaatatatgccaacacggaaagacaaaaatcaaattttgaatctgtagcaatcacacaattcatgtttctgtagatagtgaaataaatccacactagatctaaaaatgtagaaggagcaagtcttatactaaacctcaataatatttgcattttgggggggcggggaaatgtgaaggaagaataattctggtgatagtcaaacactgccattttttaatttacatttttctaaatttaagcatattggcatgcacatttttggtaggtactgccctcctgccccctacagcctttccttgttcttggctatcttcctttctatgtggtgaagtgggaaggatagttcttgtatcatctctctgaaacacttgaaaattttgaccattccttttttcagggcaaaaataaaaattattttgctttggcttctgcactgtcattctatctgtgttacctccttctttttggccatttattcccattgtcatactcttaaactcctttttcttttcctatttcttaactcatgatgttgttcaagattttattcccagtcttgttttctcattgtttacctcgttctccctaaaacctttcatttgactcgtgtttctgtacctgtatgctgtagactcaccaatctacattttcagttgtttgtactgacctccatattcacagttccagccatcactgatcatctttatttgaatgtctcataggtacatctaacgcaacataacaaaagccaaactcagtatctttgcccgaaatttgctttttactcctgaatttccctctttattgggttgcccacatcagatccctagtgatcattctagattctttcctctctctcaccctctattttcagttgatcatttagacttcccatttttatctcacatttctcaaatttactcctagcttctatccctgtcttagttaatatcatttagtgctgaaacaacgccctgcctgctactctatttaaatgtgtctacctgacgtagagaaaagggtctttttttgaaatgatagtctcatgaggtcattcccaagcttaaagctgttcatagtctccccagttcagagaaaaacgaattgttcctcggcatgacacatacagtgtccatcattgacactctcatgcctctctgattttaaatttctggtattccttctcttaatattgtgctgcagctttccttgaataattatagctctctcttaccaagcatgctatgctgtctcaatctctttgctgtgcacaagttgtcctctctgcctgatgtgtctttcccatttggtggcctattcatcacctgtaagatgtaccttaaaatagaatatcatttctaaatatttataaattatttctaaatattctaatatttagaatattatttcttgatgcaagagttactttagtagataaaatagttcatcttcatttctgtagtaagtcttatttttagcatcctcacataagtaatttagcaggagtgatgctgtcctggtcatggaagctctaaatatcttacaatttatttacctatttattcatttactgatttgtttgtttgttttattactttatttactccacaagtaattatcaagtatctagtatgtgtcagcactgttctaggtaccggagatatataagtaaacaaaatagataaaaattctttgccttatggagcttacattctaatgtaaggtgataaacaataacaaaataaatatgtgtacacaatagtatcaaacgtgataggtgttatgaagagaaataaagcaggagagatgtgtagggagtacatgggaagaaatattgcagtattaagaagggttgccagaaaataccttatttagaaaatggcatttgaactaagacttgaataaactaagcaattatgccatatctaaagaaaagtgtttcagaaaaagcaaggagaaaaaaatataaccacggggaaaatagattaagaattttgagctaaaggagccacgttttagttttgatgatgagttttgggaaaatctaaaaaccaaagaagactattgtgacatctgtcatttgttgtgtgtgtgtatgtagatctgtagatatatgatgacatatgtagatgtttcattactgttttagtaacaataatgtcatttcttttaaaatagctttgtgtaagcctgggcaacatagtgaaacctagtctctacagaaaaaaaaaaattaattagctaggtgtggtggcactcacctgtaaccccagctactcaggaggctgaggtgagatgattgcttgagcccaggaagttgaagctacagtgaaccatgattgcaccaccctactccagcctgagcaacaaagtcagattctgtttcaaacaaatacacaaacaaaaaatagttcagtgtaaggacttgtccacgtaaaagttcgtttttcttgttgttaagagggagtctcgctctgtcgccaggctggaatgcagtggcgcaatctcggctcactgcaacccccaccttccggattcaagctattctgcctcagcctcctgagtagctgagactacaggcacgtgccaccatgcccggctaattttagtattttttagtagagatgggatttcaccatgttggtcgggtcgcaaactcctgatatcaagtgatctgccctcctcggcctcccaaaatgctgggattacaggcgtgagccaccaagcacagccagataactgattttataagacagttatgttgacctagtgtatcacatgtatcaaacctaggtttaaatttaatccagataggatctagactttttagaggtatttctgatacagaatcacttatttttagttaagtattcaataaatgaccatgttagacttatttctcctctttatagttcagtgtaaggacttgtccacataaaaattgagtgccactgcaccccagtctgggcgagagagcgacactccatctcaatacatgcatacatacatacatacatacatacatacacacagttttctgttttctgggacctaatatttgctactcaacattctataaactttactttgttttaaatatatagtatatatggtatattcagagataacattatctaagcatctaactttttcagaatgcaagaaaataattaaaactcaaattctagacaggctaattgtccattccagagttcttccaagttagaagtggaacagtatccactaggatagtatttcagtgactcaaaaaggaaccaaacaaataatttttttgcatgaatgcattaaatgcgtactaataatatcttgttacaaacagaattctgactaacaaaccctaatgaaaatacaaagcctaacatatacctcttcttatccccaaagggattattttactattcataaatacttgtatttttgtaagcccagtaatctttcttttgagaaaacaaaacttattgtgtaacatatcttacagttataactcaaagcacttgtttttaaatttaattcataacacagaataaaatatctgggctactgttaaaactaaagattcctaggcaaatctctatgattcagtaactctagagttatattcaggggcttgcatttggaaacatagctaattgtagtaggcattcctcacatttaccaatatctctggttatcttcacttctaaacctcaaaaagttgcagtttccaaatccttgctgtggccaagaggattgctttagctgatgaaatgtgataagtggcattgttcacttccaggtggatgcatttaattgccttgctcttcctctccaactcattcatttcccaacatagcaattgtgctcaagttcaaagcatcctaaaataccgccaaaatatcaaagattgctaacctggagaattatctggacctacagcagacctggcttttatgagatatgaaatcttgttctgttaaatcactgtgatttgggaagggggatgatttttactatagtataacccagtcaagttgtcgttgaatttccatgtgtattaaaaacattaggaaggcttgataaaacactgcttgctagactgactcccagtttctgattttataggtatagttgtggcctaataatttctttttctaataagtttctgggtaatcgtgatgccattagtttagtaactccacttgagaatcactgatctagccaatcttgaccaatatacaaattttcatattttgaaacaaattgacattaagtcaaacttatcaatatgataaacaaaggcatcattttgtatgtaaaacaaatttaaaatgtttaaacaagcataattttttagtgatttaacactgacaaaattattaatcacttcttaaaaacacttaattgtctgaacttcaacactgagtagcaattattctgctaaatattcttgtccttaagagtattcaaaatggttttgaattagctttaatatgaaggaagaacagtcccctgtaaatacagtaaaaattgtgaagtataaattgagatttaaaacaatctgatattactagaatgttttataatatccatttcatataaatttaaaaatagttttactttttaacttttaaaaaatgtacaaaaagtactaattaattacatgtgcaatgattctgacttgtcatttaagtatttttttcaaattccccattccactctcacaatgaactttttatccaattgaaataattgagttggcattaaagaaagaaaattaagtcagctcttaaaatcttaacactaacttgttaattaccctattaataacacaatgaaaaatgacaagctgtaattccttttccaaaaatatggctgaaggtcagagagctgtcttgctggcatattgagagaccgaaaattacaaatgatgagcttttttttcttttaaatatcatcagatgccattagaaattcagcgaagagactagatcaatatttaaaatataattttaaacataattttcctattattaaagaaaacaactgctatatattaggaaataacctagcaaagatacttgtatttgtgtgttaagaagacaaatctaaagggtttccaaacattgtccaggtctgagcttttacactattgaaaaaggattccgtgtgcttttagcctacagcaaagatcaaaaagcattcacagagcctactggcaaaccagagataaatagaatggttttctctgccattaaacaataattcttgaaaatgacttttttcttttatgtggggtagagtaaatccaaattatgcaggacaaagtttacatgcacagtaagtgatctattgtggtattgtttgcatttttcttggtacagtttaatttattgttgtaactgcttcgctatttaggagaatagaattggttaccaaagacattgtaaaactgttctataatactgtagtactcatttaatatacatatataaatagttttactttttaatttaacttttaaagaattttgcaaaataaaacagaattctgtttcagagtagagacacttaaacatttgtagttttcttagaacatgtataacagtaccataatcttgtattcagatttttaaaatttgtaattgtggtaaaatacacatacaatttgccatcttaaccatttttaaatgtacaattcagtagtgttaaaaatattcacattgtagtgcaaccaatctccagaacttttttattttgcaaaactaaacttttgtatgcactaaacaaccattctccatttctctttccatagtctccagaaaccaccattctactttctgtttctatgaattaaatactctagatactcatagaaatcgattatacagtgtttgtctttttgtactggtttatttcacttaaaatagtattttcaaggttcatcgatgttgctgtgttgtaaagtgtcgaaattttctttgtttttaaggctcaattatattccattgtatgtatgtgtcacatattattcattcattcatcaaatacttgggttgcttccaccttttagctattataaataatgctgctatggacatgggtaaacaaatatctctttgaggccctgttctcaattcttttcagtatatacccagatgtggaattgctggatcatatattacttctctgttgaactttttgaggaaccatcatactgttttccataatggatataacatcattcctaccaacagtgcacaagagttctaacttatccgtatcctcactaacatatatatatattttaattgtactcatgttgatgggtgtaaggtgatatctaactgtggttttgatttgcatttccctcatgattaatgatgttaaacacatttctatattcttattgatcatttgaatattttatttggggaaatgtttaagttgtatgctgatttttttattttagctgtttgattcattggttgttgagtttcagtaattctttctatattctggatattaactgactatcagatatattatttgcaaatgttttcttctattccatgggttgctttttcacgttgttggttgtgtcctttgatgcaaatttttaaatttcataatccagtttatttttactttttttaaacctatacttttgctgtcatattcaataaatcattgccaaatctaatgtcatgaagattttcccctatgtttttttctaagggttgtatagttttagatcttacatttaggttttttatgttttttgaattaattttttttctatcttgaagagtaagagtccaactttattcttttgtatgtggatatccagtttccctatctctgtttattgaaaagactattcttttgtcatttattgaccacatatgttagagtttattgttgaaaatgaaaattattttaccacatatgtgagagtttatttctgagctctctattttattccattggtttatatgtctgcctttgtgccagtatcatactgttttaactagctttgtaataagtttgaaatcaggaactatgagatctccaactttgttcttttttaagattgttttggctagtcaggatttcttgagattctatatgaagttttagctgagtttttctgtttctgcaaaaaattttattggaattttgatagagagtacattaaatctatagatcactttgagtaatgtactcatatttttaaaaccaaggaaatttgagttatactaaaatatactttataaataaaacaacatttatttgtcaatttattagtctatttagtagccaatcaactaacatagattctttctatagcagtacatttgctgcttcagttagggtccatcacattctttaatttgagctcacttccttatttgtctgaaaattattttttctttataaactttatatactgatgacatatacaactatataaagtaatatcttatcaagcacttccttggccaaagaagaaccaaatgtgaataagatgttttgattctccaaatacttaaacactagtgttacaaataaattacagtacagtatgataaatgctaaaagagagttatataaaagtgttatggcaaactggaagttgaaatcaaggagatccagttggttggagaactaaacagagatgacatttaaactgggtctcaagtaatgttaagagtaggtaagataggaaatgcaagtgtacagagctgtgaaatggtatggtgaactggtagcatgatgaaacatctactgaggttgatacaccagacatcatctagagatgcccaagaataaagacaaatggatcaaaagagatcatgaagggactggcaagactgaaaatcagagcatataaccatataagactaaagtaggttagtcaccagcagccctgtagaagaggctgtggctggaatttgaaattattaaatatcactggacaggttggaggcataaataggttccaaagaacagtcttgatttaggcctcataatgctgcttaccaagaatcaattaactttttaggaaaaagtgatataatgaatttttgagtatggaatttttaattcatataatgtatttagaacattaaaaggttattaagttttgtagttattggtgctatttaccaaatatatctagctctggtctcaggcatagaacagaattgcattttctcaccctctttgaggttaggcaaagccatgtgattttcttttgccagtgaaatgtgagcaaagtactgaaatatttcttggtgactgtttcaaaagtcagttatcagtttgtcacattttcttctccatgctatagtaatgatgagaacatgattcttgatggaggtactggagtaactgtaaggtgcaaagccaccctaccaatccatgctagacaaacaataggaacggcaataaacttgcctgttgtttagcccctgagacatgtaaacataacttaccctatcctgactgtacaacaagtaagacataataatggctgtagaaagccttgataacagaataagaagaaaaaaaaaaaaactaaaatcaaccataatcttacccaaatgagtcattgtaactatttttatatttacctcttaaactatagtgttacaaagaagcttaattcatcatgtcaattatttacttaattgtgacagatgtttactctgctaaaggtatatgctgttgctctctctctcaggagattagcttccctgtcagtagctattgtgttataactagccatcatcaatttttctcttaagtgggaaactacaatacataacaaggttgttttgaatctcatatgagacaaggtatataaaataagtggcacatagtacgttaaacaataaagatgggagaggccgtttgtctttctaaaggtttgcttatcaaaattttaaaatacttgataccttcaaaatataaaccatttttgttcaacaaaactaaagcataatgtaataattctccatctcccttaagcaagtgtatgccatttgtcattttctttaaaaataaatgaacttgttcaattagttgaaaattttcttttatagatctgattttacaagttgatgggtttttattgcagcattatgtaaaaaagcttgaactttattgctcttgattagtccttatccttctaagaattttaatggtaatagaatattttaagatgcatcagtgcacatttatgttgaatgttagtatcctttctgctctttactgactaacactacagttaataataaaaatttatctttatttttgaaggcttattatgcatatatgatatttatacatttttggtgataaattctatcgccacctagtgctttggacaacattttatatttctgccatttctttttgcattacattaagatgtgtaaactgtgactgcccattcttctcataagacttttctctccccagtaagcttacttttctctccccagtaagctgttccacaagggcagagaatgcgttttctttagaactgtgtcctcacctcctggatcagggcatggcttgtagtagatgcttaatgcacatttggggagtgaactaatagataaatactatacagttcagagtccaataactatattctgacacaactacatcccctacttggattttaaaagagaaagtttttgtatcttcttgatgatctaattataatgctgtgcatctagtttagccaggacaagatttacatatgttgctgaatttagtaaattcttacttcctggacttcagataaggtaaaaagtaagcataattacaaagggcaggaaaaacccttagttatgaaaatatgtattatcttgactatggtaattatatcataatgtcaaagttaatcaaattttacactttaagtacatatattttagtttactttaattagaataaaattgaaaacaaaagccaaaaaagtaagaataacatattaaattgctttatattacaacagcaatatttctgtaaatattcttcctctacatttcaaaatttgcaaaagatatcaccacaggcaattgggcattacttttgagattctttgtcagtggaatacattaaatctcccgcctgatagagaaattaaaactgccacatttctgtctctgctagcatcatcttgaaatgttcatccctcaaacaggaatagatggaaaggagaggaaaggagagatgaacagagtttggagaggaaattacctcattactatgagcacagagaagagagacaagaaagagatataaaacatgagaggtaaacataataatcatcatgacaacaacagctattgaaagctcgctgcatgccagtaacagtctaaacacttagcatgcatttctcgtttttctgttttcatggcaactctgtttagtctccctatataaaaaaatgtaaaatctgagtcttaaagatgttatgaaacttttctgagggaaagtacaagtgtcagaataaggatttaaacccaaaatgttgaatctaatagtcaggttcttcactgaacgctatacctgttcataacagacacaaaatgtaaaaaacaaagaggtaaaacagaaagaaacaagcttctatgtgtattggtagatgaggagagactttgcagctgatgctaaacaagaggctagggtccacagctatctacacatctcctcaagacagagctccactgtagacagttaactccaggtagacagaagttaagacatgtggaaaacattaaatagaagcaattgtttgctataatctttgccacttttgcactgtatgcatttttgaagatccaaggccttctcccaggctatagaagtgcactttaagccaatattttgttttatgagatataagaaatcacagccatataaataaggcacaagcagagatgagtaaatggtatatagtgtctccagttttagaaaggatgcagattatatctgaaccagcataatgtcactacaagaaggatgcataatgtcataaaaatgtacttcatacgactcagttatttgtattttttatttatttgtttttaactaaagatgaatagcctctgccatattttaaaagggcaggcaatataaagttcaatattagaaaatgtacctaaatgactggaaaacacatcttatgaactagtatattaatcattcagtgtaggaagcagaaggcaacattacatatcactgtgatgtgctaagtgctagtctcaaatattcatggcttaggcaagagtttatcaaccttggtgctgtttagttgaagtcatggggggctattttttgtaaaatgtttaccagcatccctaacctttacccagtagatgttagtagtagttctcatccccagttgtgacaattaaaaatatctccagactttttgccaaatgtcccctagaggcaacatcacccctgatggatcactggcttcatttgagtatatttctaatcattatttttcattaaataattatgtttcagacttgcagtaaagatatgctgtaactttagatatgatttagaagtctatatcttagaaactactataaatagactcagtacaattggaagtggaattggactaccgatgattatattcattcacataaccatttgttaaatacacactaaatgcctgtcactgttccaggttctaggaatacaaaaataaaggacacatttgagatctgcattacaccaaaagtgatataaactgtttattgatccagattctccaagatctacttttgtattctattaatttaatcatcagaaaccatgaattgttaggccatattaccttacatctatgtagaaatatttttcctaagttatcatggtttctctgggaaatgaatataaaaatttcctttgaaatattttttagttttttttaaagtgatgagccaacataccatgcaccatgctattcactgtcttcaatccaaataacaatttacatgataaactaaagattgaattcaaagcataaagattgtttatcaacccttgatttcatttatttatcatttgagataacaattctactttttaaattatttatatcgttagagaattagagaagaaactatatgtattagtctgttctcatactgctaataaaaagatacctgagattgggtaatttataaaggaaagaggtttaatggactcacagttccacttggctggggaggcctcacaaacatggtggaagataaaggaaagacatgtcttacatggtggcaggcaagaaagcttgtgcaagggaattcctatttataaaaccatctgttcttgtgagacttattcactaccacaagaacagtatgggggaaactgccccatgactcaattatcttcacttggccacacccttgacacgtggagattattacaattcaaggtgagaatatgggtggggacacagccaaaccatatcactaaatgttctgagtacttaccagaatcattctctccggaagcttccttctaactgtgctctctcctctcttcctttcaagaaggtagtttaggtcctgggataaaaacaaaagacaaacaagtgacataatactagctccagaaactgtgatagcatattttatttccatcacctcaatcccctcaggaagtacagaaaactcacagagagcattgaagaagtaaagaagttatgcaacgtgcccaaggtcacacagtgcttggtacccatgtttgactcaatcttaagtccatgcttttgtcatgccactgcttttcctctggatcacgtgggttggagtaatattaaacatgtttaacaagtgatcttacagacagcaaccaacagctcgtacatcatagagatgtttactagctgataatcagctttcacccttctagaagacccagtctacatacaagtacaagccacatttaatttcctacctgtattctcataaattagtcgaactgagtcaccttcctaaactctggataccctccttataataatcttggagatttaagattatagcaaacaggtaaatgagtttataaaatgttcaaggcaccagcagtgttactgtgcttcagggtagagtcagggaaattagaccaggtgccagctaagagtaaagggagaaagcccagagtatgattctggatcactgacaactgatgctgtgggctgaggaagggaaaggtgcagaagggtgaaagtgggtggagtttggtaccaagtctgagcagaaactacacattaggactgcaaaggagatcagtaaaagccagatgatccctttttccatctctagatcttctagaagtaaatttcacacagttaaggctcattaagtgctcctagacaagctctttgcaacagggcttcctggggagtccagacaaattactgtttcctttgaccaaagcagcctgaaagcaggttggacctctttattagaatgaacttaggtacttaaattctcctttccctttcagagcacataggatttttctgaccataactaaagtgcaaaggtttaaaatactaataattccaagaaaggaaacattggaaaccaattagtaaggatatccatctaaatgaccagaaagatattttccactgtttggctagaaggagaggaaaaaggcgtgctgaccacttggtttctgaagcaccagaggggtcaccaatgtgaggaaaaggataagagaggggaatcttagagcaaagatcaactttaaccacctccttttcagtttaagtctccaaattcccctgtcaaagaatactcagtcgacaaagagaagctgtaccaaaaactgtttcatccataatcagctgtgcccagaaacagctgatgcagggagtgaggtgcattagcagaaagtcaggtcaagccccaagcaaaagtgatggttggtgagcccagggtctctttgaggagactccagcctgaacctcccattatctgccctccctctttgctccattagaaataatcactcctaagtggcccattatcaatgccagcatgattttttcacatttgctaaaagcttttccctttttcttttgtttctaaggaactattttaattccctctcccctttattttgcagttaactgacttgaaaaatatctgatttgaaatggggcttacagaccaatttcttctttccttcagtacatcccacgacccattccccaccccctagcacctagtaacagccatcgcatatgcattaaacaaaagacccattagtggagcattgttttgcacttctgcagacaaagaagaaagagacctccagttagaatgaactctttttgtatttctttctttttctttttttttttttttttggcaacaaatagctttcttttaaattcagaaatgaaatggaattgagaccctaaattgctctcatctaaaatgtttcactctcatcttcactttcctagattatgatcaattttccccagaatgaataattcaaattgagcccagtcttctgaatccttagaaaaaacaatgccttagcattttgggtctattctactcacttatcacttggcacattttgtctggtactggcagatattctttttgtaacatataatttatttttccaaatggactacaagcttctgaagattaaagaccatttcattcattcattcattcattcaacaaatgtatttgagctcttaccatgtgttagacatgtgctaatcacttgcaatacagccaagaactaatcagacaaaaatccctgcctccctggagtttatattctagtggagggagacagagaataagaaatcagtgtcataaatatgtaaattgtagagtatgttagaaggcgataagtgcaacagaaaaaaatagagcaatgcaagaggaatctgaagcttaagggagggctacaattttaaatagggtggtcatgggggatgagagagtaagccatgtggataaacagaagaacattccaggcaaaggatatacattaaagtgagaacttaaaaaatggagttgccatcagctgactgggaaggctgtgtttggatatgttaagttttgggtgcctactaacgtctcactggagatctgatggagtaggcagttggatataggtgtctgaagatccagtagggtctgggatgaactattcatttgagagtagttttaaaaacatgaaattggatgagatcatcacagaagtgagtataaacaaagaagactcggagatgacaggaaatgatctctaagataagaagaaaactaaaaatgtggggtaccctgaaagtcaagtgaagaaatcatgacaaagaagcagagaataatactgctggtatgtcatgtaaatgaaggctgaaaattggctgtggaatttagcaatctggaggtcattggcaatcttgccaagaaaagtttccgtggagtgatggaggttaaaacttgattagagtgagcttaagtgagaatgcaaggtgcagtccaccagatgtttgtgttccccctaaattcatattgaaactctcatcccagtgttattgcacttagagatggggcctttgggaagtaattaggtcatgaaggtggagccctcatgaatggaattagtgtccttaccataagaggccagagagctagctcactctccttctatctgtgaggatacaaaaaggtggccctccacaactaagaagaagattctcaatagaacctgatgatacgggcatcctgacttcaaactttcagcctctagaactgtaggaaatatctgttgtgtataagccatccagtctatggtactttgttataccagcctgaactaattaaggcgggggcaaggatttgatgattatatatacagacaacaatttttagaatattttctacaaagaaaagcagagaaatgaagtgatagatggcaggggaattggtgtcaagataaaacttaattaaaattaaataaataacagtatgtttatattctgctgggaataaatcaggagagaaggaagacttaataatgcagtattgagagaattgtgaccaactgtaacaatacaaaggaaatgttattttttatagcaggtagcaaagcggtttcctcaaaggagagaccctatttgtgatttctttcataagcctgcttagtggataggcctccaggacttctttgtcagctggtgcttaagcttgaggagttgaaatgcgtttgtgtttgccataggaaagaggaagagaactggacaaggcatgaggggaagaagactacatatcacgtagccaagaagacagatgtggggagtgcattgtgacttgtgatataaaccttctcctctgtctctctatcttttcaccaaaatctacacttgtagttttgctaatggaaaatgtcaagacgtgctgaaagttgccttgaggttgtaaacagatttaaagagtgaaagtagagcctgcccatggaaggacaagtcatgggggttacagagtggactctctctgacagacttctgttattattgcttgccccaggcagctctcacttattttgtatcaaattatcccctcagaacgtcatacctgtctcattctacaaagtcttccctggcaacacacactctagactcctaacttacttagctacctggtcttgacctttggagctgtcatcctatgcctatataatggcccagcctctgcttactcctcacccccaccctgcgccctcactccccaccacctgatctctcactaccatgtttcctccttgatcaatgccaggcaaagtgaactatttgcagttccccaaactcgtcatgctgtctcattactaacgtctttgtgcattaagttccctctgcctgagtatttttctactctttcaagagtcaagccctcctctttgctgatttaactcagagtcctttaaaattttgtctaaaacatctttattttctttctttcttttttttttcctcacttgttgcccaggctggagtacagtggcactatctcagctcactgaaatctccacttcctaggttcaagcaattctgcctcagcctcctgagtagctgggattacagttgcctgccaccacgcctggctaaatttttgtagttttagtagagatggggtttcactatgttggccaggctggtctcaaacacctgacctcaggtgaaccacctgcctcggcctttcaaagagctaggattgcaggcatgagccactgcacctggcaatttaaatatctttctagtggaaaattataccggcttatgcacttctctcatggtaatacttttcataatgtaccacaactgatggtttattttctgtctcctcgtttaaactgtgaggtctctatcatcctggtattctttgtacctaggatagcatctacttcacagtagctgcctaataaatatttgctgaaaactgaataaacatctaatgtcaaaagttgtgaataccaggtaacttagcataagccttgaccccatatgagtggggcttagagttcatctgctgctctaaaatcaaggtcattgtatctagtagtgaccccctggtactcacaactatataaagatacaactgggatcgtgatgtttgttcctattttattttactttttttccccagtcctgtattagaactagaagctgattggtcctgaatcacaacgaatttgactggagtcctatccttcagattagttcttctgatgtctgcttctatacttccagctaatagagcctttcccaaggtcaggtagttggcctacattctctagagcctgaatggctaggagactgaggttgcacagcatctgctgctatttgactcttttctccctactcctctccccattctgtaatatgttcaataccagcaccagtctgtaataaggcaaattttatgactggatttaggatcccatttgggaagaagtattactgtactattgcattggttttctatctcaactaggctacttccaacttacacttcacccgtgtcccacccacccaagatgtcaggtacatctcacagctgagacctgggttattgttccactttaacctctatgccagatgtctacctgctgaaccattttgcatgctcaacccactctcctatccacctctgctctgaaatctttcccaattcccactcttcatcttgcatgtactactctcagctcttccttgtgttaacaacttagtgtcttttactgaaattaaaaattttgtcaggaagtttgcagatgacatatatatggggattgagtgtcctggtacaactaactttgacctttgaatactataaaactatagctgtggaactttgtatgacaaatcagtgattcttctagttctggttcccaaatgactaataaaaagttaacaattttccacatttctctgattttaaggtactcatttaatactcattcctatccctaaagctcaagttcataggtttcctccaactgtctaggaagattaaatcacatgtgtaaatgtgataagagtattttaggtttgaacacatggattgcagaatttgtatgctggccagaatttctggtggagtaagaattttttgtagaaatttattccacccatcatgtaaatggctaaattcttcttaaggcagatcattacctagatattttgacagatttggcaaaaagaaacaggacagcccaacctaattcaattaatcttaccacctattcttaagaacaattactcacaagaaaaatacagctgcaccaaagaataaaatccatacctgccacttattaaagtaattttcaatttgcttaagtctctgtgcctcattttcctgtacgaagaaaaaaaaccacttcctcgtagtaagttgtcataaatattatcaaatatcattctcaaaaatcctgagttgcattaaagcaaaaataaatcatgaatggtatatttttattttctttttaaaatgtagaataaaacacaatggaccatagacatgtacttagggtaccaaccagtggacatgacaagataacataatgttgatagggaataggagtagggaacaatgtataactatctaaatgtgcatgggaaggggtgctaactagccctagtttttaggagttccctacagaattacaaggaccactgcttaatatcagttatgagagaggctgtggtatgcatcagcttattgtttgggaagagcttagtatgagatggacccttctctcatcttattaggactgaaaaattaagttagttgatttacgggaaagtggtaaagatttgaaaagtgatagatatgataaatggcaggctgggcatggtggctcatgcccaaaatcccagcactttgggaggccaaggtgggtggatcacttgaggtcaggagtttgagaccagcttggccaaaatggggagaccccatctctactaaaaatatgaaaattagctgggtgtggtggcaggtgctcataatcccagctacttgggaggctgaggcaggagaatcgcttgaacctgggaggcagaggttgcagtgagctgagattgcaccattgtactccagcctgggtaacaagagagagactccatccaaaaaaaaaaaaaagaaaaaagaaatgataaatgacaataagaaaggcataagagaaaaatattcaagacaatagcaatgaagaaaatatttaaatgttctaaaaatattttggaataggtgtttagaaattaaaaaaaatgatttatgcttaaatacaaggctagacttttcatttcagcaaataggataattctactgcccaaacatataggtagataatattcaacctttaccacaaatttagtagccattgtcattgttaagggcaacagtaaagtattttggaaacatttggaatttaaatcgccctttgatagttaaactgtgaaattaacacataatgaatatctatgaaaagttgcaaagctaccttaaaaaacacagaaagcttcccagttaaggctgtattacatctttactgaaggtaccaatataaccaaagaaagaagaaagaaaatgtccatcagaaagaggacttaagtcagacatttaagtttcttaaaagcagaggcttgcagaggaaaccaaacacaacacttctccaaaaattgttaacgggaaatagatccttaacatttactaccaataaggccagttatattgcactctggaggcaaagactaagtactatatttggagaaagacttccagggtttaaatctggctttgccatttaatagccatgggcctttcaaaataatatcccagatatcagtgttttaacttcatctgcaggtggggctgacaatatttcttcttcatagagttcatgtggataaaatacacactatcaataaatgttatctatgattattacatttactgagtgatattgataggctttgtgtcctcacccaaatctcatcttgaattgtaatctccttaattctcatgtgtctgggcagagacctggtggaaggggtactttgccttatggtgttcttgtgatagtgagttctcacaagatctgacatttttacaaggggctcttccccctttgctcctcacacttctctgtcctgccgccatgtaagatgtgcctcttttccttccaacatgattgtaagtttcctgaggcctcctcagccatggggaacttaaagtcaattaaacctctttcctttataaattacgcagtcttgggtggtatctttatagcagtgtgagaacagactgatacattgagccaattccctttgccctgatttcaaattaacattaagcaaccttcagattatgatatggtttcttgtataactcaagaaagcaatggccaatttgagtattggcacgcctggaacaggttttgtatttttattataaattaatggattgaatttctcctgttatattccagtcttatgatcttgattattatgagtctattatgttagcaatgtggcatatgtttgatagcaacccaaaggtcttttgagctaatgtcaagattcaaaaattcaacacaggttgcctcagttaagggtgtaaatttttttttcataagaaattctatttccagggaaataaataatagagaatgcatatagatacatggtagggcatcagtcaaatctaggatgagggggagtatagagagaattatccctgttcttctttcacttatgctgatagaggctaaaatgcaagataatctcctttctattagtaacttggactatttcaatataccctagtttaccaacccatccttagatatgcaaccaaagtgatctcttttttaaaatttattaatttatttattttattatactttaagttctgggatacatgtgcagaatatgtaggtttgttaaataggtatacacaagccatggtggtttgctgcatccatcaacccattgtctacatgaggtacttctcctaatactatccctcccctagtccctcacccccaacagaccctggtgtgtgatgttctccctctgtgtccatgtgttcttattgttcaactcccacttatgactaagaacatgcagtgtttggtattctgttcttgtgttagtttgctgagaatgatggtttccagcttcatccttgtcccagcaaagaacatgaactcatccttttttatggctgcatagtattccgtagtgtgtatgtgccacattctctttatccagtctatcattgatgggcatttgggttggttccaagtcttagctattgtgaatagtgccacaataaacatacgtgtgcatgtgtctttatagtagaatgatttataatcctttgggtatatactcagtagtgggattgctggatcaaatggttatttctgtttcttgatccttgaggaatcaccactctgtcttccaccaacagtgtaaaagcattgctatttcccacatcctctccagcatctgtcatttcctgactttttaatgatctccattctaactggcatgagatggtatctcactgtggttttgatttgcatttctctaatgaacagtgatgatgagctttttttcatatatttgttggctgcaaaaatatcttcttttgagaagtgtctgttcatatcctttgcccattttttgatgaggttgtttgctttttcctgcaaatttgtttaacttccttgtagattctggatattagccctttgtcagatagatagatagcaaaaattttctcccattctataggttgcctgttcactctgattatagtttctgtttctgggcagaagctgtttagtttaattagatcccatttgtcaattttggcttttgttgccattgcttttggtgttttagacatgaagtctttgctctgaatcatattgcctaggttttcttctaaggtttttatggttttaaatcttatgtttaagtctttaatccatcttgagttaattttgtataaagaataaggaagggatccagattcagttttctgcatatgaccagccggttttcccaacaccatttattaaatagggaatcctttccttactgcttgttttttgtcaggtttgtccagatagttgcttgcagatgtgtgatgttatttctgaggcctcgttctgttccattggtctgtatatctgttttggtaccagtaccgtgctcttttggttactgtagccttttagtatagtttgaagtcaggtagcagtatgccatcagctttgttctttttgcttacattttaatattgttatgtgtgaatttgatctcgtcattatgatgttagctggttattttgcccattagttgatgcactttcttcatagtgtcgatggtctttacaatttgttatgttcttgcagtagctggtactagtttttcctttccatatttagtgcttccttcaggagctcttgtaagacaggcctagtggtgacaaaatgtctcagcatttgcttgtctgtaaaggattttatttctcttttgcttatgaagtttagtttggctggatatgaaattctggatgaaaattcttttctttaagaatgctgaatattggcccccactctcttctggcttgtagggcttctgaagagagatacactgttagtctgatgggctttcctttgtgggtaaccagatctttctctctggctgcccttaacattttttccttcatttcaaccttggtgaatctgacgattatgtgtctttggggttgctcttctcgaagagtatctttgtggtgttctctgtgtttcctgaatttgaatgttggcctctcttgctaggttggggaagttctccttgataatatcctgaagaatattttccaacttggttccattctccccatcactttcagacacactaatcaaacataagtttggttttctcacattgttccatatttcttggaggctttgttcattccttttcattcttttttctctaatcttgtcttcacatttttttttattaagttgatcttcaatctctgatatcatttcttccacttgtttgattcagctattgatacttgtgtatgcttcatgaaattctcgtgctgtgtttttcagctccatcaggtcatttatgttcttttctaaactggttattctaattagcaattcctctaacctttttttaaggttcttagtttccttgcattgggttagaacatgctcctttagatcggaggagtttgttattacccaccttctgaagcctacttctgtcaattcatcaaactcattctcttccagttttattcccttgctggtgaggagttgtgatcctttgcgggagaagagacatcctggtatttggaattttcagcatttttgtgctggtttttccttatcttagatgatttatctacctttggtgtctgatgttggtgaccttctgatggagtttttgtgtggacctcctttttgtcaatgttgatgccattcctttctgtttgttagttttccttctaacagtcaggcccctctgctgcaggtcttctggagtttgctggaggtccactccagaccctttttgcttgggtgtcaccagtggaggctgcagaacagtaaagattgctgccagttcattcctctggaagcttcatcccagatgggcatctgccagatgccagctggagctctcctgtatgaggtgtctgttgaccgctgctgggaggtgtctcccagtcaggaggcatggggatcagggacccacttgaggaggcattctgttccttagcagagctcgaatgctatgctgggagatctgctgctctcttcagagccagcaggcaggaatgtttaagtctgctgaatctgtgcccacagctgccccttccctcaggtgctctgtctaggaagacagatgttttatctataagccctgactggggctgctgcctttctttcagagatgccctgctcagagaggaggaatctagaggggcgatctggccactgtggctttgctgagctgcagtgggctccagccagttcaaacttctcagcggctttgtttacactgtgaggggaaaattgcctactcaagcctcagtaatagcagacgctcctcctgcccccaagctcaagcatcccaggttgacttcagatggctgtgctagcagcaagaatttcaagccagtggatcttagcttgctgggctcggtgggggtgagatacgctgagctagaccacttggctccctgacttcagcccccttgccaggggagtgaacggttctgtcttgctggcattgcaggtgtcactgtggtaagaaaaaacactcctgcagctagctcagtgtctgctcaaatggctgcccagttttgtgcttgaaacccagggccctggtggtgtaggaacctgaggaatctcctggtctggtggttgtgaagactgtgggaaaagcatagtatcttggctggaatgcacttttcctcacagcacagtctctcatggcttcccttggctaggggagggagttccccaaccccttgcacttcccgtgtgaggcgatgccccaccatgatttggcttgccctccgtggactgcacccactgtctaactagtcccaatgagatgagctgggtacctcagttggaaatgcagtgccttctgcattgatctctctgggagctgcagaccggagctgttcctattcggccatcttcccagttaccaaagtgatcttataacaagaaaatttgtttatatcattcttaatttcttcagtgatttcacagtgggcagggtaagtatttacctaactcacagaatactccagcttcctcaccctcagaggtaaggcccaggcagtaatgttcatacattaaagtaaatctatgcccctggctgcagttgattataccaagggttaaaacagctgggccaattatattctttcttctagaaatttggaattgtgatgaagaaagattagtctcttccaattgctggactcagtagttgaatgatggctatgtcttctgtgtgaactgtgaagcagagaaagctggtctagttagaaagaaaataatgaaacagaaacactaagaagaacagaagtgaaagaaggtgacatcttcataggctcgcttctccttgtttctgtttctaaggacttactgaattgccacacttgagtttcaagaaactgcctagatttttctgtttaagtcaaattattttttagcttaatcctgaattatgttttaactgattgcaactatgaaactccttctcttggaaagtgcagtctaacatgatacccttcataagtgttttttaccagctactggtcagcctcaccttctactgtcacagcttctgcttgattccccatctctccaccaaacaccacagaagacattttaactttttatgttctcataccatggtgttttctatatgctattttctatttctacagtaatcacccatccttgtccacttgctaaatggttacccattctgaacacttctatcgtgctttggagattctcacattattgtacataagtcattgaagaaaaatgatttgcatatctgtctcaccaccaccaccctataatctcacaggtggtgaacatataccatttatattttttaatttcacttctgtattctcaattcaaaatacacaatatgtgctgtcatgtattcctgatacatttacatcttttaatcattcataagataacatgtatgttcaataagcacaactactaaagactttggggttgatgatattatttctgggacaagaagataaaataaaacctgagattctaaagagttacgttctacttggcattcccaccaggacataaaagttctgataattgttagtcatgagcccagcaacataaaacatcataagctctttcatcaatgtcaacgttaaatcatatttgatgtattaagtgccagtataaaaccaataacagcagcatcctgggacatagccagaataagagctgtgaaggatcatttgccgttcataactgcattgacttgagcacaagtggggattaaagaacagcaggctacctaatcagccactgtctggagagctgaagttgggttatcacaagctgagagggcagtgagagcgacagtaagacaggtgtacatctgaacaggttgtcaggagacaaaagtgcctgtgaagtggccatcagaattgaacaatgaagtgtgttggtcccactgagggtgagtcagtcacaccgccaggatagcagatgatgaagtatggtgaagtaggagaagaaatatacaggagaagaaatatacaggatgctcctggattatgcttgttgtctttgtttaattattaagcaactacctctgtgtcttcttttaaaaagatgcccgtttggtgaaaaataagagtgactgattataaacaaccattaaatcaaaatattaccaaattctgcacacagaccaaagttacaataatcctgttaaagagtttctaaaacattgctgtgatgcatttctgggttgtgtttgtgtaggtgtctgtgtgcccagaatccctttgagggaatcttcgcagtccatgtagttcaggcgaggctgcttcagtcacccactgatgccattcggtaggcatctaacctaactgcaactctctactcccaccaaatcacaccagtctgggacagaggccttcctaggatactgacagaacttttgaggaaaatatctttttatgagtgtgaaattctgattgtcatctgtgttataaaatgggaaaaagggaaggagtaattaaggtaacagaggaaaagagaacagagaaacaaagaattccttgtttcaaccatgcctggagtttattctcagttatgggagacaatgagttacctttttgctcagtgtagtgtgaattgggcctgcacatattaccaagatagtcctgacaaatacaactgctttttcactaaactgtccaactttttatctgccccatctcattataccaaatataagcccatgtgcagcagctgtacaaacaggacaaaaaagaaatagataataggatgggtctaggctttggtcagcaaagaactaagccactgtccatgactggtgctccagcaagcacagctcttatatcagtcgctaatgtgcttatttctctcacgattgagatgcaagcaaattttaatagcaataagcaaagagatagaattaaaatgcaacattaattttactggcttctcacaaactgaaatattctgaagagaaaattgaaattagcatatactgagcttagaccctaaagtgttagaagccaaaaggttttagccttggcatggccaaaagcactgcttactttttgataatggcataattgctttttttcatatcagtgaaagcagaaacagaagcagcatattgactttataagtcataatcaggctggcagcctgtattagtctgttcccacactgctaataaagacatacccaagactgggccatttctaaagagaaagaggtttaatggactcacagatgactggggaggcctcacaatcatggtagaaggttaaggaggagcaaaggcacatcttacatggtggcaggcaagagaggatgctcaagggaacagcccttttataaaaaacaacaacaaaaaatcagttcttgtgagacttactaacatgagaacagtatagaaaaacccacccccatgattcaattacctcccactgggcccctcgcatggcatgtggagatcaggaaagctacaattctggatgagatttgcgtggggacacagctaaatatcttagcccttgccttccttaacatttctctgctggaatcacagatacactccatataacacctcagtttagccctggctatgaccaggtaggtgctccttggcattgttatagggctagtcttgcatattgggcccagcctcaatcatatgatgggagttctggcactctctgtccacttcattttccttaaccctactgcttcccccatccagaacctgaaacttctggttatatctaagacaccacctagtaggactgcattctgttctccatgctgtttactatacaattttctatgaaaagactggttgtttggaatcacagtaactccctccacctggccaagagaagcacagccactgtcatagtgtatgtctgctttggagttcattgtatattgagtcaaatctaaaattttatattctagtagacactgaatatggtttcacctaggtgatttcatgtgtttaatactgcatcaaaacatccttggcaagttcctgccttctttattcccacctttctgtcactaagttctctatattttaaaaataaaccttaaaggttatgaattgctgttggatatacaaatatataggagcaatactagttaggaggcttttgttagaatccatttgagagactatgttagtttagtccagtatgttagaagaggtaagagttggtcattttctaggtatttttgaaggtagatctgatgggattttctaaaatgttggatatgggttgtgccagaaagaatgccatcaaaggtgacacctctattttttatttgagtaactggaaaggtgagttgctgttatcctacttagagatgattgagggaggagcagctttggagggtacagagatggagaactagtttgggaatactgtttgtagtatctattaatcatcaaaatagagacgtagcattatttaggcaccctgaaggccaccctcactttaacaccagctgaaaagttcaagggcctccaaggccaccttcacttctgacaccagttgcaatttcaggggtcccaaagattactctcaagtttgataatttgctagaatgagtcacagagtggactgaaagctgttatactcatggatacaatttatagcagcaaaacaatgtaggttaaaattggccaacggaaggagtgcatagggaagagtccaggagaggtccgtgcccagacttttcagttgttctttcccagtggatttgtggacagtgctcacttcttcaggcaatgacctgtaacaatgtgcatgtagtattgccaactaggcaagctcactagagcttgaatgtcttaagtgtttattagggtttaatcatgtagacatgactggccacccacttggctgacctgtagtctccaacccctccagaacttgagctgatgccacatagctcaaagcctctaccatgaatcacattgtttgactaatcacattgttagcccaaggtgcccaaataaacaaaagcactcttgttagataggacatgccaaaggcttagagagtgtctcccaggagctaatggcaaaggccggatctctctttaggtaaaattaattctttattacacagatgccaaatagaaaagtgaatttaaaagtctagagtttgagaaagtggactggtaagagatatgccagcgtacagacagtgtattagagtcctagcagaaagtaaaattcacttagatggttttaatgaaaacattttgataaagataccccttacaggactgcaggcaagattttgagatcaagtagggcctgttgagacacatatataccatcctgggatccaaaggaaaagcagttaacagaaccgatgaaaagggttaacatgtgccaagcacagtgctaagtgatttgttcatttgatttttcctatatggtaataattattattatcaaatgcttataagggagaaaactaaagtttaaaacatttaaatacctttgtctatatttgttcaggagagagttaatgacctgggattcagcctgaatctgcctgccacgggctgccatgccacttatatgattctaaaatttgacattgttatgccacatataagatcatcctgtgggtttcagccgctctccatgacttacctacaaaagggtgtctagttagtgactctcccacttaggctttcctgagaggcttctgctttgctagatcagggttgtgagcatttctggtatggaagtttacaaatgggagtggagtagaaaaaacaaaaacataatggccgaattctcctgtggaaggaagttagggaagaggtaaactagacttccaggaaaacagaagcaaaggaagtatgtatgtgtatgattctaagtgtgtacacacatacacatgtacatgtattaagtgtcaaagtgtgttttcaggatttgggtgtgtttgagaagagaaaaaaatacaggattttagttgcaactgactataaatttgtacacttttaaaatgttttcatgggattgtaaaggtctgaattcctgctggaattctatttatttgaatgtatcatggttcaaggttatcaagtgtgtcctggcttcgaagagaacatagtgcctagaatgtatcatctatactgtattattattatgatttttgttacaaagcgtggaagggctttgccattaataaaacaatataatggatatgatttaatatcattaaaaataatcaagagattttaatatggggataaccattatataatcccaccatgcctatcccaccacctgggtcagatcccgtattgaaacatgcccctagacacagaactggactcagaaagattcttggcacagtgcttcatttagctacaaataatcaattatccctgacatgcaagttaaaactcatttgccacttggtttataatgtatcaagctaaaatgttttaacatgttctgggtcttcaatttactaggttatatcataattttaaaataaagaaaatttcaaagaaagaaggcaatatctctgtaaaattagcattcagacttgagtatgtcccaaggagactagccctccaattctattttgtatagctttcttttcctcctctgagaaggtgaaaaactctttgaagatttcctttcatttccttttctcttctctcttatttctctaagccccaattatctctgttttcaatgttctctgtacagaaaaaatccgcatcaccacccacctccagaaggagagaatggctgataaaaaattggagattggattttgtttcagtgccaatctactacttgtgtcaaaccattttaaattttctcattatagttagctctcttctctatttttacagcattgccacacattacaaaatccatagctggtacatatgcactatttagttagctttaaaacatttctgtagcccacatacattctaataaaattaattctttgaaaggccatactttggcttctgaataaattattatcttttctcaactgaaaaaaaaagatgatgatgaaacatggaatatagatgaatcatttttgtgtagcttataatacaatgcattttgggttgagtctgagcttgcataaagactgactgaaatgataaataggcctgatgattaagccaggtggcaaatcactagtttgtgtagctgccaaaatggatacctgggtatgggaggaaacctgggactcccttcctggggatagggtagtcgaggcctgccgtagaagtggtgtgattaatctctttagaagagagtgccagctgcagtgtgcataaatgtctcctcctggattctccttaaaagctaaattgatgacagtctcttaaaagagcagctcagccctctgtccctgtaagataaagacaaaccttgatttcagctactactgaaataagtaaaagtagaaaaaggttaaaaaaaaataacagtactgtactcttagtgaaggaattagaggtaatagaatgttactcatctaccaaaatataaggataattgcaatgtggtacccttttttgttagaaggttttgtggagcccatctgtgcagattgtttgttttttactatcattacatcaattaattacattagggaagaaggggacactttaattaaaaggctgttttaaggagttataattctactctgtcattaaataatttaacaatttaaataggcaccaaatttgttagtaaagaataattctgaaaatgtttgtttgtaaattatttatattaaccacattttcagcaaaattaattttgcctttttatttcatcaaatcaaagcgtccattgatttcttcattttgaccaatggactgtaggataggaagacatataaaccatctcaattattttgagagacttattttttcctaaaagagaaaaacctctcattttaccaagtatgcatatttgcttgtgtgtgatatgtctgattagggtaatcttttctgcaattggcatttttagaacatgatgagttgcaaagagaagacatggctggtgaaaagatggatatagacccacagaaataaatatatagccaataatgtaatttaaaaacattgctgctacttaagtccatacttctttggataaaaaccttcatccacataagttatactacaggaatgcctttgtgtatttcacataaaatgggtggataaacatctattttttggatgtcttgaatgcatctttctttttgtcaaccatcttccatttttctagagtgtgctaaataatggaattcagagacttgtatctaaatgtcagggaataaggaaagcaaaggattaagaatgaaaataaatatggaaatatgagaaataatatcatgggacagaacaagagaggcttagaagctaagagaagattctaagcaactcctggtgcaggagttgatggaaagtgagaatttaaaaataatgattctgcattctgtatttaaactgttctctagactgtttctgtctgattgaaatagtaagccattttttttaaaacattgaatgtgaaaagcattatagaaactgcttttgtacttaaaaaaaatgccagagtcaaactgtatctcatgcagttgaagactgaataagtaatattattccagtcattatatttatctaggatcagtgtcttacacatagtggatgtgcaaaaaatatatgtggaatgaatgaatgaagataacattttactcaaatttttaagtaggagacggcaggtcctactagtagtgaggtttttatctttttttcactcttcaatgttattccccagggaaactggcaaactgaaatctgttacattaatgccagcagagatgtatgagtgtgaagagaataagtaaacatttattgtacctgatggctcaatggactatcaacatgagctcttaagagacttgaaaatacttggcagtgtttatccttaggatgaactctacaaaaactatttgtggacattattttcagaaaatttctattttggggtcagctgagctttttcaattcaaaacttatgagctaatatgtaactatataacgcctttcctttggcaatgagttaatttcttaatgttttttaattctaatgttaggttttctatctaaatcagtgtcaaaatatcatccaaaaatagagatagtagctagtacatttttaatacaatattttcccatgttacccaatataaacataatgacaaacagccatttactgagagtctaatatatgccagtttatttttcagagttttacatgttaaaccatagatgattttaccttcttatagagaaaaatatatcaaagctgagagtaacatagtgccttgcacaaagccacacggattgtaaaattttgaactgagattcaaacccaacaccccagctataatagactaaatcccccaaatttacatttgacgctcacaaaatcttgtgaggtaagtagggcaaaagcaatttttattttctttattcacctagggttgttatttgattattctgcatttatggaaataattttgtgagaatgatagaaatttaaaatgggaacaatttaggggtaatctaaattagcaattcttagacattttcgttttagtaccactttacatccttaataattattgaataactctaaaagtatttgaaatatgtgctatattccttgataccatattagcaataaaaattggaacattaaattcattattagttatttaataacaatagtaaactacctcttcacataaatattatatttttatgataagtacctagatgttccaaaacaaaaaaaaagtgagaagggtagcattattttatatacttataagtctctttactatttagtttaatgggaggcagctagattttcacatctgcttcctcattcaatctgttgtaacatcacatgtcctgtaacgtctggaacactccactgcacatgtgtgagagaatggaagttaaaaaaacaaagaagggctgggcacggtggctcacgactgtaatcccagcactttgggaggccaaggcgggtggatcgtgaggtcaggagttcgagaccagtctggccaacagggtgaaaccccatctctactaaaaatacaaaaattatccgggtgtgatggtgggcacctgtaatcccagctactcgggaggctgaggcaggagaattgtttgaacccaggaggcggaggttgtagtgagccaagatcgcgcaattgcactccagcctgggtgagagtctgagactatatcaaaaacaacaacaaaaactacttagtattatttaaaaatagctagacttcagggacccttctgaagggtacaggtgtctgtggagccacttcgagagctgctgatctagataaaactttcatttagaagacatggaaattaaggtgtctcatggatctgctactgatgatcgattagagaggggctgatactttcctacaagggtattagatatggctaggatggatgctcaaactatcttatggaaatatatgaaggtgattttgagtggcggtttgtattttacctccctcccactgatgacacaacaaccaacccgcacaacccttctgaaactacccttgcctggaacagcaatgatcttgttaaattcaataatcattttttaaaaagtgcttactgagatttgtttgttagcaacccttgacatggctgatcactcccttcattttgactcaattgtatggtcctcccatgatctcacactcagtgaaagcaccctctctctccagatgcccaaccagaagtcagaaacttcccagactctgatctcttcctcaccaagtgatctcaatcatcttttcttataaatatctcagtattccatccacattttttctgcctgatattttgccctgactatgcatcttacctctcttacattatcactactatcttctaacgatttgattttattccttatttttatgtgtttttttttccaaattttattttagtttccaggtgtacatgtgcaggtttgttacatgggtaaattttgtgttgtgggggtttggtgtacacataattttgtcacccaagtaatcagcataataccaataggcagtttttcagtcattagttcacttcaaataatgaactccagctctgtctgtgttgttgcaaaggccatggtctcatttttatggctgtgtagcattccatggtgtatatgtaccacattttctggtatctaggttgatttcacatctttactatcatgaatagtgctgcgatgaacatacacatgcatgttttttaatggtagagttatattcctttgggtatatcccattaatgggattgctgagttgaatggtgttttaaattctttaagaaatctccagactgctttccagagtggctgaactaatttacattcccaccttttctccacaacttcaccagcatgttactttttgactttttaataatagtcattctgaatggaaaatatttgcacactatatctctgacaaaggtctcatttccagaatctacaaggaactcaagtccgcaagcaaaaaataatcaacctcatttaaaaatgggcaaaagacatgaaaagacacttccaaaagaagacatatatgtggccaacaaacatatgaaccaatgctcaatatcactaatcattagggaaatgcaaattaaaaccacaatgagataccatctcacactagccagcatgggttttattaaaaatccaactatttctttccccggttcttctcatcggtcctccataatctgagcaattcttttgaactacagattccaagtgggcacttttcacagctcttaggttaaagccccaattctttcaagtattttacaaaagcttctgaagcagccccgtgcttgcatctacagctgggcttgtcactgattcttctttgcttcataagattctctgacctgctccctcacttccatgacagtatataaaaactgtttattcttctatatgcattcctttgactctttctctttttattcatgtattaacttggatgtcacctcctttggaataatttcccctgagtcctcccactctgagttagattatcctgtatatgattcctcaatgatgtgttctttccaaccaaaatattatttgccagtcttcatttgtagttacttgcttaatatcattttcccctgtatacttttagtattgtatgcacagaaacttcatctgattttgtctttctatagtgaaagaataaccccattaaaaaatgggcaaaggacatgaaaagacacttctcagaattgttctacccaatgttgagaacaatgttggacttacagtaagaagattataagtcatacacatttgttagatgcattattaaatgaatattttttctcttttttctgcagttagttgtatttatggttttctgactcacctttatgaagttgagaatcttgctttgaattaattattttattgtcctgctagtataatatagttactatcctgtatgactgctatgccaaagtggttcaaagactggctctcgtatgacacctaaaaccaggtgaaaccaggcctatatttggaaatttgcctcattcttttatgaccaagaaggtcatctgggaagattggttaaaatatgcatgcatgagttctaccctctgaagattctaaattggttgtttagattgtaagcagctccacagattactgccacacctttcaaagtgtaggaactactgacttactgcaagaatactctggtttatttataaaaagtagttaaagagttaccttgtaaaatgtactctaatttagtagcagagcactcccatgttcaaagaaatatatagttttctgaatgtatagttttctgtacatatatgtttggaaggacgtcatagccgaacattaaactctagcaggtattacaagttcaagtacctatttttgtttctttacagctcaatgttaacacctgtactcattaaacacatcttacttctctagaacttattgtagtatgtttaatggatgcatttaatatcaatttttatgtagtatttatttaaatagcattagtaaatatttaactttgcaaaacaaaatgtggtaatactattttaccatgcaatttttgcagctgttatgtgtagaagctgttaggtgtagaagctgtataacttacagtgaagcaactttatggggccatgtgtttttaaaacaaaatataccaagtatatttgtgaattcacattttttattgttaattgatacataataattttgcatatttatggagtataatgtaatgttttgacatatgtatatatgtactgatgacattagagtaattagcatatccattaccttgaacatttatcatttatttgtgataagaacagacaaaatcttctagctattttgaagtaaataaaaccttattgttaactatagtaatccttctaagcaacaggacaccagcatttattcttcctttctaattgtaactttgtacccactgaccatcccctctccatccctctcttccctctaccctccatttatttttatttatatttactcctgttttcaaaaaggttaagtaacaggtatgtatacatacatacagacagtacatgtacgcacacgcgcacgcacacgcagacacacacacaccacacacacacacacacacacacactcgagaaacagagagaaggaaaaagagacagtttctgattatttacaaatattttgctttatcattgtttgtcatactgtattgatgaaggtagtttttcagggaaaatagaaatagatactagtatagagatgagatttttaaaagataagaagaaagagtagaaggagaaaagaaaattgcttcatttgatccaagctgcaatggaattggatgatctttttttcttttcacactcttttatatagtggatcttttgtgtcagctctttaatgtgtttcattacttgaagactgtataaaggaatacattcaataatttttctcttattttaaaatgcatcacagttatatgacttattggaaatatattcattaatgtgatatatttttaatttaattatcaggtacttctctaggagaatgcttactttacaaatgtgtgcaggtatatttactttttaatttaatgttgttaactagaaaacaatacaaaaattgttagcattattttttaaaataattatggttcaggctatttaaaatctattttattaaggaaagttatttcactgttacatatacaccaacttgagtttccaggttattcaccagaacattacatgttactgacgatgaaaaccaagtaaccaaagtttctaataatagggaatagttacataaattaggtgcgtgataaaacacagtgttcattaaaggcaatctagaataataatcactgacttacaaggccctctaaggcattatcacaaaacaattattaatgtaaaatacaatacaaacaaagctatgtgtgtacacgtgtaaacgcacagaacgtgttatggaaaaacagtatttcaagcctttaatagtgacagcctgcaggggagtagaactggggtataaagggaaactattttactctatgtctttttatacatttaagttatttatattaacttttagtcatgtgtttcttttataacttgaaaaatgtcttaaagaatttgagaaatgtttattttaacaaaaataacagaggatatggaattgttttgaaacaggaatttcaagttgcaccattaaatacacttatacatggtcaagaaaattatgcgttcttggccgtatcaaactatctcatgtagtttataatatacaaacctatgtaaccacaaaaattaaaatgaaataagaagaaaattatacattctaatgagtgttttctgattctttgccctactctattttttatctctaatattcttttttttttttccattttaattaaaggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggtaacctttaaattacttcaattcttgttttcttcataaacttgcacttacaatatgatcttcttttaaatcaaaatattattgttatgcaatcagttataataaccttgatgtaattttatgatagaaagtctgacaattgcttttaattaattgtcttaaaagaaaagtaatgtaaacattgatgatcttcaaaacgggttgttggaagtttggaggttattttcaaatgactgcaatgctgttggttaatgagatagttgattaatgagatagttatttctttttgttttgaaatgagggaaggaactaagagtcaaccagttgagcagctcactcattacaatcagccagtaggaaaaagatgtaatagatttaccatttacctgatatttactgtaagagactttatatatttgatcttatttcatcatcactacaacaaaaagaagtagggactatctctactttacagacaaactgagtcccaaaatgaacaagtaacttgaccaatgtcaagtagcaagaacatagcagagggattgatatccaacctaatgatgttaacaagtattcattccagaataaagcattgcctgacaaaaaccaaccaaccaaccaaacaaacaaacaaaaccttctaaatcaatcaaacaaaacaatttgtagctgtgaaatcttttagtattatgtcagcattattcagacctaacagcaaactggaaaacagaaattattatcagtccatatcttacagatgaaggaactgaagttgggagttaaatggccagaacaaggccctacacttactatgtagtagagcctggatttgaacacaaatttttggattttgtttcttaaactcttttatgcacactgagctgacacctttgtagcttggaactagtcagtcatttagaaacctctcatgtataggacaaaatatttctactggagagttacgcagattcagatgtcaaattatatcccattaaatataactgccaatagtaaatgcctgttatagcatggttaatttattaaacagatgtttatccaatattccaatataaatgttgattttcacagtaaaatatttactttgatttgaaaaattgctatagttttatctttggataatgaagcatatgagagtttttgggtttttttggcaacaaataaaacaacgcactaagattactactgaactctagagtcaagatttatttcacataattcccaaacaattcctgatcatggtttgaatacacaggcttggaaaagagacctttcctttactcctggagtgagtggcactaagctatttcagtgacagagctttggctgctttctctaggcttctagtaagtatgtaaatgatcagctgtcttttctctaaagaactaactctcactattttgctatctggaaggtgagaagcctgtcacctttaaatttgaacttgctttctgacttctattagatatatttattattttatacttgttttcttatgtgttctttgcaaacatgctttgtttgcaaaaggaaaacagaaataatagaatatttaaatacatataacagaaaaatgtaattttaacaaggtcagtagatgaaaaattagaaaataggtaaaatgagaatatgaaagttgagatgaatccagagcgacattattatacagtatgcatcctctgaggtcctataccagaagaccacaaatatggtggtgttatttttaactttgtctcacatttgaattttccagttattctagtaaccaagaagaaagtgaatagcttctaggaaattcagcagtgcatttaatagggtcctattttgtgatttgtgaaatttttctgagattcctgaacattcactgatgttggaactcctaagacatggtataggagttgaagagcaaaaatagatgagctttcagctagtctggcttcatccaagaatgaataataggactatgcagaaaaataaatggccttaatcagtttactcttgtgcgtttgtttgtgtaatttatttaatttatttatttaaactgattgagcttttactagttattgaacaacagtgaatttgaagttttcctgctagaaagctttaaaagtgagtggagcttgcggttgagtagatttcctctgaggcaagttgagtacactaattggcatgcatgcctccatagcagatgattctacctccatccagatttatcaaagaaaataccctagggcagagccaagatcctctgaagtaaaacctcacaaggacattctatcacagggaaaaaatagtaatcaggaacttcaaagtttagatcagagagtgtgaaataaaaacttttagcctggaaaaaatgtaaaagaaaatgctaataaaatcctacagtggtgtgaagtaaaataaagtaaaaattgaagaaatgtgtataggcccccctcatattgttgaccttgagcaatatgatttctggatcttacctgaaaaataaactggttgcatattatctgcctagataactgcatgtgttaattcatcatatagcatagcactacaccagcttaatgttggggtttctaataatattttgactttagaaaatttaatctgtagtatttcttttaggagagatgatatgacaaccgcttttatgttgaggcaattattatattatttgtgcataaaaacatactgattttattctctctaatatgtttgaagtgtgcatacaattcactcaaaagtagcagtaagacatgctataattaaaaccagatccagagcaagttatttaaaaaaaaattctactggaaattattaactaatcttttaagagagtattcctgttgttcattctttttgagtaaggttacaatgtaggtacttaatcaaaaataactactatttctacctccaattttgtttgtttgtttgtttgatggagtctggctctgtcgcccaggctaaagtgcaatggtgcgatctcggctcactgcaacctctaccttctgggttcaagcaattctctgcctcggcctcctgagtagccggtattacaggcagctgccaccacgcccagcgtattttttgtatttttagtagagacaggctttcaccatcttggccaggctggtcttgaaatcctgacctcgtgatccacctgccttggcctcccaaagtgctgggattacaggcatgagccaccgcgcctggcctcccagcgttttctacgtcatatatcacagcacattaactgatccttgttttcaaaatcaaaagctgagagaaggtcaatgaaagccagaaacagactccaattaccctcatagatttcttctcaaggtgatgaagaaaaacctgtagccattggaaatacatatgtcagaacaaatcatcttcttctccaccatctcctcaacaacttcccctacaccaaagcagaatttgatgcacttgcctgagacgtccatgttttcaaattttcaaggaaggaacaggcaaaaattttagaatgcatggagtcaaaaattgttctacaactttgagaatatgaaatataccactttagaaaatgacatagattccaaactccacattagagacctggagtccatgtttactcactgtctcactttgttggacagtttattcattcttttcatgtcctagtttccttacccataaaatgaacataatagtaggactgacttctagggtttttatgaggcttaaatatgtaatgtgcttagaatagtatctgacaaattttaagcattatataagtattatttttagttatacatctgaatcgttatttctttcaattacctttatctctagttctatacctacagagttgataaagtaaaaaaaattgccaagcataatattgagctgtcattgaatggtactggagatagggagccatctgaacatatccatcaggagcaatgaatgccttctacaaatatgatcttgtaaatttgtatttaataagggaaattctgtcttattttgcttgagatgaaattttaatccgaatattattggtttatataagtattacccactgaagaaatattatttggtaatttgatacctaaatttcctgtgctcaattctttgatgccacctttcattaaccaatgtttctccctttttaaatatatttgatacattccaaatttttcacaaatatctattccttcttaaagaattcatgttgcagaactacaaattctatcctacctaactggttaatgctgatttatgagcatgatgcttttcttatttttattttttatttttaattgttgtgggtacatagtaggtgtacatatttatgaggtatatgggatattttgatacaggcatacaacgtgtaataattacatcagggtaaatgggatatccatcacctcaagtatttatccctgttttttgtttgtttgttttgtaatggggtgttgctctgtcactgcagcctcgactttgggagctcacgtgaccctctcaacctcagcttctcgagtagttgggactaaaggcatgtgccaccatgcctggctatttttcttttctatttttttttttttttttgtagagatggggtcttgttatgttaccaaggctggtcttgggctcaaccagtcctcctgccttggtttcccgaagtccagggattacaggtgtgagacactgcacccagccagcatttatcctttatgttacaaacaatccatttatactcttttggttattttaaaatatacaattaaattattattgactatagtcaacctattgtgctatcaaatactagatcttattccttctattttttaacccattaatttctatatgcagaatgtagttgaggcagctacttcataaatgagtttttgtagttagtggcttttggaaggctattagatgtacctgagaataattgtttcctactaagaactcttcattcaactaaaaatgcattgttttttaattatccttgccaactgctgttcattgataagcagttatttcaaaagcattctcttatttttggagagaaaatgacatggacacttgttataactaaaagttctaacccaaaagtccttgtttttaagattgacagtctaaaattgatgaggactgtagaagagtgaaataaaacacagtaatttgtgactagtttattaataacaacaaaaacatttctttaattatatgtaatttttaaataagagtggtaatttacatttccttcattaatgctatggaaatgtctctaaagagctaaaataaatgcctgttggcattgtgttttgcagcacttttttcctaattcagtaatattgttcattaaaataaaatggtgttcctcattggagtatttgtagtgaagacgttacgaatgtaacaaattaagatgtgctaatttcaggttttgtgtcaaatttaatgccttctttaatgtgttaagccatagctttacaattgcaaacattcagctaatagcttttctatctagagaattgcttcagaaattccttcagtaaccactaatctttaactactgggaaaagatttagtttaacctaattgtatgtaacatgaatattgtaggttgattctttatcacatcctactatattttgttctcacttgaattactgacatactgtctttcctgaaatatgtaccttcagtaatttttttttttccttaggcattagctatgggaatgatgacagaatactatcattatatctttaccactctggtaagtacttcattaaaacaaaatgttctgaattttattattatgactttttcagatgaaaaataggttttttagtaagaagtattatgactgattcctttgtagttatattttaatttgataagactccaccaaaattattatcagagaggacaactcttaatagaagctgatgattttgaaataatatcatttcagatatcaattcaaaatattgcatatcttatttttatgttgctttagagaactttcagaatataatggatcttgaaattagtttcctgagaaatcagtgctttagaaaagcgcaaattcagccgggcacagtggctcatttctgtaatcccagcactttggtaggccggggcagaaggatcacctgaggtcaggaattcaagaacagcatgaccaatatggtgaaacccatctctactaaaaatacaaaaattagccgggcatggtggtgggtgcctgtagtcacagctactcgggagcctgagacaggagaattgcttggacctgggaggcggaggttgcagtgagccaacagtgccactgcactccagcctgggcgacagagctagactccatctagaaaaaaaaaaaaagaaaagaataagacaagaaaagcacaaattcttatgttatctcagctgtattcactttttgaaaatcagatgtattgaagctgtcctttcagtagattacattttctattctgcttttgcctgtatttagttagattttttaaaaagtcaatatactttaatttgccatcagcaaattgaatgttacctttatattttgttttcacatacccatcacacaattttcccttataatgtatgaaaatctgactttaacctgtatcaaacttactgttagctccattttgttatcaattcattatcctgacctttctttctctgtaaaacagctgtctctttactaattctttcttccacatgtcccaaatatgagtatctccaagtttggacttcatccaatcttattttctcttcaattattttcttcagaactggtttgtatttagagcctcagttaacatcttcgttcgaatgaggtctaaatgttctatgtaatatttatgaattactgtatactgtaaaacacttttaattgttgtgccattagataatttcaaaatatttaaactttagtgtcctctgaattgacgtctcttctgattatcttaaaaatttcaacttttgttgactcctgtatcaccaacaaaattttactgatttttcctttgtagtgtctctagcatctatcttctccattcccataacaaccagtctaaccaaagttttcttcattaacttgaaattcttccagttagtctccttgcttctagaagtcttgaagctgccagatcagattattaaaatttaattgattgcaatagcttcctgtgatgacaactcttacctccaaaggagattattcatgcagtaggatgtattttacttaaaaatagcaaagctggctctggcatatctctatattatttcctagcagacaactttttgcagcttgtaagaaacttagtggtgggggtggagaaggaagtgagagcattccctcatcagcaaattatatttcagtgctgttacaactcagcataagcgtaagattttggggaaatcaaaagtatctctcaatagggaaaataaatgaaacaactagtttaggatacatagaactcataggcctacatttgaaggccttttatactttgatcctaatcaaactttcccatttccttttgctactattctcctttaggaattctcatttatagctgaactgatgtggatcagtctcctgaataggttttatatcttctaatttttgtgtctccactcacactttgaattctctttttgtcaatcatcagcccggtctttctttaatggcagctgtaggggagaaaagatttcttttcctcacacttcatgaggttcaaggctgagatctctataacaaaagagaggttgacaagagaaacacctaaaaatgtatttaatataaattttatgtgacacaaaagccatcagaaatgaagactcaaagaaatgggaaaatctggattttttttttttttttgctttggtttgataaagagtagatagttatgtaggaaaattattggacaaagggaggttatgatctaatggcaataaatccagaaaacttagcaaggccaaattgttcagattcttcttgacctccaggtatagggctggatccctctggaatgagagtcttatgacctcctttctgtgggggtaggtcagagaattcttttatggtccacttcaggggagaaaggtgggataaggtcacagagtgaccttcctgcttctgtgtcttctcaatttcctatagccaagtaccatatttgggggtagcatgttctgagcctcatcacagctaagatcccatctgctctgtgaagtttttcttgaccatacaaattgaaaataacttgtcttgcttctgacttcttttgcatttatgatttctactcttttaccacttggcatatattgccatcctttatttattcacctctttcctatctccttggctagattgtaaacattaaaaaataaaaacctaaagattcctatgtttttcatagcacagactagagctcaggccaatgccagctgctttccactgaattgtattcttattatctagcctgtgtagctgtatgagtctgaggcaagctgttcacagaaccaatggcattaatcttgccttgattctcaatattgtccataagttcgagggttagctatgccaactagaaagagggcaaaactccacatgctggatgttttcatggtggcatccatttccatgatagctttggcctcatatctcctgggacaactaaagggcagagcaagaaagttcactatatacagactagaaagggcaacaggcataaagtgtttattggaaacttatagtgaagttcctaggtgtgagacatgagatgaaggaactgtattgtttctgcaaccaaaaaggctagtcttggccttagcatttttttcacacctttcatacagttttcattagttagaagctgtattttgtgacttgctttctaaaaacaacaatcaaacaaagaaacactgacaaaaaaaaaattaaaaacagcaataaccaggcgaggaagcaggacacagaaaaaattaaagcaaaatatgaacacataaaataagggcaagctatcctaaacagagagaagaaagctattgcaaatcttagatgtgagttgtagaagagcccattgtttcactggcggatttagaataaaatatatacatagatttttacatacggagcatgtatctctgcaatgccaaagcatgaggacagtctatttgaatcttggtgatttgtgatgtttaacgtcacttgacacaaaggtgttaagtgacctaaaaaaaacaaaaaaagtgactatttcagtaatacatgcctgtgaagatactctgtccataataacaacacaataacatttgtctttcaggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacggtatgaatacccacttaaagatcagtttgtgtgtttctaaatagtattgcatacatatgaacttctgggtttatatgcatacatataaacttcagtttaattgtttgacattaaaagcaaaatatcagagctacaatgcaaatacttgtattaacaatttttttaaatcaattttatatgaaaagcttatgcttccatccaagtatctcaaaaggcattacaactatcaccagggtactacaacataggaatttctgtaaagttaattagtgccctacatgggagaaatgagagactgaaagaagacatacatctggtagttatccttctgatcttacctatcaatatacgaatactcttcaacatgatgatttctggtatctggtgttatataaatgacttatgtcacacaaaacacacaaaattctcgcatgagcttactcactctttaaggctgaagactaatcaataatcacatttgtcattttcaagtcccagtttaaacccagaagcggcactattgcataaactatgaaagaagggtatattcttatataacttagttgtttatgccaaacaactttagttgtttataccaatgcttacaataaaaatctaatggcaaggcatacataattttaagttttcttatactgtgtcctccaaaagataggtaaaaatcagtgtttgtttaagctactatgtaaaaatattatttttaaataagtaatcaatataaaaattatgacttcagacattttatattttttatactaaatccttgaaagatggtatgtatttgacatcatgcatattaattcagagtagtcacatttcagtcatatttactctgtagtagccaaatgtggctagtgtctaccttgtcagacctggtaggtatgtgtcatgttatttttgaaaattataaatgcctgatgttttcttattaaatcatttttctacagactaaagtatcactataattaaggaaatagcttagcagtggggtgatatttacatttcataggaaattaccacctgcttttaatgagtattagtctaaatgcagaatttataaacaaaaacatcctctatccttacatgtatgtagaaaagctttttctattatgcttgtaatttttccattaattacttcaatagcttcaaagcttgtttttgatactgtagggataaaaggaaaatttgatttttttatccttagaaggttttgtaatacaaattgagtgccttcatagagactatgaagaagaaatggttagcctaaaggcatcaactttctgatggaacaaaaaatacatttgttttcagtttgtgagaaaaatcacctactagaatttcaaaatatatccgtatgaatttgttttaaaagaaacactatagggaaattgtacttcgttgcataaagagatagttgaacagttctagtagtttagttttaacttatgtttgagaatttttattgagaggaaaatacctaaataacttaaaaattaaaatattttccttcaaagtggagccagatttaaaataaaatgcaaactagaaaaaattataaatgttatattttattaccagtttaaagatggtgaatcaaacttttgaaacttaagacaatgtgattttttaatattataatgtatgctatcctttaaattgttgttatgatcatgtgaatatttttatataatatataaaaatatttattatataaaaatatatattatataaaaatatttaaatattatataaaaatatttatatattataatagctttctttacaattctttgatttcaggatgaatgtcttattatttattttcaatagcactattaaatggttttaagaaaagtaaatcagtagatatcagcacaattttacacttttatatatttacttccacagataaataagtccaatgactaatgtgccccttcatgtatcagaatcataaaaattattcaattttactttggtacactctgtatagctatgtgagtccctctgtgactttacacatcatctcccgaaatgaagtaatccctaatttgtggcaacttatgtaaactattgaaagacagataagtacaaagaatgatgtattaatttccaaggtagaagctcttggagagaattaacctctacaatatggaaaaagagagaggatattaggagaattacaaatttgcattctctctttctagcacgagtctattcctcttctgcttttccctgttgaactggcagatgatttcttggaaggggaaaaatgttaaaatgaaaatggactgatgaaaaaatgtgtctattaaaaatcctgggcattatatataaaccatggattctgagttatttagaagaattttccatgcaattctctttcctttggtatagttcttaaatataaagtagatatgaagtttgtcattaaaataaaggtttctttcaaaatagatgcagattgattttgtttttacaatttcccttttggaaaattaatatattttaaaatcctttcatcatataacattgtaccaaaattttaaaaaaatacataaaatattttcattatgtaacattaattcttaattataaaatagcatatggttattaaaataaaaccaattgagttctgtattaaaatgtgggcatatttatgtcttacataagtattctttttcttttcaatttaaaattgtaagcattttcacaagtcattaaatgtttaggaaaagaaattaataagctgtttccaccatgaatatagtcagcaaattaagaggattctagttagaaaaaagagaaaaaagaattatagcctggcattgtggcattggcaacattcccttcagtcaattcatgagatctcagtgtttatgtatctctttttctttttatcccctatagtcccataaagaaatgggattatcagcaaagtttctagtgcttggagcaagacctattattatcagtatcataatcatttgccattgtgtaagatcatagtgctcagactttgacatcctttcttcatgtttgagctataaaaggaaacagtaaattggattcataagagtttttctagttgagttaggattttaattggcctttgagatgactgtttatcagttaaatgactactgaatacaaaaccacttcgcttgccattgtagtttctttctctgcagtctagggtcatcatattaaagatgttaatgttagtaactcagtaaaatttttagtttcacttggtataaacccaaccaaggaaccaactcacacagtacttccaagcctgatctagttaaggaggaagaaataaagctcaacactcttcttttacacatgagggttttcttttaacatatgatatcccacttttctccattcccacacaatgccatccagttagtgctctgaacttcccagacataaaccccttattgtaaaactctttccatactctgcattctgtattgtgttcccatcttttcatgctcctagaggtgtgcaaatacctttcaatgagcgttactactgttctttattgcaaaatcagataacatcttccccagtcctctgaccagacattgtctgcctttatgtagcacatttactataggatgagaattcacttttgaaccagtgccaatcagagcccgacaatggtgatacttgttattgatttattgagtttacagcaatttcaggtaaagacaaacacctcagagtacattttaaacagtctagctatatcccagaaatccttcccagtggttctaatatacatatgcatattaataccaatgtacctgtaatccattcagtagcttaatttaattatcagtattttttttcttgtgctgatagataataccacatatttccttgataatataaatgtattacacaaatcaataataatcatattgatagactatatcatttgggtttctatagggatattactgttttagaagtttaaaccctggacaccaaccgctatctccatttcctttcacctcaaaaatcattaagcactgtcaattttactgtatcaatatttttcttaactacattcatcttttcaacccagaactttatcttagttatgatcgttccctggctttcctaataatcccctcactgaagtcctactcctaacatctctctcctacattcaccttctttctagtatgatttttttcagaactttgctcatggctcctcatcatttactaggtgtaacttgagctcatttgccaagcctaaaaagccttctatggtctggctctttccaatttgtccagcctcatatttgcttgctccctgttccaccaagccaccctctcatctcacctttgatgtgttgtcactcatcatgtatcacctattccagcataggatacttcattatttaaaccacttacctttttttgaatgtttggcatattcctactcatactctaattttcaggttttctgttaccttttagattgaatgtgctgagtcctccagatattttatatgtgtggtcctttatttatgcactttatgtataactccatgttgaaagttaactctagtgctttagtttctttttacatcactttttcaatagactgttagctcttttgaagcaagaagtagatattgtaatctttgaagtccctatacctagtttaatgcctggtgtaaaacaggagctcataatgagagagtgactgcctgattgaataaatgcatttgttaatttattttaatcatattacatctgtgttctaatcattagttcctctaatttccccaaatatatgttggagagcattttatttgccctcttgtactttattatcaatatatctaatcatttagaagatgtaattaggctagtctcaatgacagaagcttagaaatacttttttttcttttttttttttttgagacagagtctcgctctgccacccaggctggagtgcaatgacagtctctgctcactgcaacctctgcctccccagattgcagagattcttgcgcctcagcctccgagtagctgggattacaggcgcacaccaccacgcctggctaatttttgtatttttgctaaagatgggttttcaccatgttggccaggctggtctccaactcctgacctcaagtgatccacccaccttggcctcccaaagtgctgggattatttataggtatgagccactgcgctcggccattagaaatacttttgattaaatagtgaaagtatagtaagttagaagagtagttcccattctttttacaaaggaagagataatgtttatgagaggtgagtctttatgtgttttaattctaaagccctaacagttatttctttataataacagaccacagaccccagactttataatttccttttttatttgagtatcttaaaataaaaatgagcatcttgtatatacatcttacagcaggaatttagctcatccactaaggtgacacaagtaatcatttgttactgtataaagatttacttgtatagctgggtgtggtggggcaggcctgtagtcagctatgtgggaggctgaggtgggaggatcacttgagcctgggaagttgaggctgcagtgaacagtgttcacccagctaaactccaacgtaacaccccgtctcaaaaaaaaaaaaaaaaaaagcaatggaaatagaaccatagagaaataaagtatgaacagaacagacaggctttttcatttactgctagaacaactgcaagcccacctttgctgctatttgcttgtcttaattaattttagctgtttttctttaattcatttgaaatgaatataaatataaggttttggcaagtaatggatcaaaccaactcaacattttttaaattggtgaagcattttgaaaaagttggcttcatcttatattgcactaaatcaccaaaataaaagaataaagagtagcaacataatgaattgatgaattaactttttaaaaatcaattttaatactgtgtattgtatgcagcacacaggatttgataccaggcactcaggatttggtaatcaagacaatacctctatttcatcaaataactaagggaattgataaaatcagaagatagtaactgtttttctgatcacttcacaatctttgttgatataacaattatgttcaaaatgtgatgttgattgcttcttaattttgtatttttggatcttctttcctgtcttcctgaaaattcttgttaaaatttcctgttttccgtaatcatttatgatagcaagagacacacatatatttaccaagaatttaacataacttcttagtattttgtcgaaaaatgtgtaacatttcacaaaatttattaacataaatgttataactactagccttattcttgttgttaccacagaaaaaacattttggggtccataatataataaaatatggcagaaatacttgtatatttcagagtatgtaatgaagtcataagtacaacatttgttacatttatatatgcttgatttaatgaatggtaaaaggacatggagcatggaatgtgaataacagaatggcactatatttctttattttatgtacatattaatcttctaagatgcactaagctacaagttaaatctaaatacaaataattgagatgacctaaaaacctccattgttttattaacatagaacatttcgtctaattgccttttctcatccacagattaaataagcagcatttaagcatctaaaattgatggatatggaatttctattttaagtaattgttttttacatgaaaaatggcagttgcagtgaagcattatctttatggtcatattatttttataggtcaattttcaaacttttcacttgggaaaagtaagggtaaatcaagagagattttttccccttcaccctgaagagcaaaatttatcttcaaagcattgatataatattatgtgacaccaacttataaaggataaatacatttctgcacacaattttcttcagtctcttattttatatttaaaaatgtaggggagaaaaaaaaaaaactttacctgtcttaggtttgttcattgtctgggacctctgacagaagacagactaacatgaaaaaataactgaagttcattgttgtatgcagcacctactcacactgaagaactcagatgggaatagctcaaggggtggttagaacgtggacttattagcctcttaacaaagaaagatatctttttagaaaagtgccaatacaaaggaaaagtgatttaggcttttaggggtggcaaattgtgagcagatagatatatacatataacattatataaaaataaaaaattatatatatctaatatggcacttgtaggatcatatgcatatatatgtgactatatcatatatatgtatatgatcatgtacagatatcatgtgatatgattatatcatatgtatatgtatatgatccaacaagtggcatattttggggtggcatatcctgaactccttcaacagctatatggttttacgtggatatgacgaatcaccaatgatatgaggaagtctagctagacagaaatttgtgacgttcaggaaggagggcccctcaaggacagtcaatgtcaaggacacccagaagaggtgatgcccaatgccctgacaagagcatgaagtccaactttgcagagtctgagaactgacaacattctgagatttaagactccacatctgcatctggactgtggcatcaaggtagaattaataaaagcaatgaatgtgaccttgaaaaacaaaaatgccaagctggttattgaggtaacaaggcattgaacttgagaaagcaagtacagggcacaaagtaaaggaaatacaacatggtcaagaaaatagagaatggattatttcactggggtcggcactcagattctaacctgagaatgaagttaacagcaagtttgacataatgttcaatgctgtaagttaaaggagtggattgggaaacagtgggatataaatctgggataatgttttttcacgctaattaattaaaagataattataaatattctacatttaacatagaaaatcaaaataattaaaaagcatcaaatactggttgaaattattaaagaagagagagtaagagatggaattgaggcctacaaataagaaatcttattattcaaatattcataatatcctacagcaaagttctggctaaggaagtttattactgtaactatagtgcactctcatcatagaaggaagagtggatctatttttaaaatgtatagaatatgttttctggctactagtttgcattcagggtaaaaatacaccaaactaaactatatgttgtatttgggatgaactaagatggagtagactggtggtaattatcaaagctataggttttcccatattatttcagttttatgaataatctttggaatttgtttttggctcctccccccaaaaatttaaaaccaatgccatataaaaaaataccttggcctcatcccagtctttaaaatttgcatttagttgaatacttacatttatatatgattttatataaatataaataatataaaataagagggaaatatataaaaatatataattcttatttatatctaaattcatattatcatattatcttaggtaatatcttaatacgtttgtgctgctctgacagaatacctaagactagataattaataaaaaacagaaatttatctcacaattctggtggccaaaaagcccagatcaaggtattggcaggattggtgtctggtgaaagcaactgtctgcttccaagacggcaccctcttatattctccagaggggaggaacactgtgtcctcacatggtgggagaaaccaaagggcaagagagtggtcctttcagcctggagctcttttataatgttgctaatctctttcatgagtgcttaatgcagtgatgatgacttaatcatctctcaaaagccacaccttttaattctgttttattggggattaagtttcaacatgaattttggaagggggcacagtcaaaccatagcacgcacttttgtgaatagtaagcaatattcatatttatctatttaatcatattcatacctatatttatctatgtactaaactatactatttatacatatctatatctatttactagaaagacagtgtcactggtcacagtattaataggataagcatttataatacatggacttggtacactcagtatatgcaaatgctctttgacttatgacaggattgcatgtttataaacccatcataagttgaaaatatcataagtcagaaatgcacttaatacacctaacctacctaacatgatagcttagcctcacctaccttaaacatgttcagaatacttacattaagtaagtattacttacctacatttggacaaaatcatttaacacaaagcctattttaaaacaaattgttgaatctctaatggaatttattgaatgctgtactgaaagtgaaacacagaattgttgtatgggtacttgaagtacaatttctactttttgcatatggcttttgcaacatcataaaataaaaaaaatcacaagctgcaccatcgttaagtaggggatcaattgtgtgtatcagattttggtatatttttgttattaaatattagctataaactattaaaatattaaaaaacaaatgacacacgtaactgtagattgcatcaattttagaatcaatatgtctgtaagaaatttaacaattttccctgctgtgatttataatgaacacattgcagctttttttagtcatgttcaattttagaggaattttatttaaaaatagagattctaaaaactatcataaatatagaacttggcatataataaaatttatattatatataatgcacaataatcctacctctgatgttttaatataaatatatacctcagtagatatttccatttcttttgttttaaattacctacctctggatcccaccagtgtagaatttctcctgcctaattgatccaaaaaagtactcaactctgttattagaaataagagtatatgcatatataaagaatatgaattttaaggatgttaggatgtatacagtggccctaggaatagtgacccaaacaatgactttatacaaattctgagtctagctaccagcgaatgttactatttgtatttgacatctaatataaataacctaaattgtgaattgtatttaatgcttactgcattttactgctgtttctgccttattaactcaagacatcatggggcagttatcatcttcattttatagattcagaaacatagaataggcaggttatatatagaaagaaagatccctaaactattgtcagaagcaaatataaaagaatccttaagcatctaaaggaaaaagttgagcatgatgaattagaaaccaggaaaaaaaaattactttagatgtgcagccagattttttgcttcatttttaaccttatagaatttcacaccagttttgggtaaggtggtagctagttggtctactaaaccctgttatttctttccttacagactaaactcatacatagaggtcacaagccatatctgaatctcattcccaaacctctctaatgctattactttaggcaagttacctaatctctttgagcctcactcgtcaaatagaaataataaattttagtgggttgtcataaggatcaaaagggataatgaattcacatataagatgatgaaaacctacctggctttttataattatgagttatattattgtctcctcttaaaggccctgtgacttataacatagaatttgacagagtgcttgtggtttaattaactgattcattatttcagcattaattatcatctgttgtatgcaaaatcactgtagtagatacttagggtgtacgtgtgtgtgtgtgtgtgtgtgtgtgtgtgttggatacaatcataagaagctttcatacagaatctgcttaaaacttgaatccagtagtcttctttttaaaatgagcccaattacaatgatttaaaatgtgctattacaatacatatccctatttaacagatatttaagtctaggtagaagtttatgaaaatgatatgtgtcattttttctcaatgtcagatcatttcgtttttaagttaaaaagatggcttgttggacacagaattaaaggatggatttttggttaggtttttcatgcctgtagtagaagactattaaatatattctatttccatctgagagcaagagttttgtaatctaaatcacctaactcttgaaaacagtctgcttattccttcctttgtaaactcctgctaacagtataatatttctgagcctcagttgccttagctattcgatgaaaccagcctacatcacagtgtcactctaaagattgaatacataactctggcaccacttgaagacagtgtctggccagtagttgatcctccataagtgatatccatttgtttcaagataaatgccctttcttcactttagtgcagatgctactatgttctgagtacagttcatcattctcaaaggatcttttgatccctgtctatacaaaagcgacaactgaataagaatgcaactgtgtaaatatttacttactttcaaatttaagagtaggtagttgcttattttaatgctctgggtgagattaactaaatgaatgaacatgacatagctagtttaatatcaaattgttgatgctttttttcgtgacactatctgagtaattatatttacattagaaaggcaaattttaaaaaatgtagcctatgcagttttgtgatataaaggcctaagaaatggtcaagaatctactctgatgcactaatttccaagatatgcttggccaatactttttaaatccacattaataaatcagaagaatgtttcagacaaaaatgaaatgaagagttttagggtgaattttcctaacggatattaggaattctcctgctttattatgcagaggaaatattatgttgatctttcatttgcctttctaaaagaactcatacatattttattcattaatcttcagaatgccctgtgaccaaattgaaccagaaggggaaagtgaagttagtaaacagacacagatgttgaaatggtaccaaatcgatccttcataaaaaacctcctatgtattgctattcattcattcattctccaaatatttactgaacatctactctatgcaatgtatggtattatatcatgtgaaggataagaaaaatataaataaatagatagattacatgatgtttgcacttgaagaattatcagtttaataagacaagtgaaacgtagccttaaatcattggaaaaaatatgctggcatgcagtgagaaatgtatatagaaaacagtgcatttagatgagcatttatctactttttgtttaggatataactataactttacataaagacacaacttgagaatgttatgtgcccaattaacatgaagaatggttcactccctttgtagttacctcactggacttggataaaattctacattcctgtgataagtcaaagaaactcagaaacttgatcaggttgagcagactggttgatggaaccacaggtttcattgtaagatgctcagcacatatgtactctattcaagctagagaatttcatagctgctgccaggtttgaagtactccagaaagtgctaccacagtgctagagttactgccagacctggggtcctggtatttctgctgaaaatatggcagtcaaatggttatctctgtttatcctttcttccattgccttgagtgttgaaggccatttttgccaattgtctcctcacatcctgtctggtcactcatcactagtactagagctcaaatttactctcaaattgacctggactcccactattccagctgtttagttatctggttctttatgcaacaaaaggcacctctgagtctgcccatagtggctgagttaggacccccatatcagtcaaaagctatttccagatccagctcttctctgagactatcaggccttgtctacactgtacttactttcagctgagaatgtgttctctcacctaactccacttgagcatcctcagtccctcaaaggtaccctggattgtggtcttgattgtttttctcctaggagtttctttgattctttgtaaatttttccactttctttctagcaactttcaagccctgggtactactaaggagtgaaggacagagcagtgtctataaatccatgtatatagttgcaatgtaagaaacagaggagagagtagtctcagtaaagccaaatatacatggctaccagagagaaggtgcaaagttgactttaatctatttaaaagaaaaaagtcactaaatgaatccattcacaatatgaaaacctacaccaaagccgggcttggtggctcctgcctgtaatcccagcactttgggaggccaaggtgagaggactgcttgatctcaggagttcacgaccagcatagacaacatactgagactccgtttctacaaacaaaatggaaaaaattagcctggcatagtttcacacgcatgtagtcccagctctttggcagtctgaggtgggaagatcacttgatcctgagaggtcgaagctgcagtgagccgtgatcatgcaactgcactccagcctcagtgacagagagagactctgtctcacaaaacaaacaaacaaacaaaaatccctatacaaagagaatttgatatttctatcttttcacatagaactaaattaataataataataataattgttattgttattattttagcatcactaagtacaggacacccctgctataaacgttataaaaatttgacagtttgatgttattggaaaaggaatttgggggaagatagggctcaaactgaatctcaagtataaatataaacataaaatagcattttgataaaaatagatgagagtaggaaggccatttaggaagaagataatggaaagccattaaagatgttagaacaggagagtgcaataaaagtaatatcatttaccatgccttgctaaatatcatgcaatttgtggtgattatataaagatatgtttgccttacactaactctaagtctcacaaaaatgctgtaggatgagcattatttctcacttacagatgatgggactgaggtgccaatatatttagcatgttgctcaaggacatttgattagtaaggttaaggctgagcgtttaagatcagtcccttctaacttgataacttgtgcttttcctgccctatcctgcttccaggaaggcatatctggtggctctgtgtgaatgcataagacacactccagcaggtagcaggcttcctgcaattcaagcctgagttaataaggactggtatagagcccagggggctcaaaggaatgattgaatgggaagatctttttgagatagggaaggatagtacggagacaaaagaggccttagagctttgcagcttaggtgactaggaagactctagtgcttttcaccgaagtggggctattgcaaaagcagggagcttgaaaaggagatggtattgattgcaaacaggaaaatttgagatgatggtaataccttaaaggaagagaggtccaacaaaaagctggaagctgaaaaattgtttctcatttctataatgactcagttttctgtttgtttcagaaatggagaaaaaaatttcagacttttgggagcatatgtttacaatccttcagagaaaaagacttagtcaacctatttggccacctagactaagtgactccagaagctgagagaatttaagtagtgttgaatgtcaaagaattactgcatactttagtgcccttgtttctcagtagtcatgccggaacagcctgtgccttcgtagtacctgtgtcaggggtcttacgaataatgccttgggagaagagatgttaatttgaattctggttccggctttcaagcaaaatattactcttgctaatgttgtctatcaaataaacttctcagatttcattcgcagccttcaaatatttattcctatttccaatttttttactaaatcaaaaggaaaagggaagtgaataagtgataaattaaagactgtgagatgtctttaaaatatgaacttctctagcccctaaggcaggtgcacatgaatttaactgacaaaaattatgcacagttttcttgatttgaaagtctcacttaagtgttattttaactaaaatttgaaacaatcaaaatctcaaggtaaatatagatattactcacttttaaaacatcataatttgaacatttactattacatagatattatgtactgtagcaaatttgtaagctataaaaatatgtggaagacaattacaattttccatttattaacataccaagcaaagaaaatgacaattatcattttaaggaccagtagaagttctcttaacccaccttcccctaaccgatttgtaagagtaaccaaagctctgtatccactggttaaaatatactgattgacatccacagaagtgagaaaactcaccatcaggaggctactatcatgtttctgtattttgactccgtggtttggtattcttagaaaaggtcagtagtattttttctataaccagtttatgcttgttgtacctactaattcataattcaattaaacattacataaaatagttaaataaaagtgcaagcataacattgtttctatgaaaactcaaatgactgcatgaaaaaaattgataaaggtactttgcaagtatctctttattcttgtttcacttaaaagaaacaagttgaaaatcatggataatccattatgtttggagcttatgcaaaacagaagaggaaattcaatcagcagacccatgaaaaaggtcttggctctacattaatacatttaggaatacatttacagttagatgttgtacattaacatagaaattttgaagtatatatgccttaactgtttaactggccaaatgttagctttgattactttggaaaattatttataataaattttctgtgcccttgtacatatttcattaaaagtaggatcttatggtatacacagcttgcttaatgttttcttaagttaatttaacatttatttaaaatttgctatgtctcaagcactgtttttggaatagagctatagtggtgacttagatggagttcaccttctatgtggtacatagaaaatataaacaatgaaagaaaacaaattaggataagaagatggagagtgatttaggtgtggggaaggccctttagctagggttatgggagaaaaatatatgtggagtaagtcctaaaggataagaaataggtagccatacaaatattgatcagaaaagcatcctaggcagaaggaacaattgcaaacttcttgagatggaaacaagcaaggtgcatctgagggaaagaaaaggtaacccagcacactgataggttgcctttctttcataatttgtgatgagaaaaatcaagggtatccttttgatgcattatatttgaattgcctattagatatccaagcaggaatatgcagttttgtttactagtgtattatttgagcctctaacagtatttggcacattaataggcattcaatcaatatttgttgagtgaaggaaggaattattttgggaaggaataattttgagatgggtaatgttttacgagtttgaaactcaggtgaaaggattgtagaataaatttgtgagtcattagcacatagataatatttacagctaagaaactggttaagattatccaagggtatagtgtgaatagaggagtgccaaagagtgatcttagaagtcaagaagagaaagagaagcaaaggtgattgaagatgtgcagtaaggtagaagaaaaacaaaaagagtctaatttcaggaagactagagaagaaagtgttttgagaaggacatggtcaattgtgtcaaatcaagctatgagaattgcttaattatggtaagcttgaagaactaatcattttgatttgacacgaaagcattgttagcgacctcaatactattgtctgcttggaatgttggggacaaaagctaagctggactgtattgagggaatgtgaggtgagagagaagaggtatcaagtctaactagttatttcaatggggtttcaatttaggataccatagaaatgaacctgaagagatacataaagtcacataaattttttttaaacattgaattaaggcatgtttatataggtataaatattccagtagagaaggaaaaaataatgttgcaggaaagagtgaagatacttgcaaagctgaaatctaaggaagggacacttagagggagttagtcttagatagaagcagggattgtttattgcattataaaaaaaaaaagaagacagagtgtggaaattcagatgcaggtgggtggatgaatttgggcaggacagcagagtagttcttgactcattttctccattttattagtgaaaaatgaagtgagtataccagcagaaatggaattgaattggaagagaaatttagaaggtttaagaaggggcaataggagcaaaattatctttttggaaagtgggaaagtgaatattctggggaaatatggaacattttctgggtttatggcccacttgagattaggggccataaatgttaagtgatttcagttaactgcatcctactaaacccagaaggacagttaagtcagcaaatagttaaatttaatgagtttaatttctctaagagaccatgatggagaataagacctaaaagagttgccagtatttataaacaaataattataataccaaatcatagaagttagaatggaagtaagggaatgtgtgaggtgctggacagtgaaaatgtggattgaagttctccaagggggtgaaaattaggtggaatagggtcatttgagtcactgggctgggaggataggggatttgttaaaattaaaagatgcatgcaaaaattaaaagatacaattaaattttattaagcaattctaaattgtcttctaaaattgctgaactaatttatacactctccaatgtgtaccatactattattcattatgtttttaaatcaataataattcttagaaagttatttagacttatttgtttaacaatttaaatagaattgaatctcgccattattttgtgggctagtcttttttcagaatatgtagcctcctcccttctccccaccccccgaaaaaaacccatgtaacagaaatagtaatagtaaaggaggttctttccatgaaacaaatgtggaatttttaaatatgagcctctaatattttatcagacataatttctttacacttcaaagatatcaagtgttttattataactaaacaaggaaacattgagttctatcatcttcatttttaaactattaagtttctctcaacagccaaaattgataataattataaattggcctttattttttatatataaaatgtatctatatccacatttctaactttcatatatatttatattatatatttatatattatattacatatatttatatttatatattatattacatatatttatatttatatatttatgaatgttaaaatgtaatatagatttttgtagaattttatctccttctgagaaaccatgtcataaatttttaagtttagattacttttcttttaacttggtttttaatttggaagcaggagcttggcattaatgtgtataacataacctgaactattttttcttttcttgagaaatgtagccttgtcttgcttgcttagtaaagtaatgcaccttaattcagctttgttatccttcttcttcttcttcttttttttaactgtagcctatttggtagttcctttttcctgtgaaacatgtataaagttctacaaaaataccaaaagtttaccatatttattgctaagatgcaggtatactacattacttatcctcacatcattagacgaaatgcatatgaactctccttacaactgggtattgaacttcactggtcattggttattagaacattttcttttaatgactgtatctttttgtaagatacaagtgttactttggagagaggtaggaatagctctatggaaaatgtacatgtacatgtggtggaatttttcctgaaattaaaggaaacatgcagtttggtcaaatgcatcaaataaattaaaatagtgacggttactgcaaccgaatctgctgtcttaatatgctatcaatgtaaaacagcaatcatttataattgtcatcaaatgacaaagttaagtgtgataagaatattttgcacaccaattaatttttctatcagttttgatactttaaaatgttgaacatacagttctttaaactgcattgtttcttttttagctgtttaaaataaattctttaagaagtgcaacaataaaaaaacaaatcagcaatgttaaaaaatatgtaaggagacatgcagattttaatcttcttgttgctactgtattaaatattttgtccttatcaaaatgtatgcacaaaaactggacagaatatgcttctgtgatctttagcagctctgtattgccccataaatgactcagctacaaatcagtgaatgtgcttcaggctttgatttttgttattagttcaaagatgaacatcatgaggacatcactcagagacagatttatcatgttttgtttcagatctcatagtgaaagctgaattttcttgtctttgttctaccaaatacattgctatatacatgatagtttaaaaaaattaaacctttttgaatatgctagagaatattaaccaatgcataataaaattaaatcaagtaggtgccatcacagtctaaaaatataacacccgatatatgtctgttgacatatttgttattcaaattcaaattttctttctcatattgttgtatatttacaaatgtgtatctatactatgcaaacattgatggctttttaaaatttattttatattatgagtatataataggtgtatatatcatcaaatattgtatctgtttttctccttcatgaaacaaatgacaagatgagattagatgcacaacagatttattggcagatatgcctgtgaaagataaacaggcaggaggttagaatagacagttttcagaccgtgctataggtctgaaacctgtaaaaggagagagggaagacaggattggatagaaaaagtctcagacaactatgccaaaattcttagccaggccaatggggattcctagagccacagcttttcattagaggaattttgtacaggaatggtcttgttctagcaaggctgccaagctcaatcactggctggaagcagcctatctgaagagcagcctgctgaacacagtggtgtatgcaaaggtgcagatgctagaggctgtccttcagttatgttcctagtagcagtttcagcagagcttcttcatagtcatcaaatatatgtattttgggcctttcagtgaagttgttgctaagaagatatggattttctttcttaattttcttagttaatatgttcaccctaataggccatgtcctataagtgtataagtgttattaggtaagagaatgaagatggattctgtggctgcatcataggctctgaatttaaaaagcaacaacaaaaaccttactaaatcaaatctcaaaacatatatcctgattgtggggcagtgtgggcttatagatgtttgcaaatgaataagcacatattctaatttgactcataatgctgttaagaaacaaattcataaatgtaagatagttattgcatttcaatgaggcatgccagcaatgttcaacaaaataggggaagaaacttataagcaagtatggaaaataatacagtcagtcagcaaggtacataggtttaataactgagttaagaatatccatatgacttatgtgtgcagtatacatatataaatatattcttttatatacattatcacaattcttttatatatattatatataatatataaatatatatataaattcttttatatatgtaatagaattgtgaaaatatatatgtgtgtatatatgtatatatgtgtatatatatgtatatatgtgtatgtgtgtgtgtgtgtgtgtatatatgtgtgtatatatatatatatatatatgaattgtgataatagtcccccagaaagtaaaattctgcaagcgggaaaagagtgacaaggcactcatactcagtgagctctggaaaggtgctcaacttactttacctgaattaatagatcataatttagcatttgatgtatagtctttgattctcaccaaaaaaatcagaaagattgcaagatctctcagtagttctagatgagaattcattgttatttttcgttatcattgatcagtaatatagatgaaagctcaataacgggttacagtgaatgttcattgaatgccaagcactgtgtttggtactgctgatacaaaggcaagtaaatcaagtgttacctcttcccttgttaattagttaaaattgcattcattcactccttaagcaaaaataatatatggttcccaattgcttttctgggcattggggatacaacagtaaataaatgttacagacaaaataaatgaatgaaaaaataaacaagtcccaaaatacaactggatagcagctgtggaatttttcttagtagatggaatcttttattccgtatttaacactattaaattccttaatagactacaccataaactctacaatatagagctcaacttgagatacagaatgtttaaaagagaataaaaacttctctgaagaattccattgtttaaagaaatggaaatcagcattattcaacatttcttactttatatatttaaaattatcttagttgctttttgtgatactacattattattttaataaaatatataaagttggatgatgataatataactcttcaaagatacttctgttagtggtttgatatatattttttcataatttttagtgagtaaatccatctacacatacatttttacataaatttaatttcatgcccattgtcactctttaaaatttaccttcttttaaaattactacaatatatgggcatatgctaatttactgataaatatgttgattgtcttccgttacttaataaacaattttaagaagaatctgtttttatatatatgaatctccataagagtatttatattttcttaggatagattcttagcaagggtacacttgatcaaaatttctacatattttaatttttgacatatattttcaaatggctattcaaaccttgtctaacagttttccagtttttcctctgctataggttgaattatgtcaccaacaaagatatgttgaaatccttacccccaggtacctatgaatgtgatttcaattggaaatagggtctttgaagatgtaatcatgtcaagatcagctcattagggtcggccctaatccaatataattgatttccttgtatatattattacattactttgtaccccataaatatattgaccaccatagttagtcaatttaaaatttaaaaataaatattaacgataatttaaaaataatttttaaaacagaagagggaaattggaacacaggcacacacacaaggagagcaccctgtgaagaacagacaaacagggagaacacaaggtaaaatggaggcagagattccattttcactgcaagccaatgagtagtagctggcaaaacaccagaaactatgagaaagatataaaacagatagaccgtggccctgcaggaaccttagtttggacttcttgcctccagacctgagaaaataaatgtctgtgttttaagccatcctagtttgtagtaatttgttaaggcagtccaggaaaactaaaacccacctctaacattttagagtgcttctttaccctcatagtcaccaaattgagcattctcactactttattactctgtctattagaaaagtaaaattacaaagatacctaatacatttaaaactaaatgaatctcattagataaaaggcagagaagtttcacatttgtcatatatatgcatgtttgtctatttaccaacatacttacctgttatcctttactttgttttataaaaggatttaagcagctattctctagttaatatagaaaaaaaatgctttaaaatggaaggaaaagaatcttccattaaagaaatagataggtgtcatcctcccagccaaataactgggctttgcgcggggtaggtatttaagtttatggctatagcagtatctggattgcagggttcaaatcatatgtttctattttctggctaacctcttatctctcagcttcagggtttggcatagacctaggatggcacagaatcatctaccatttctatgagatagaagcctgagaattcttgccattaacgttcagcctttctctcataggggtttgccgtgctgctgaaatacgcagttggtctagatggaaaatagctttctgacagtgtcaattcaaggatgttctgagtttattattaactctgggaattatatcataagaggcaaatactcctacaaaacattgatcaatgccactgttagagatacttggtcttaggttgatttgatcagaattacatttactatgttttaagtacaagaagagccctctgatgttcctcattgtggagttcttttcaaatagaatgcattgtaaatgtcatctcctgtgatgacaaggcagttgtagagtgtaaggcagtaaaggtgagatggaagaacaggggattggcagtcagaagcctgcattctagttgtggctttgctgcttactggctgtgggcctttggaatggtgagttgaacttctgtgttctcatcagtcaaatgggctttgaagtatacctcaaaaggtgattgtgaagatcaaatgtgaccatgtttatgcaagtattttggaaacatctagcgttaaatatatgtaaaatgttttcagttgcagaaattttagtttgaatcaagagtggtgggactttgaaacctctattctctcttttgtaaatatttttgtcatatttaatctaaagataaaaacaaaacactttataataactaaaggtttgtttatttggggctggctgtaagcaagagagtattatcactgagggttgttcatagccactcctgtagctcatccactgtttcaatcctacagtttccttcctttccgcgtaggctgtcttcacctggggtcacaagacgtcctcatgctcagcaccatgctttgttgaagcaccagggtggaaatattattatattttctgtggaaaaagtgagggaaattgagataaaaaggggaaaagttatttaaataagtatgttcatatctggtttataagccttaagataatttttatgaagagctatcttgttttactcagattatttttattttggttgactttggcacctatctgcagtattagtagcattgaagttgttattcagtggatgaaaccttgctgaagtggctgtgtggataccctaaaatagccacttctcccttgatgagtgtcgcattaagattccatggaagttcacaagggaaaaacaccttttctgtgttggcttttgttattgcacccctctatcccaattaacatttactgttttttacattggtaacttaattggctgctaaattttagaagataaactctgaatgtttatgactaaaattagaaatacttaaaaacattatttaaaacaaatgcaatgtaatgatgaaattcactgactgtatagtaaatatgttgccaaatatatagaaatgcccacaaaataatattttaaaaatattctaagtttactcttcatctgtattctaaatttgattccataatttgagatacaaaaattcatgattttaatataaaatctgaagagtaatattcatgaccatatacttacatatgatctctctaaatatatagtagtaatattaactattaataaactctataatgcaatacttcgtattaaagaggatgattgagtttaaatagctttgttcttacttatactttacttccttgggaaacaagtgaccttatatccaaaccctctgaagcaaagcattgaaataaaatgtttttaatgctgtgatgagaatttaaatgtcacagagtgctattgacatacatgtaagatcaaaagaggaagtgtgttatgacagataaatcaagatagtagaaaattctgttaaggtctaaactgaaagtatcataactaaaaacatgtagtggcattttcatgtattctgggcacacaaatcagctacaattggccaaaatgttacataatgaaagccagtaaataacatttttttcctcaaaaatagtagactgtggcattatacgtgacatttagaaaaggttcttattgtagctgtttctatcaatattcctataacaattgatttaaagattgtatttattttgtacttcaaacttccttcaactggtaaaatagaaactataaaagatcccctacctatgggtcaaattacttaccccaaatgattgagtaaatttgcaaccaagctgaaattagaacttttaattataatttaaaagatatttgaaattgaatggaaccaatcatagaaaattttatatttagctcctcaacacactaaagttccctttttgggccataggatcatagctgactgctatcttttagaaccttgctaccctgtgtgtggtccactgagcagcagcatcaacatccatgcagaaatacagaatctcaggctctagcccatacttactgaatcagtttgccttctaacaagatcctcagtgatttatatgcccattggaattggagaagcacgatttcaaacatcattatatatttcctcagttttttttcttacaggcaataggtgtgaactacttactaaggtggactgcaataaaaaatattaactttgtcataaaatgtcgaatattcattagtgtatttatacatgtatgagtctgagaaagccagactccaaagagtgaactatgcaatacgtattttatttttttctaataaggtattgatttttgttacagataaagatttaaaactatccaaatactgcattaaagtggcaaagtgcttatgagaaataagatatcagagctgaatttctacttttatcaccattgagggatacagcattctcaaatgcatccagtatcattatctgactagaaaattcttgctcaaatcattgttcaacagaatactgtttagatcttatttacagtttccaattggactttaggcaagaagctcttgtaggctttaaattccacacaaaggcacaatcacataatcatgactcttcttcctcaaatattttacatgcttcctcataaaaagtagagctcttcaaaaggttaggcctatctccctaccagtattggattgagtgtacagacaaaaacatacctcaaatatgtttggtaaagatcagaaaaaaactctaatttttcattttacaatgtagacttgtcacaaagaataaagaataagagaatagctggaagcagtacctctttcaaagcgtaggagggcaggctgtcagcaaaccaatgggactatgacgaaaggccagcatccactgtcttttagtttgtggaaaccatttattattttaaaaaattataccattaataaacttagaggcatggtatctgtcatcattactgatttgtatgcatgaaaaaacctcctgaccttttcttttttaaattttataactcatgtgaattcggtttccttaaggacttgttaaacagtactatggctttcttggtcatcctgaatgctaattttcttcaggtaattcggttcgtgaagactgaaagtcattatttgtttatgacctaatgtcattcattagttctgtttcattaaaaaaatggatattactgaagaaatatgtttatcaaagaaaagattcaaggtgggctttattatcttcaagcatgtggtctattaagcaaaataagatattcagcaaaagactatgataaatcagtttctctttattgaagaagctactttgacatttccattccagctcagtctaagtctgcatgacaaacaactgtttcttgctagcttctgtattaatgtttaaactctctttggtaatcaggacttttaaacattttttataatgatttggatagaaatagtcaaatttataattacatttgtgacagaaaggtgaaccttctaacagtagtatttttaaacatatctctatactgaagcaaaaagaacaacctagcatcctttgccttatcatcttctattctataaaatatgaaaatgggataaaagtgaagtatacactgtgttttcaccctacgcttgaattaagaattgctttctttccttcatattagagtaagttaaaattagaacactttttatttaaattgtcaggtaaaatgtgttgctttcaaaatatgctttctttttagtaaaataaagatccacctttctttcttatattaaaatgcaaagaaatgtatattttagagtaacatatgcatttattatttgcaggggtcatacagaatagaggtaggctaccagagtgcttctccagagctgatcaagcacgttagcatttgtaaagttcttttttttgtcaggagaaccaaaaagacatacttccaaaattaaaatgtaaatcatatgttcaaaactaaaatgaattaatgagttaagtcttacaatacctgttggaaacactttccacaagacttttgtgatcttttatttgatgggccatgagcaaccagaaatgagtatgtttttagattcctggactgccatgcttcaaatatattgatgtatcttactttacatctctttctctaagaggattattcagttaccacttttgagcttaaaaaaaatagactttaatgttgtattccagataaattcttttaaaattctggtatcaacttttaaaatattatcttctgaattatccactggatttttctccctggaggctcactttagagatgttcacacacaactgctggtttgctttagataaagcacttgttctcacgttctcatgtaagttttatcacaaacaatgtctaacttcacttttatcatttcgcttcttaattcctttctctttgtcacaagtcctgtgctttgtagctgttttccttatttttgtttttaatgtggcttacctttgcagttaaaattcttagaaattattgttactttgaatttcaaatcagaggaattaatttttttaaagtctataatgcaaacaaattattatgatattgaatacactaaaaatctgaagcatttttccagtttaaatgataattataatataaacaaatacactcttataaaatgtgagtaaaattaatattaagagagaatttgaatagcttcaatattaactctaatattatttcatatacaaacgttttacaatttatttccaggatcagaaaaggaaccatataaaataccacaaaaaaaaatataggctttgcctgaagtgttataagtaaaatttagaaatgttcataaagattataaagtttcttctcaatttgtttaagttcagaaacgtcattaaaatgtttatatttgctcacctttttggtaggcacaggctaattcaagataaaataatgtaatgtttttctgggtgctatgaccccacataaacagtcctgaagacaaataatgtcattcaggatgctaagtgcttacctagatacaggacatgatagggacagatcccccacctgaactgaagcaagtcaaagaggacttgaggctaacctgagacttggaagatgaagagttccctggcagacaggaggaaagaaagacaagactaatggggagtgttgtagggaaagaaactggcttatccaaagtcatggggacacataacagcacagacacataaactgtcagtattttagtttggtctacgtctagggacttaaagatcaaaccaacatctttaactataccaagaatataatatagtccaaacaacggcccataaatgttctaggtatgtgggagtttttatggcagtcttcattaatcccatgttatgaaaaagaattatttctgatgttcctgacaaatcagcagagttgcaagtgaaggaaggaaagtggaagaagtttggaaataaatgaccgtgatttaatatggaagaatcacagcaagagaaccctgatattttggttctaactccagtttagtttataaacctgcttcgtattctaaacaagtcatcactgaccctatattttctaaatacaggataatgtttggcctaaatatgttgtttgtgttttaacaaaactctgttagtcaagagacaaaaacacagtgtcattgttggaaatgctgaaagaaatcttgaaattcaacctccttcatcctatagcttcctccacttccaccttctacctgcttccccttctatcttccttttcctgtttctacattttctaccttcctatgttagctcctgagcgtctatgaataaacctaaagcttcataaaatactgtggaaattagtgtccagataacttcttatgttctttcagaccatatttctccatctctgaatggtgtttaattaataatcaattaatagtcaaagggaaaaggggaaatctgagggcctgtgataataaataataaatatagttaggttaattggtggaatctaatgaagaggaaaggtatactataatgaaagaaggcaataaataaaatctggaactaaaatagtaattgtaaatactatctatgaattccttagtgtcagatattttaaatatttagtcttgtttaaatttccaaccatcctggagtagctatactgtttcctgtttatacagaaaagtacatgagttaaacaggttaaaagaatagtttcttatggactccactgacaacctatggagagacaatgcttttgtactgggcccttataggtgttgagcttaatcttcagagcctcctgtcctggggtggggggaggggggagggatagcattaggtgaaatacctaatgtaaatgaccagttaatgggtgcagcacaccaacatggcacatgtatacatatgtaacaaacctgcatgttgtgcacacgtacccaagaacttaaagaataataataaaacaaagcaaaacaaaacaaataacaaccacaaccacaacaaaaggtttaaagtaagcatattcccattttatagctaaaaacctgagattccaaaaggttaaattaattgctcaacctgaggccatctggctcctcttccagtgcccattcctctacatactttattgcttccttaatctccacaggaatcatttccccttttctatcagccttcaaaagcttgttgattgctctctaattacaaatacttggagaaaagtgtgtaaattgatatgcaaatgatcttttccccttagcaaattagcactttacttccatctaattaagtagctttgtgaaggaaatggatttctgaaagaagaatggaaagtgtttggatttgttctgggggtgtttctggtttagcaagccttgtaaatgaggtatataaaaaggagtcaagagtaggagcaaacaatgaaagcagagaaaaaacgaagggggttggatgaaaaaatttaagtataatgactgacaaaccttcaggagaaagtaaactgcctttcatctttcattctttctccaataataacacttttttttaaagtaaaataaaactttaagaaagttctgatttctctcagacatcggtgttaacgctgacaatatatttatcaaaaatggatatattcaagcctaaactactaatttttgttgtatctagaatttacaggacattctcttaattgggaagaaattaattccttgagtatgttacaagaattttccttaggaaagagtcacttgttgcaataggaattaagatatggctttgccattatatatatttagtggaattaggggcaagacatgtatgtactagcttcttccataataggactgaagcagttgcctgaatgttatctttaattattgccagtgaatagtaattcggtactgaatatgtactgaattgaacatgtaactacctgaagtaaaaggtgtcaatttaaatttttcattgaaaatatggcaactgagattcacaataatatattaaatctttatcctctagcaatctgtttttatgaatttaacaaaatgtctgtatgtaagcagtttagttgtatgtgcttggggaaagcctttagtctttattaaattatactacccaggtccataaatagctagttcctataagttacacaatgccatattaagttatattagccattcttcttaataatgaaaacatatttaataataaaatattatttacccttctacctatgtttctttgccaggtattatactcttgtctataccaccaaattattttttggatttacaatgtttatttttatattttattcattaaaatgtaataaaaaataattgaaaactgatgctaattgaataccttaggaaggatcaactctgctgttggcaatttcacttatcttattctagttgccctttaagaaaaataaagagaaatcatattggctgttttccaggagattataacacattggagaagggagaatctttgtagcaaaaaataactagaaaaccattgggtgccagatacaaattatgatgtaaattataagaaccattttattataaacacttctatggaaaaagtgacaaatatcacatatcagagaaaaggtcagacattcagatcttaatttgtatacaaaaaatctttttactgttactgaatactgatatcccaagagtaattgaagaagtatgcaagtactataaattgcctccaagctacaatattcttttgaaggagaaaagattaaaagattataaattccatattcccaaccaccatcatccctccattatctagactgtgtcccttccagtgtattgtgaaaaatcttcgagagatcatgctgccaatatgtcaaggattctacttttttgtaacaggtgagggcctttgatatcaaacagttcaccacctttattcttacaggaagacactgaggcccagagaggtcacttgggtttgtcctgttgtgttcttagaggtgaagatttgataccaagtctgacatgtgatcctcaaccaagcaagggtttcaaccttgacttggtatcttcatgctctgaatagtcatcactttattgtgcaatttatctaataacacaattgtgtctgtaaagaaaatacaaatggagaaaagtttctgcaattattaagcagaatataaacctaaggatatataaagcatatatttatctcaatatttccatcttctctttctcaaatccaaggttttcttactctactttcaaagaacaatatatatgatgttttaaatttgaatataaagaagccatttaaatgtattttctgaaatgtgcaacaggctgcaagggtttttttttttttttttgatgaatacataattgtcctaggcatttttaatttgttgcatggcagatttcctgaatcaaatagcagctgtttggggaaagtagcaagcacattttctgcaggcccattggttgctgttttgctttcatattctctcaccattaactatacagcaactagagcagaggagttgttaacaaaatatactttcactgctagccaaactatatacatgacttagtggtaatatttgattttatatcatttacttatgtctctgtatgtcttacaccaagggactaacacccaatgggagaaagaaaaaaagggaaaattaactaagtatctgtgaaccatcaaataggctcagataaaataatgagccttcaacaagctggaatataataacattaggactttggagttcagtgggcagttagatgcactaatggcactgctgtgctgggaaaacatatattttatttggaatttttgtgtggaggtgattgcacattatatgaatagctgtgctaaatgcatgaaggttttctgccagcataggaggcgattaaggccccctctgccagataacagctcactggagggaagtaatggtggcaaagtaaaatctgaaaacagatgatttcccatttaatagtccattgactctcctcctacagccactgtggtgatggtgctgctctttattttcatttcacaaagaagcacaaggtattctgagattttttaggtcatacattttctttcaaaaagaaagagagagaaaaaagatgagagagaaagagaaaaggagagaaaaaacaccaagtattgcattaaagaaaaatgcaattgattcactcattcattttaagaaaaaaagatacttatttttgtgtttattgaatgttcattgtagttcaggatgatttcgtttttttttctttctcccctgcaccccctcgtttgtgtcactcatcctctagggagctgtatcaaacttacaaaaaagggtactgcattttgaatgtatatccaacatgattatgagacagacccagcccacactgtcagaaaaaaataaaaaatgtgtttgtccgttcaaactgtgatttggatataaaatagccaatatacttttaccatttaaaacattttcccattaattattttttctcttctttatcttttatgtgttctatattctcataccatatatgttgaatatgcttatctcatttcaccatttgtttaagcatagcagttaatttgtttcttcttaaatattcatcaaacagaattttgattaatttagatttaaattaaaatgtgtaagtgtagtattgtctattaataattcctggtatttctgccataggtcttgaaagtaccttggtccattctggactatttgtctttatttactaacatcattttctgtcataccacatctatttttatgtacttttgaaaataagacaaataatgattcagtcatccaagatttgcttaggtatggaaatatcaattttcaaatagtcttacagtaaaacaaatttaaaaggtcctagaaggaaaaaaaaagttttagttaaactcacttatttgcaaactactaaaaaaataaaataaaatgcaaaactgtacttcacctttattttattgctggatgaaattttttgttttcagaattattttcagacaatactgtaaatttttatggccagaatcttagcatttgcattttttatgccagatatgcattattttgatgtctaggttccttcatcttaaaaatacagttcatgccaagttttgggagattgatcattaagcaagctggcgattaagcatagcaacactgaatgtatggatgtaaccattcagataggtggttctatctaatatgtccatttgttttttagaatgataaatttttaataatttttacaattcctttaatcaggcagcttcttctataggtactcaggacagtttagtttattgattgttgcttcactttttgctgtcagaacttgtggatgtctcttttctattctaaaaggcagtttttacagcaacaaatagcatgcaagtaaactataaaaatgtattcagcaaggtagggtgactcagcctgcaatcccaacattttgggaggccgagatgggcagatcacttgaacccaggagttcgaaaccagactgggcaacatagagagactctgttctctacaaaaataaaaataaaaattagctgggagtggtggtgtgttcctgtagtcccagctacttgggaggctgagatgggaggatcacctgagcccagggaggtagaggctacaatgagccatgattgtacccctgcactccagggatacataataccctgcagtgcactccaagtgcaccctgcagcctgggcaacagagtaagatcttgtctgaaaaatacataaataaataataaatatgtttttatttttactgcatattctcttctttaataagttgttctacatttcatttttctttattacctcttttaaaactataccactttctctggtctttctgttgtttgcatttcatgcctttgacttttcttaaccctatggaattctgacatacttacatggaacacatatattatttaattcactacatgtatatatcatttattttacttgcctttaagaaattacttctcacaaaaaaaagaaattacttcttaatttcaatatgtttcatgcttttcaaggaactcaatattttcacttaggcctttttttccgatttatttttgtaagaaagttaaatctatgtcaactctaaaaatactttaatccatttgtgctttaataacctcattaaagggggaaggagtaatgaagtgatgtttctacttcattaaatatactagtagtgagaactacatatggtggttttataattgttattattcacaactacatcctgaacatttctgaaagatttatagtgattagcaatattcttcttttcaagagagaaaaattatggtatgaagagattagtaattacctaaagattttattggttacttataccaggagtaggctagaactgatatctactaaatctttctattaggtagtccattaaaaacaaacaaacaacaacaaaaaaatttctgtaatttgaccttatagtgctatattgaattgtactaattatgatggctttatcttcctttgactttcagatccaagtaatacctgtgcatttgaatctacatgatctaattgtgtttatacttacgtctttcacaatttttactactattgaggttgtttgtataaatacggtaaatagatctgataacaactcatagctcaggaatttatatatggtgttaatgagcacaagattagtgattcaaactacattttagttccattttataaggcttcaccttcttctcaaccagacagtgtatctggactgtatacaaagagggatggatgccaactgtgaaacccagttttgaaatgtgtttttgttaggcaagatgaggaccaaaggaataaaatattatgagatggtggggaggagataaatgtctaattcctagtctaaggaaatatgtaagatggtggaaccagagtcagaatccaaggaagtctggggccaaagctgacagaagaaacaaataagatgcaaaagcaaaggatttaagatgtgatcagcatggaataatctgggagaggatgctgtcatttttactgccagtccttttaagggtccaatccttcttatcagggatacatctgcccattttaaaaacatcatatttagaaattgcattctgataccagacatcttatagaaagttgtgcttagtcatgcctggagtaggtgagacagaaagaatgagtagttagagtccatgctcacttttagaaaaaagaattcaaagcatatgcactactttgagtgagtcagtattgtcgtcttcaaatgcaaaggataacaagtaatttctccatggccagggttgataaaaagtgactcatgtcaaagatttatcttttttttctccaggcatagtgtttcacaaaaaataaatctatataaactgcaaaagtaaaatgttcatatatggacaactaaaagacagtgtttatccattccattatagacattgtacaactatgagtcatagtggcaaaatgacaagttttccactgtagcatctaagatttaaaaataaaagaaaattagaaatctcaaaaataatagtagattgcaaaataccttgcaacattttttgagtcagccaattactagaaactggaacatatgtttatctgagaaatacctttcagctgccttcctccatggctgtaagatacattttgcactacactgcaatacctataattataggactataattttaggattggaaggaaccttattgatcagttagttaatcccttcttttcacagctgaagaatctaacaactaaactggttaatgaataaatagtaagtgaagtctaataaaacatgtttgaaggctaatagcatctatataataaagactaaatagatacacattcaaaatatgacttcactgttgggcaacataagacagctagtggagaatttagatttctctctttctaactgattgtcatgtcttatggaggaaattctcaaagataatgttaacatatgttgggataaaccctttctgctttacctcttcttgttatctttttcttattttagattgtgtagtgttacagatatatttgtataaccagtggtatattttatgtactctatgaaatttctcttctctcaagaaagttgtagactagccatatttatcttaggttgaagatcatatgttctgttttgccctggacatttctggttgtcatagggtagtagttaataataccctctttcacttttcaaaatacctcagtttgaatgataagttatatgtccacccttgccttaggtatagtctttataaaaaaaaaaatttaacttttattttagattcagggggtacatggacaggtttgttatatgggaatattgtgtgatgctaaggtgtggagtttacgttatcccatcacccagatagtaaacatagtatccaataggtagtttttcagcccttgtgtccctccctctcttccccttctggtagtttcctgtatcgatcgtgcccatttttatgcccacgtgtacccaatgcttaactcccacttataagtgagaacatgtggtactcggttttctgtttttgagtaaatttgcttaggataatgacctctagctgcatcctgttgctccaaaggacatgattttgtcctttttcatggctatctaggattccatggtgtacatgtaacacattttgtttactccatccactattgatagacacctatgtacagtctttattcactatttaaaatagatttatgggattcatcaactgtgcataagagcatttgggtaggtgaggaggcattaatgaaagatggtccagacacaattccaatatttagaaattggtatctggttggggagagaataaatactttaaatgattaagacaacacctaattcagtgacagaataagtgatatgcctgaaaaatctaagagttctgagaaataggaggtttgagggctgaaatgatgagcattttccatcttctctccactctgtttaacatttccttaccccatgggtatctcactgaaggactcctgtgacctgaacctgccttttctgtctctttttcactttattgctctctgtaagttagtgtgtctgctatgttcccattgcctccaacattaaactctcataaaagttttattttcttttactttgtgaattcaataaatctactagttactttgccacagtgatccgggcttatggctttacacgggtaataatcattcatatattaagtggctgcccttatactcagcaaatctgttccttcaaagtgaacttttgcagctattgatttctttccctagttcttgtaccttttaccaaaaagttggatttcccaagagcaacaccattgggaaaacattttagtaattgattgcgatatattttgaaggctatgtgatcttagttctgtgggattccaaaaatgttaattatagagtcctctctattgtaatttctgaagtatcttctctaaactacctccactgaatctgaattcacattgtcttatagtagaagaagatattattcaaatgtttaggaaatttctcaggaaacgataatttaaccatctgtatttgccttgtatatctgtgggacaatagacacattgatttagtatttttcactgttttttgtatagaagacatttttcttttatgttcttgagtaaatcatctcagaaaagatgtaatatttttatgttacaggtagcatcaccataagaatggctcactgattagttttgacttaaatacatgtttaccttagctatgctaagattaagtgtacaattttaatcttcaatatctgtaggcttccaggtttctggacagaattcaagagagtatcattttgtactggtcactgacagtccaaagactgtcgttaactctgatgtttttcaaatgacatattgtgttcacctgaatgtttgacccaacaaggaaaatgaatatttattccatacatccttaaagaagggaatttttcttttgcttttcataatgtaaattacatgatgattgcataaagttttcattgagattagtttataacaatttttttctataaatttaattaataaaaatatctaaatcttaaagtcaaacaattaattttaaatacagccattgacttttcaggacttttaaaacctcataaagattaaaaactgcacttatatatataacagtgctaagataggtcttaggtaattgtaattttctctttataggagatttgaagaataatcttcctatgttggataacgctttatgcaaacagtgtccagagaaaagatataatcctcattaaaagtggttgtgcttgcttagcctctatgtttaatagaaaatcaagacttgctagtgcaaagatagtgtctgttgattcagaagattatagcagtgattttccagaagctaatgaaaggtactaaaatgaattgataatctaactggtgcattttaaaacgcttaaagagaacttaatatataatgtcttcatgaattgcttctagttctgttttaataataaactcgtaactcagatatgcatacaaacaggaatcaattgggacagcaatgagcataaacatttataatcacttgcttttataggaactaaacctatgacagttatatcgatgattagagtacctacacatgaagacaggtagaaagtagaacatacatccaaagtaacatactgtcaaaaatatccaagcaatgattgcatatttgaacaatgtatattaaaagattataaaattatgtgagcagtatgtatttttagcattttatatgcacaactatcttctgtttggtcaaattacgtgtcttttatacacgctaaaaactgaaaacaacatggacaatgcaaaagaataagtttatgtttctaaataaaaacctgtacttgttaatcattttgttttttataacatctccacaacataggaatcaagtcatgaaagcagacaaagtgatactatattctgaagttattatgctgttggcctgactgacatctgtagacataaactctctacctgtttgaaagtattacagatattaatttttaacaatatttgccctaacttgcatttttctctttgtttttagtatctgacattttatatgtctcagattaaatattattttgtggtggtaaaatgtaaacattatttttatgaattcattctcatatatatacaatcacttaaatatgtattgaataccaggaaataagctatatttaacaagtgaacacattaatttcccaggatatgtttattgaaccttatgagactattaattctgatttatgtgctccttatgtttgatacacagaaataggcaaccctttggagaacaaaaaattagaagaaaatagatgctataattcatatttcaagtagtactgtccccagtaatacagagctagtgaaaatagcgcaggatgcttgatactggagtgtactttaaacaataaattattggagggcatagaaacctcatcaagacagcaagtctgcaaagactccatgtgggcaacctggccttgctctcctgtgctgctggtcaacttcctacagctcagctggcattgctcaccagacaagtacatgataggcatatcacttgttgtacattatctttcaactttttatcttttaataattttctggctcattgttacatttcctgtgagaaaaatggagttatttgaaagtttagtttcagtggtttttcttgtggctataattagggtgcagtccacttcccattgatctgtgcacagaatacaaaatacataagagaagaggtgataatgtgaagtgagaagttaaggggaaaatggccatgcggcttctattatagaaatgagggcttaaacacatacaatgacatagcctatatataattgagagttatctatgtgcatgagaagcaatgtgtatgtatgcatatatattagcggtgggaactgtacacaggctaatgtttagcacaaaaaatgataaaataattatttttattaattaaatgcatcaaagcctaattaaggaatgactcatgtgcagatgattatgaataaattgccaaatagaacctgtccaaatgcagaaaaaattgattttaaaataattcatataattattttattgagataatcaaaaatatctaatttgaaagcaaaatgaagatatttgaaataatttggttaacttatcacatataattattttattgaggtaatagcaagtatttaatttggaagcaaaatgaagacatttgaaactagtttggttaacttatcacagctatggtataatttgagtcagaaaactgacatcaactaagtaacaatagtatatcaaaccattgagtatatactatgtgctaaataaaacatgtatgttatgtcattaaattctatcagtaacactgcatggtagatacttgcatttccgtttgatacaagagaaaacacaacttacccacatcacagtagagtgccacagccaaaatttgcagctgtatctctgacatcgtgacatttattttaaaaagagaaaatgaaattagttatttatttaacttaatagagtggttgaaagcatgggctctaaagaaaaccagatggttttaaattctgacaggcactcatatactagctgtgtagtcttggttacttaccttattggagcctggattatctaatttataacatggagataacaatacacagagtaagcactcagtgttgttattattaagatatacatgttgccttaattgactgaaatatctatgacaagtgtaattctgttgatatttatctggatattttaaggtatgttttatttgtcttccaatcaggaacatggtaaccataacctgcccaaccccaaactaataactgaggctataaaaagtaagagtcacttaccatttcattctatgcagtttcctgccttgaaataggtgtcttatggctttggttggcaatactgttaatggaatatagttgtattaaaagcaatttttttttgacaattctttgttagcagtcagcaactaaatatattaagaagccttgttttgcacactcttccaaccacagaacactaaagatgtatatgttataattacaattatcctttctcttcattgtcctgctgaggaatgcactgtaattctggcagctagagtagagttggcttgctttccttggattgcagatgtctaattgcaggcaaccatttcatttaaaatggctcattaaagtaaaaaccatttagcatcagtaacatggatcagcatccatgattatgcatttaattagagagaagtatgttttctcctcttttctaatttttctatctatagatctacctatgtatcaatctatgcatctacccacacacatacacatagatgcacacatgcagatttatacaaagcttgccttagacattaattttatcattttgccatcattgcaactccttggctaattgttccatggagtatgtatagaacgtactaattatgaaattatagaatatattgttactcaatattagtaaattgcatattgcacatataggaattttctgttttgtaggcttttctagatatgttatattttaccttagtaaatgtccttatttactaactgaaatattacttgtttattatcattccaaagaagcgtcatatcctgaacgctttagtttactgatcactgaaataagaccgtggtgtgggaagagagagagagagagagaattccaatttttctcattctcatgcataaaagatcaatcatagaagcatagttttgatgtgatgatatgtcctgttatttgtattgtgaaaatagatttgtctaacaatatttgttcggaaatagaacatttggactttttaagcattacttttaacaatatttttaaaaatagtcaaaaaccacaggcattatctatatcataattctactaaacagcagtgatgagtggcaattagttgtttattgagtcactgtttacataattatttgtaagttatttgtaaatggccttaggttttttagatctataaatttcagtgaataaaatataatttaaaggctttcataatattaaataagaatgaaccaggctgtcttttattagcttatttttcatttcattagagaaaaacacagtttactttggcagaatctagatatgttgatgtactttatcatgtccaaattcgaggcagtaaataattttctgtagagagcccctagtccttaaagagtagactaaatcaacaaaggatccagaagtaaaagtcagaagctaaagtatatttgtgcatttctgtgtcagtaagaaagaagttaagactgagatataaattaagaatacattatataaaacctgctccagtcctgtcctgtaagacagccaggggatagcctcaagagttcaaggttaatgggtctctatgggaagtatttactttctcactggatttttaaattacattcccttttttccccaccagtactactgaagtaaaaagagaaacaaatgaacaaaaacagtgctggcaggtatgctatttattgcccaatggaaaagttataaaatcattgttattactgctgtataataattgatacatactgcttgatatgtgccattgttttatgctggtcacctttcacccttttttgtttttttttgtcacattcttgatatagatcataagcaagaaaagagacaagtgaaagtggaaggggaggaaatagagaaaagataaagagataatagagaaaagaaagagagaggaacttcaagaagagagaaacatacttcacagctgggcaagattcagatttttttttaaaaatgagaggatcaaccatgatttgagagaataaggatacaaagttagtgtttaaaaagagtgaagagagaggggaaagagttgttttgagtttgaagtgttagtaaactatgcttctcacacactgcgatttacttgaatgttagtcgtcaaagtgatatcaaatcttatcactgcattgaaatgcaaaatagatgattgattactattcatagttcttcaactttctttctaagcaaattttcaagtacttctatgcagttgcagtccaagtagctaagtcttagaaattatctgagcagtgaagaaagtattactcatctttaggaaggaatacatttaaactgaaagtgaaattgtgtctctttgatcaatggacaattccaccctaacccagttgctaaagaaactgttttgatgcctttatttttcatgcctgccctcagttactctattgtttttatgctgagtgctacaaagggaacgaccatcaaaatctctttgtactaagaactttaggaaggagtgaaaataatgtataaacaaagcttctgccctagttcattataattgggaaaataaggtaaatgcgattatacaatttcaaagactatataatgaaatagagtgtaagttttagaataaaaacctggagaatcaaatgacaaaaacatttgcacatagggtttcttttagggagtttggaggcaaataacctataccatacctattatataaggcacagaatagataatagtgtttaaataaaaagctataaattgttactcttatacagatataaaaatgaacacattttaaatgttttatttaactcacatgggaaccaggaaaatgttgtaatctattcaaaaaagaatctaaggaacagacacatgtatagactaggaatatgcaaatggcatcaaaatattttccacaaaaaagagtatgaaagtcacttaaaacctctaacagacaagacagaattcataggtatgtcagttacctacaatttacagaatcttaaactgtatcccatagaaccataatcttggcctgccaagaccaagagtgctataaataatacatagttttcctaggaattacaaatcttttctcaaaaatagtaagggcaaaaacctagagaaccataataacactcatttcatcattttcaaatgagtagtgaacagcgtatcttgaacattacaaaagatagaaatcctaaacacaaaaattattatataatacatttgtcagttctttgtgtttatatgcacacacacacacaccttttttttcctagtgtgataattgctttatattttggttattccttttacatcaaacttaatatttcacataatctaatcaattgatctagtcctttgggatgatgtcttgtctttgttctacagatgagacaatcaacttcctatttggattttaaagaaatacgtaagggtttgattaatgatagagttcctgggtagaggaaatgatatttttaaaaaattaattagattatatttttaggaaacattactttattgagatttttacattaagtgataacaatcatattttttttagttttcaaaagagaaaagacttggttgttttctactactattttaagggttagttttttcatcaaagcaatatatatctttatttcatggttcatttttataaaactcgattacaaataatgcgctgtggaatttttcccaaggcaaaagatcaaatatagagaactggccaaatatttatactttgcctctgtgttttcattaatggaatttttattagaacttaatatttgtttatttttgcattttggaaagaagcgtgtctaaatccaaacctttctcttacattacccttttaaaaagccaagtaaatctgagcattcactttcctgctcaaaaccttgcaatcatctcctttactgaagtccaccagcctctgcttgatctgccctatgcagactcatcctccctatctcctcaccccactccttgctttcttcttggcttgcaaacagctgcctcttgctgggttctcccatactggagagaaagagagagcaaggtctctagaattgcctcttatgaggataataatcctatcatgagagtcccactctcaggatcatatataataaatcaaatgactttccaaagtccctaactctacatactaccacattgggaaattaaggcttcaacatatgaattttgagaagactcaagtcagtcaatagcattctgcccctgacaccccaaaattcatgtcctcacatacaaaatacgttcatttcacccaaatacccaaagtattaacttgttccagcagcaactctaaagttcagagtctcatctaaatactatctaaatcagatatgggtgagactcaaagtattactctttcctgagaaaaatttcctttttatatgaacctgtgaagtcagacaaattatatgctttcagaatacaatggtggaacaggtataggataaacatccccattccaaatagaaaaatagaaaagaataaaggggtgggagtcccaaacaagcccaaatcctaacaaggcaaatttaggcctccttcattctgtcttttttactatgttccttttagttcaaaactggcagtgttgctggcataatcctgtctttattcctggactctgctggaatggctgattaacttcatcacagtcattcatgatttctttattaaagttttagccacatctttaatgttctcttcagaacaagctttctctctctctctggtaatatgaataggctgagaattttccaaatcttcaaggtctggttcttttttgcttgacaaattcctgatttaattcctctttcttttttttttttttttttttttttgtattttattataagcagtcaggaggaatcaaattagctgcttcttcaatactttgcttagaaatctcctcagctaattatctagtttcattgttcgtagtccttccttccacaagacactaaaacatagttcagccaaatcccttgctaatttgtaacaagaatcacatttcctccagtttctgatatgtcctcatttccatctgacacatcaccagaattgcccttaacactcatatttttatgtttctttaaaatttgttttaacttcctattatcaccacttaattaatgcccatatttttagtatgcacttcaaattcctacagcctccacccactactgagttccaaagctgcttccacatatgcaggtatttgttacagcagcaccacactcttgttaccaaaatctgtattagtcaaagttccccaaagaaacagtaccaacagataatatagtacaagaaactgactcaagcaattatggagactaagaagttccaagatctgaagttggtatgctggagacccagaagagttaatgttatagttccagtctaaaagccagcagactcaaaacctaaaaagagacaatattgtagcttgagtcagaaagcaggaaaacattaatgtctaacctcagggcagtcaggcaggagaagttctctgttcagcacatgagggtcagccctttttctctatccaggccttcaaatgattggataaggcccacctataatacattagggaggacaattactcagtccactaattcaagtgttaatctcatataaagacatacccacagacacaccaagaatcatgtttgtcaaagtatttgggtacccatgaccctgtcaagttgacacatataattaaccatcacagggagcctagaggtaaagaccttgggtggggggaattatagaaagaggctggagcagatcctacagggccctgaaggacacattaaagaattgggaacttgtcctaaggaaaatgacaacccattggtgatttttaaggaggtaaataaggtaatctgattactattattattttttaaaaggacatgaggaagtttgggttgttgagaggaaaggcagagagaaaggtggtactgtagttagaaattgtggtttgatctcaacttgtcttcatggagaagaaagtggagttccagcttgatccagcttgtcttcattgagaatgggagagttttgaaatatagtgagagattgatttgatatgaggagagaataaaagggagggatcaataatggtggccagtggctagatttagcaaatatatttgtagtgtgtgatttaccacaaatgaagaaagaaggaagttttataggaagaggatgactttagttttaggtttatgaagtttaagtggtgcaggtctgaggtccagaggtgtagtctgggatagacttacatgttgtaacaggccaagatttcctaggtagagaatgtaaaaaatgtagcgataaaggatctgatgaaaaggcacccagtatttgatggatagaggaagggaagccctggaggtaccatcaacttttttttggctcctattgtattcaatatgttgacatttatacaatatctcagaaataacagggtttagaaaacatactgtattagtccgctttcaggctgctgataaaggcatatccaaaagtgggcaatttacaaaagaaagaagtgtaatggacttacagctctgcatggctggagaggcctcacaatcatggcagaaggcaaggaggagcaagtcacatcttaggtggatggcagcaggcagagagagagagcttgtgtagggaaacttccatttttaaaaacatcagacctcgtgagacttattcactatcatgaaaacaatatgtgaaagacccatccctattattcagttatctcccaccagattcctcctataacacatgggaattatgagagctataagatgagatttgagtgaggacacagagccaaaccatatcattcctccccaggcccctcctaaatctcatgccctcacatttcaaaaccaatcatgccttcccaacagtccctcaaagtcttaactcatttcagcactaactcaaaagttcacaatcgaaagtctcatctgagataaggcaagttctttaggcctatgagcctgtaacatcaaaagcaagtttgttacttcatagataaaatggtggtacaggcattgggtaaatacagtcattccaaaagggagaaatcggcccaaaacaaaggggctacaggccccatgcaagtccaaaatctggtggggcagtcaaagctccaaaatgatctttttttactccatgtctcacatccaggtcatgttgatgtaagatgtgggttcccatggtcttaggtagctctgcccctgtggctttgcagagtacagcctccctcatgactgctttcatgggctggtgttgaatgtctgcagcttttctaagtgcacagtacaaactgtcagtggatctatcattctggggtctggaggatggtggcccttttctcacagctccactaggcagtgccccagtaggggctctgtgtggatgttccgacccaacatctccctttcacactgccctagcagagtttctccacgagggccccatccctgcagcaaacttctgcttgggcatccaggtgtttccatacatcttctgaaatctaggcagaggttcccaaaccgcatttcctgacttctgtgcactcacaggcttaacaccacatggaagctgccaaggcttggggcttgcaccctctgaagccacagcctgagctctacattggcccctttcagccgtggctagagcagctgggatgcagggcacaatgtccctagactacacacagcatggggaccctgggcccggcccacaaaaccagtttttcttcctaggcctctgggcctgtgatgggagggactgctgcaaagacctctgacatgccctggaaacattttccccattgtcttggggattaatattcagctccttgttacttattcaaatttctgtagtcagcttgaatttatgctcagaatatggaattttcttttctattgcattgtcagactggctgcaaatttttcagacttttatgctctgcttcccttattaacagcaccccagtcacctcttgaatgctttgctgcttagaaatgtcttccaccagataccctaaatcatctctctcaagttcaaagttccacatatctttaggtcaggggcaaaatgccaccagtctctttgctaaaagaatcaccttttctccagttcccaacaagttccttatctccacccgagaccacctcagccttgatttcattgtccatatcattatcaggattttggttaaagccattcaacaagtctctagggagttccaaactttcccacattttcctgtcttcttctgagccctccaatctgttccaccctctgtctgttaccaagttccaaagttgcttccacattttcagtattttttcagcagcaccccactctactagttccaatttacagtattagtttgttttcatgttgctgataaagacatacctaaggctggtcaatttacaaaagaaagaagtgtaatggacttatagttccacatggctggggagcctcacaatcatggcagaaggcaaggaggagcaaatcatatcttatgtggatggtggcaggcaaaaagagagagcttgtgtagggaaacttaatttttgaagtcatcagatcttatgagacctattcactatcacaagaacagcaggagagagactcgccccaatgatttgatgatctctcaccaggtccctccacaacatgtggcaattatgggagctacaagatgagatttgggtggggacacagatccaaacaatatcacatggtatcatggtgaaaaatgtaatgaaaccatgactacatttgatctttaggtttgcactatgttttaatgagcgtttcaacttttattgcttttatgttgatttttacatctgtctacaaagtgattttttataggcttttggtttttttggctgtagatgtgaaagagaatggtgcattgtgaaagaaaaggttgaacaaaaatcaattcatgtcagaattgattaaaatcaggaaacattttcaatgtcaacaggatatttaggatgagaataattaaatgagctctggaggcaaatgaattattgactacttacaaatatcaggcctaagaagatagagattgagacatatgtcttcttttttttcttagtgaagagaaacagacaaaactcttctaatatgtaacttggtattaaaccattgtgaggaataattaggaaattatcctaacataggaaaaaatatacaattgacacattaaatgtcaattgtaattgacaattgtcaaatgtcaattgtaattgacaattgtcaaatgtcaattgtaattgacaattgtcaaatgtcaattgtaattgacaattgtcaaatgtcaattgtaattgtaattgtcaattgtaattgtaattgtcaactacatgtatatatgtatatatactcctgaaaataatctctctctttaattcttttcagaagcagcttaaagttacatggagaaaattcttaagtagttgatattacaatgtcaacttttgcctattttcagactttgtacttagatactatatgcaaattgcagttttgtatttttcccctgaggattgttctagtgttcccacctgccctatcttcacagctttttttatcccattcctactttatcctttgagacactggtctcattcattcactcatccattcattcatttatatggtaaatattaagcaagagtccctattttcacaaatctgacattgttgaccagggtttctcaaccttggcactactgacaatttggctagataactctttgctgtgggggactgtcctatgtaatgttggatgtttagtgacatccctgttctctacctaatatacgctgatagggcccaaataaatgtctcttgggtggcaaaatcaccctgtgtaaagaaccacagtttgagagagaagaaagacaataaagaaaaataacataacacaatattagtgatgataagtgctgtgaagtaaaatagaaaacgggactgtggtaagagtggcagcaggagcaagggttctaaagctttctcaaggacagcagtctgcatagcgcacagatgtagaagccttgtttctcttttaacagatgtctatcattcactctaaacctgtctatggaattgctaattaaggcaagagcctgatgtattacttacatgattaaattatttctggttcttgactatttacaaaatgtcacagtcacagtaagatttttttgaatatgtcaagtttctcaactgaatagaacattaataacttcaaatggactatcgcatgctattgattttactctcttgtttctgccactggagaacacgaacatcaataaatcacataggccctcagtgggtgattggagggtatatttatttaaaactcttccattaatttttgtttattacattattcaatctatcttatagctggtctgccatttttgtgggtttcagaattgtgaggactcttaatgggaaatgctgtgacactgtgataaatgaaagagcagtggacggtgagtagcacacttgggttctcgttcaggctctgttattgactggctcaaggaccctgggcaaagtacttcacctctgggcagcttctcttaaataaggactagtctaccttcttaatttatttcattgtttttaatgaagaaatgatatagcaaatgtaagataatcttttaaaatgttatattttttctttaaaaaattaggtaattataaggaagatttatatttctcagatattcttgaagttgaggagccacaattgtgactgtttccatcacttgatgtttcttctcctctaacctacttaaaaattgcaggcccctgtgctatcctggtaaatctccctccagtttgccagtatgtgtcatgtttcactgcaaacctcacacaattttctgtaagacatggcctaacccgaaaagtataaggaggctgttaaatctgtggttttggagcagggattttttttttcatgatcatcccccaccctcaaagagcctttatagacattgttttcgtagttgctcacctatgaaatgctaacatcacagatttatcccctgccctccgcagaatcaactttgctctctgggaatgatatggtggagaaagggaaagcgattgcctgagttgagaattcatgtttgactcaaagttaagttggagtctaaattcccagcagctttttggcagatccaacccagtccaaatctgctgtggctgtatagtgtgggacactggctcagctggccggatctggtgttaaatccctgctctctgcactggcttatccttcccaaatactccatgtttctgagtggttctttggctataaaatagcattgtatttcctgttcctgaggttgttgtgaggactaattgaagtaacatataggaaggttgttaacagtgcatggcagatgaaaaacagaaatgttcattattatttatacccaataacagcaatttttaaaaggaaaagggggagaggagaactaatgcttttaagtccacaactgcattctacatttgtgtagtggttattttcactttatttttaagctatgttcagaacgtaacttttgctcttgtttttctttgttaggtttgaccccatgtttaaacatacgtattagtctgttttgtgtttttataaaggaataccttaggctaggtaatttataaagaaaagaggcttctttggttcacagttctgcaggctgtacaagaagcttggctccagccagcctctgcttcttgtgaggacctctggaaactttcaatcatggcagaaaaggaaggggagccggctggcaagaaaggaagcaagagggggtggtgccaggttctttttaacctctagctctcctgttaactaatagagcaagaacttactcattagcatgggtaaagcacgaagccattcatgagggttctgcccactgacccaaacacctcccactagatcccactccaacattagggatcacatttcaccatgagatttttgaggggacaattatccaatctatatcagcctgacatctgcaaatttaattggcttttatgcttctcactcaaggtaaaaaacagaaacaataaacaaataaaatacaaccactactttgaggaggacaaggtcagggaaagccacaagcatgcaagtatgcaactaggaaatttccctgaggacactggttgtcaaccttgactgtataatttggactgaggtatggcctaagtgttggaattttaaataattcaccaaatgattctaatgggaaatagggtcaagaactaccaaatattcaataataaggaatccactcaaatagaccaactattactagagttttcttaagttctctgttgaaatccagatacacttgtctgcagaattcatctgttaggaagaaacttttcctctatgatcttaggttcaaatggttggggtcctgagagttaactgacgatagatagattagcagaataaaagacagtgtttatgtatatgtacattgcaaaccctcaggagtactcagtgatgagtaactcactgaatcctcaaaattaacattttatataccattttaacaaaatgtatttttttaaaagggcatcagtggaaacgtatggaaagtttattgggctttttgatgctaatgagaataggaagcctgtctccatggcagctgaattcacaggaaattccttgcaggggagttaatgggagctatattttcaggacattctgctttaatcagataagggatgttcagataagatttctttttcattttctgtagctcaaatgttttcacttgaaaataatctttatgctaaaccgtgatctctttacatgtgataactcttaaaatgagaaaatgacacacaactacaccaaaaaagcaaataatttaagcatggcattactgagtgctcattatgtcccagttttatttaccagggccaagtaatgtgtccaaagttaacagctaataaatagcaaagctgggagtatgcccaggtttacctgactccaaggtcaacactctgttataccacactgttcttaatatgccctagtggtaacagcctctctttagacttctactgaggttaataagctatcatacaattctgcttaagaagattatcagaatatacttttttctatttttggaaaaagcaaatgtatatctttttaatagtttttagcttcctagcagtgacagtgaaccaggcctggtgtgcctgttacgcagtatgccaatcactaaggtgacaagtttgcagcagagaaagagtttattcatgaggcagccaggtgaggaggtgagaggacaggtctcaaatctgcctcctgaagatgtggtttagggatatttgtgggataaagaatcagggtggactaaggtgtggggtaagatgattgaggtgtcaacaaaaagagtcagactctgtaaaatatttgcagagatttactctgagccaaatatgagtgactgtggcccatgacacagcccttaagaggtcctgagaacacgtcctcaaggtggtcggggtgcagcttggttttatacattttaaggaggcatgagacattaatcaaatacatttaagaaatgcattggtttggtccagaaaggcgggacaatttgaggcaagggcttccaggctatagataaattgaaacattttttagttgacaattggctgagtttgtctaaagacctgggatcaatagaaatgaatatctgggttaagataagtggttgtagagaccaaagttttaccatgcagatgaagcttttagctagcaggtttcaaagagaataggctgtaaaatgttttttatcatacttaaagtctgtgttgatgttaatgccggagaggtataatgaggcatgctagaccccccacttcccatcatggcctaaaaccgtctctcaggttaaattttaagagccctggctgaggacgaagtccattcacatggttgacagggggagattagaattttatttttggtttagagagattaaggaaaagtgaggtaactggcgatctatacgagcatagtcaagcttcgtggctctttacgggaatcatgtttacaaaatggtatttgttagcatgattttagggtggagtttttagtccctggacaacaaaaggtcacctattggacatttacaccagcccaactggagggttagtggtttcaaccagcttgcattggacaagagctgaccaagttcctgaaaaacaacttaaacaatcgttaccatggtgacctacacctcagcgatgttataagaaagttaggaaaagtttagtttatatcgcttagctatgtgacttttagctatataagttttaaaatcaactagaagcaagcagctaaaagcaagccagatgggttaagtttggtgggcctaatcaggtcagcccttgttttaagcagggtttaatccatcttatatgaaaaatttcttaacacgttgggatgcaattcacttctatatggaaacttatttagaccagctaatagctgtcttcctaatgcttctttatcttggcctttagaggcttccttccatagttttttccatagtcttttatctacaccttgttctccttaccacagagaaagtaatcaaaatggagttgtgtggtcttgtattctccttctggtctttaaaaataacatcaaccctcaatttcattcatgataacaagtgccctatgtagtatgtcctatcacttccatattttttcttactttaaaaataattaaaaatttcagatacttaaagcaagtgttaggtagccattatatttgcttaatatgagtattattaatttttaaaaaacgttaataggttttttgggaacaggtggtatttagttaaatgaacaagttctttagtggtgatttctgagattttggtgcatccattacctgagaagtgtacactgtagcaatatgtagtctttttttattttgagatggagtctcactctgttgcccaggctggagtgcagtggcatgatctcggctcactgaaagctccacctcccaggttcacaccattctcctgcttcagcctcctgagtagctgggactataggcgcccgccaccacgcccggctaattttttgtgtttttagtagagacggggtttcaacatgttggccaggatgttctcgatctcctgacctcatgatccgcccgcctcggcctcccaaagttctgggattacagacatgagccgtcgtgcccagccagcaatatgtagtcttttatcccttgccaaccgctatcctttcctctgagtctccaaagtccaatgtgtcattcttatgcctttggctcttcatagcttagctctcacatattagtgagaatatacgatgtttggttttccatttctgagttacttcacttaaaataatggtctccaattccacgattccatccaggttgctatgaatgccattatttcattctttattatggctgagtagtattccatggtgtgtgtgtgtgtgtgtgtgtgcgtgcgcgcatatatatatatatatatatatatatatatatatatcacaatttctttttctttttctttttttttttttttaagatggagtttcactcttgttgcccaggctggagtgcaatggcacgatctcagctcactgcaacctctgcctcctgggttcaagcgattcttctgcctcagcctcccgagtagctgagattacaggcacacaccactatgcctggctaatttttttgtatttttagtagagatggggtttctctatgttggtcaggatggtctcgaactcctgacctcaggtaatccgcccaccttggcctcccaaagtgctgggattacaggcaagagccactgcacctggcccacagtttcttaatccatttgttgattgatgggcatatgggctggttccatatgtttgcaactgcaaattgtgagcactgtttaattctaagcttccttgtaggtaaggcaaaaagcaagcaaagtattttaggcaattcccataactaaagggaaattatttattatatttgtccatttgaaaagatattttttcatgttgtaaaaaatttattaaatgaatgctaacataaggattaataaacaacatgatcttaacattcttcatggagtaatttagtttttttcaatttttgataaaaagctgaaggtatatcaacttgttattcagtgaaaggataactattggtagcgaaatataaacctgatctagatttggagatcaaaattttggatttatacactttagggaatatatcagaatgaataaccttcacatcacattgagtactctatgaagaatcagttacatgggctggacttttgatcagaccctcatagaaaacagctgagcatgatgggcctggcattctattgatgattaccaatacagtcatgtattgcttaaaaagcacctggccaagttatacatattataaaggctttttggtattctcgttgagatggattgagaaatattttatatatattttttgagaaacgttttatgtatgaataatagatgggcaatatgaaatcacagtataaaatttagttttctttcaactagtctcaaaatttcatgcccattacaaaattaaaactaagaaaaaaaattagccatgtttattttttctttttctgttgtcagtgttcttttaacaccttagctcttcagggtgctctccctgcagctatatttttagatgtttcccagtttctctcctcatcaggatcatttaatattgtaacacttcaatttttaaataactccattttaatattttgtgattgagctatttcaccatatgagaatcttaggtctttctgttttctgaaagttttgaaatatgacttaaagcttgaactaaatgtatggttatatcccacaattctcgtctcctaaccacccttccccaagattattcagaatgtcaagataacaaattatatttcgcggagtctcatcattccaacttcaccacgagtttttccttattgacccaaagtaactttactgctttctctgttgtctgaggcattaaattgccagccagctaggcaagtgaagaaattaatttatttagttgaataataattctaggagaattgagtactgttttttctgtctcctttctatcatttgtctaactaatctctctagcatttggtggtataaatacagaatagtcatctattttaatcatctaaccaggtagtgtatatcatcctcacaaatagtgcaacttagattccagtcttattgttaacatcctgctaccttcaaatattttatttatttattgagacagagtcttactttttgcccaggctggagtgcagtggcatgatctcggctcactgcaacctctgcctcctgggttcaattgattcttctgcctcagcctcctgagtagctgggataacaggcatgttccaccatgcctggctaatttttgtatttttagtagaggcagggtttcaccatgttggccaggctggtcttgaactcctgacctcaactaatcagctcacctcagcctcccaaagtgctgggattacaggagttagccactgcgcctggcctaccttcaaatttttgtctcagtggataagacagattttgttacccattttcttcttcaaattgacttgtttgttctattaagatatacattttcacttccactttctaatattgaatccctcagtttccctttgtaaatacatatgtgcatatgtgtatgcacacacacacacatatatactcccaaacacacccatatattctttattgtaataccccgcttgttgatatatagttatgggaggacaaaggtattttctgtaatatggttgtgttctcctatgaatgctttgggaaattccctaatgtttttctatctgtgtcatatctattatatttttataacccttgttaacattttaatattatttttattttcccataaattttatgtttaaatcttctgaattagatcagcagttcaccagagaaataagtcttccgtgtccctttgaaaatactttctaagtcacaaatccccaccaagtttggtatcttaaatcatgattctgccaccatctatataaccagctgctcagcatttttcctttcctaaatcacacattgaatgggaggaagaattttaacacttggaaccctttaaaggaaccctttagctttctgcctaggatgtcatgaattctaaaaatggtttgcatgtgtattatgatggcatcattcatacccacatgaatcagcaggcatggatagttgtcagcaggtgtgataaggcttggcagtttttccattatgtcctggatacatgctgcagaaaggcaatggcttttctgtttggccatgtcaagtctacataaaatttactcattctccttggtgaatgactagctttgttcaattagatagccttcattcttttctgaaaataaactgttatttcatcctaagtaattaatatctgaatttttgtatgttttggaatttctatgttttatatctgtaataaaattaagatatatgtacatcttaatttattgagtcaatattaatatatttctgaaataattcaaagattaatagcactattttataacaacattatagacaatattggtagatgcatcattcattgttatttggatgacttaaattatatcagaattactaaataagaattaaatattgataaaaatagagggaaagagtatcccatactgtgccatctttgaggtcacagctcatgaaagagagaaaactgcaaaacagactttatctttgggtattatttcacaacaatcttatcttactttgttctgtggttggcaggccgtgtgctatagaggccaacagccagagtctctgcaggaggatttcaaatagtgccaaatcagaaagagatagcagccaaagggaactgacattgcaattgctagaatttctcctgaaaatgttcatattttaggtaaaaataagcaaaattatgttactgcagtcactaccatgtaaaacaaggggcaatcttggttgggttaagttataacatgatgttaaaaatggaaagtacatatctgaaagatattcatgcagtcaaattaataaaaatgtcagaataagctatttcttattctggaggttgttagaaatgaagtagactaagatgcattctctgttagggaaagtcatgaaatacagtcataatttggttctataattcctttcatcaatttagcacaaaacagataattaaataaaaattatttagtagtgataaaatttgtattctgggagttaatcatccttgttaaattaaaggacaaattaatgttgggaaattctgggacagctaaaagacattaaaaaggacattaagtatattaattaaaccatatcaaattgccattttttggtaaaaaatggttgatatttataattacatatggttcaatttaggtagtatttaattcattatttacattataaatatttatataaatttatctttttccaccagactctgagtcctgctagtgcaggcttattgatttatgtatcaccagtatatatcacagtatctgatactctacagctgttgaaaaaatgttgaataagaaactgagactattcgccaggacaattgtctccagcagtttgattgactatcactcaaaatatatgtacatgtattgacttacaaattatgttctgattcattatacatgttacatcataaaacatatatatacatatattaaacatttttaaagataattttattttgtctaggaagaagacattggcttagaaaaactccaacattttagcctgacagtaaatactaaatttgcaattgcttggaaagaacaagtgcagtaatttaaatctggcttttcatctttcttattttaaaggaattgaattagggcaaagaaaaggaactaacttttattaagcacctggaataagaaaacaaatttatgtacattattaaatttacacttaacaaaggaagtattattttatttatatattgatttattttttgagacagagtctgcctctgtcacccaggttgaagtgcagtggtgcgatctcggctcactgcaacctctgccttctgggttcaagcgattctccggcctcagcctcccgagtaactgggattacaagtgcccaccactatgcctagataatttttgtatttttaatagacacaagatttcaccatgttggccaggctggtcttgaactcctgaccttgagtgatccatctgtctcggccccccagattgatggaattacaggcatgaaccaccacgcctggccagaagtattatttttgctaagcagaatttaaagctgaaaatctgagaagttagataaattgtccacagccattatccagttcctagttccagagcctggcctaaaacctggtctgaggtctggtaataaagcctgacatgtgcgtttccttcctaaaaatgatgatagtagtctatcaatgagggttaaaaaatggacatttttcataaatttatgcattttacttctgtatgacctgtatggagaaaagtgattttctctttttggtaaataagcaagactcctaaatcaaggcaactattcaatatttctaacttcttggtttcttttaatagcaacagcagtagcaacacaagctaactattgcttactgaaaacttgtgtgtgccagtttctttttttttttttttttttttttgtgtgagacagggtcttactctgatgcccaggctggagttcagtggctcaatctcggctcacctcaacctccgcctcccaggttcaactgattctcctgcctcagcctcccaagtagctgggattacagatgttcgccaccatgcctggctaatttttacttttttttggtagggacagggtttcaccatgttggccaggctggtcttgaattcctgaccttgagtgatccttctgcctaggcctcccaaggtgctaggattataggcatgagccactgcacccagcagtgtgtgccagtttctatgataaatatcgtacctaaagttgcctcatgtagccttcataattacccggttgaggtattatttttaccattttgctcttgtgaatactgaggcttaaagggaccaagttggccagtgttacacagaaggtaagtgacagggctaggatttgaacataagtttcttagactccaaagtcccttctctgtaatcacaataaatactgctgcccttctgaagagccagattttgtgatgtgtccatgatgcttcctttattttacccttctcaccgaggcccagataaatgtgtttgaaaaccattcaatcatactcattgggaatagtaaggtaaataaaagcatcaaaccttgtagaggaatcctttgtcctctcagtggcatagctagtatttcttccatggctagctgattaatggcagacaaagcagcatgcctattgcacatatctatagcacaagctatagtaacaagacttatcaatatctcaatgctatagcaagaaaaagcattcagggagaattatgcaattatttttctgtagtttctgactccttgatttgggaaagttagtagctgaatgctcagagagagagagaaagagaagggttgtaactatatagagggttaggttaagccttgtggattagctgcagttggacaggagcttggtagaggaataatagactttccatgttctttcattcaggcccactggctatttcattcaccgctttttaacttacatttcatgacttttctagaattaacagggcaaatggttcaaaatactgccagttaatttgtagataattttaaattctctcatcattgtgagatattgtggtacagtgaaaaaagtactatattttgaagcaaaacattgagaccctcttttaccatgtactaactgtaaatttgtaaggtcacctctattttctaaatttcttttttcttatttatgtatctatttcttctaaattttttgtagagatgggggtcccactatgttatccaggctggtctcaaacttgcgggctcaagtgattctctcaccttggcttccaaaagtgctgggatttcaggcatgagccaccacacctagctattttctaaatttcttttttttttatttttactttttattatggggaattttaaatatgtacaaaagtagacacaatagtaataacaaaccctcatgtattctacctagtttcaaaaattatgaactcactatggcatcttatttctttgtccttctcactttacttttccattttatatcatagtaaatccgagacatcacatcattttattgatacatattatgttttgtattactaaaaatatgggctttaaaaaccatatataaccaaaataccagaatactacctaaaataaactaataactttttaacatcatcaaatatacaatgatctaatttccaattgccttacaaacttcattttttcccccctaccattgggtttttggaatagggattcaaataaagtccatccattacaataggttgacattattttaccatctggattttgctgattgcaaccccatgataatcttcaacatgttcatctgtcctctatattttctgtaaattggtggttggttctagaggcttaatcacacttaacgttggatatgtttgtttgttctcgtgcaaaattacttcatagatgatactgtcttcttccctcagaaggttgttaatgtttgtgtctcttgtgatgttaggaaccagtgatgatcactatctagctttattaattcattaggggctaaatgaggagattctatttctttcactttctcctcacttattagctggaatatttctaaaagaaaaaccttccctatgtactatttagtttcccattcatacaatttcatgtagaaaagaaaaaaataaatgcttattttcctttatttaccacttttcaaaatgataaattggttctttatcatcttacaacaccttatatgttaatttttgtatcattacaaactataaataaatatatttattgtgcttcaattcttttccatgattgttctttttgagttttaattattttattttggtcattgtgaacctcctcaacgagcctcaaaataattttgactctgacctgtttctcattgatagtgtcttttgttgagtattaacacgattttccagaattatcttgtatatatttttgccccagccctaaattagcagtttatcaaagtagcttggtttctttcggtgggaattgttacatcaaaactgtaatacaggcactgtggtactcattgctttcgacttagtcacagttcataggcttctctgtagacaaagctggaaaatattttatttcatttcattttaaattataaaacccattaagagtttattttgataattccaactcaaatttagaactacaataatttaatcttctattttatgtctgtatctcctttccctgacagtgaaaaatctaggtttttagtgataacagaagtggtagaattagaatattatgtagtcatttgcgttattccaaaaacaaacataagagtctcagaataccaatactaacatgaacatatgttgtaactgtaataaatatgagcaataatattgcatatgtaagagtacacagtaaattcaaagctttgtacaaagttaagtagttttaaaatatcatcctgaaaatactgtagatgtatttccacaaatctccgaaagagaaaatattgttagacgtatgatacaaactgacaaaagaacttatattagaaggtaaactttgaattattggtctgcaatatggtaaaactgaatattttaaatcaagacaaaataagacgggctgggcgcggtggctcacgcttgtaatcccagcactttgggaggccgaggcgggaggatcacgaggtcaggaaatcgagaccacggtgaaacccagtctctactaaaaatacaaaaaattagcctggcgtggtggcgggcgcctgtagtcccagctacttggagaggctgaggcaggagaatggcgtgaacctgggaggcggagcttgcagtaagccgagatcttgccactgcactccagcctgggcggcagagcgagactccgtctcaaaaaaaaaaaaaaaaaaaagaaaataacacgatcaccatgtccaacttccaaaacacttttgctgcaatattcctatgaatataataagatttcctaagaagcaagggcattttaaaggaagaaatcattttgttctttcttaagatctagaatttaaactcacaatataatctgatgcattgtaagttatggagagtatgaagtctttgtggggaaaatgaactagatacgtaattatgaatacaatccatgaaaggtaactaactgtttccagatatacttaagaacactcattttatttctatgtctttacttttaaaggactctttgaacatcaataattactaaccagttaggttttatattaatattaatatgacaaaaaaagaaaaaaaaggaacagaatattagtgaaaatgtgggtcttctatttttgctgcatgataattgatagttttccaacatattaataaggcattgctggggttttctactgtgtatagtaatataaaatatttgtagcatagaatatattaaaataatagtacaaataaaatcaattgaaatacagtcttatgttactggatacaataatttgttaattaaaattatattaatttttaagactgttccacatattacatttaaaacttttaattaatgtttttgaattaattgaagctatccaatattgtaatttacatagatttagctatgggatgaagtataaagataaattactttttttaataaaaatggaagaaaatatccaattaatagttgctggagaagaaatatcacaatatttcttagataacttcttctcctataagtatatagtattgattacataaaatttatgttggtaaagtgattgatttatcttcttttattatgtattttcagaattcaagacttagttgtaaaagtattcatatgatgtaattagcttttacaaatgttaaacacaatcttattccaaaaggtatcttaatttgtatcaaagtaaatctcttttgaaaggcaatatgtgcctgagatatgtttgtgcataattagattgttctatctcaaagttgcttaaggaaacaaagctattatgttgtaggagacagtaaaatgatttaggatatgggttctggattctagttcagattttctgtcttacgtagctgtctgatttggggcatttcaattatctacttaatattttgtaagtgtttaccctacagtagacctatgctaaccaatcataatgtaaatgtaaccaaaagagctataatccttttccccacagaacattcagtctcacgagggaaatagacacacatgcaattactatccataaaatgtgatgagtgctatgtgaaggaggacagggtactaggttagcacatagctgaggctccttactcaaatcctggatgatcagggaggtgcagcctatgctaactaggaactggattatgggaacgagggatgagtgatccagatagcagaaacgatatgtgcaatggctcagaggtaagaaaacctggctcctgtgaggaaatgaaatgttactcggtatggatggatcatgggaatcagaggagtaagggatagcggaatgtaaacaaagacagatgaaaagaggctggactatgaagggcctcataatccacatgggagaatatgaacttgatcctttcagcgatgtaggcactcttgaagccttttaaaattaactctgcttgaattgtggccaatggccgacaccaacaggttgatcctgaaagcaaggaacaagaagaaaagacatgaaaacaagtcacttaaactcactgtcccttatgacaggattagcataaatcatttcttttcttttttctttttggtttttttttttttttttttttttgagacggagtcttgctctgtcatccagtctggagtgcagtggcacgatctcgactcactgcaagctccgcttcccgggttcacgccattctcctgcatcagcctcccgagtggctgggactacaggcgcccgccaccacgcccagctgattttttgtatttttagtagagatggggtttcaccatgttaagccaggatggtcttgatctcctgaccttgtgatccgcctgcctcggcctcccaaagtgctgggattataggcatgagccaccgtgcccggccgcataaatcatttctaaattcactcctagccatattatatgagttcaaaatcttttctacctagtctagactctagagagttttcgagaagatttttcctcatggagatataatgggagaaaatgagttccatcttccagataaactagtgtgttatctgccttagctcgtcagatacatgagaaatcagaccacacactaataaaaacctaatttaaaagtgtatctactaagtgtgtatgataagtttttgacatttggaacagagcagtatcagatgcagcactatagtaacattaatacaatatgacaaagtggtaactaaatattgtgaaatatattattctcttacagatgtgtctagtttattgacagaactgatttatatagtgcatttcatcctaggaaagcaattttatgaaacattattataatggaaattgtgttttttcaattagttgttgaacgccaagactttaactcctgggggaaaatgtttataaggaatactttctgttaagagtgggcatgtgggcacttcattagaaaggttttatactagaggacttttataggtggtataaaactccctcccccccaggttttgtgttgtttaataacatctgaagccaacatgatgccattccttgttagtgctgctgctgcacagtttcagacaagatgagcagaagaggtaagtttccctaagggagtagttagaaaattaattaaactgagggaggcactgggatatttagaaaacaaattagagtcaagaacaaacacacacaagaacaaaagggagtaataagaaccaagggagaaagaacaaagtttaagtcatggctttccctccactgtcctaaacagaatctggataatgtatcttagaaaattaagtttcttatctacatttataatctacatttataaatggttacatttataatctacatttataaatggttacatttataatctgaaaataatctgaaatatctacatttataaatggttacatttacaacatttaaacattttattccaacactgtttaaaagatacgttttctcctaagcaaagccttcatgccaatcatgaatctcagaggctgttctactaaacgtcattttgaaggttgccataaactcttcataaaggacaagtttataagggcttggtataaaaataaacattcaagcgctctctgaaaataatttctttaaatgaccatttgaaattaaaaataagatttatttttggtgttgaattaactgcaaatacaagagtactacaacttcttagacaagtaggctttaatgtactagtttaaaatacagagttgtcttgtctgccagtcaatatttatgaatttattcaattttcatgaagtttgataaaaaatttggcattttttgctattgcacttactaagaattaatcctcacacttcctaaatcaaatggatattcttaaaagcaaagacatcttattagatatgcatttaattttgaaaagcgaccttctgaaacttgtaagtaattactttgtaaaaactctagtggttgagattcacgttccagaaaaatcttgctttaaatagctttaaatgggacatatatggttagcatggaatgagaaaagaaaatatatgccctctcattgatattatattattggattattatgctttgtggcctttgaactggtgaatattagagccacttgttacattatctatcaaaagaaaaatatttttaaacatgaggattggggtttaggcaaccattttacaaataaatcaattaatatttatacagtacctaatgtatttaaatttttaagttcagtttaaatttaaaagttcagttcttcatggaaaacaatatagtaaggaagaaaaatcatgaatatgttaaattattaaaatgtaaacaaaattggacaattatacatagtgataataataactatgttttcctggatgtttagtctagtgaagcactctacatgcattatttcatttaaaagtttacagtgggaatacatttaacttcttttctcaacatgcagatgagataaatacaattatcattctatttcatagattggtatactgaggttcaaaggggatgagcgattcgcctaaggacatagagtccagcttcaaacaataaagtctggcttcctacatgagtaatttcacaaactgagttactaaggcctctctttcataaatccaggcatggagatcctgtgttaatggaattgagatccttccaggtacagtttgaaaagtctaccctagtggtctgcaaatggaaaataacattttcttcatttcttttaaaaaagcaatttctctaatgttttgtcttttacttacttcagtctgtccattttagtagtttttttctgcttagaattgatatctgaattataaatgctagctttatttttggcattaagaaataatcacaactgggtgcaatggcacaagcctacaataccagcactttgggaggctgaggcaggaagattgcttgagtccaggaattttgagaccagcatggacaacatggtgaaatcccaactttacaaaaaatactagcctggtgtgatggtgagcacctctagtcccagctacttgggaggctgaggtgggagggttgcttgagcctgggagagggaggttgcattgagccaagattgtaccactgcactctagcctgggcaacagaatgaggccctgccttaaaataaattaaaaattaaataaataaatgaatgaaggtaggttgagtataaagtatagtgtataaatgatgagttaaagcattttaatatttttttcagtgtatttcagtacttatcttgctataactaagccagaatgcatgatgtggggattattatccatttgatatattatcctccttaaaatatagtttatgtaattcaaagcatatgtggattattaagtgcacattgtttatagttaaataacttgctggtgttcatccattgctccctgttggaagatactccaatgttgaaagcaaaatctctgctgtttgtttaattgtgccccagggtacagttgggaatgtgtctatgagtgaaagaacaccagttttaataagaatacaatgtaatttaacagttcataaaacagtaaaatttaatcctgaactgagagatttattaaatttcactcagcagaatagagcatgggatataagagcaagtgagaattaagtgaaatgatttcaggggtaatagattttattacgtgataaactgggggaatcattctttttttgaaaagctatttattcttaattcattctttggaaataattgtcttacataggaaagctttttggagacaaaataaataaacttgaaactattaaaagcttttgtttaactttatttgtttaatttcaaaagagtaaaactatactactaaaatcatatcaccattatggctaaaatattttaaactgtaagtgaaagtattttgcattcagggaaaaaggaccagtcttctttttgtaatattcatttaaagtcctcccaaactaaatgatgcttgacaacatgctgtctcagagagtttcatttttgcatatcaagtagcatattaaaaaattcttaggcatattctctgcatctgtaatgattgattccattggagctttacctaaaatgggaaatattttaaaatttattttgtttttccctttcttttaaattatgtaaagaagtattaaacagtttgaacatgctattgaagattataatgagttacattagtaaaattttctcaactgtaagacctacaattgctattttttattttcctttttttgtaggggttgtaaaacaattttctgagtaaaagaaggaggctcccccaaagctagatgtctctttatttgcataacaaaacagcagcaactattgagtgtatagagatttagctgtgttttaatacacattgtatctattgagcttcattacacctagtggagaaagtagggcagatattattgcacctactttataccttggacaaatgaggtttggagaggttactgtttaccaggggacatatggctgttaagtgcagaacagattcagcaatggtcatttgagttcaagtcataaagacaccattaaggccctttgttgtgtattaaccagccaacatttaatattagtttttaatgatataaataattttattacagtcacaattgtgtttgtaattattcaaaatccatgaataatttcaataattgactgttttaaaataagattttaaaaaataaaaaaaggtttctttaataatcactagctagataaatgcagcattttattttttttatttttttatttatttttatttttatttttttttgagacggagtctcgctctgtcgcccaggccggactgcggactgcagtggcgcaatctcggctcacttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccagcattttattttttaaacaaaaatatgtatatgtaaaatgtttaacattgttgagtgatgaaatacctgtgaaagtttttataaactacctaaatatgaattcagtgatatttaattaaatgactgtgagattatggaattaaatatatatatttaattatatatatttattatatataattaattatatttaattatatatttattatatataattaattatatttaattatatatttattatatataattaattatatttaattatatatttattatatataattaattatatttaattatatatttattatatataattaattatatttaattatatatttattatatataattaattatatttaattatatatttattatatataattaattatatttaattaattatatataattatatataattatatataattatatttaattatatgtttaattatatataattatatataattatatgtttaattatatataattatatatttaattatatataattatatataattatatatttaattatatttaattatataattatatatttaattatatataattatatataaatcaaggttaacacaaactatgcctcttaagctgtgtactattttatgttgagatttttgcttatcaagtacaatctatgaaaagttaacactgtcatacaaaattaatttttcatctcttgactttgacagctatgttttatatcatctacacagtgtctgtctcatatgagatacttaatacatgttaaatagtaataagaatcaaatgtcagctcttagttgatggacatgacatgaagtctcagtgattcttcagaaatgaatctgaacagaactatccaaagacagttaaatggttcaaagaactctaatattgagtgtcctcttttgactccatctagaaagatcatagcattcagggagaagaggactgctggatcacacattagtcttttcaagcatacctgtacacagaaatagtctctagggccactatctttgaattccatggctacaaatggaaacaatgtgaattgctgggtggcctttgtggtatgtctggtgctgagcaataataaaggaaaatgaagggaaagcaagaacacttaagtctgtgtgactctaatgatttttagtcatttcttctttttttttccccatgcagctattttaagttaatacaggttcccctaaaggcaaatataactgactcattaggaaatcagttgggaaaacaatattttgcaattgtggccccaccccttcatttctccagagctcatgatagcacacatgctctatctctgttggctatatttttagctttcccacattattttgcaatattcctttccagactaaaaaattaacaaaactccacactgaagcaacaaatcactatcttacacaataattcactaaaataggaccttaaggtattttgcctttcttcaaactcagactgaaagcttttctggtcacgatttttcaaggttatacttttataacaaaaccagatgcaaagattttacctaatcagattttacaataatgcccccatttccctccctccctccctccctcccttcctttcttccttccttccttcttttcttttcttcctttgtttcctttccttccttcccttcctttcctttcccctcccttcctttccttccttcctcccttcttttcttttcttcctttctttcctttgtttgtttcttttccttcctttccttccttcccttcctttcctttcccctcccttcctttccttccttcctcccttcttttcttttcttcctttctttcctttgtttgtttcttttccttcctttccttccttcccttcctttcctttcccctcccttcctttccttccttcctcccttcctttccttccttcctcccttcctttccttcctccctcccttcctcttcctctgtctctgtctctgtctctctctctctctcttctttctcagacagggtgtcactctgttgcccaggctagagtagagtggcactatcataactcattgcagcctcaaactcctgtgctcgaatgatcctcccatctcagcctcccaagtagctgggactacaggtgggcatcatgaagcctggctaatttttttattttattattttttttaaagacagggtcttgctatgctgcccaagttggtttcaaacaatcctgcctgagcctcccaaaatgctgggttttgctttcctgacaccggtatctcctggttcaaataatcctgcctgagcctccccaagtgcagggattacacgtgtgagccaccatccagccccaatttctttctttcttttttaaaattaggttcttcctaattacttctgaatgacagtgaatgacttaggctcttaatttgcctttgaatccaggtattcagggtgacaagaccaacatttgcctggtctagtttgataaatgactctgtctaaaatggtgtcattaagtacgtgccttgacaggatttgaagtttttttctaattcaagatgctaattacagctttcttgtccagttaatattcagctaaaaagtacacatgtcaggcaggtcagtttcagatacccatgaggttaatctagaagcaaactaaagtgaccatcaaagtataatattttcagtacattttggatttttaaaaatgtatttgttttgctgagacacttctttgtgactgaatcatcagacttaagagctggcttttgattgtagatctcctagagtcagcccagacagactcaacagcaggtatagattccagggctgtctacaagaggccacagtgccaggacaaatcatgctgggcgttccttggagacgctcatgtacaaatgaaataatgtttcaaagaacatcaaggccatcctccagaggaacaagaaatgacaaaaggacaatgtacagattgagggtcttggcagaaaatcaaagtggctgtccctactgctttgatttgatgacaatgtggtaagaacattcgagtagcaggatttgtttttaacaactgagtgatttcctgggtgccaaagctctgggtcagtgtaatgtcctaatttattcaatcctgaaaaccactctgaatgtgaggtttctagaaatggcatataagtcttatttagtcactctttgttagttgctgatatctgattaaacaacacaaattaactagctgtttgaatgtgttatgaatgtctatgtctcccagaagacacacatttcttgtctgatttttcttactatgtggaagttagcatcttattcaatttattagccaatcaaaatcatctgtattttctactaaaatcaatccccttttgaattcatctcatgccattaaataagtaaccaggggaaattcttcttctttgttcactcaaggtttaagaaatttggccagatgaaatagtataaatcttttatgaaaaataacatattcctgttaattcatctaaacttagttgaaatttaaaatatgttagatatttttctggactagtttcataggtgtgtgatctatatagtcacatgggaccttatttaattcttaatattatttggaaaagaggccatgcgtttttttgtttttttgtttttttttcctgggccctgcaaattatgaagccagccttgtttgcttccagtatttaaatagtaccggtgtttgcacaaataagtctaagaacaaaaaccacttgaatgtattatctgatttgacaagaaaagagataaacgtttgtccttaaggaaggtgatcccaagatcagaaacttaaataaggttttaaatcctgtattttggcttccctgacaccagtatctcctggttctctgtattcactgtctctctctctcatgcttctcttccttcatcacttatatgtcagagaatctcagggctatcttctctcaatttacctttattcctgagtgtcatttgctcttgtggttccaatccttctcataaatttatgatttccaaatttataacccaggtccatacctctcctttgagccatgaactcatgtaccagacgcctccacttgcaagtttggaaactcaatatcatcttccgtgacatcttcctgaaacctcttgattactgatggggatacagcagtcaaatgaagtctctatacacatagagattatgttttagaagagggaaaagataaccagcactctgtgtgtgtgtatgtgtgagagagagagagatgagaaagtgaaaagtgctctgaagaaaagcaaggtgagagaatgaagaaatatgtgaaagtgtatttctaatagcatttatctgcattactttttatctcagtgaatattatgaccatcttccctttggcccaaacactaataaacctgggagttattgtagcctcccttctcttcattatcatcattgttattattttaaagttgaggtctcaccctgttacccaggctgaagtcactaggattatttttaatgagtttcctgaaggatctcctgcctctagtattataccaatgtgtctgtcattctccccactcaggaagtgctctttcctaaaagtaaatctgatcatttctgtcctctgaaaacactttaatatcttccactcatcctacagataaaatctacgctcctagccatggctgacgaaatcttcatttttctgtgtgtgtgtgtgttttgttgttaattattacttattaccttctccagcctcatccattatcactgcaaatccacaccttcactggtgcttcatctatgaggaacatttttcagcttctcaacactgtcttgttgtctctcatttctgagctgtcacatctttctccttctccacctaactcttagacttctttagtgtcaacatcactttcttctgaaagccttctctgagtcccccaagttaatttcagttagtgttttttgtatgtgcatgctatagcaccctgttcctcatttcagttttagcatttattcaccttaatttgtactgcatcttcaattgcctacattttactgggcgtgaactccataaaggcagaccctacatatatcttgcttatgtttatctctctagcattagcttagtgcctagcatagggcagctgagtactgaatgcgtgtgtgcttttttaatgtgtgtttcactctgaattccttctgaatctaaatgacattatgtatatgttaatgtagtaatatataaataacaatgataatggctattggacacatcatttttttttctaggaagaatagtggaatgattcaattatttcagattgcatttcagctttggagactgcatttattttgcaaaagctacttgtgttagtcccaaaattaatctgcctagcctggaggcaggtacctgctatgctgtctggagaagtcacatgaaaatagtcaagatatttttttccttcaaggagtgttttcttatgaaaccaatgcctctctctccctctccacgaagcggaaattaattttataactggtattcttgaaagtctgtataaatggaaggcactattttaaagtagggtttcatctgagtgcatgtgattaaaactactcttcatctagaaattagaaacatggcagatagcaaatttggattttcttatacatctacttaaacttaatttctccaaaaaagctatgagtcatttatttttgtggaatcctttttttattgtatcacaaagcctaaatttaaaaaatgttgcatatgagtttaatatcattaacatttaaactgttcttgattaaagtatgttaaaatgtctttgttttgcaagatgcattaattagaataaggatccaaacatcaagctaaagcattctctaatttgaagagattattttaagaaaatgatgaacaaagtccagcatcattggaacatatttgcctgatatattttatgcacttattccacttatgtttataataactattcggtatgtttgggcttttgttcaggttgcttttagagcaacctgaaaaaaaaaattgtaatatttactagaattttgtttaaagtgaagtagctatattattaagtgtatgtttctaatcatgacctcaatttttaaagaatcttgtgtttaaagatttaataattgaggatataaaaatgatatcctgaagagttcctgaaatatttgaagcattaaagtaatgtttgatataaatgagcacctgttgaagttctatagtattcaattggaagaataatatcttctacacttacctcaaattcttttttatgataaagttggatataaaacctaaaacaactattctagtttacaacatctagtcatgacagataattgtcaaactgtgttttagtttactacagcatgtctttatggccaaatgacttctgggagtgttgtcctctgaagttgagcttcctactcacaactctgctcaagacagaaagaaagcatattagtcctgttccaaatgagccccattcttagcaagtgctgctgtaatttaatttaggtttgggccttcacttgcaggaaatagacatgatgttaattaacagaacaatgcttgtggaaaagctttatgatactacttgattaaccacattccttttgatgttcatttttggaaaataattgtttatgtctcctgacacagtagataagatggcatgcatggctggtgtttgtaggtgtccaaagggattgtctttagactgatgtggcttttaggcaattctttttatgtaacctagcaatcttggtgcctaactcctacttctggttgactttacatatgaaaagaggggaaatttgtaaacttctgagaaattagaagtaactcaggtaaacattgaatactatctagaattcagaagaaataactgctacttttaattgaaattttaatttgcttttggtccattaattctgcggtttatcagcacaatacttttataattcttacatatcaatcatgagtaaaattgtgctttagttatttaattttcttccaaacagtaatcaattcacctttttttctccttaagagagtattcttctcacagaatgtagaaatataaaaaagaaaggtaaacttttctgtaatcccattaccattataaacattttggatttattatgatctctctttctttctttatgtatttatggagatagatggataagatatacttaatatgacagtcataagctatattttgttttacacctaaataatgtacattttaagaatatgcatagttgaaatacatttatttgttaaaataatgaggtatatctattaattctaacttggaaaaatatattcttagatttttttaaagcaaattattgtatatttgacttttgattaaaataataaaaataaacacaatatgtgtgtgactgggtctatgtaggcccacactgttgagaataattacctctgaggaagtcaggagcatgggtggtgggatctgaaatgttttactagatataattctgtactattacaatgcattataataggaatatattattttatgagtatggaaatgttaacatccatccttatgtcataaatataggtctagataattattttatttttatttttatttttttttgaaacagggtctgcctctgtcacccaggccggagtgcagtggtgcaatctcagctcactgttaacttgtaccacacaggctcaagtgatcctcacacctcagccttccaagtagctgggaccacaggcatgcgctaccatgcctggctaatttttgtatttttagtagaaatggggttttaccatgttgctctggctagtctcaaactcctgggctcaagtgatctacccatcttggcctcccaaagtgctgggattacaggcatgagccactacactcaccctgtataattttaatagtgttatttatttatagaaacacaacataaattgcttaaccttgttgagaaacattaaggctgctgcattttcaagtaatataagccatgttgtcatgcacacatctgtaaatgcatccatgtacatttttccttttttgttccatggaataagtttctcaagtcaaactacaatgtcccaactggtgtttgacatgcattttcagactgttctccccagtgatattaccacctttttctagcacctaatcatagctgctagcacatcattattcatctgtgtctggtgagcaaattatggtttctctcacctagaaatgttatggattctctctcacctctagatgaggaaagtaaatttttatcatcaagagaggacatagaatgaaagctgtcttccataatctttgtttcataatgcacattgtattatgttaatatgagggacactgaactctaaaatagatgcctaaatcatattgtttaggcacacagctatatatcacagtaatttctattatctaaacctcatggtttagatagaaaaaacccacaatctttggaatttaatagcctgggtttagattttaggtgtgcccattactcagtgctttgagccttggctccttggcatgtattgtttatatcatgagattgttaaagaaaattaagttaaataatatcttaaagtgcctactgcagtgccatgtggtaggtattatagaaagtaaccttgtggctaaataacttctttgtgaaatatttactatttttctgatttaaaaaaagacagattatcatttaggatatatagttaaaaactgacctaagaggctaaaattatagctgatatgcttattattgctctgatttttttatatctgtactaaacttcatgcttttaacttttggttaagggtattccttctggtttggttaatttcaaaagtataagaaaataaaagtaaactttaatcttctaccttgcatgatggatatgtgtaatatctttgtactgttttccttggaaaaaaaagtagatacaaatgcccaagtatacagtatgttgaattttgctcaccatttgacataaatgaaagtatctttgtagtaatttttctttcaaaatgcaatagaatgtgtatattcattgggtagcctttaagaggtcagaaagaaaagacactaaaggatatacaattgcagaagagggaagtggaggagtttagagtcaggaatgcagaggaagagaagaaatattatctgatgctgtgaaccctggaaatacagaagtctactcaatagttaagagccctttgctgagcttcattggacatactcaggtgctatgatagctatttgagtaaatgtatgctttataggagtctcttctcctggattctcaaatctagcccacaagataaactcaaggttaagattaaacaaattatgagtatctttttgagtttctttctaaataaatgtatatacttgtttgttccaaataacgaggaaagaatattttatgctatagcctgtcaacctaagtaacagtgagagaggccctctaaaagaaaaggtatttatttgaaaataaagcattgtaatgggaatatgcacgtcaaagtaaactatgcacatagttagggaggtaaaggaagacagaggttttcaaagagaaaaagcaggaagattatataattcttctgaaataattacctttggctacagagaccaataacaaggttatcgccagtccgaggttagacaggcagttgctgggcaaatgcccttgtagaaatatgtttttgtgtaaggttctgatggcctttgtgcaagattgtggattttgtatttttttgttatcagacatacaagaatggtaaccttctctttacagtgttctctggttctgccagggctttttgtttgttcattttttaacattagtgactcatttgattttgacacctttcacaagtctatcgttactgccttgttttttctgaaatgtcttttttgttttttctagtgatgattcttatgcttttaaaaacatttctaacatcctcctgttgcttatttatctgtggagttgctgttcattctggttttcctctgagtccttgcccatacgtcaccaccctgtcttaccttggctgcagctgttgctagtcatcagatgaagcaggtgaaggttatcaaactgttatttttcctgagtaaagtgtcatcacctcacctactgctctttgtcttctttgaattaatttcctaaatggcatacgattcagtgcaaaaaaattgttgttgtaatgaaagtcttttatgtcctggttggtgatttataattggtttcatcaagtataaaactcagaagtataaatgtcaagagttaactgatacagcttaattggtcatttccaattttgatgtcagtctattgacctaccggctaaaagggcattgtagagtattagttggcatttgtttttggagtcctttatgatttctttcttattagtgttcacagcagtgtaccattaaagtttttggcttcagtacacattctgattattcctgaacctgcatagtcacaataggaagggtagtgttgattcaaacaaaattcagatccatgtatttttggcaggtatagtgtgttcttctgcaccaactcacatattccattttgtgcctttacaaaactataggaatagtttagtgattgcctaaaattttcctagtaaattgaatgtttttctacaaaaatgtcttaaaaatcagaagataatatattcagtaaatttattttatgtacctattatattgtctagtactttaatatgtataattatttatggtttgattttatacacatctcattttccttaaatgtatattccaacttatatggagataaaagtaatgatatcactttgccttgaagaaactaaactctaagactgttatcatttgattctttcattttgagctgtctaaaattttataaaattagttaagagcaaaaagaagcatattagttatctttcttttttttcttttttcattaaaaatttttattcagtgcaacgggttgtataacttttatagacaaaaagtacaaatagctagtgtggtttgatttaaatttctatttgaattaaacatttgaatactttttcacttgcaatttatccttttagacaaatttctggaaccttcatttaaatgaacacagatgtaagaaataaagcggttatggaagcccagttctggactcattattaacccatttatgcctgaggttgcaattttttgaatttttattttgttttattttatttttatttattattattttttattattattatactttaagttttagggtacatgtgcacaatatgcaggtttgttacatatgtatacatgtgccatgttggtgtgctgcatccattaacttgtcatttacattaggtatatctcctaatgctatccctcccccctccccccaccccacaacagtccctgttgtgtgatgttccccttcctgtgtccatgtgttctcattgttcaattcccacctatgattgagaacatgcggtgtttggtttttttgtccttgcgatagtttgctgagaatgatggtttccagcttcatccatgtccctacaaaggacatgaactcatcattttttatggctgcatagtattccatgatgtatatgtgccacattttcttaatcccgtctatcattgttggacatttgggttggttccaagtctttgctattgtgaatagtgtcgcaataaacatacgtgtgcatgtgtgtttatagttatctttcttttaaagtacaggataatttgtcttcaaacatagctggatccaggtgcccaaagaaagtccttatcaacaggttcctcttctcccacttcctctcttttctctactggcttcattctcagagggagatataaaggtggcatcaaggtttataatccaccagtctgggaccccacaagaaagaaagtacctctttcctaatggcttcctcaaaaagcttgggtttaactaatgagctgagcttgtttcacttggccatgcctgaagcaatagctgtgacaaggcctgaaatatatgtttatacctggagctaggagattaaagcaggaaatggactgaagtggaagaggattctgctgcagtaagaagagatgttgagaaggcagaacaacagttcccactgaagatgccactgagttactaggaccatactcctggtcttctgagttccatattctactctttgagtctttcacatggatcagttctaagatgaagtaagaataaacttaaataaatcctttaatgtttatcctctaaaaggacaagaatattttaatagcctgaaagcagatgttgggaatctcagaaaatgaataaagtataatcttgaaaaaaactagtgaaacttctggtttgatctcttccctaatgccaccattcctctcaacttttgattctttagcttttttccactccttttattttttgaagctattgatgttgctagaaaaatctttgaagcaaagactactctctaacattaatagataggaactactccagatgaaattaagtacccttctattaccctgcatatggcattgcattaaaattttggtttacttgtttgtcccactcacatactgtaagtactccaaagaactaaatcatctttgatttccaagttttattgcccaaccacataattgtatttgttgtcagtaacacattaataacataagtgttgttgaatgaccaaatcaaactgtaatgcacttacagacacaggaaacaacacaatgagaaagtgtatgttcatatggggcagggatattcaagagaactaagaatgagcaagcagaggcatttcctcatggcaataaaacaataattagttaaagcaatatattttcaaaataggaaacatttatgttaattaaaatagtgaagagggccaggtgctgtggctcatgcctgtaatcccagcactttgggaggccgaggcgggcggatcacgaggtgaggagatcgagaccatcctggctaacatggtgaaaccccatctctactaaaaacacaaaaaattagccaggcaaggtggcacgcgcctatagtctcagctactcgggaggctcaggcaggagaatcgcttgaacccgggaggaggaggttgcagtgagccgagatcgtgccattgcactccagcctggcaacagagcaagactttgtctcaaaaaaaaaaaaaaaggaaaaaaaaaactagtgaagagatggaaggtcttcaagttaaggatctgaggtacactataaatatgagtgtagaaatcaattcttatttaaaaaacaaaaccaaaaactctgtcccatctaaattgatattatcagttgttaacatacttgagattttcagttaagttgttttataattatgacatatttaaaaagctttataattcatacttttataaatttatctaactttattcttacaacaactctgtgaggtagcttaccatattacttaaaggtgaggaaaatgaagctaagaaagataacatgacttcccattgccactaagaaattaaaaagctaaaactctaaatctcatattctttctatgaaaattgtactttttcaaaattttatgacaagttgctactacaattattgtagagtaatgagcacaagatagaaagctaaacacaataagaacataaaaagtcataaaagatgcatattgatatgttttgtttgcatatgtattgtttcatttttttcagaatatctctctaactttttaagtctttttcaaatcatgcttacagatggcctttgctataatttaatttttaggttatcagtttttattggcatttggaattaatacttacgtgaatatttgaactcatggacctaaatttctagtgtatttttggtttgcatacacctaggtcccaaatttagaaaaaaatcacagtctgttaacaccgtaaaaatctattttaattcatcatattgaaaaaggtaaatataaacaacattgatgaatataaatttttaaatgcaagtacctaatctgagctgcaaatatcaagataattggatgtattggagaccagctggaagtgcaaagaatacttccccttggtattgactcttctctaaatcaatagcggttccaaatgtagtaaaaagcggacaagatttaacaggttctaaattattaaggccagtgcattgttgctagagagttcattaacaatctcatcaatacaatgtggttcatggacattagtaagagctttgtgtaacattttaaaacagaatgagatatctcaatggactgatcttagtaaaaaaaatttaattaggtaagaataattacattagttaaatggaacttttaattgaaaacttgttggcattttcttacctgcttcacagctgtcctttaatcatttatatttaaaaagtgaagagtttctgtacatgatgtttgaaaattatctaaacatcttggactttttgtataaacgtttaaaggagtttagataatgtggcagtaaaaacaaataggattttctgcttgcggaatggtacatttaaaagatatatatatcagaaagaaaagttatagagaaaatatgtatggtaagtatatactattcttgggaaaaaggcaaagtagtcattttctgaagctttaacatttataactttaaaacttcatgtattgaacatcattccttatgaagctttaaaatcttacagggaaataatactgtttataaaattatcttgttaaagaaaatggtatccaacaagagtttttgaaagaatgaaagcccgtatttgtgtaagataaacataaagggccaatggaaactcttattgttaaaattagtgtcagccacattttaggctgtatttactggttgttgttcaaaataagctaattggcaatcactattttttggtagctttcagcttaagccagagagcactggtttggagagacatagacatttattcaaattcacaggaacactaaacaaatggatttgttaattattcatgacattaattctggccaagacagtttcttatctgaatctcagcaaccactatcactcagtgctgcctactttacttgatcttcagaacattgctgaatttgaatattcttcctaattcatcaatttgtctcttcctttcagccctcatgggtactcaatgacacacatgtagagacaaaaatctttatatatatatgtgtgtatatatatgtatatatatgtgtgtgagatatatatatacacacacacacattactgtatagtttatttataataaactataaattcatttagaaacaagacagaggctgtactcacattccccgccccggtctgagctgctgacagatttggctcattgtatttctaggaggtaatacattctagctgtatggcaaagtgtgaagatacagatttcttcatatatatatggaaacaatatatatatgtgtgtatatggaaattatatatgtgtatatatatggaatatagatatatatatatggagagagagagagagagatgtggtcttactttgccacccaggctggagtgcagtggcactatcttggctcactaaaaattcatatatttttaaaggtatttcatcatgcagtttctgaaattttctttaatgcatttaatttgtaataaaatctctctggtagttcaaaaacataagtcataagcagatttgtgttttcactgtgtaagaggaggcaaaaggaggtaaaatgctgtaatattggagaatgactttgggtaggaaagaaagaattttagttttcttcttcgaagaatgaggaggccaggctgagatttaatgtacatgagaagtttaacagcaatgaaggtgaaacaacaaagaaaagaccataatataaatattggcaggttttatttgttcaggcagtaatttgctaggatatgaacacagtcaatggcctaagaataattacttttgattacccttattaatttgtatgaaatgttcatacaatagtttgttaagcaagcacacaacattataaagaattatggagagagacagacatatgtagaatgtaaagagtaaataattatgcagagaagacagacaaataagggttatggttatattacaaaaccggtataaaatcagagtaaaatgtggattttctagtaatatgaatgttagccacaggatgccttaaaatccacctgattcaatcccctccttttatagatgaagaaactgaagactagaaaaaataatagtcatacttgtccaagtttacatgctgtagtgaaattatctgtgcaatagcagtccttcatttaatattaaatacaagacattataatattttaccactcatctttattcttgaattctaaatttgtcagtaacttatatgtactcaattttttattttttggcattctgagttcaactgaattgtagcgtcatgtacataacacattgtgtagggatcaggttattatatgttaatttcctccatgctcctttgccatctagaacctgatctgctgttttaaacagcatgaggcctgttctcccatttaggctaacagtgggtgcagaagggttgaagcattatactttctaaactggttccttgttctggagagtatccatctgaagagattaccgctcttctggtgatcatcgccatcatcgtccaacacctgcctatgcaccatgtgccaggaattgtgcgaactgctttaatgtattatctcatgcagtctgtgtagtccacgcagctgctggtaaagaactctgtttcagagtaatacaaagagccagcaacagagaaagcataatggcagctgcagtgtaactgggagaattgtctctgacaattggctcccgactgggtctgagggcatttcttcatcagtccctcagttcagctagcagccaccgcacacctgctctgtgctgggcagagtgctcagtgcagtgtgccagctgaatgagtgagcaccagcctgttctccatgtgtgaccccctccttcttgctcagaggggtgggcgattgtctgtcccatttaggcttgtgctgactgtgcaagggagatcccaaggtcaggatctacctctttgcccatcactgttaatatctgtattatctaactaaagaactaacatttgtattttttttcctgaaactatctgatttttaaagtaatttttcaagcaagaaaatctttagatcatcatatttaattttcaatgataaaatgaggaaacaaggcaatagggatttttttttattattttctttagtaaaaaggtcaagtcagtgaaagatccagaattcataaacttctattctatttattagaccatgcagctctttctgctatgcactgtacctcaaatgggaattcagaaatgagcaaaatctgagatgtaggagttccagaatggatctgccacctgccagctagcattcggatctcaaaggggacctgcctgcacttacttaatggaaagataaatgtgttcaaggaactgttactataaattcatttagaaacgggacagaggctttactcacattcctctccagtctgagctgctgacagatttggttcactgtacctctggggggtaatacattctagctaaatggcaaagtgtgattgttattcagagctcccaaatacctatttcttttattgtttaaatgaactttatggttgaattcatccatttattgaaaagtacttttatacacttactacaggcaaggcagtgtatggaatactatgtgaggtattaaaaagatagacattgttcttatccaaaagatgattgtgttataaaaggaaaaacaaaaggcaagaaaaatataaacagttttattaaaactagaatgtaaaaggaagaaagaagatacaaattagtgatgtttaatttgctaggattctagatagttctagaataaaatgaaatcaatggaccatcttccaagaaaaatggtgaatcactctttaacttctaatagatgtatgagagtaaaatgtacacattataaactacacatatttaaattactcttaagagtaattatatttagatataaattattgcattcaacattgaaagcatttgtagcccaggccacgagtgctaataaacaacaagtcttgagcaaagagtgaaatattatcacaaatataaccgtgcttggtacaacagacagaataacctggaaaatactaggttctaagttctcccagtcaaaattcaatggaggtatccaaaagtcattccaaaagaatgacttctcaccagaagaaaaaaataaacatttttgatggatttttgctgagaaaaatttttagtacatctgagaaatttgatatactaacgttctgttctgtatttgtacatagtttggaattgtttgtttctattgtcttcatacttttttcaaagaaaagctatgttttaatttttgtgtaactcttgaagcacctattttagacctttacaaaggaaatgtataatgtgataggaatcagaaacagaaataacatatgcattaaacctggacattggtagcttggtaattactgcttagtatcagattattttgtaaatgaaatctaagcacatataaatattttaactattcatagaatctattatttctgttttttatatttggagatattttaattatatatataagatcaaaatattaatgtcaatttttatttgaaactttttagaacatctaatttcttaaattcttcaattatttaaaaatatgtagtgaatttttccaaagtataaggaaaatgtaagcatacatagattttactgttttttttaataccttaaagactcatcagtcatgaggttagttgatggatggaatagtactgagtgactaagcctatttctgtggcaatggctcagccatagaaattagcatttgtcactcttctgcctgtttgtctgttacacattccattcttaaaagtaatttgactaggtataagatacaccaagcaataagctagtaagaaggttaatgaatatttaaatatatttgcagacatttcttatgttcttttcaagccagccatttggaaagatcactatagttttactaaaatgtgtaggacaatattgcacaattttaaaggtttgcaaaacaaaacaagtttttggctgaaaaacattttttgtaggttaactaacttattttggaaataaaaatagcttcaatctagtctgaagtaagctctgaaaggcagcccacattccagttgacaggcgtctgaactagcagtgaagcaggtagggctgcatttagctgtcacattagccctgtctggctggtacctacctaatttgagcttctttctgctgcactataccctcagagggaacagatattctcttctagctttccattaagtgtggcccatatatatgggggtatgtgtgtgtatgtataatatataatgtatataatccatatgcatatatacacatatataattatgcttggagagataaatctctctctctatatatatataaaattgtagttgaaagagagaaaatagaacagattatcttatcttcattattgatttactcccaacccctgcttagcttttgtcttgcctttgtagtttaggatgtaaatgaccacagatttatctaactatctcatatggattttaataaccaaattgtactgatatttttagtttacttggttaaattagagttatgttgaaccctgaagcattctttagaggtagctataatgtataagaaaaagacaagatttgacttagggactacaataacttttattggaatcccagctcagagatgtattctccatggtccgtggaaccatactagcctggtattcgtaagacaccccctaaactgtgagatcttctcccactagtttcccctcctttgcccatcatagtttcagtgggaatatggcctaggggaggcagggattataattgtttagacagtgattctaagggttaggatttgcccgaatcttatttctgccaatctttcatgagacctcgaaataattactttaaccttcctatcttcagtttcctgctctcaaaaatgtttgtagtaatatcatttagaacatacggtctttgtgagaattaaatgagataatgcatgtaaagaaatcagcacagttctgtggcacagagttaaggactcaatataacttgaattaaaataattattgttttgtaataataatattataaaaatgataatataatttaacctgtgtttcccctccacttctctcttcctctgttccacccctctcttcttttctcctgttttcttccattaagaaaagagtcaaggcaaggaattatagagtcaataagagaggatgaagatttagcaaaagcagataaatcaatctctaaatttgggtgtaagagacgcctcttaggccccagcgtgaaagatacactagggcctttgccctttgaaaacctcccgagcagcaactggatagaagcaaactagaatgttgaagagggctttaaaaagtgttatattgctaggggttataagaatgtcctttgacactcatgaaataaagactaaaattgctgctttttaaacttattttgtcctctgaactaatgtttgcatcctgctcagttcaggatttgttagaattatatgattctataatttctttttgtaatctaatttgtatttgtttattttgtttttttctatttactttatatgttattttttcagttatctttttctaggcattgttgggcctctatgtaattccatacttatattttatacaatcatttataggtacttctttcttatccttatagtgatcagatttcactaataattggtcacaatcagtgacattatgaacctctgaaaggagtgtggtggctccttccaggacaacgactggaaatgtgggttcctaacttgaccattcctgtccatacttgatgatttaaattatttgttttacctcaatgttccttgggacaaataatgtttaagcttgataacctttgatttgtagagatatgtatttgggggtatactatcaatttagtgttgcctacaagagtgcttaatatttttagaaaattctattcaccagtcaccataatgtgttctggctcctgtagtagatacatacatatacacatatgcatacatacacacatacccctctggtatatacatacatacatatacatacatacattatgtatatgtgtgcgtgcatgatatatgtttgtatatgtgtgtatgtatatttaccttttctgtttctaaatttttaaatattttaataatatagtttcctggatttatgctatcttatccttcatatgttcagaaatctatttttttcatgaaattgttcctagttaatattagtaactttttaacccacctattattgaaccatattcatacattagtttttttttttctaaaataaacaacagaaatttatttctcacaattctggaggttgaaagtctgagatcaaagtgccagtatgggttctgatgaaagccctctcctaggttttggacacccaacttctcgttccatcttcctatgacagaaagagggctagagagttctctggagtcccctttattttattttattgattcttaatgtatgtacatatttatggagtacatgtgatcatttgttacatccatagcatttgtaatgatcaagtcaggctatttaggatattcactacttctagcatgatcgagtcacggtatttgggatattcactatgtctagcatttactatttctctgtgatggaaacattgcaatcctctcttctagctattttaaaatatacaataaattgttgttaactctagttaccctactctgctatcaaatattagaacttatttcttctatctaactgtaagtttgtaaacattaaccaacttctcctcgtctgtccttctcatactcaggttcccttccaagttttcagtagctatcattctcctctctacttccatgagaccaacctttccatagcccctacacaggagtgagaacatgtgatcttactttctgcgcctcacttatttcacttaccataatgacctccaattccatccatgttgctgcaaatgacatgatttcatttctttttcatggtcaaatgatgttctattgtgtatatatcctacattttctttacctattcatgtgctgatgaacacttaggttgattccatattttggctattgcaaatagtgttaaataaacataggagtgcatgtatccctttgatatactgatttcctttcctttggatacatacccagtagtgagattgctagatcacatggtagttctatttttagtttattgagtgagcaccatgctattttccataatggctgtactaatttacattcccagtgatatggtttagctttgtgtccccactcaaatctctttttttttttttttttttgagatggagtctcactgtcgcccaggctggagtgcagtggtgcgatctcagctcactgcaagctccgcctcccgggttcacaccattctcctgcctcagcttcctgagtaggtgggactacaggcacccgccaccatgcccggctaattttttttgtatttttagtagagatggggtttcactgtgttagccaggatggtctcgatctcctgaccttgtgatccacccgcctcggcctctcaaagtgctgggattacaggcgtgaggcagtgcacccggcctcaaatctcattttgaattttaattcccacatgacaaaggagggacctagtgggagataattagatcatggggatggtttcacccatgttgttctcatgatagtgagggagttctcatgagatctgatgattttcaaagtgacagtttcccatttgcatgctctctctctctctcttgccaccatgtaagacatatcttgcttcccctttgccttctgccatgattgtaagtttcctgaggcctctccagtcatgcggaactgtgagtcaattaaatctcttttgtttctaaattacccagtctcaggtagtgtccttatagcagtgtgaaaaatggactaataaagagaattggtactgaaagtggggtaatgctataaagataacctgaaaatgtgaaagtgactttggaactgggtaacaggcaaaggttgtaacagtttggagagcttcaaagtacacaggaaagtggggaaaagtttggaacttcctagagacttgttgaatggctttgaccaaaatgttgatagtgatgtggacaatgaagtacaggttgaggtggtctcagatgcagatgaagaacttgctgggaactggagtataggtctgtcttgctaggctttagcaaagagactgcttgcattttgcccctgccctctgtggaactttgaacttgagatagattatttagggtatctggtgggaaaaaatgtctaagcagcaaaacattcaagatgtaacctggcttattctgaaagcattcagttatatacattcacaaatagatggtttgaaattggatcttatgtttaaaaatggaagcagagcataaaggtttgggaaatttgcaacttgaccatgtggtagaaaagaaaaacccgtcttctggggaggaattcaagccagctgcagaaatttgcataagtaacgaggagcggaatgttactagccaagaaaatggggaaaatgtctctaaggcatatcagagaccttcacagcagctccttccatcacaggcccagaggcctaggagggaaaaattggcttcatgggccaggcccagggccctgctactctatgcagctttgggacttggtgccctatgtccagctactccagttccagctccagcagtggctaaaagcagccaaggtacagctcgggctgttgctgggaacatttacccaatgcctgtacctgcattgtatcttggaagtaactaacatgcttatgattttacaggcttattggcggaagggacttgccttgtctcagaggagactttggacttggatttttaggttaatgctggaatgagttaagactttgagggactgtggggaaggcatgattggttttgaaaggtgaaaagtacatgagatttgtgagggaccaggattggaatgttatggcttggctctgtgttcccacccaaatctcatctcaaattgtaatcaccatgtttcaagggagagacctggtgggaggtgattggatcacggtgttctcatgatagtgagggaattctcatgagatctgatggttttataagtggcagttttccctgctatccctctctctctctcctgctaccatgtaagacatacctttcttcccctttgccttctgccatgattttaagtttcctgaggcctctctagccatgcagaactgattcaattaaacctcttttgtttataaattacccagtctcaggtagtatctttatagcagtgtgaaaacagactaatacactcagcagcagtgtataagagttcctttttctccatgtttttggtttgcatttgttattgtctttttgtttaagaactattcaaactcgggttagatgatatttcattgtggttttgacttgcatttccctgatgattagtgataatgagtgttttttatatatctgttgtctgtttttatgtctttttagagaaatgtctgttcacatcctctgcccactttttaatgggattttttatttatttattttttttactgttgagttgtttgagcttcttttatattctgaatattgatcccatgtgagacaaatagcttgcaaatattttctaccattcaacaggttatctcttcactctgttggttgtttgctttgctgtgcagaatctttttatgtcccatatggctttttgtgtcccatatgtctattttttgttaattgcctatgcttttgggtccttagccatagagtatttgcctagaccaatgtcctagagtgttagtctgtgtttccttctagtagttttatactttcagaacttatatttaagactttaattcattttgcaatattttttgtatatgatgagagataggagtctagtttcattcttttgcctatgggtatccagtttttttcagtaccatttattgaagaacctattctgtttccgacgtatattcttggctccttttcaaaaatcagtagactataaatatatggatttatttctggattgcccattttgtttcattggtctatgtgtctgtttttataccaataccatgctgttttagttattatagccttgtaacacattttaaggtcaggtattgtgatgccttcagctttttttctttttgctcaggattgctttggttattcaggctgttttggttccatatgaattttagaagttttttttcttttctatttctgtgaagaatgtcatgatatattggtggtaattgtgttgaatctgtagattgttttgggtagtatggccatttttacaacattaatccttcctatacatgagcatggtcttttcatctgcctgtgtcctcttcaatttctttaatcaattttttgtaggtttcattgtagagttcctcatctccttagttaaatttattcctaaggttttttactttttgttggtagtgtaaatgagattaccttcttgatagtttggctgattagttatttgtgtataaaaacatggctgatttttgtttgttgattttgtgttctacaactttactgaatttgccaaatagagtttttggtggagtctttaggttttttaaaacataagatcatgtcacctgcaaaagggacaatttgactttttttttttccagtttcagtgtcctttctttctgttgtctgattgctctgagtaggactttcagtactttgttgaataggagttgtaaaagtgggcatcattgtctggttcaagtttttagaggaaaggatttcagctttttcccatacattatgttatttgtaggtgtgtcatatatggcctgtgttatactgaggcatgttccttttatgcttagtctgttgagtttatattatgaaggaatgttgaattttatcaaatgtttttctgtgtctgttgagatcacatgatttttaccctttattctattggtgtgatgtattacatttattgttttatgcaggttgaaccatccttgagctcctggaataaattccacttgatcatgttgtagtaccttttggatgttctgttgaatttagcttgctactgttttgttgaggatttttacatctatgttcaccagggatgtttgcctgtgaacatagatacaaaacatagatgttcaccagttgttgttgctgttgtgtccttgtctgcttttggtatcataatactgacctcataaaatgagttaggaagaattatctcctcttgctttttaacaggtagtttgagtagaattggtattaattattttttaaaagttaggtagaatatggcagtgaagtcatctgatactgggcttttctttggtggaagccattttattattgattcaattttgttactcttattagcctgttcagtttttctacttctttctaattcaatgttggtagtaggttgtatgtgtctaaaaatttatccatttcctataaatttttgagtttgttagtacatagtttttcataacagtcttttaggatttttttgtatttcagtgttatctattgtaatgtccattttttaccttctgattttgtttatttgggtctttcatcttttttttcttagtttaactagaagtttgtcaattttttttaaagacttttcatttcaataatcctttgtattattttttaagtctctatttcatttatttcagttctgatctttattatttttttcttctactaatactaggtttgatttgttcttacttttctagttcttgaggtgcatcattaggttatttaaaatctttatattttcttgatgtagatacatattgctataaacttccctcttaacactgcttttcctgtatccggtgtgttttgatgtgttgtgtttccatttttatttgtttcaagaaacttttagattttctgcttaatttactccatgacctaatggtcattcaagagtatgctgtttagtgtccatatatttgtagagtttcaaaaattcttcttgttattgatttctatttttttgtttattgtggtctgataagatatttgacttttgcaccttttcaacttttaaaagtttgttgaaacattttgtggccttacattgtttttcctggactgttttgtgtgctgatgagaagaatgtatattctgcagttgttggatgaaaggttctgtaaatgtctgttaagtccctttggctaaactgcagttttaatctgatgtttgttgattttctacctagatgagctgttaaatgttgagagtggatattaaagtccttaactatttctgtattgtagtctgtctgtctctttagatcaaataaaatttgttttatatatttaggtgccctgctgatgggtgcataaatatttagaaatgtcctcttgctgaattgatccctttgtcattatataatgacctggtttgtctctttgtactgttttttgacttaaagtttgttttatttgatataagtatagctattccagctcacttttggctttcatttgcatagaatatctttttttcattcctttactttctgtctatatgtgtctttacgagtgagatgaatttctttctttttttttattattatactttaagttttagggtacatgtgcacaatgtgcaggttagttacatatgtatacatgtgccatgctggtgtgctgcacccattaactcgtcatttagcattaggtatatctcctaatgctatccctcccccctgcccccaccccacaatagtacccagagtgtgatgttccccttcctctgtccatgtgttctcattgttcaattcccatctatgagtgagaacatgcagtgtttggttttttgtccttgcaatagtttactgagagtgatgatttccaatttcatccatgtccctacaaaggacatgaactcatcatttttttatggctgcatagtattccatggtgtatatgtgccacattttcttaatcgggtctatcattgttggacatttgggttggatccaagtctttgctattgtgaatagtgctgcaataaacatacatgtgcatgtgtctttatagcagcatgatttatagtcctttgggcatatacccagtaatgggatggctgggtcaaatggtatttctagttctaggtccctgaggaatcgccacactgacttccacaatggttgaactagtttacagtcccaccaacagtgtaaaagtgttcctatttctccacatcctctccagcacctgttgtttcctgactgtttaatgattgccattctaactggtgtgagatggtatctcattgtgattttgatttgcatatctctgatggccagtgatgatgagctttttttcatgtgtcttttgctgcataaatgtctttttttgagaagtgtgtgttcatatccttcgcccactttttgatggggttgtttttttcttgtcaatttgtttgagttcattgtagattctggatattagccctttgtcagatgagtaggttgcgaaaattttctcccattttgtaggttgcctgttcactctgatagtagtttcttttgctgtgcagaagctgtttagtttaattagatcccatttgtcaattttggcttttgttgccattgcttttggtgttttagacctgaagtccttgcccatgcctatgtcctgaatggcaatgcctagattttcttttgggtttttatggtttcaggtctaacatttaagtctttaatccatcttgaattaatttttgtataaggtgtaaggaagggatccagtttcagctttctacatatggctagccaattttcccagcaccatttattaaatagggaatcctttccccattgcttgtttttctcaggtttgtcaaagatcagatagttgtagatacatggcgttatttctgagggctctgttctgttccattgatctgtatctctgttttggtaccagtaccatgctgttttggttactgtagacttgtagtatagtttgaagtcaggtaatgtgatgcctccagctttgttcttttggcttaggattgacttggcgatgcgggctcttttttggtgccgtatgaactttaaagtagttttttccaattctgtgaagaaagtcattggtagattgatgggaatggcattgaatctataaattaccttgggcattatggccattttcatgatattgattcttcctacccatgagcatggaatgttcttccatttatttgtatcctcttttatttcattgagcagtggtttgtagttctccttgaagaggtccttcacgtcccttgtaagttggattcctaagtattttattctctttgaagcaattgtgaatgggagttcactcatgatttggctctctgtttgtttgttattggtgtataagaatgcttgtgatttttgtacattgattttgtatgctgagactttgctgaagttgcttaacagcttaaggagatatcgggctgagacaatggggttttctagatatacaatcatgtcatctgcaaacaaggacaatttgacttcctcttttcctaattgaataccctttatttccttctcctgcctaattgccctggccagaccttccaacactatattgaataggagtggtgagagagggcatccctgtcttgtgccagttttcaaagggaatgcttccagtttttgcccattcagtatgatattggctgtgggtttgtcatagatagctcttaatattttgagatacgtcacatcaattcctaatttattgagaatttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgcgggcctcataaaatgagttagggaggattccctctttttctattgattggaatagtttcagaaggaatggtaccagttcctccttttacctctggtagaattcggctgtgaatccatctggtcctggactctttttggttggtaagctattgattattgccacaatttcagctcctgttattggtctattcagagattcaacttcttcctggtttagtcttgggagggtgtatatgtcgaggaatttatccatttcttctagattttctagtttatttgcatagaggtgtttgtagtattctctgatggtagtttgtatttctgtgggatcggtggtgatatcccttttatcattttttattgcgtctatttgattcttctctctttttttctttattagtcttgctagcagtctatcaattttgttgatcctttcaaaaaaccagctcctggattcattaatttgttgaagggttttttgtgtgtctatttccttcagttctgctctgattttagttgtttcttgccttctgctagcttttgaatgtgtttgctcttgcttttctggttcttttaattgtgatgttagggtgtcaattttggatctttcctgctttctcttgtgggcatttagtgctataaatttccctctacacactgctttgaatgtgtcccagcgattctggtatgttgtgtttttgttctcattggtgtcaaagaagatctttatttctgccttcatttcgttatgtacccagtagtcattcaggagcaggttgttcagtttccatgtagttgtgcggttttgagtgagtttcttaatcctgagttctagtttgattgcactgtggtctgagagacagtttgttataatttctttttttttacatttgctgaggagagctttacttcccagtatgtggtcaattttggaataggtgtggtgtggtgctgaaaaaatgtatattctgttgatttggggtggagagttctgtagatggctattaggtccgcttggtgcagagctgagttcaattcctgggtatccttgttaactttctgtctcgttgatctgtctaatgttgacagtgtggtgttaaagtctcccattattattgtgtgggagtctaagtctctttttaggtcactcaggacttgctttatgaatctgggtgctcctgtattgggtgcatatatatttaggatagttatctcttcttgttgaattgatccctttaccattatgtaatggccttctttgtctcttttgatctttgttggtttaaagtctgttttatcagagactaggattgcaacccctgcctttttttgttttccatttgcttggtcgatcttcctccatccttttattttgagcctatgtgtgtctctgcacgtgagatgggtttcctgaatacagcacactgatgggtcttgactctttatccaatttgccagtctgtgtcttttaattggagcatttagcccatttacatttaaagttaatattgttatgtgtgaatttgatcctgtcattatgatgatagctggttattttgctcattagttgatgcagtttcttcctagtctcgatggtctttacgttttggcatgattttgcagtggctggtcctggttgttcctttgcatgtttagtgcttccttcaggagctcttttagagcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgagggtaacccgacctttctctctggctgccgttaacattttttccttcatttcaactttggtaaatctgacaattatgtgtcttggagttgctcttctcgaggagtatctttgtggtgttctctgtatttcctgaatctgaatgttggcctgccttgctaggttggggaagttctcctggataatatcctgcagagttttttccaacttggttccattctccccgtctctttcaggtacaccaatcagatgtagatttggtcttttcacatagtcccatatttcttggaggctttgttcatttctttttattcttttttctctaaacttcccttctcgcttcatttcattcatttcatcttccatcactgataccctttcttccagttgatcgcatcggctcctgaggcttctgcattcttcacgcagttctcgagccttggctttcacctccgtcagctcctttaagcacttctctgtattgtttattctatttatacattcgtctaaatttttttcaaagttttcaactgctttgcctttggtttgaatttcctcctgtagctcggagtagtttgatcatctgaagccttcttctctcaacttgtcaacgtcattctccatccagctttgttctgttgctggtgaggaactgcgttcctttggaggaggagaggtgctctgctttttagagtttccagtttttctgctctgttttttccccatctttgtggtattatctacttttggtctttgatgatggtgatgtacagatgggttttggtgtggatgtcctttctgtttgttagttttccttctaacagacaggaccctcagctgcaggtctgttggagtttgctagaggaccactccagaccctgtttgcctgggtatcagcagcagtgtctgcagaactgcagattttcttgtaccgcgaatgctgctgtctgatcgttcctctggaagttttgtctcagaggagtatctcgccatgtgaggtgtcagtctgcccctactggggggtgcctcccagttaggctgctcgggggtcaggggtcagggacccagttgaggaggcagtctgcccgttctcagatctccagctgcctgctgggagaaccactgctctcttcaaagctgtcagacagggacattgaagtctgcagaggttactgctgtctttttgtttgtctgtgccctgcccccagaggtggagcctacagaggcaggcagacctccttgagctgtggtgggctccacccagttcaagcttcctggctgctttgtttacctaagtgagcctgggcaatggtgggcgcccctctcccagcctccctgccgcgttgcagtttgatctcagacttctgtgctagcaatcagcgagactccatgggcgtaggaccctccgagccaggtgcaggatataatctcctggtgcgccatttcctaagcccgtcagaaaagcgcagtattcgggtgggagtgacctggttttccaggtgctgtctgtcacccctttccttgaccaggaaagggaactccctgaccccttgcgcttcctgagtgaggcaatgcctcgccctgcttcggctcgcgcacagtgcactgcactgctgttctgtgcccactgtctggcactccctagtgagatgaacccggtacctcagatggaaatgcagaaatcacccctcttctgcgtcgctcacgctgggagctgtagaccggagctgttcctattcggtcatcttggcttctccccgagatgaatttcttgtaggcagtatatagttgggtcattaaaaaaatccattcagctagtcatatctttcaaatgaacaccttattgtgtttatatcaaaggttattattctttaattgtttttgtttgttttgtatatcgtttgttcccttctttctctcttattgtttatcattgcggtttagtggttttctgtagtggttccagaatttgtttggttcttttatatgatgtctatctctttatggaacttttcattaatatcctgatttttttttctttgtattgtttttctgtgttctctgtgtctcattgagcttctttgctataattattttgaatcttttttcaggcatttcatagatctatttttcactgaatattttgctgaataattattgtgctcctttagaggtgtcatacttcctggattttttatttcttgtgtccttttctgtccttatgttgatatctacacattttgtgtaatagttgcttgtttcaatttttttttttttttttgagacggagtctcactttgtcacccagtctggaatgcagtggcgccatcttggctgactgcaacttctgcctcccgggttcaagccattctcctgccttagcctcacaagtagctggaattacaggcccacagctaccatgacccactaacttttgtatttttagtagagaccaggtttcatcatgttgtttaggctggcctcaaactcctgacttcaggtgatccatccacctcggcctcccaaagtgttggaattacagatgtgagccaccatacccggccagcttttttcaatttttttggatggattttcataagggaaaatttttcctatggatttatctatggtattggttgagggggcactttcgctttgattatagggttagcagtagcatagtcctcatatgatttttacagcatcagtggtgtctgtgatttccgtttcttagactgtgattattagtggagactgtgttgaaattttactgggtgtaggagtgccaggtagttcagtcctgaggcccagtggtgttatcagtgggctaagtgtgcctgtctttaggctcctgtgtggcatacaagggcacgtgtgttagtgggctcaggtgggccaattgttgggcctccaggaagcttgcttcggttcagtagtggcagcagtgggcatgtgtgtggtgaattcctgggcccctaagcagtatgcatggcatgagaaatagcagtagtgatggtgggaccacccttggactctcaggcatcacatactggtgtttgcagtgcctgcaacaggctggatggaccagccctcaggagaagtgcacggacaccagcagtggtgaacaaggcagggctgttctcaggtccctgggtggcatgcttgggtacttgggggatagtgccaggggtgtgggcctgcccttagtgtcccctgatgggtgcatgggaataggctgtggtgaataggacagggcaatctccatgccccaggtataacaatgtatttcttttttacaaatatgcatttaccagttttctataatctctaccttttcttattttgcagtgcattttcattatgtatttatgaaaaaattatatagagatttatgcattcaagtgcttgttgacatttgttacattgtgtaactacaaaaccaccttcactactttgcttattaaccatagagtgttgagtgagaaacccagagaaaaggatataaactttggacagattatatggattaaatccagctctacgtctatatgctatggtttgttttttgagttacttagctgctgtctgccttggtttcctatttgacacatacttgatgggattgcacctgaataatggttatggaaattaaaggaattaatttaaggagagtgcctcacacacagatattgaatgaatgttggctattaatattattaatagaagacagattttcacatatttgtgagaataagagaaggcacatttttgtgagcattcttgtgagaataagagaaaccacatttctgaagcactagaattttcacacggtttttcaaaggaaggagatttatagacacacaattttacaaagaagacaatagtttaatctgacaagatattaaatataaatagaaaaatctacataatatcaccaaaacaactagtctaaaattaaaaccaaaaagtaccccaaactggagaaaatatcatagaaagtatttcagaagttctgtttattgatttataagtaaagatattttaaactgggaaatccagaagtagtttgatcagcgacttttagattacttgtacctttttctcaaggatttatattttattgttacagacagtagtctcaccattttgcccagactgggctcaaacttcagggctcaagtgatcctcttaccttacccttccaagtagctgggctacagatgtgtgccactgtgcccagctatatttatcttatagtttaataatattatctaatttttataattgtacttaaaataacagatttcaaagagttttattagcaactactgtgtcctgatcttgaaactgaaactatataccagaaaagattttttgatttttaattaggcaaaattattttctagcattgtcatattaaataaggttactactctaggatttttatgtatgtcctgttagattatctatatgtcagtaagtcatgaaaagcaattttcatgaaaacttggaattagaaatattatagattgtattcttttagttattttttccataatagatcaacatttttatcttggcaataactgctatagtttttgtaatcttcctcatacattacgtgttaatcttaaaaactgtggaaaatatgaaataaaaattttactcatgattaattcacaagagttaaacattattattttattgtgttttcttgtttttgttgtttatatagtatgtagtggtggccaaaagcattcctgaacagggagggtgggcttccccacttgttagctgtgtgatttcaattagttcttcacttttcccaaccttggttttgttatttataaaatgttaacaatagattttttattatactattattcagagaataaagtaaatatattaattacccatatataagtatacatgcatgtgtattttagatattctatttaatttataaatatatattgctttataaggtaatacttcatattactctataaatatatattatctgtacatatatttataaagtaaatatatattatgctgtatttccataataaaccattatatatttttttttatgtatatattacatataatagtttatattatatataaaataatggttatatattaataatggttttatatattatatattatatattacatactatatataatatatgaaaccattatatattatatataaaaccattatttatacatttatatatataaaatgatttatgctggaaatgcagttctgtataatctaaatctaatttaacacaacaccatttaagatgtatttaatttccatctagttgagtatttttcaaaacatgattttttagtgcttatataagaaaacatcgtgaatttatttagaaatttccctattttggtcattcagtagatttccactctttttttttttttttctaaaaacaaaacaatggatatgtagccttcattcttagctccgattttcttaatgctaattccagaaagaggaattactgggttaaaataaacataaatatttttaaggctctcttacgttttgtgctgcaaaattaccctttctgttgacagttatatattttaaaacactcaaaatgtatcttcccaattctgttgatgatttttgtgactacctgtgtaatatatgtaatatgtcctctgaatattaactcgggtcagagacaaatatcagtcaaatcctcaggctcaggatgtatgcctcaatgaacactactagttttcactatgcatccttcagggtatgtgaaaatagtcagtagaatttataaaatgaaggtttggaatctgagttattttcccaagagatttatgaactataaaataatattattatgttctcttattgcattgtgctctttagccatcttccattttatgtggtatagctccttaggatccatttggttgaaagctactgtgtatactcattttgtattgtattgtggcaaatgctgtaatctacagggttcctattcatttcacagctcactaattgtgtgaatgagaagaggaaatatatgcttttattctaaagcatgccaagcagatggccaaagttcattactaggagcattgtcagtgtggctgtcttttctaggtagtaagcctggcatcgatctgtcaaacacagagtgagggtccatttaacacagcacttgaaaatcactgagcctctgttttgttatgacttataaacattttatttttttatcatcaacctccaaagtggttggtcatttgagcaggtgcaaacacagtagaattcatatttgttttacctgagaagccaaatgaacttttattcatatggaaatcttggggaaaggaaaccgtacaagagattaagcttagtttcttgaaaagcgggtaatacagctattgagattcaaaactaccatcatttctgagattgaaacttttgaaaatttaagttgaagaaaaagatcagggtttatatctttttaaagctaaaagattaaaacaatgaaagaatttaaggttttaagtaagtctcccttaaaatcttggtttcttcctataaaaggaaactgtttacttacttttatatagaatatgtaatttatgtgaccattaaaaatgttagcaatgtactcattgtgtgtgtgtgtgtgtgtgtgtgtgtgtataagtgagacagagtaagaatcagagatagtgacaaaaaggaaataaagcctgtcttcatacatgtcctacttcaacggcagtactaggactatatgtaattgggttatttcaggaaaaggagggtaggtcaaattttcttatggagctgatgtagtaatttgatcataatgtcttgtttaagagaacgagagcatgttagagataacgttttcttctttatacaaagaaaaatgggatatatatttcccttacctcttccctcttcctccttgcaaaccatctaccacaagttctacaagttatattgactataaatttccctttcccttgcttttcagactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggtaagttaggagaagaacatctgccttgtctcttttgttgtcaagctgaatgaagtgagattattgtggtttttctagcaagtgtccttttactttatgtttaatttaaattttctctcttactccaaataagcaaaattaacatttttactaaataataccaaatgaaaggtgaggggaaacaaaatatctatcaaagtatctatgagggttagcatttacctttctgaatctttattacttttcctttatgtagagatatagattaataaaggaatgtttatattttaggcaacaaaatataaaatgcatttttaacataaatgtcatttgcactacagcaaaattatacctaatttgtgaggcttcaagtatagttattcagattaattgttcctaaatatgtctagttatttaaattatatttacaattaacaaaaatagaatgtatggattaatcaaagtgcaaaatttactccatgttatataatgcaaccattcttatgaccatatatcatttctgactatgtctgttatagatcaagaatattcatagtgagaaaaagtttttgaagatcatacatacatacatatatacatgcatatatatacaaatatgtatacgtatatatttttcctgtcaaaaaagaaagtcctttgttaacttagaatacttttcatagatgaaagtttaactgtgccttaatctttgcaatgaaatatcacaggtattattaccatatgaaattttttattaatggcttaaaataaatcatcagttcatcttgtaataaattattcatcatgaaaataaaagtgcaaataggatcataattaagtatctctgaatatccatgaattttctttgtctaattcttatcaaactctcaggtagatgaattaatagtttcgaagaatatgcagtttattagttgccccatattctaacatttacttctggtttaaaactgaaacttagtgagctgtagacacagtccacaggtctggcgagatgaagaattgatttttctgaactcagcactagattattgaaacaatgacgtgtcaagcagccctaaaagaagcagttgtatgacattccccattgtatttattgtagggtgtaattgagaatcttgtccactaaatcacacagtgtcccccttatgaggaccaacaggagaaatttctctcaggtctcagtgccaggaaaagctctttctcctgagcagctggtatgtcttaaattatagaccctgtatattgtgtttttatcatattttcttctttgttttggttgctaggaagttcagaattgaatttgtgataaaattacttgtgcaatttcacctggtatacatttctttatgctctctctaccccagatttgttcttctgttttacacttctattcttgtacttcttgatctttttgtttacttttatactattgtccattttggttagtcacttgaaagtttttctttggaagccattaggctaaaaatatttttttcttccttattccaaaccagtgaacacatgtttaactttagcaaagacatgttgcaatatgtttatgaatatgtattaaactttttctatttcatttgtaatttattagctgaaaactaagaatcttgcacataagtatccaaatatcatatggagcctcagaaatttagtaatattaatttcaaatccttattgaaatattacccttaatctactgatatttacttcttttgggtcttggttatattattttaaacattttagttgtgagtatacattttataattgaaaatttctgtatttaactactttttcctaagctatttccaaatgacaaacaatggaaaacatctaattgtggttctataaccaacagaatgggaaaactttttacgttaaaaaagtccagatatttactcaccttttagggttgaacatattatacagctagattattatattcccatctcctccatgaagtatatcttgatatgaagtaattataatacatttcccttgcccttacttagtggaaagctagggggaatgtatataattgagttagtataacatagcttttcctggattcagtttctcttattgtaataagttccttttcatgttattatgaatttagtagtgggattttataacagtagttctaactgtatttgccagtgagatatttaatatctcatacaccataaaaagtaactaaattcttctcactttagttaaagaggtacactacttaaaacataataatacaatgtctcctagacagaaaattgtaactggaaaatgcattgtataaaatgaaaaatttatagtaaattttctgctgaaactaggataatttatgtagaaaaacatttttcaaatttcagaagaaaattaaaatattttaaaaatctctagcaatgtaaactgaaaagtaatgaatataagtttcctacttttgtgaaaaaatgtttattccatctttcttcacttatttattatcaatgtttttctattcccataggcacattgggaaggcctcacaggcagaataactttcaacaaaaccaatggcttgagaacagattttgatttggatgtgatcagtctgaaggaagaaggtctagaaaaggtatttcagtgagcttatttgctttaattactaaatgaaacatatctcaaagaagacaaatattctctgttgtagtcacatttcattgacatttaactttattgagtaactctaaaaataaatagttaattcattatattgaatataataattgacaattaggattcaaggataaagggtatcttaagacaattttatattttattttctaactagagatttttctgatgcatataatgtttgaagtgcatataatgttaattagtcttaaggtttaatatagcaattagaaaatatttggtttaatatgggtctttatacatgcagcttataatcacttatggttgcatagactttccaacttggagcaggccattaagaaattaaatataaaagtatgtttctattttttgagtcatatttaagtgaaatatttgaattcatgtatgcacagtaactagggtatatacataaatgtaacataccacactggatctatcttacttgattttattgctagggattgtggtaaaacacccaaagaatgtgggtatgtgcctacttaatgaatattttagtgtgagttttcttaaatacataatgtatgtatttagatatttttctgatagattcattgataattgacaagagatattaaatctttttatatgttatttagatgttattaaatcttattagatcttattaaaataagaacttgagaaaaattatatgtgactgagataatattgctttgaagatagtaagctatcttatatttcacccagcaatgaaacatgcagctttatttctagacagaaactgaagaggaaagctgagacctacgaagggctttcttagtctggaagataacagcatatttgaatgctgattcaaaccatccaggacagagtaaaattgcatttttgatagtgtccccaagacagttttaaatacattatgaccaactgatgactcaaactgatagagctgttacctcctgccactgaggatttcaaactgtacactttgtgaagaccaagcaaagtcaggaatattttataataaactggaacccaaatattcatgagacagtcccttcctaactgtctcactctccagatgagaaaattagtctgtgtccaagactggagttgataatggtagaattcagtaagctcgtgaggagtttatcttactgtttactggagatgttattactttatttatttatttatgaaatatcgaaatcactaggaggaatttggaccattgctgacatttcaatacatctgcataaaatggcagtgctcttcatattaccatagatccattcctgtcttgaattcaaaataaatgaaacattacaaaattttctctgtgctccattgtggcttacagatacgcctgaatataatggttatcaagtacatatgatgatctatcacactgataagcaaggtaaaccagtgtgagttgttcaggttgctctgagatttcataaatattttatattattttctaaaatctgaaaattcattttgctgaattaattatgttcagtccttatcctcaaggggcttttcatgtacagtgataagataatacatatttgtaaataaatacaatcaaaagctatatgtttcaagctttcaaaagaccaataaaaatataatttctgataaaagatataattaatcaagagtcatagtcaattgagtacttagaattagcctttgaatatgttgaattattgattgttagaaaatcagtcattttagaaggaagtagaagtatggggaaacacaaacatagcgtttgattttatcattacacacatacacatacaaataaagctaaaatgctagattttagtcataacatagataccatgtccaagatatttgcagggtattagaacacaatgtgagtttaaagaaagaatagccctgaaggctatgggttacttgggaagataatatagtttagaataattttagtatgaggccatgaatttaaaaccattctaataggaagtggagatgagtaaacagtttgtgacagaaggcattaactgaaccatcagcaatgttgttagttcaaagactagcaaagcatttggactatgtttttaaggagaaatggaggagccaggtaggaaaagggagataccagggataaaagcataactcaaatattggaaaatgaattagcaagtaggggaattactagtagaaataaactggcataaaccttcccctgaaaagacagataaggtaccgaggatgggtggaggtaagttaaagagaaagggagcaaaaagttcacatcacatgttttcaatatccttgaaaatttgtacatgaactcatcagctaaaggacagcggtaaagtttagtcggttcttaagaaaaattgaaaattccattttgacagacttgattttgacttagaaggaacaaaatgctgctaagtagcaaaaagtcctcattttaaatttagtagaatagtttacagctcaaggtctagattcagagatattttggctcaaattctcactctgccctttactttttgtggacaaatttattaatctctctaaaacacagcgtcttacactgaatcatgaggcaacagcagttatctgcctcatgatgactgagtgttattgacttgactttttttctgcctagaaagtatagttaccaacccatagatggaaaagacagcatccctaccctgatggaattcacagtttagaagggccaatagatggtgatccaagaggcttgaatttcagttccaattctatcaaaactaagcatgtgaacttcatcctgccaccgaacttctctgtgccaaattcatcaccttaaaaaaaaaaaaaagtgcagggcaaagggctgccctcttggacagtctgaagtgagaatactatggcctctaaaagaacccggaagtaccatcttgaaataaattgatgctagaaattttaatcgttaaaatttaacaattatgttctatcatgactgagagacaaaaataaagaaggaaaacatgtaaagtgctaggtttatccctcttctcatgcctattgccttttcttcattctcattctgtcttggtcatcttagaccagcacacttcatttagtaggttaatcttctaacaaatatggaaggaatgtctgttttatgccctcatgaaggttataatctaatagaggaaacctgccaataataaatagactcattagacttataaaattataagattgggcagtaataagtgctgaaaagaaggtcattttgtttttatgtcactgacatgatagattttacataatgttcggaaacatgaacttcaggatgaaaacagttaacaggaaggaagtctatgcttctgttgtttacaactgtggagcagataaaccaggaagaaaccagtatgcttctgatgaatgggaaaaggtgggccatgctcaagtgtctgagcctggagtggagatgggcatcctttctacttagatggtgtccatagatcaaatgaattctttctactctattataacagaagccttaattggaacccagcccaattcactgtggtcccaaaaagatcaccgatactgtatacacagccagccacttctgtgcaaacaagctctctgggaccatggcagtgccttcaatggaggaggggagggcaagaagggggaaagacagtaggtactattacagactttgcctagttcaggcaatacttttgcttatgagaggctggtattgagcactcaggaacaggaaaaggaaaacagaataagtgattttccaagcttgaattcttctggtcagttcaaggatcatatagtgtattctactttcaaaatatgtttagaatccattcatctctcaccacatccgttgctgaatcataaccatagtacctttcaactgtacaactacattggaattcccacaagcctctctcttcaattctgttataatccattccctaaaccacagcagccaggcagatatttttaaaaggaaattgacccctgtcatccctctgtttaaatgctttcatagattctcattgtgttttgaataaaatccaaagcaccagtgacctctcatcatgtcatcatgttctcagatattttcttctgccctacctacagagggtttttttttttttctcatttcctcaagaaaacaaagttttcttatcactttggcatagagtaatagaaacagttttcccagccaggaatatccattcccagttcctttgcctggggaactcttactcatcctggtagtatcatcttaaatattacttccttagataggcctcctctaagtctctaatcaagtttaaatttctcctaatgctctgccctttttaatttctgactctatcaaagtacacaattatttattcacgtgaactttataaaagggctatctccctagccagagtgcaagacctactagatggaaaatatatgctcccttttccactactatatattaaggctttgcaaagtatcctttgtcttgaggacaaagtatgtactcaagaaatatttgttgactgttgaatgaataaagaatctttatggaaattatgagatacttcacacagaacgcttactcaagtgtctgatgcagagttattttcctgtagcacagtttgttgcttttcctagctttgctctatacctccaacatgaggacagggaaagacaatagtcaagggatcagtgggttggggtcatgggtcaatgtttcaagtgggtaaaggattttagattgcagaaggtcaccctgaagtcggaaattgtaaggatccacattgcttcagtggtaaatctggccccattcatggcacaattaaaaactctctgaccttccagtattacattaaacagtaaaactcaacattctatttataaatgttccttttttgtccttacaagttacagtatggaaataaacaaagctcacccaaatgagaacaagtggaagttactattcagaacttactacaggaagggagacagccttcatcacttgcattaaacagggattcaaaggcaagcaggggagtggaaaagtttcatagtggaaagaaatgaagacctcaggtgtgctgtgattggagattgctggcatgaggaaactggagttggtctaacaaagcagggcacctagataatgggttttggggggcacatttgactttctctggctggttctgatttggagggtggcaaaaaattgggaaactggaagtaataggatgaatcctgattgttttgggtagattgcctgctgagattgtgtttggcttcctgaggtgctcactccagagcttctgggtcatagtttgtcatcacacatggtttggtcattgtctatttgtgtattcagtctgtgagtggaattactgaagtaatttggagggagaagaatagcaaaaataaaaagaagcaggaaaaatttacttgtgaggaaatataaaaacatcatcaccaacaataaaattgtttttttggtttgttttgtttttgttgtttagaatgtgtaaccaggatgtaacttattgttggaagtggtttatccttattgttccatcacctgaagcttagctatgtgcttaggaaagaccagctctagagggaagaaaacacaaaactgatggcataagatgttacagaaatattcaggaagatcttagactgtaacttcaaaaggatatcatttacagcaaaaagagttggaagagttccacacaaaatgggtttagactgagttgatgacattatataaaatagtgcaatttcattgcaagatgagctacctagaagccatttttgggaaaacaaccacttaaatttagaaaagaatttcctataggaaactgtaatgcaataataaaatccctgaatcttaactcatgattgaattttcttttaaactctcctatgtgaccacaaagtacttcgtgtgttttccaagagaaaaaagtcagtcttttactgttacactttcctggttattcaaaataatttttattgtactacagaatatttgtttctaagtacaggtgtaaattaaaattattcttgtgtacttctcttatcctttttctagcatcaaattttgccaatctgattactttgtggatattctcctgtgtgatatttaaatgaaaatagacattggagaatagaattccctatctcctcagcagataggctctaataaaccattattaaaattggctttatgtattaatattatattaactttgaaaaatagaaaggataaaactgataaatttctttggacagaaatagtgctgagggaccttgaagcatttgggactataaaaaacaatcacaatgtgtttgccccagcgtaggtttgtaataaaatcagatttagtttgtgtatcctttgggaaaatcttaaaaaaaaatacagaaagacattttatgaaatatatgtttgtcaatttctatagttaataatataaatataaaaataatttgtaaatgtcttataaatagtatttataaataatataaagcaatatattgcacatttacacacctctaaaaggtttaaatttgtcatattttactttcatgtgaagcttcattttaacttttaacacttatgctttttaaatatttactgcttgcatccaccagtatagagactagtattaatccacagactttttgctaaaactcaactatcttgataatatatgaggaggataagaattgatagtgaaaccctgcctgcctgagtttacaggcttatgtgttctagaattagaacatgtttcaaagtgctttttgaatattttttgtaaagtatgtattttgaagaaaaagtggttatttctacagaaatctttactattgacctttcttttacttgttgactcctgccctcattaaacttcatatgaaaaaggtgcctgaatggaatttaaattttctgaacttatctaaatctgaaaatctacctcagataggtgaaatttacattaattatagatttctagaaccggatgcacggcagtttttatcttcctctctttggtggcatttgatacatatacccagtgcccatggcaacagtgacccccaacttgtccaggaactgagatttatcttgccttcctctacgaaagcaattttaatggtgatgttaactcgtaaactttaaattagtcaaaaagtgatgtttgcttctctaaaaacaaaaatacttcctgggcaggatccaagcctattgcctttctttggagatgttagccatttaatttgtctaactcttatatagaattcattataaaccctgtctcagaactgtaccgacatttttgtgtgtcagtgtgtatagttattattttgtttggcaactttacactttcaggacgataaaatatttcagaaaactatttatgaatgatgtttatgtttagaaatcaatcagattgccttatttgaggtcacagaatttattgttttggttcccaaaaagtcttattttggcccaccaatgaatattaaatattggcttttttcttttaaccactaaatttgaattaacatatatatatgtataaattacaattatgatatatataacataattgtaattgattgatttgatttcaaatcaaatcaaatctgacctacatttttatctgtggaaaaatggcttttaactgaatggtatcgtattttcatatttgggaacatgtaattcattaattcaaacattatttaaaaaatcaaaatcacaacctgtctgttaactctttaattgtgcttagcattaaattgccctaaactaaaataaaaatcttaaatgagaaaaatcagtgtttagttagattattaattcctttccatgagatgattatatacttactgatttattgtactcatattagcactatagttctcgaatggtaaaatccgagatcctatgcacactagttgagagtttcaggacgctgattacgaaagcgttctttgccctatccttataggccaattaacttatatctgaaggtcagccaatttccagacaattgctctggactcaaattctagctggcaggaagcacataggctttgctgtaaaatatttctttttgttttctagagctcaggtgccaatgcttaagtgctctcttttcaacacttagttcaatggaagtaaacagttattaaacttcggtgtcaagggttattagacggtaatgcaactaactatctctacttttcatttaactattcatcatttgaaggagtgaagtaaggaaaacaaaagtctctaatttcccactaatagtgagaaaactaatctgttgaaaaaaatttctgtacccaatattcatgcattgtattggcttgagaaacccaggttttcagaaataataggtatatgagttaatagagaaataaacagtccactagtgtatattcagtcaattgcaggaaacatctttcatacgtaaatcagcatttaatataaatctctttcttatgctttctatttctcaattccctcaaacagtactatcggggtgccaacttttttccaagggaagtagtcaatatacttcaaggaaaactatactttgtaggtcatatggttgggggcaactcattactggaaagaaatttctttaagcaaacatattctaagatggagagtctgcattgtgctaagactgttggaaacccatgtacagtgtggtttctcattatcatcacacaggatctctgtggaaaactatggcttatattctttattcaaggctgacacattctcctgacattaagtcaaaacaatgtacaatcaaataactttcttttttacatttttacattgttgtctaatggaaaactatattgcttctttttccatctaccaacatccagtgaatattttgtgagtcaatgccagtaagaaagtataaagagaattttgatagatttgtatcaggtattttttagtggagaatttaaattatttcttaatttaaaataaatttaactttatttggaactaatatttttaaaactaactgggaatgtttattttgttcctacttgaaaaatttcttgtatacatatcaagcaaattatttccataaatttcatagaaaataagaaatgtgtgacattgatccggtgtacacaaaacagagctaacatgcatctttagaagaaaagatgctactttcagaggttaacaattatatagcccaatagaggaaatagaaacattttttggatttaaagtagtaatatgagttacaaaacaaaatttgtactgagaaaactgtcaccaaaaataaacaaataaacaataaagaagcaactaattaataagataaataatttaaaaattattctgaaaactgttgttttctacctagaaaaaaatacacagaaaccaaagagaaaatatacttataaaacaaaattatatgaataatttacacattcctgaaaaacaaaacctatagtgtaaaatatttatttaaaatacttataaaatataattaggaaaaaatggaaattcatagtaaaggtatgtggcataatatttcaaacattaaatatgatattgagatagatcttaaaacattaagaataacacaaaaaacatgaagataaaatatggaaaacaaaatatgtaattataaaagaatagacacatatgtatgttcaacatttgccaaatgaatgaatgatattggaaagtcaaccaaaaaagtctgaaagtttttatcatggagtaattcactcacttactctatttatttattcaataaatattcattggatatttattatataatttaaagattgatgaaatgtttcgttttgtgaaggcacttagagtttaacacagcaggatcaataaaaatgaaatataatttggattcaaagcaatacataagtggcatttctgagatgaggaaaataaaacatttatttctgttcaataaatattattatttatgttcaataaataaaacgtttattggttatataaccagtatgttcagagatctcacatataaagcccgtaggatgtcctatattcaaaggccttggggtaaaaagatgagtatgccaaagtctccatccgtagggaattagtttttactagacagagataagtaaacagttaaaatataatatgatacttattgtagtaagtaaaagcataactaaattgctgtgtatggaagcgtaataaacgatcatccattactgcacagaggaggaattgttttacctatattttgaaacagtaattaagatacatgcataaggtagtgaaaagggaaagagtacaccttctatagaagacatgaggacacaaataattgagaactacaagatgcaacaaagtctatgttcagaaaatggagaaatgcattatatttctgacaatttaagaaaagaaccattgtttctctctctttctactcagtctttaggtaacatattttgcaaaaagttcatatatacatgatatacacatccgtatataacatatacataaatgctatgtatgcatatacataaatgtactatatatagagatacatgcatacatctacatagacatatgtaaacatccacatatacacacacacacacacacatatacacacacatatgtacttgttgagatttaatatttccaaatgataatactgaagactttcaagaaaaaatattcaccaatagcaaaatacatatgaggtagctctcagtctttttgagcaacattaatactagagaaaaatgaataaaacttagctctgaaggaagacggctctgatataataggtcttcatttagctaagttttctttatataagaaggcagcaaaaatacctttaagtctgcaaccataaaagtatgtcacataattatcttttataataaattatcttgtgtaagtacaatgataagtgaaaagcaaatactcagaagaaactgtggctagatatcctagtaaacatcaaattcagttaagcacaaaaaaagatagttttgaataatgactttacaaattatatcaaaattacaaccttttccttgtagcaaaataattcataatacacaaagcaaaataaagagaggcagtgtttacaaccccacattaaattaactaaaaccggctgggcacggtggctcatgcttgtaatttcaccactttgggaggccaaggcaggcagatcacctgaggtcaggagttcaagaccagcctggccaatatggtgaaacccatcttttctaaaaatataaaaattagctgggcatggtagtgggtgcctgtaatcccagctacttgggaggctgaggtggggagaattgcttgaacccaggaagtagaggttgcagtgagccgacattgtgccagtgcactccagcttgaaggacaaagcaagctccatctcaaaaaaaaaaaaaaatgttaactaaaactgtgaatcagtatgtgtggcagcagaatgggacaaagcatagataattttcgtagagtagatatttcaatttttatggctgaatattcgtttttcagcatgatagtaatatttcaaacagaagctgataatacacattagtagacttaaatgtattttatctcccaattaccataggaaaatttccaggagtagaaagtaaataataaacaccaaacaatgtgaaaggagcaaggctaaataaagataagattcagtaagagaaaaagttaggacattgaaaaaatctactaaggcactaattataaaaaaatccaacaaaatgagaaatatgttgaaagtgaaaatatatataatgatttatcagcaaatgcaaagaaacaaataatggaggtaaagtaagtgtgattaataatatatattgagagtttacgtaaaacaaagtaattgaaataaaaacagttatttttatcaataacaccatctacagttaaaagacttgacaattataaacctttataatataatctgatgttattcaaactattaaaagctaaattgttatacagttgtcttatggaaactaccatgaactgtaaagggaaagataacaagtagagaaattattttggaaagttatttggcaacatatagtaataatcttaacaactcagattatctgtgctcagtcattctaattctagaaatctgtttttaaaatgataaaatgtgtgaacaaatatttataaataaatgtgtttactaaggccttgtaacaatgatagttgaatcacgatatgttcatatgatcattttgtgtagtcattataattatggatttgattatctttggtgccaggagaaaatgctcacaatagtgtataaacagaatataattagtaattgtcataattatagcatacttataaacacactatgttgaatactttttcatttaatcacactatgttgaatactttttcatttaatcttcactatagtttatgaagtagatactattatttcccatttacagatgggagaattgtgacacaaagaaataatgtacccgagtcacctgatgttaagtggtggacataggatcctggcagtcaaatacgctgtccataaaagctgggccattaacaacaaggctatgatggaaactgtgcaaggaatgtgtgtggaaagacaaatgacaggaaaaaataggaccacaatattaaccatgattgactctgggtgtattcataggatcaaagtttaaattgatcttcttcttatatcttctgcatattttataatctcatgacaattaatatgcattctttttctgaccacaagaagaaatcaaagagccaatcagaacataaaataaaaatgaataaaatcataattttctatagctccttatgacttttgaagcactttcatatttcttgtatctaattgaatccttataattagaatggccctataatttattacacaaatcatgatattttttatttgtacaagagggtattattaatgaaaacagtacctgggcaaaccaggatgtagagtcaccatatataaaacaattctgtaaggtcaacagtgcttaagcatcttaattgcgtttcagagctaaaaaaaaaaaaaagtatttcaaaggcttgatcaagtcatatgacaaaatagtggttcccgaatagacaaaaatagattgctatcactttgtccatgttttttgccattaaaacaaaacaaaacctctggtgacaatttcctcaatggaagaaagttttgaatcatgtagttgacaatctaggaatatctaaaattttatttgacttaaaatattaaagccactgatatttctgaaatgtcataatattacgctaagaaagctgagatttacaaaagaggataactaatacttgtgaatataggaaattgtagattcatgtaatattcatctgtgtcagaactccaaaaaaactagaaaagcaactaaccaataatgaaactagagaagtattttcagatggtaagttgagtgaacatttagctaaattatttttataaaagtaataatggagggtggcattatgtgaaatgggaaattctttgtattagttacttggttagaaagttgaaaactttctaaggttttattagatagacgacagtgaacaaatgatgtttgtcagtggtttcactggtagcattacacatctgaaaatcttagctattttgccaatttatattaaaaaaaaaagtaaaatctaagggaacaaatgcatgataggtattaattatggaccaggtatagaaaagtgacagtcattcactgcaaaatactatctgcagatgtgtcttgtttagccaagagtatttgcaaatgattttaaatttgaaacactttggccgggcacagtggctcacgcctgtaatcccagcactttgggaggccaaggcaggcggaccatgaggtcaagagatcgagaccaaactggccaacatggtgaaactaaaaatacaaatacaaaatactaaaaatacaaaaattagccgagcgtgttggcgggcgcctgcagtcccagctactcgggaggctgaggcaggagaattgcttgaacccgggaggcagaggttgcagtgagcagagattgcaccattgcacttcagcctggtgacagagcaagactccatctcaaaaatagataaataaataaattaattaatttttaaaaaattaaatagtttaagcaggtcaacaggcattctagttttgacacccctccatccttccctacccaggtccccagcaggccctctactagccctggtggtgccttaccggaaactcaactaaagcacctgctctgggaacatgcagccccaaggcacacagctgttggaaaagcaggattgggattgtggcccctcctttctactgtgtcttgacattttgtgagatttaaaaattgcacatacttgcatagaaattcttactacggccctgtacattatcatgtttcacattgatatgaccggcttggctcctgaagcctttcattattgactctgaaatagaattaggctccatctttaggacattgtcataagcatagtctaatgtaaagaaatgtaaattggccagtaggtggtttagtttggaaagaatactgaattacttgactttttccttcctaacaccaacatcaggaatatacagaatttaatggtgagaggaaaattaactccatatgaggaaatatggcaaagagattatgctgatgggacctttgttagcatatttagttagaacagagtaaataatacctgctaaatcaatgccattttaaaaagacttaatttatatacaaagacttattttaaagataatttgatagttttccttttctttgagaaaaataagttggatacttgtctaggagagtatggaagacaaattttgttattgattactcctgggtatgagacagtgaggaaaaagaactgatttcacatcttcttttgcctctgctcttccttgctgctgatcattgttatatgatagtgcaatggtataagtgtcaataaaccatctaatgaatgcattttgtgacatcctgtgcttacgtgtttcttctggaggcttatctgcattatctcatagtctgtgttcagtgaatacaaaatgtctaaacactgtgagtatatgacctaatctatcagaagatattagttaaattaaaattcatattaaatggatcacagaagaaagtattggaatgtgttattcagatcagattttactgtcttctcctttcttgggagcactttaaaaggtgcaaagatgcgtttttaaatctccaaagataattctgggcatggtcttatcccaccaggggtagtgcaaaatactattcaatgcttcccttaagcctacctttacctattaatttatcttggatccctagattttgcgctgtcttttagctttgtctgtataatatggcatgttatctttatgagaggatgaaatagatccattacagtaaaagatgtatgccattaatgagtttctagccagctatcaaggtatcatcaaatgtggtttatcttggtgaatgaaagcttgaatggaaaattaagctcccacactgactggagaagttcagtggatcgttttgttctttaatgttacacttcactgaacacacttcacagagccgtgaatcatgctttaaacaagctgcctttactttaacggcagcagacaatgcagcaaaggtgaataataagtgttagcaatcttaactttcttttgcagtactctctaccacgtgcctgatggacaatttacaaagtacatatgctattttatagattggaacgtgggatccagccagtggcctgaatatgacagaaagtcaaaagggaaagccagcgaacatcacagattccttatccaatcgttctttgattgttaccaccattttggtaagtatttgcttttccattattcttagttaaatgtagatgaacacagaagtgcatagaaaaggacattataattggaacagcaatgaacagaatgtattttacagttatttagcaattactgtacaacagatgagtcaatgttaatttagtcacagttttgttagtcttaaatgatctaaattgtattaacgtttgggctgtttatgttgactaataatacagcttaatgtattactggaaatcttttcatttttccaaaattagttactattgaggaattgtcaatgtcaagacttgaaaaatacgtgcagctctataaatatagttaagtgatgagccaaaagtgaactttgcttctgcttttattttccgcaaatatatttcatagggcatggcacttatttttcagaattttttctcattataattatattttaactttattttcaattttattgttttcatcttggaaaattaattttactttatgaatttccctaatgtaaccaaatggcaagtgctttttaaagccagaaatattttcagcactgacagacttaatattgttaagctagatgtttttacccctcttatatttatttatatcttttaattagatcacacagtaatgttcgcttatgcccactatgtcatttgcaaaagggaattttaatttaggataagcaaatagctcttacattatttagtcagtacttttcacctaccaaataagcttatcaatgaccattcttattaatcctcaggtagtcagtaaaaattgagagtaatatctagaacaaactaccatgaacatttagcatttatataatttctaaatttgatttatggtgggaaatcaagctatgaggaatatatattcttgcccctttagtagcaacgagggatgtcagatctgtaggcatgtcaaaatgaagtagcttgggttaaagccttttgataatgaagcaaagctgataatcatgaagtgacagtgatgaaagtcataaagtttttaaccaatctgtggctaaggacctcagtggatactcgctctctctgtcacatccaaacgtctaagacacccttttacttaattttctatcttcctttcttttcaaagataactcccatacccaccaacctagccctcttcttcagtcaaaatgttctcacagtacaattacacatcctctttctgatctacatgccactatgttctggatctcattacttcctgttgggactattgcagtagccacgtaactatttcttctgcctgtggctttcctcctttgcagtgcacccaagtcccaccataaaagtctaattctgttccaggcaaatggtgactgcttgaacaaggacaacatcaacaacaacaacacaacaacgacaatctaatcctgtcatttctctacttctttgttatacagattgttagagaatccttattgaccattaaaaagccaacaaatttaaatttttatatatagggtcctctatggtcttactctctctcacctttttatcttcacttcccattattttctttcaggaaccgtgtgttttaattgaattgggataaccagttagcctgctacatagttttgtgaatgctcttcccttgctctgcaatatgcttatctcaatttctgagatatagtattcatcagtaatatatgacttaatattcatattatgctattcttatttcatgtgtgcattattttcccaaatatcactaaacattccttggaggaatagaattagattatgtcttctgtttctataccatatgtacctctgcaatgatcataggatcaataattctgggtagaaaacatctgtagccttcagtaatctggcccctacactcctttctatcatcttcctgatctagccaaattcctcaaaacatcacttattttatggctccaaatcttcgctcaattcttcttcttctcctcctccttcttcttcgatggagtcttgctctgttgccagtctggagtgcagactcatgatctcggctcactgcaaactccacctcccaggttcaaacgattctcctgcctcagcttcctgagtagctgggactacaggcgcgctaccactcctagctaatttttgtatttttagtagagatggggtttcaccatattggccaggatggtctcgatctcttgacctcgtgatccgcctgcctcagcctcccaaagtgttcggattataggcgtgagccactgcacccagcctgctcaattcttctttatgttctgcagtaaaaatcctattcattttcttgtatccatctcaaatgctacccacttcatgaaaatctttgacagctccattaagttgcctgtgtcttggggagaaggaggaagtttgtatactttatgtaccagaatactccatcatggcattatcatttttttaattaaaaaactatgtatgtttgtgtttccacttgacataagctctataatcaaattttacactttctgatttctcaatgtcggagaaaagtgccttgggtatagcaagagctcaataaatatttgtcaaattaaattaaataaatgatatttaattaaatgggaaattagacgaagtacagaactttcaaatgactatatttaaatatttttcaagtgtgcaggttattaaaattatctagtacaaataaagcaggtgattaagagtacccatataatttctcaatcttgcttcagtattcagtgttattttttgagaagtgttcagatattgcttctcaatcataatcaagtttatatctctctatgaagaagtggtatctaattttatcttcatatcagagtcagctctaaagctttaataaatacactaatgcctaaaacgtaccccataccatttgaaacagtatttctggactttgaatcttggacactttgatttttttaattttcacaggtaacacaaatctataaccatgattaagaactatagctcagattattactccatatgaataagatgtaagatcaactatggaagatgcactaagctctcattttaataaacaggttatttatattttagagtatgccaactacttgtttctaaaagatcctaatatttcctaaaaggataaaataaggcactttatttttataccttttagttaaaaaaaaattcctttttctgaatactctgacttcaacatatccatagtcaagtaaagaacagatttgaagagattatgtaccttatttatgtaagcttatttttgatgtaatttactggtattctatttgtatttttggagaaattatgattttttgattgatgttatgattattttgcccttttctcttgaaatatcttagaggaaattctggctacattatgaataatgacatttctcccatatccctatcatgggaaggagatacaaggagatgttaacttgtgcttcttgttcaacatttttattacgtgtctttaaaaaatgatgaggtattctggaattcagcactatccacaagctaattataatcagctctatttctcatgaattctattcattcacttatttaattttattcattattttatttgatgaatatgtattgaataataatgatatactaagcactgtatttaaagctaacaaaatagacatgatcgcttcccttattgaacttagaaaatggcaggaattcatatggagagttttacacacacacacacacacacacacacacacacacaaacacatacaacttataattaagatataaaagaaaagtaaatgatacggtgccttaatatacagggtaattttgagttatactagatgtcaggagtggaagggcaagtcaggttaggactcacagtagaagaatagacagctgagactgagagtttgaggaggaattagcaaggtgaagaaagggcaagggagtattctaggcgaagagaacagcatattcaagcatcctaaagcgggaaagggcttggaaaattttgtggaattgaaagaccattatgactggtgctaatgcctcgatctgcttctcagctgcttccagtataaatgtatgaatatggtccactacaaaaaatcatagcagacatgtattacatgcctactgtgtcccagacatagtttgaaacactatccatggatttattcgtttacttgtaataataaacttttgaagtagacactattagcaccattacttatttatagtattatatatatattttttcttttttttaggttagaaagctgatgtttatacagcctaagtattttactcatggccatacaactagaaggtggagtagttgtagggtttcaaccaatctgtttatccaacctgagcagctgatactataaaatgaaaattctagtggtcaaatatagaaaaggctaacacttatagtttatgatcaaaatagcatcttgattgataattatttacctaaagcaatgtttctcatccagaagtcccacatatgctagaactttgtgatgcccttagagatgtgcctccaaatatctaaacattttttctctacggagaacattatttaggctactcttgcgtgaatatgttgggtttctagtctctgcactcccctcatttagtacttagttttcttttactctctttaaactataatctcagattctcctgggcaatcaagacggtataggagctcacttcattttttctcttaagaattgcaatgtttacacatgtttttactccactttaataacatgacctagacccagtacattgtacgggtacagtacatagttgtattatgcagtaaatttacatagagagcattaaacatttattttatatatttttttatttttgaattaagatttatgatataaaattggagatttatggatcgtcaactacaggtctatgcctaaagctcagctctatttatgccctaattttattgtttgtgattttccatattgcctctttcatctttgaatttcaagttcggttgttgttaaaattctctgtttttttgtgtttatcgttattaatggaactagaactattatctttcaaattatattttcatttatgatgattttatttattgcatagaggttgttaaaatatgagttcctaattgtcaaaaataataacaaaaatacaatttttgagcaagtagtagagagattttaaagtataacgtgctaaaccttcagtttgtaacctggtcttgttgctgctgctgttagctatgggaagtatcaggggactaagtattattttatttatttgtttgtttatttctatgggttttcgggggaacaggtgatgtttgtttacatgagtaagttctgtttttttttttttgtttttttttttgatggagtctcgctctgtcgcccaggctgcagtgcagtagcatgatctctgctcactgcaacctccgcctcccatgttcaagtgattctcctgcctcagcctcctgagtagctgggattacaagcactgccaccatgcctggctaattttttgtatttttgtggagatggtgttgtatttttgtagagacggtgaccatgttggtcaggctggtcttgaactcctgacttgtggtgatcttccagcctcggcctcccgaagtgctgggattacaggtgtgagccaccatgcccggccatgagttaactctttagtggtgatttgtgagattttggtgcactcatcacccaagcagtatataccgtacccaattttgcagtcttttatccctcacacccctcttgccctttcccctaagttcccaaattccattgtatcattcttatgtctttgcatcttcatagcttagctcccatttatgagtgacaacatacagtgtttggttttctattcctgagttacttcacttagaataatggtctccaattattcaagttaatataggaaatgcctactttttcctctaaattcttagttttcgatagacatttttcactcctgtctgactatgttgagtgtttctcattgtgctatgcctgtataataattaatttttgtccatcaaaagattagtagcatttaaatgctactgcacatgttccttcttttgttgactagtaacactttagcatacaaatgactatgcatttggttactttttcagaaaagcatttattgtcaaggagattccttctccccagtggctcagtgaatttaacaaatgtacttgctcctgaaaacttagtcgtattttttattttcccagtactttgtggaaggtattacagtatccactttacttgcttaagcttgtaaagcttttgtgtcacagcccacagatacggaaggcttactgggaagcaaatttccaatgacaattgaaaagtacacagtacaaaagagagaagtgaccgaattatcccctaagtggttctgtagcttcttctataatatcaacaaaagcagtttttttctaaggcttcaaatctgccactgcaataagttttccctctgattctcgtctttccattgtggtagaaggactgtcaagcatgaagttcttagagagttgcatagcatttgggcttggaaacccagacactgcaacttcacaaagaagaaaaatattttccttctcagcaatctcagtcacatattaaaatgcgagataagagtgactcattcaaactaaagtcttctccaaccccattcctacaatcagcttgttcagacaaccacactttttctcaccatattttttcttctatttcagagattgtgctggtactacatttctctctttcattcttgctctgataactcagtgtgttttatttcaaatgtattttatttctcatattttcagagacttccacaaagctagtcaaatataaaactattgatggtggtagagaaagaagaaataaagaaagtcatgagttttgatgtaaaattaggtataattttgaaaatcctagggtcttaatttctaaagccttctaagtgccagaacctcattttttacttcatatacacattctttttcctttgtcctttattaaatctgacttaaattaactaccatgatgaagacttataagcagttttgcctttatgttattttttattccaaacattattgtccatactataaaattgacaattttataattgtcaatactaaaatggttgaagactattttattatgatcagtatattaagttttgtataaaagaatgaatagaaaaatctgaattttgaattcagctcagccactagcaaaatatgtgaaaatgaaatatttttgccttaacattctcatttttttaggaagatgttatcacaataggaccatatacacttgtacaatctgaattttagctacaaccttgaactgagattcaaatgtaaatttgcaattacttactggacatatatccacttagatatacagtatcatgctccacatgcatcaaacctccttctttgattcaggactcacaatgctgattttgcctatattttcaatctctatttatgattccagtacctttctattcaccccagccagaggtgtgttttcttagattcctcagtccctttaaaacccatactcacaattcaagtacctaaaggagaaagagtagattattctaagaaagttcaacagagaagtaatcaagaacattttgaacaaatgagatatgatttgttcatgggtactactgaatgggtgattatttttagagtctgctttgagaggcactgtacttataggaaagaggaaagagatggcaacattaaaaactaagtataaggtttcttgggaatgcattagatagggcaaaaatctattgaggaatgtggatgaagacgtaaaggttaaaagcctagaagcagggatgatagcactgccacagcgtgtgatggggatggtgggaaaggagatgatgaatgatactcaagtatgtatggagatgttggcaatgacttttgagcagtcaaatcttgattatttatgtaaggggataataaattagattcagagatgaaatgctgtttggagattagctaataggtacagtctcctttcccatcaaaccttttactggaaccacaatgaaatagtacatttgattgattcaaacttcagctttttctttcttactatctttcccttgtaaattaaactacccaaaattttaatgaccaaaatagaaattatcagcagaaagatagtaacaaccaactgaaggaatttaatagcataccatttaaaaaaaatgacgttttttcttaatacaagcatgaatgatagtcactatgccgaatcctcccttaagatatattactctgacatcagtaaattcctttcttgaaacattggtgaacagcacaactagcaaaactcaccttttttttcttgaaagtcgagttcaactattacacaatcattatttccataagactcactacaatttccagtaagtaaatattacttttcagggagaaagaagttattctcatcttcccaaatcccagtagattttctatagttacaggataaaaacagaaacttttcttagaattataattatggccaacaagacttagatttttgtacattttgaaattctctaaagttatgtttctgaaataaggtaaatacagtttgcagaaactacgtatatgattatgcttgcatagtttatgaaagatttatgtgtgtgtaagtatgaaaatcactcctggcaaagattgcctttgcttaatagacttgaggaagaaagtagaaaagaagaaaataaaagaatttttctagattgcctcagaatgtacttgaattttgtttaaaaaagtaaataataagcatggtttattaaaaaacttattagggttattgctctataagcctggcatactatttgtttttgctttaaaacatagccccacattggattaaaaaaacaaaacaaaacaaaaaaaaaccaatatcagtctttctgctatcttcagaagaaccatttcacatgtaatgacacccatagactcaaaataaaaggatggagaaagatctgtcacacaggtggaaaacaaaaaaaggacagggattgctatttttgtattagataaaaagataaaatagacttcaaagcaacaatagtacaaaagtacaaagaatgacattacataatgataaagagttaaattcaacaagaagatttactactctaaatgcatatgtattcaatattggagctcccacgttcataaaaccttacttctagacccaagaaaagactttaacagctacacgatagtagtgaaggacttcaacacaccactgacagaattagagagacgattgaggcagaaaacaaagaaattctgcacttaaatttggcacttgaccaattggacctaataggcagctacagaatcttccatccaaaacccacagaatatacattcttctcatctgcacacataacatactctaagattgaccacaaacttcatcataaagcaagtctcaataagttttaaaaaactgaaatcacaccaagcatcttctcagagcacagtagaataaaaatagaaagcaacaccaagaggaactctcaaaaccacacaaatacatagaaactaaacaacctgctcttgaatgatttttgtgcaaacaatgaaattaagggagaaatttaaagaaatctttgaaatcggaaaatagacacacagtataccaaaacctctggaatgtgtgaaaagcagtgataagaagaaagtttatggtgctaaatgcctacatcaagaagatagaaagatctcaaattaacaacctaatctcaacctaaaggaactagaaaaacaagaacaaactaaatccagagctagcgtaaaaaagaaataactataatcagagcaaaactaaatggagacccagaaaacatataaaggatcgatgaaatgaaaagatgggtcttcgaaaggataacaacattgatatactgctagctagattaacaaagaatgaaaagagagaagatccaactaagcacaactgaacacaacatatgtgatattacaactgattccacagaaatacaaaagatcctgagactactatgaacatcactatggacacaaactagaaaatccagagaaactgaataaatatctagaaacacacaaccttccaagattgaaccaggacaaaacagaaatcctgaacagactaataatgagcaaaggaattgaatcattattgctgatcaacccaaaaagctgtggaccagatggactcacaactgaattctattatatgcacaaagaagagctggtgcagatcctactgagattattccaaaaatttgaggtggaaggactcttccctaactcattctataaagcagcataatcctgataccaaaatctggcaaagatacaacaaagaagaaaactataggccaatattcttgatgaacatagacacaaaaattctcaacaaaatgtaaccaaacaaaatccagcagcacatgaaaacattagttcaacatgatcaagtaggctttattcctggaatgcaaggatggttcaacatatgcaaataaataaatgtgattcaccacataaacagaattaagaaaaaaacatatggtcatctgaatagatgcagaaatgcattcaataaaatacaacatcatttcataataaaaatcctcaacaaaccaggcattgaagaaataagaactgtcaatgctaaacccacagccaacatcatactgactggggaaaggttggaagcatggcccttaagaactggaacaagacaaggatatccactctcaccagttctattcaacattttacttgaagttctagtcagagcattcaggcaacagaaagaaataaaaggcatccaaataggaaaagaggaagtaacattatttctcttcactgaatttatgattttatacctaaaaaaccctgaagattcctccaaggactcatagacctgataaatgacttcagcaaagtctcagaatacaaaattaacatacacaaatcagttgcatttttatacaccaatagcattcagactgagacccaaatcaagaatgcaatcccatttacaatagccataaaaatataaagaacctaggaatacacctaattaaaaaatgcgaaatgtctttatgaggagcactaaagacaaaacaacaacaacagcaacaacaaaatcacgctgaaagatgacacaaataaatggaaaagcattccatgctcatttcatgctcatgagttggatgaatcaatatcattatattgtccatactgcccaaagcaatctatagattccacactaatcctgtcaaattaccaatgtcatttttcatagaatttgaaaaagaaactattctaaaattcatattgaaacaaaaaagaggctgaatatctacggcaactctatacaaaaagagaaaagccagaggcatcacactacctgacttcaaataatactacaaggctacagtaaccaaaacagcatgggattggtataaatatagacacataaaccaatgtaacagaatagaaaactcagaaataaggctacactcctacaaccaactgatctttgacaaaatcgacaaaaacaaataatggaaaaggatatcttattcaatgaatggttctgggaaactggctaaccatatgcacaagaatgaaactggaccactacttttcactctatacaaaaagtaactgaagatatatcaaggaaattaaatctaaggcctcaaactgtaaaaatcctggaagaaaaccaaggaaatatttttctagacattggccaaaaatttatgactaagtcctcaaaagcaactgcagcaaaaccaaaaattgacaagtgtgacctacttaaagaagttctacatgcaaaaaaatatttgcaaactatgcatccaacaaaagattaatatccagaatctaaaaggaacttaaaaagaaaaggaaatatccccattaaaaagtgggcaaagaatatgaactggcacttctcaaaagaagacatacaagaagccaacaagcatatgaacaaatgctcagcattactaatcatcagagaaatgcaaatcaaaaccacagtgagatgccatctcacaccagtcagaatggctattattaaaaaagtaaaaaaaaaaacccacagatgctggtgaggtgggggaaaaaaggtaatgcttacattgttggtgggaatgctaattagttcagcccctgtagaaagcaatttggagatttctcaaagaattaaaaatagaattgccatgtgactcagcaatctaacacagaaacagaaaaccaaatactgtatgttctcacttataagtgggagctaaacattggtacacatggaaacaagatgggaacaatagatactggaaattccaaagagggagggagaaaaagagaaagaaagaaaggcttgaaaacatcctattggataccacattcttggttgacagggtcatgagaagcccaaacttcagcatcacttagcatatccatgtaacaaacctgcacatgtaacccctgaatctaaaataaaaaataatttaaaaataaaacacaaactctagattatgatagttattccttttatatgtagaaagttcatttgaaagtgattttttaatagtatcgagatatcaaaataggattttttttccagacaataaaacatatatgagcccatgtggagataattatcatcagtagtttttgattttcacaaaccagtcatctccagtgttgccttttcttgaaaacattgagttgtactgatggtagcttcgaggcttcttttcttgttcttcctggtattctcacttctaattttgataacctgtggtgcaccatggcttctgacatgaacactaattagggatggcagaattcaggcttgaagagccacagtgaataggaggaaattgaaagatggactcagacaatgacaagaaggttcttagctctacagaagtaagagtacatttgttggaatgacagatactgaaaaagaaataaaataatactgtcctgtcagtggaataatatcaatcaactgttattattatttatagttacctattattgttcttgttggtcatttcttgtgactgtgaattagaacttagtttttggcatgtccaattcaatttctgtgtattttttcctgtagcatttacgggagtatgagttattgatatgcaatgaaaatactagtagttaaggttattgtcaactaatattcttaaatatatgacccctttccaattttgagatcacagttttgctatgtacatttataaaacttaaaaaatttaactgagaacaaaataactgaagactattttagaatgcctaaaatatagtttagattagtggtggtatttattaaaataatttaaatcacaagcttggtatcatctgtaggctctggaaataaaagaagttatcagtctttataaatgttaatgatactagattcccattaaatctcatcaggttaaaaatacagttttaatgaatgaaaataaatgcagtataaaggaatcatttacaaataatgtaataatctttacttctgcatttctttttatataatttctgaaacttttctaaatgatcagctaaattagcacttaaatatattttgttttctaatcttgataaatttgaaactcttttaaaaattgttttacagttataagactcacaattttagtcacgctcattaacaaataattggctatctaagaaaaaaaccccaaaactcttttatttctcaccataataataaataattttatgaaatgttcttaaatagtaaaaaagaaacattttctgaagcaatttaggataaatgtaagaacaatcatttccaaccaataatcacaaattattaaaagttaggccataagaatattagctcttcattctgcttgacagtatttgagcatggcttggcttcttacttggcaggtggcctggcactcctatgccagctgtcaagctgaagacgtggctggacagatactttagaagagctacgtatgatgttctgagtgagatctaaagaaaaacagaaactgaagaaacaaaacataaagtttgcctgcattaagagcctgtttttctgtaatatacatttcatttttttaaaatcttgaacccactctttcaatacaggtgcccattattataaattctggttttggctttagagttcaaataattcaaattatctgcaaatctgtaatcaaagaactgtctagatgtccataatgaaagctatcctcattactactgtgaaatatttgcttcatctcaactttccgatgaaattctcatgaaaattcagaagaaacaacacaaatacaattttaaaagtgatattttaaaataacgttaaaggagaactatcacaatttcaatagaatacacaaatagactttattgggatagatttctgtggttgaatgtttttaatgctataaatatagaaaaatatcttatttttgaatttttttcttatcttgagtcaatttatggaaatgctcctgtatttaagagatttacaattaattgttcattaattatatgccctttggtgagaactttactcttcatgcctgatcttgtttttcgttgttgttgtttgtttgttttgttttgttttgagacggagtcttgctctgtcgcccaggctggagtgcagtggcatgatctcagctcactgcaaccttcgcctcccaggttcaagcaattccctgcctcatcttcctaaggagctggaattacaggtgcctaccaccatgcccggctaatttttttttgtatttgtagtagaaactgggtttcaccatcttggccaggctggtcttgaattcctgacctcgtgatccacccacctcggcctcccaaagtggcctgttcttgttttaacagcattttcttttattattcttaacaatgataatagatttatgctcaagaaaaccttttatttatactttttcaataaattatttttcaagaatgggcactaaatacaaatgaataacttgataatctacagagattgtcattaactttcaaattgtacttattatgattaatatattaattaatttttgaatggcaaaaatacttatattccagcaataagctattattggtaatggttaaaaaatattctcatgaactgctatattttgtttgctctattatatttaggtatattcactagtgactgctcaataattacaatatttaactactttgctagtttcttatatcagggttatgctaacttcatttaaatgaagatgaactggtttcagagcatttactatggtctaaagcagtttttggattatgaggttgttttattgttttatattaggtgaaaaataaaaattccaaagtatttttttcttctggaagaaatgcttcagtagctttcataatttattttatgcttattggccttttcattttattgtttctttttgaatcaattttatattgtgcactgatatataaccaggtattcaaatttattaacatagattttcacataatgtcaccatataaattttataatctcaatttactgaatctctttctcacataaaattctttgaggcttaaaatttctttcccttttttcttaatttggttgatgaagaaatttattttattactgttgcttttactaaaagacatgtttactgtttagccattttcttccttcctactttgtacttcactattttttcagcattttcttattatttttctttctgctatttgggtttttttggagcgtctatttcccagcctcttatgatttaagtactccatttatttatgttgattttaatcacttagtggtaagttcatatgaggctgaacttttctttcacaagtcttttgaagatatttataaattaaaagttgtatagctagtgattaccagagtgctttgaaatcaagcagaacactcatcgcttaaatcaaaccagactttggatttcagataacagttatttaataattcatttaaataatacactttaaaaaactacttttaacatctacacatttctttttatttagggaaatttagacaattttgtttattaaagctagtgttcatggtttttttaaatatcaccttccagggcagacatggtggttgggatgacttgacacctgaagttcaagagcagccagggcaacataggaagaccctattactacaaataataaaataaaaaaaaatagccaggaattttgacatgcacctgtggtcccagctactggagaggctgaagtgggagtactacctgagcttgggagatcaaggctagtgagccatgatcttatcactgcactccagcctgggtgacatagtgagaccctgtctctaaataaataaaaacttacatacatacataaagtcaacttccacattttttgtcccttaacttgactagtgccaataagtatctttaaatgaagtgtgtatgtttactaattttcattccattcatttattgcctggtgaagtgactgaaacattaaattttttcaattttcacatttcctcttgaaagcaattttgatatttttttcattggtttaactttggttttattctggctagccagttttattttaacttgtttaaagcttacaagactattctccactttatgtttgtaatttgtttttatacgttgatttttgtcaggctgggtttaagtaagggtgatttaaatttatttgacagttttctatgaaaatgtcattccttcatcctccaaaattcttaccaatctgaaaaaactacccattataaaaagaggtacagattacctatgagttccttttttttttttttttttttttttgagacaaaatctcactctgtcgcccaggcaggattgtagtggcatgacctcggctcactgcaacttccatcccccgggttcaagtgattctcatgcctcagccccccgagcagctaggattgcaggcacccgccaccacgcctggctaatttttgtattttagtagagatggggtttcaccatgtttgccaggctcaaactcctgatctcaggtgatccacccgcctcggcctcccaaagtgctgggattacagccgtgaaccatggcgcccagcctatgagtttcttttatgtctttggaagcataccctgaagttatatgttttcctgctgcaacatggctttgttttcctctagcctctgaagtagctaggactttttttcaccatactcctgggaattttcttttttttttttttttttttttttttttttatggttgtgttggaacaatttgtaaagtttggaacaagaaaatagtctcaattagctccaaagtatctcctattatttaattaatttttttttttataaattaatttttttattattattattattttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggcgtttggttttttgttcttgtgatagtttactgagaatgatggtttccaatttcatccatgtccctacaaaggatatgaactcatcattttttatggctgcataatattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgtcttccacaatggttgaactagtttacagtcccaccaacagtgtaaaagtgttcctatttctccacatcctctcccagcacctgttgtttcctgactttttaatgattgccattctaactggtgtgagatgatatctcatagtggttttgatttgcatttctctgatggccagtgatggtgagcatttcttcatgtgctttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggaattttctttaccgatcttctgtgctacagccccatttcctggatcttattcttgcatttttcttgaattattttctcattttgttaaaggctgtaatagcatcctgagaaaggttgctgagtacaaatttaagaccttatatgcccaaaaacattgagtcttccatgaagaattataggttgaatttttggggaggcattactccattgcctttttctgctgttgcagttgttcacaggtcattctgattcttaaccttttgtatgtggcctgtatttttccttcctatgaacaatttcaagattgtctctatttctgaagcttggaaacttcactaatgatatactcttgtgtatagaattaaaaatgaattttaaaaatttaaaaacttcattatgttgaacattctctagagtcttgatttgtgccgtccaatacggtagcttcgtcacatatgactattaaacacttgacacctggctagattgaatggagatgactgttagtgtgaaataaatactggctttcaaagacatgatatttaaaaacgtaaaatatcttaaatttatattgattacatgttgaaatgatagtgataatattttgatatattaggttaaagaaaataactgatgaaattgaattcatctttaactttttaaaaatatggttattagcagaagctacattatatgtgtgctcctttttggggcttgttgctatatatatagtgtgtatatatatatatatgtatgtgtatatatatatatatatttttttttttttttttttttttgagacagagtctcactctgtcacccaggctggagtgcagtggtgtgatcttggctcactgcaacctctgcctccagggtttaagtgattcttctgcctcagcctcccgagtagctgggactacaaatgcacgccaccacgcctggctaatttttgtatttttagtagagatggggtttcaccatattggccaggctggtcttgaactcctgaccctttgatctgccctcctcggcctcccaaagtgccaggattacaggtgtgagccaccatgcctggcctgttgcattatatttctattcagcagcactggtccagaatcttgttgggcatattcaatccagaaactcagttccttcagtcttgagatattttcttaacattagttaacatggtaatttcctttccatcatttctcattgtctgtatcactgagtattggtcatctgacggttagacttccaagtaccatgtaaacaatagatagattctgtttgttttaaacattgatgtccaggtctcacatccagacattcaggttgatgaaacccagacagtattgtctgaaatctccctacatgattctactgattgtctaacttgcagtcgtgtgatgagtaagttctggagatctaagctacaacatgatgagtattgctaatgatagtatattgcaaatttgaaacctgttgagagattagatcttaactattcttaccacacacactaagaggttaactgtgaggtgatggatatgttagtcaactttgattgtgttaatcatttcataatgtatatatataccaaacattgtttcataagccctaaatatatgcagtttttatctctgaattatacctcaataaagctggaaaaaaagaaaaagggaaaatagtctggggaattaattttaggctgatgcacatttttatttagtcttctagatttcaacatagtgcttaatctctgcgaatctagagccacttcaattcaattacttcttcagttttctgccagggtcaggacaaaaagaatgggtagttctccagaaatgggttgaaatttctacctaatttactacttggtacagattatggacctctgaacacggacttttgttggggagaagaatgaaatatttcttgtactgtctctggttaatcaaggattattggtttcctggggccttatatttagtgtcaattcttcaaaaatgataggtaaagttctttatggggttcaggacatgctacccccaaatgtgtctccgtggtattaagaaagtctaggaaggtcactttcttttccccttctcccccaaagcacgtcataagactctcatctgagaggtaccctccctacacttggaagaaaagaacatccttatctctgaaatcacagggacacagagaagaatatgaacaaacagttcttgctaagtttccctcagtttattactgttagatcctacccttttgttctcaaatcctatttccccttaactgtccattcttcatcaaacttaagcataaaagtacataagtttacttcattttggagagtcttcatttctgaaggtttccatgtcatgtaaaacttgtattaaataaatttgtatgttttgctcttgttaatctgtattttgttatagaggccacagccattaatctagtgatgggtgaaaaaagaaatcaacccaccaagattccttaatcaattgcctgtaactctatatattttcaatgtgtaacaaaaaggtcatggattccagccacatgtgtaagccaagttgaccaccctgctgtgccagtggaaacacactgtcacagtaagactgtggtattacctacgtatcaataagaccacagacggaattttgtatctgcaatttttccatttcaagagttcatttattttaaacataattcattaccaacagctaaccctctttttttcactctattaatacaacttttttttttttttgagacggagacttgctcttgttgcccaggctggagtgcaatggtgcgatctcggctcactgcaacctctgcctcctgggttccagcaattctcgtgcctcagcctcccaagtagctgggattacagctgcccaccaccacgcctggctaattttttgtatttttagtagagacgaggtttcaccattttggccaggctggtctcaaactcttgacctcaggtgaaccacctacgttggccttctgaagtgctgggattacaggcttgagccactgtgcccagaaatacagcttatttcttaaaaatagtctggaatatgcttttttttttaattgaatgaggctctttttgatgccaggttcatgctcctgcaccagttttgtttgtttgtttgtttgtttttacaagaatgcctacaacttaccagttaccttcaaacacaattttttgtacatatctgaattttgtgcctacaaacttttagcaagactccaggctactctgactttcactgttctgaatttgtatctttgctcataacctcacaactactttggttgggtgccagtagaggcaatgccagtgcttacttttcaccaatccttgagctgtatttggtttaggaatatgagtctattaggtgaagaaggaatgtaagatatttcagatagtggggaaaagtatatttgaaggcacagatgtgtgaaagagtttaggatatatgaataactctaagtagtctaccactgatgtagcacagaaaatgtaagggactggtgatggatgagtgtgaacagataggcaacatcaaagtagaaagcctttgtaagtttcctgaaggaatttagtttttatgatattaaagaaattttgaaggatttaaaatacatgaacagtatgatcaagttgggggttttaaagatcccttttagttttgaaggtggaattgttgttcactggacaagatttggtgagaacagccaaaaaatattgcaagaatacaagctgataagatctgaattatggaagactctaaagggatgagggaaagaaatcagatttgtaagatatatgggggaaaaatgaagaatatatcatttgcaaattggactttatgaagtcagaatttaggaagacatctttctgataaatatgactggaaatgggattgaggtaaaaaagcagaattgaaataatacaggatgaatttaattttgaacatattgcattttattttcttgtaatatattgatctagttggcagttagatatgtaattccagagctcaagagaatgttctggcttggagataacttttggagttaagatgatggttggtctcatgaataatggtgtgatagttcactcagggagcacatacgtgtttcagtacatttacactattggacatttctttcttctcctgacactatttcagtgattctgtcctaaaacttactgtattctgtttggtttgacaaacaattataaattatgggcttccaaagaaggtaaaaagcatctgggattaaaagaataaaatgtcctttgagtctggctcacaagttctttaagcatattgggaaatgatgattgtaagatgacagccatgagacattcaaaaccagtaaatcctgaatatgtcagatacctgcaacctaacttcatttcctgatacttatcggattcccaggtcctgatctctgtgttttcaactacaacttgagtacttgacattgatttctaattacttctcttcatttgagatttattggatactcttaatgacagactatatcctgactccaattaaccccactacagtgactcaaaaagaaagttacagacttcttcctctcatagaaaacacacatattttgtcttgctggcatcactggaatcagtgctttaacataaaaatccacaataacagatgagtccttggtttatccatttatcagtcaattattttattaggcatatttcttattaggtgtttatatatagtgacattaattaggtgcctaacctggaatgaatattcttaacttgaatcctataaattttatattctgagctctcttagctttagttctacatagtaattgattaaaaaaacaaacaaacaaaaagcatgaatttattttaactactttgagtaatctcatattggaaaagcaaacaaaacattttttcactacttcatcagaggattaataaaagaaagaaatgctttcgccatatagttgtttgaaaaacatttcatgttatatgaagaataccttatgctacattcaaatataattatagccaaaggcactaaaatatttattttcatgtatgtcacagctttatgtctttaaaaactcaaaatttgtatttgctgtttttaacttttaaatttacattgttggcaagtatgatactccctgaccttgaagagaaacaaaacagtaccttcaaagtgaagcacacactttttgtgccctcgagcaatagcattccgtgtttactatttgtttacatcagaatttcagtgtgctccacagttctgataggtataaatatataggcacaccctaaaactatcctgtacttaaatagattttagaggatactgggttaagcagcaaagtttgttaggttttgttatcactgaatgtttaacaaattcacgtgcattgtgaatatctcagaatgattttttttttttggtacggtttctctctctgttgcccaggctagagtgcagtggagcaatctcagcccactgcaaactctgccccccaggttcaagctactctcttgcctcagcctcccgagtagctgggattacaggcacccaccaccatgcccggctaagttttgtatttttagtagagatgggggtttgccatgttggccaggctggtctcgaactcctgacctcgagtgatccacctgcctgagcctcccaaagtgctgggattacaagcgtgagccaccccgcccagcctgcagaaagattttttgaaactaaaacttggggcataatttctcagaagaatacactgtggaaaacaataagttagactctgacgattttgaagcccttacaaatatttataatggaattcacttatacgtgcaaatctatgaactacataccctaccaataattagcagaagagcagaccatttctataattagttgacacttggtacctggatttaatatctaactgaaaagaagctttcagtaaggtctgcgagttgaatggaaaaatggaagtcagaatctggttttgaatcgtgagcctgccacttagtagttgatttactttaggtaagttgccataactggagtggggataataataatgaataacttgaagtttgtttctattagagataaaaatttataaattatataacatcattcctggcacaaaattgtcagtgagtgatcgtttttaacgaccacagggtaatctaaaattaaaacataataaatggtgttcttcgttgctatttccccccggactttctaatatgttttttaacattttctccttatgggccaccattcctcttcttcaggccatgtgttggtgaacttcttctctatatcctctctcaattcatttctcttgcttggaaactcatttatctccatttacctaattcatactcattctactcatacctttttctggtggtttttcctctgggatgatttaactgactgacttgggacatttttacttttcccttctctcacatctaatgatccttttttctataaaatgttatctttatgcatttaaatgcaaacttttagtattagtttatatttttctgtacaagttctctgtcctcaactagattaaaaggtgcttgagagaagcaactctgtcttaaagcagagtattttctttaaaatgataggtattcaaaaaacttttttttattttattgattacaaaaggcagcagctgaaagttaaactcactattcattatagaaaaagaactttcagtagacagatgtggctaactactactgatcattgaggaataattctcattgcacaagatctttttcatgtctgttttacatgcatattcagtgacattgaaggagttttccagtgtctgatcaacttttgagtgggatgtgggtagaaagcaagttagtattgagttctttattctaattcatttctctatcaatgtgtttccatttgttttggagaaacaaacagaagtagaggatggcaaacactggaatctcctttctaacaccagagggcctccaaacaaaatgttcagtgaattaaaagaaatagaattctagtcattgaaaactccaccttctaatctttggatgcaaaatgtcttcatttttcgattggctccatctttctttcatacattcaaatttattcgatctttaagtagtgaaaaatacataaagagaatattgaagaaaaaaaattcaacctcatttattacaccaaaattggttttaggtagatgctttaaaacaattttaggaaatggaatgccattctaagcaggatatgaattcaaagagtggtaatcagcaataattatatctggatagtttgtcagagtttgtgggggtaaagatttttcctaacttaggccttcatgtccttgtatccccctgtctttcttgctccacacttttcttcacttaagtcctacagaactatttatactttccatcatccacatgagtcattttccctcttcaaagtatttccatctacgccacttctttaactccatagttatctgtcttgactgcatatttgaccagctaaataatttctatcccatgtgcaaaatgaaaatgagggatctcttgttgaacaagtactaagaatttcaaaaggacactagcagagcagaaaacccaaaagcagagtcctttgaaacgttgggccctgtaccacagcacaggtcacgtccccatgaatctggcccaactgcacgttataatcacataggaagttgttttttgctttgtttcatttttaaataatgatgctaaggtagtgctcagatgcattagatcagaatttctgggggtaaggcccagacctcagttttgtaattttaattgcattttaattgtaaaaaatttaagtttattttaattttaatgtgtagccaaggctgggcaccaaattcaaaggctatttccttgtcacttggcgtatacttacctatttacttttctatctctctcatgagaccattaagttccttaagagtagatatcatatctttttagccttttcatctttatgacatagaacaacacctggaacattttagatatctattaaatagattatactgaatgaatgattaaatagatactaatatgacctcatttttaattttacagggtgtaatcaagaaaaaaagaaagtaaaggcagacttattggatgataatttgaaagtgtaaagagaaaacatactcttagaaaaaatgtaataaaatatttgagaaattagatctaaatttactttttaaatgaagggtattgagagatacaatagtcccctcaattctgtgcttaaggggaaaattatcttatttacactattactcattaaactttcagagttgaggaaaagcaagaataaggaaacaagatgggagaatgtttacagaattaaggaaatatgatgtttctcaatatgtgtgtaatacagttgaataataggagagtaaatttgtggtagaagattccttctcaaagaacgacatggcttgtgaatggtactagaactggaaaataatgagccattattagcactagttttgtctgatcaaattaatagaataaatgtaattgctcataagcactagtaaagaacaatcttaagcatttgctagttttaaataatttggtccagattttaacatagcatacattttccattatatgattgtgctagatgtttacacataatgtaagagtatggcacatataaatagcccattattatgttgtgtttatagtatatcatagcaatttgaggacacatgacatgtctcatttttttctttttggtacagcgtttggcaaactaagttcagagggctagatacatgttttttgtattttctcttttatttaggtaaaacttacatgatgcaaaattcatcattttcaccaaagtatgtaattcagtggttttcagtatgttcacaatattgtgcagatatcaccactatctagttccagatcattttcataacccctaaagaaaactctgtatccattaatcatttattctgcgttcattgtttgtttgttgttgttgttgttgttgttgttgtcgttttgagacagggtcccattctctgtcaccaaagctggagagtagtggtgctatcatagctgactgcaacctccaactcctggctcaagcagtcctcccacttcagcctcccaagtagctaggactgcaagcacacaccaccaggcctggctaatatttttattttgtacagatggggtctcgctatgttgcccaagtgggtcctggcctcaaacagttctccctgcatagcatcccaaagcactgagattacaggtgttagctactgtgcccagccttgcatttgtttttacccatgaggccctggcaatagcctatctgctttctgtttctatggtttgagtactctggatatttctgggtgactagaatcatgtactgtgtggctttttgtgtctgcctgctttcacttagcataatattttcaaggttcatccatgctgtaacatgtatcaatacttcaatacttttatgattaaatgatattccattttatgcatattcatcatttagtttatctgtgaaaccactgattggcattcagtttatctccaaaatttggctattgtgaaaagttctgctatgcacattggttcacagtttttgtttaaacaccaatttttaatctttttgggtatatacctaagaatagcattgctgagttttatggtaattccatatttaactttttgaggagctgccaatattttttttatagcagctgcacaatttcactttctcactagcaaatgtatgaaggttctattttctctatatcctcaccaacttgttactttcatttttaaaattataaaacatcctggtaggtgtgaagtggtatcttactgcggtttagatttgcatttccctaatgactaatgatgttgagcatgtttctgtgtgcttgttgacatctatatgtcttctttggagaaatatctattcaagctctgtgcccatttttaaacagcattgttttttttttgttgttgttgttgtaggagttctttatatattctgaatagtagaatattatcagttatatgattcacaatattttctcccattctttagtttgtcttttcatttgtttgacaatgtcctttcatacacaaaagttttcacttatgataatgtccaatttatctatatattttttgttgattgtatttttggtgtcatatcaaaaaatccattgccaaatccaaaatcatgaagtcttacctatatattttattgtgagagttttatagttttatcttttacatttagatcatgataactttggattaattttttgtgtactatgtgaggtaagtatcaacttcattcatttacatgtagatttttagttgtcccaatgccctttgttcaagagatgattctcattattttgttgagaagttttacatctgtattcttaagggacattggtatgtagttttcttttattgtgaagtcttttctggtttagtatcagggtagtgttggcctgaaagaatggacaagaaggtgttccctcctgttttattatttggaagagtttgagaaggattggtgttgaattttctttaaatgatgatggaattcatcagtgaagttatttggttctgggattttctttggaggttctggatgactggttcaatctctttattttctctagatatattcagatttttatttctatttgaggaagttttgatagcagtgtctctgtagaaatttgtctatttcattggggtagtctaatttttgatgtgtaattatttctatgattctcttgtaaactttttatatctacaaagttggtagcaaaggccctcttttttcatctgattttttttgctattacttttttcttgattggtctagctaaagatttgttaattttgttcatcttttcaaataatcaaattttggttccattgcttctctctattttttttttctgttctctattttattatctctgaggtaatctttcttcttttcttcctacctgcaggtttagtttgatcttattcttctaggtttctatggtgtaaatttatgttacttatttgagatttttcttcctttttaatgtagatatatacagctgtaaattccctttgagggactgctttcactgtatccattgagttttaatatgttctgcttttgttttcattcatcacagagcattttctaatttcccttctaatttcctctgcaactcattggtttctctcaaggccagtttctattaatttctttgttcctgtcaatgggctgtactttcttgtttgtatttttcacttttttttggttaaaaaatgggcattttaaacagtataatattgcaactctagaaataagatattcccctcacccagggttttttgtttactggttattgtagttctttgttgtttagtgaccttgctaaattaattttgtaaagtctgtattttttgttctgggtggccactgaaatgtgtgattgttaggttagtagtaccttagtaacttgacagagatttccttaaactcctggaacaaaacaacaagaaacaaaaccaaacttcccgtctttgtagtttggttgtatattggggcactcctttactgtttagccaggcagtttacaattctgccctattcttccttcctgcttgcatggagcctgaatctagccagaggtaagggcttagggtcttgtcaggtcctttctgagcatacatcccccactggttatgtgcatggactgctagattcccttgactatacgggagcttgtcccagctcttagtgcccccaagtatttcctccctagtctttctgtctcaggctttcaggtcaatctatttcttgcccctacttttccctcttacccaccaggtggcaggtaatatatttgcctttaaatgcttacaaaaaacaccacgtgtgaagcagcttcagccttagggaagctccttatgcagatgaaccaatggcaagtccttgagcccatccctctgggagccaccacacaggttaaaatacgtaacaattttgtaagaataaggtccatatggtttcctatggtgtgtatgacctgcatcaggaatgcaggctactatcttcaagactgttgtggagctgaggagtatcaaatagtatcaacagggtaaattaatatgccacagagctctccaaccaagattctgtagtttttcccttcactaaacatttccttgtcgttgtaagtttttattcaattctagagttatttaaaaattgattctgatggtttgccagtttatcaactgcttctatggctgctttcacactataatgacagaattgaatagttatgactatatagttcataaagccaaaaatatttactatttggtctttaaaggaaaaaatttgaacctctagtctacatatctatattcagaatttacataaaaacatttgtttcatgaatgtattaatgactaaattggtggatgaatggatgaatgaatacatccaaaatatttatattttaacacgaggtattccaatatagatatctacatgcatcttgttaaacttcaaataaaaatttagaaaatcatggtaatttattgatcatctttggagttgctcttttcacttagaggttactatggaaatacaggagtggcggtagtcaattatcaataaacatgccaatcaaacacatatattactactggggatcattctcatggtgtttataagctgtcccccatcccttgatcaaatcatactgtatgtgtgctaaatctacccaagagtgttgcttattagagtaatgagttgataacatttttgtgagagaaaaatttatctttgctgaaaatcttcctttattctgcttgtatttctttgtaagcattagttatatttcttgggtgtttttcatcatttgagaagaataccttttacccataataaaagtaaacctatccatgaaaattttatctaataaaaatttttagtttagatgcctgaaatcaaataaaaataatattaaacagggttgaaaagaatgttaaaacaggtaactaaaacttgctgccttatactatctagtaaagcagactttccgaatgtttatcctctgtgcttggatgagaggactgcaagtgaagatttgggaaaattcaagtaaagcatggtctaggtagaaagggaaacaaagaaaaacccccaaaccaaaactaacccaacgaaaaagggcagagggttatcctttgttccatctccttaacattgctgtccatagtaatacctttcatccttaatctcccttttaaaagtgtgactgtcccctctgcattatcctgagcacctcttgagcccttagggggaaatatgttgaggtctgtttcattttattgttgttaaggtgtaagtctgatagttataatgaaccaactcaccttcctgaaaagcataattgttccactatttctgttgcccattcatcagccttctactttcaatcaacttaacatctgccttgatttccatactctataaaaactagattgccctcttactagttatgatttaatgccttcagtaagagggcagtaataagatatagagactgaacacactgctcagaaaatagaaggaaataaattattttcaggaaaatatgaactgctcagttttgtttcaattgccgtaatattactttaatcttagattatttttttgtaaccattatgtctttttcatttggcccatagggatgctatttaaaaaaaggagggttttttttttttttttttttttttttggtcaaccctatgttcattaaggaaaaaaaaaaggcaccattaggtaatattttctaaatgcattgatatctttaagaaactggaatttcagctgttgccacaaataaactttacaagttttttagtcataaggataaattcaagaacaagactggggttacctgaatatacctgtctatttttcaaaataaatgatttgtgggctacagcatcctgtgttctgagattcaccacaatgctctaaaacaagacacatgtccctgtttctcaaaaacgtagcctgtgagaacattctgcattccacttctgataactaatgaagcaaagtagacgtgtaaataaatacaggataatatataattggtagggatttcaaattcaccactagattgggagtttcataagggcaggaatttttctatgttgttttgatttgtttttcattgttcagtgttgtatacctagcacctggaagagtgttgggacagagtaagagttcagtgtatgcttgggtaaatacattggtttatttattcttatcattgtaatagcaggggatattttatacatatcacattaaaattaatttacattttaatgtccctatgttttaagtagcatgagtaagacactgatatctcagggttaacatatgaaaaagataattgagccctagataagagctgagagatacatgagttatatgctttaaacattattaaaagttttattatatttaaataaaacatttttataccctcaaccttaaaatgtattttactttttcagaacttcattttggattcattctgtgccaactcccagtctaatgcagataaaaatatatgagttattgggttccttaaaactggggttgatagtagaaatgctgacaaatccttattacagatgccagtggaatgaagtgcctttacctctagcaaatgctgatgtggagatttaagactatatgagaaatcagttaagttgcccaggagagttttatcatattattcaatgaacttggtatgtgatgcagtaattgcttttggtaccatttttcttctcttacgtgaggttattatttatccttgtaccgtgtgaaacagagaaagagagcttaaaggagagtcataacttgatgtaaaactatcccatgacacagtgtagctggagataggaatcaaagcaagaaaactgcatcttacttatcagaattaaatatgggaagagtaatatttgacattgtggagatccataaatactaaaaagatacactcagaccacaaatatttttttctagtgatgtgcaaacctgttgaagacatatatctaagtaggttttttaatctcagagggatcaacaaatttatttgcctatgacagaagttttcttattagctttaggtgaaggaaatcaaattaacaggtaggaggctagtaggacaagttagagtaataagatttaaatagcctaataacttttacaattatattgctgttttcacttattgcacacatatatccctcatatgcttcacagactcctaacaccaactttgattatattttatccagtgttcaagtcagtttctgtgaaaaataaataaaaagtacttaggaatataatttaatttaaaatagagacaattataatttaacaatgcaaacagaagaaaaagcatttttagatagtcatatgttgctacctaaatctgattagtttaatagatgttatttttataaattcttaaaatactttatgttaaaaaggtgtgcttttatttagaaatgagatgatttgtcaggtagaaaatgaattttgtgtattttatatttactatttattttcttccataaagttgtcttgatggcattgttcaataattaataccattttgcatacaatatagcccagtggctaatcccagttaactaaaaaaaaaaaagtcatacaacaggtgtttaattatgtaatgaactatttacaattttatattcacatggagtttggaaatggtcagtaagaattatttaatcaaggaagtatgggagggatgggtaagtggtccagcagtcagcctggctgagttgtatactggctgttgactatgggcaaaaaaaaaaaaaaaaaaaatcttaacaccctttccctcagttttttcataatagatataatattactgacctcatgtagttgttatggagaatacaattgaaataatccaagtaaagcatttagaacagggtttggcacatagtaagtgcttgggaaatgttaaacattactattgcttagtcatggggattggcaaattgtcgatctttgttccttttaagtaaaacaaaacaaaacaaaacaaactctgtatttgaaaatcataacctaaatgaaacaaaagtatgaaatcaatagagctaatttactatacctacatgctttatttttttcccattccaccaaccctgtattctcagtctttcccctactctgcaagggaatatgatattctcctcaagtccttaaccctctacacatgggttagtgacttgaggatttgttaccatcatgcccgagcctcatagtggaacttacctgtctcaatttttttccttcaagttcaggtttccctggcttccccggttgaccagaacaattcgtttctattcaattcatttcagcagtcattttattggtaagcctgctatgtgccaggggatgtttggtgcttttgaagcaaaattaagtaaccattttgccgagtaaatcgctcaagtctagttcagaaggcttacatataaatcatcacctactacttggtatgataaatgctatggtaaaagtattcaaaagttgttgcaggagcaccagaaaaagaaacacctaaatatgtctgaaaagtgaatactcagtaccagaaagctgtttcaccacagggcttcttccctttctaatataacaagggcatataaactatgatctatggaaatgtgttatctacttgaaagactagcaggccaggaagagtagtgaggcaaaagggtatgataacctcttgggtggaagggcactacatctgttacatttgcagtactttgtgtacccctggggaataaagtttatatgtgatcaaatgttacataaaaatcagacaagatcctaactgttcttttacttatgttaagctcaaatatgtagctttggatgtagttaacagattaatttctgattcccatctgattcaatttaaaaatccaacatatatggttttctcccagacgatattacgatgtagaaagcaacctaaaatagtgggaaaagtaggtattgtggaagttgaaaaacctaggttcaaacctcttattttgttgcctcttttagttgttctttacctcttcttagctatgtgacctgggaaaattatttaacctctttgaaaatttaaatgtcaaatgaaaatagtcccaataagactgcattgaaacatatgaaaaaatgcttaacatcatatggcattagggaattacaaattaaaacaacaatgagacatcaccgtataccctcaagaatggccaaaatccagaacactgacaacaccaaatgctaggaagaatgtggagcaacaaagcctctcatttcttattggtgggaatagaaaacagggctgccactttagaagacagtttggcagtttctttcaaaactaagcatactcttaccatatgatcttgcagtcatccaccttgatatttacccaaataaaccaaaaacttatgtccacacaaaaaccagcacatggatgtttatagcaactttatttataattgcccagacttggaagccaccaaaattttctccagtgggtgagtggacaaataaactgtggtatattcacactatgtaatattattcagcagaaaacagaaatgagctatcaagccatgaaaatacatggaggaaacttaaatgcttattaccaagtgaaagaaaacaatctgaaaaggccatattccaactatgtgacattctggaaaaggcgaaactctggagctactaaaaagattaacggttgccaggagttagagtggggaaaggaatgaatatgtaaaagcacagagaatatttagggcattgaaactattttgtattgatactacaatggtggatgcatgccattatacatttgtcaaaactcataaaatagacaacaccaagaatgtgcccataaggtaaactatggactgggagtggtaatgatgtgccagtgaatgttcgtctgttgtgaacatgtactgatttggtgctggatgttgatagtagggtaaactaggcctctaggaggggtagggagatatgtgaaatgtctgtaccttctgctcagttttgctgtgaacctaaaattgctagaaaaattaagtctattaattaattaattaatttgagacagtcttgttctgttgcctaggctggagtgcaatggcacaatctcggctcactgcaacctccacctcccaggttcaagagcttcttctgcctcagtgtcccaagtagctgggactacaggcacctgccaccacacccggctaagttttatatttttagtagagatggagtttcaccatgttggccaggctggtctcaaacttctgacctcatgtgattcacccacctcgacctcccaaactgttgtgattacaggtgtaagctgtgccgcccagcctaagtctatcacttaaaaaaaaagaatcatgaaaaattattgggaagctgaaataatgaaattatgttaagaagctgatttttgccaggatttttttaattaattcccctaacaactttaaatgtattgttaaatatatttagaaattagaaaattgagttatagaagtaactaatttatcaataatttatccaatcagtatttactgggcacctactatatgctaggcattgtattaggcatggaagatattataatgagttcatataaatgttatattttaggagagtgagacaaaaacccaatagtaagccaacaagtaaaacaattgaaaatgacttaagtactgtgagaaaataaataatgagatagataataacagagaagattctctttagatagaaccaaaggaaagattttatatttaacttgagccttaaaggaagcaaaagagctcaccatttgaagagcattatagacagataaaacaacaggtaaagggctttgagatggaaaatagctttgtatttttgaatctgggagaaaacaggatatctagaccttaaggaaaagaaaatagagttggagagagaaaggtaagttttaagcctttatgatgaatattttattcatttaacacatgtgtcttgagcaccaacggcttgccagtcattttcttctatgcactgagataaattaatgaacataatctctaattcctctatactcatgggtttatgtcataataggggaagaaagaattgcacatacatcaaaagataaataaacaaaacttcagatgggatgagtgctatgagcaaaacaaagcagggtagaataatggagagtaccttagaggaaagaggtaacatatatatgcggtttctttgaagtggtgaatcttgagcatagggttaaatgacgagaaaacaaccatgtgaagatcttaagatagatcttccctgtcagaaaaatcaatcaatcaatcaatcaataaaaaggcagtgcaaagagccaagacgtggagttagaaacaaatctggcaagtttgaagaccaaaatgaaggccaatgcctggaataaaatgagaaagagagggaatagaagctaagttcaaagagaataggccttgaagaccagcataaacagtttttattttattccagttttaatgaaaagccactgttgggttttaagcaaatgcacaataaaagcagatttagtttttacaagattgctacgactttctggggagaatggactgaggggggcagaaatggaaagtaaaagatgtagttacaataggaattcagataagaaataaaggctacatgagccatgattctagcaggggacagtgtaaagaaattagtagaatcagtatatattttgaggggagaatttgcaggatttacaaaggataaaacagaatttgagaatgattgcctggctttggacttaatcagttttgtgagttgtgaagcctttcaccaagatgagagcaagtggtagaacaacaggttttagggcccatggcaatgatgttgaatgttattctaaacacattgggaatctatgtgatgatttcaagtagtagtggggaggtaattcaatgtatccttcagtaagatcccttgtgtttctctgtatcaaatgagctaaaagaaagggaagcaaagatgatgactcacaaatcagtttgaatagcagagtaaacgatggtgccattttctaaaagcagagaaaactgaaaacatgtaaaagttttggggaaaacaagaattatatttgggatatgttaaatgtgagctgtaatataatgtctatgagacataaaatcatgctgacaagtgctattggatacgtgtgcctaagacttgcaagaagtgtgggcctaatatataaattttgaggtcatcaggataaagatgttattgaatttgatgtgtgtggatcagaaaaaagtaggaataaaatttaagaaaaaaggttagagctcataactaattttaggaacataaacatttaactgaggaattataataatggaccatggaatttggggccagataatgaagtgaagtcaggagaggattgagaaatagtagggaaacgtgagttcactgaattgggggtctttatgtgatcgaagagcacaggcgtgggtgtgattaaacaatgagttggatgagtgggttgttagaaatcctaactaattttctgacaaatgcaggctgcagttttgaccatgcggaagagagactagacttcaatgagggaaataatttggtaatgagtaaataaaagaattaagagatcagctgtattggatacttcatgtaggtggattttgaatataccgagaataataagaatttgaaaaaagagcaaaattaccatccagtagtcaaatatttgaaaagtaaaggcttctcttcctacttaataaaacttttgaaccagatttcattgaatgacagcaattgtagagagagagagcctggtctagcagggtggaatgagtctcagaggagcagtagttactgcacaaggcaggggaaaaaatggtgtggggacagcaatgaggggcagggaaaacaccaaatgtgcctctgtctccaagggatgtggaggtaaatgaaaatagtctgtaggaaagagagctgaaggctaagcaatgtcatcagggtacagtccagcagagcagggagataaaatggtcattctaaaaatcaggtgaagatacgaaacaacgtgcctatctctgaccaggacttctctaacacacagtggcagtgtttagaaagggtcagaataacaggaggtgaggctgcagggtgcatacaactgtatagagataaggtaagtccacagagatgggaaggaagatgaaaataatcttgattatttcttagttgagtgtgggcaagctgacacatggctgtcatgtctaaaactcctttaggatagctctcatgggatgactgttgttctccaggggttggggaagagggtgagcacattcctaggtggactggcatgggagtatcctaacttttctcactctgtaatagcttcctctaagataacaggggctttgcccataagcaaatagtgaatagcagaaccaattgttgcaccttggtttattcatagcagcacagtctgccataccatgtgcaagtgccttcgataaaatgtgctaatgcatggaatctttttgcacttagttaaacatacaaatttctcatagggcctaatttgcagagcctcacaaaaattggctcctcaccccttttttattcagatcttgttcaaccaactcactcacttactggatgtgacttctgtcacactgttgccaattatcctcttcctgaaacactccaatattatgttggtctcagggctttttaccatgctgtgtccttggcttgaaatactctgttttcagagtttcaagtgtctagactctttctcatctgttggattatacttcgtctcttaccttctctgaaaagactttcaggaaattacttaattttgtcttctcttatcttaccgagtaccttgcagttgttttcttttctattgacctattttatgtttttataccacttaggaggatctgataatatgtgttgtatttgtttaggcatttgttaactgttttcttctctttatcatgaacttcatggctcaaggatttctatttatatagaggagggctggctcacaataggtgctccataaaattatgttggatgaatgcataagcacttgataaagatcactttcttcctctctctctctctatttttttttctttttttttttttttttttgagacggagtctcactctgtcacccagacttgagtgcagtgagcaatcttggctcagtgcaagctccgcctcccgggttcacgccattctcctgcctcagcctcctgaatagctgggactacaggcgcccgccactacgcccagctaattttttttgtattttttagtagagatggggtttcaccgtgttagccaggatggtcttgatctcctgacctcgtgatctgcccgccttggcctcccaaagtgctgggattacaggtgcaagccatggtgcctggccttcttcatctatattttaaagtaaactactactttttaaactataattaaatatagtagttgtaattttcatggttgttgggacaaaatgtgattatatatataaaaagtccacactccagttctttgcacatagtaggcaattagtcagcaatttttttcattaattttatccatagatcccatggaaacagcataccagatattgattaaatgatataattcaaattgaggtattataatcatggtgaaattagatgtcggatatgatgtattatatagcatatattacatatcacatattattggttatatataataagatttatggcataagatataagatataccatatttttgttatatagtcatggtgggattacaatagttaagttttttttgtaaagcactactatttcatataaaacctgaattttcttttaatattctagacttcattaattataattagaagaaaataaagttgactgttgtcctaaattaatgagaaaatttctgtcttctaagaaaagcaataattctgatgatgagtttcatgattaactgttacctcttttcttctttttcaatgttttcaggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcatgtaagtcccttccctcatgatttattagtttgttatgttgctacaaggtttactcttttgttgatgtatatgaaataactacaaagagtagtgatatatttcaagcatgtatttccttcaataattttatttaagctagatagtatttgtcactaaatgtaaagaatctaagagggatatatagccctatatatgtaaacagattaaattttccacaggaactgagagatggaacattatctctcttgattattacatttcaaagagatacttcccaggtccttgagaaaggctttcctgggccataaagttggcaagaggcttaattagcttttaaaggagttatatacatttttaaacagagagggagaaatgacctatgagtttttaaagtaagtattctaagaaaaaggggtgaggaggggtgtttctttccttattttcagttggaagaatcaggcctttttttagaatttagtatttaattagtatttagtatttttaattagctcttgcaattgcaagtctttgttattttagaaataacatgtttgtcaccttcttattctccatccctctttcttaagaggaccttaagcatacagggtttggtatgatctttcaaattcattatgatctaaacaagatggttcttggtggtacaatatgaagatgcaacttcagatagacatcttaacttttaaaaagtataatttataaatttagaagaggagactttgtttcttacaaagggttgcagcatgcacggtggccattcagacaggttgggaagcatagtctctggttggaagccaaaagcagatactttgagggaggggcaaaaggaacaggaatttatgctaagcaagatggctgaatatatatattatattttccccaatgggatataggagaagtcatgaatatttatgaaaggagaaacttgtgcatgaacatgaacatgcctctccatggattccatgtacaaaaatggtggcattagcatggtgtgagggtggagttttcagccctatggcatcaaaaagtgaagcacaggacatgaaaatccttactaagcattctctgaagatggctatagccattcaatggtcgtggtctaacaggcaaaataaggaaaggcagcatcaaggttggttgatatcactggtgaagtctttcgaaagggctgttttctgttttcagtggtgaagtcttctgaaagggctgtcttctttagggaaaaaagtctaaaggcagttagtgagaggttggtgtataatgaggcctcctgtcatggctgagaatacagttttcaaggttactatggggttccctgggcagggaaaaggtccattcagttgttttaggggctttggatttatttttatttctcagatattaggagaaagtgaatttctgaggcattaggtattgttagtccttgaaaaaagaccttttccctgaaaacatcatcctctcttctccactttcccatactcggtagggctccataaaatagtgtgctcgtgagcacttggtaaggcaaaggtgagttcaaatcctaattcttcaactatgcagttgcatgccttgaaaacactgccttaaacactttgaaacttaactttctgaaacataagatagagataagttatatcattttaataattaggaatgatatataggaattttctaacacagcgtctgacatatagtagataatcaataaatagagatgtaactaataagcccaaacttagtgtcttcttacttgttctgtcttctactatagtatttatgagtgtttgtgttgagggctaaaacataaacatttagatggtattacaatgagaaatctgtagggactatagcactataattattaaatttgaatttaatcatagtcagtgagatcagtattaagttttagtagtgaagtttattaactggatcctttgctgtcacaaatataccagtgctttcctacctaaatgacctatatgttgtgaatggcagttttatattaagattaattaaacatagagaagcattagtagagagtcaaattcactgttcgatcaacaataggcaagataaagaaaaacaaaacaaataatatttagggtacaacaaagcagggacacccttatttttttgaaaattactcttaatattaaaacaaactcaaaatagtcattatagataaaatcaaaacatttttggaccttcttatacttagagtttgatatttcgcaaatttgaattacacatacaggggacaaagctcttgacccctaaagttttgatgaaaatcactgataatgaggctgattaattaataagagaaaatacatacaaatttatttaacttgtatatacaggacccttcagaatgaaaactcaacttcccaaagaagtacagaagcttatattactatcttgaggttacaacgagaatgggggcttggatcctggtaaaatagtttatgagaaggcaaagagaataaattttatggaggggcaataaatgattacaacggaacagaaattaagttgtaaacagtttcctttttttagaacttaaatgatgcttgaagacaatgattatcttgcaaaagggtctgttcagatgtggttagattttttgttttctttcctgtaatggataatgagattacagggagggaaacaagaacacttgttctcctaggcaggtaaattctgactttttgtagataggaaaaaaagtctctcctagtgatcatcgattcccaagaatttttaacttaaaatactcattataccaggaagccatattttggggtgaaatattttgatttccttcacatgtaagactgaaagtgaagagattcattttctttcttaaatctttgaggatcttactccagcatttctcaaatacattttattctccttatatttatatatttttaagagacggaatctttctgtgacttagactagggttcagtggcataatcatagttcattgcagccttgaagcccttggctcaagcagtccttctgcctcagccttgtgggtagacatgctaacatccctagctaattatttattattattattattattttagatatgtggtcttgctatgttgctcatgctagtctcaaacttttggactccagggatcctcctgccttagcctctggagtaactgggattatcgacatgagccactgtgcctggcttcaaatacacttgaaaaaataaattttgtggaaactcatagtttgatacattttaaaatgttaataatatatgtcctactacagaaaaaatatggaagcaaacaatctattttgtttttcctttatgtactaataatctactctttcagtcctagcagattttccattgggctgatcatcttttgagtttttatgatgattggtgattgatgacttgaaattttttggttagctataaaaagttgataacttttgaaagttatcaaactgatttgaatctaaattaggatgctattttatcatatcagtttgctgcattcataatcttctgtaggggcaggttgaaaataaatctcagatctgtcccatctttagtttttcaccgcccatgtagctcatacgtttgccattttattatgtctctattatatacttcctgcctttaatatcatctccaggaatgcatatatacattttagtcagattttcatttaatcagcaatgttatctcaaagctttctcactgaaatcattgcagagatactgaaagattacagtatataatttcaagtactcatgttggcctttaatttctttttcatagtcccctgacacctgatggtttgcacagtcctcagttctttcctcttgtcaactgtttaatgtccatccccagagttctctgctggggctgtactccaaaaagctttttgtgccattttattcttctgaaaagcctactttcttcgacacctataaaactactacctctggcacttaatcatagacattccttattacttgaaattctttgtcctttcatctttcacacagactaatcccagctggaggcaaaatttcagaatatccttaagccagtgttctgctggtgaatctctgacctactgtcataatgctgataaaatgtgtgagggaatactgagtactcacattcaacagatctacagttacttcttaactgtgcaaatttgggcaccgtgtgtctaacttttctctttctcttactctcctgtgtagctttgggaaagtttcttactctgtcttgagtgacttatatcatttatacaatgggaataatgatactcacttcattgaatgaagatgtggattggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgtggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaagaagatgtggattaaatgttaatatctgagaatagagcaggactatagccttctttaacttagttaaatacatcagtgagacagcagagtttgggtatatttggaggagacacaacagaaggaaaaacgtaatgacaggaagtaggaaaaatttaaatgcttcaggacagtgatgcagatccctctgtagatattaggcccctcatgcttcagtgtatgaaaagctcctggcactgatggataatctcatgcctataaatacaaatttttcctttttaaaacctgagccctagtcaaaaaactgctacttaacctgggttgcaactaaagaaacagcatacaaacagttctaagactgagctacttaatgggttttcaaatcagatttgagaagtaaactctaagttgggacatgaatgcattgcataggccttaatgtgctgagtggcaaataggaaatactcaagaaaagtagttattattattattactattaaaattattattatggttaatgtatccaaaaaggtgccaatgtttttgaatgttgctatattttgtctattcaaccccatgagctagtttacaggattactgttgaaccatgattatatttaaaacaaataattgactaaatgtgtgctataatgttatcagagaaaaggggcatttaaaaacagatttttaaagccacattatccattcctttaccccattagaattgtgtggactatgagaagttatctaaatagtaacatttaaagtttagctcttttataagtgccaaacatctttacaacttctttgtctttaaagagatttgtgttttaatataattaaccatttgatgtaggtaaaagagtgcatcgggcaataaatgcttactttttaaattatgttcatttttgtagcttcaattgtgaaatttgagaagtaaacaaaacttgatcatttgacaggttttcttaaaaaaccggaatgagaaagaaattctgtttcagcttagaaaacaactatagtaaaatgggaagtctgttggaatctaattcagtattttacattatttttaagaagactcacgatgccacagatttccagctgtctgaatgcttcccagcttgctgccttggcattgcaattggtatttaatattatcaagccttttatgattcataaatgagccttggaggacctcactacactttgcttttgcctcctgattgctcttttattatatgttggaaaggaaatcaaatatttgtttttcagggaacttaaaaaggctccaggtattatcacaaaaatggaaacactaaatcaaaagcagtttattctaaatgggaattgacttgcacagccatagctttaaattttgacagcacattgtttaattttgcatcctagttgaggaactctagtacttcttgtgaaaataaacaaaaaggctaggcgtcgtgactcacacctgtaatcccagcactttgggtggccaaggtgggcagatcacctgaggttaggagttcaagaccagcctggccaacatggtgaaaccccgtctctactaaaaatacaaaaaagttagctgggcgtgctggtgcactcccgtaatcccagctacttgggaggctgaggcacaagaatcacttgaacttgggaggcagaggttgcagtgagctgagatcacgccactaaactccagcctgggcaacacagtgagaccccgtctcaaaaaaaaagaaaaaaaaaaaagaaagaaatacaaataataaaaaaaaattacaaccaacaacaacaaataaaaactgttggggagtagaaacactattattattgtatttttaaaatgttggcaaaaacaactaaaatcacaagtataaatttataatttcctatgaccccaaagtgacaactattaacatatttgttaactttgcttcaagtgtctcttttaatgtaaaagttataaaatattacagataatgttgaagtgccttcctcaccataattgtcttgatttagtattttccacatcagtcataaaatataaaactacattttcctcatccctctccaggtgtaaccaaaattgttcaatagtaccatgtaacaggattatatcatttttatttagtcttctactgataaacattcaaaatgctataattgaagatgcacatcttatcttccatagcacctatgcaaaagcttttccataatatatgcttatttcacattgcatgcctgtagtaaaacatctcatgtaccccataaatatgtgaaatatatgaacaaggaattgtttatcatagttcatgtattttctttccaattttgttagcaacctcatccgaaaaacaaatttcattagatattaaaaagatttttctccaaaaaatttttactaatttacatttctaccaatagtttataagaatttctattcctctgcaaaatcattagtacttgagattagacatttagactagactattagagtacattagactatttgaatttggtcaaatagtctggggacaaatagaatcaaattgctttaattttcagatactcataactagccattctttttctccatatttataggctttttaatttccccttctttgaattccccatttacttcattccttcttattaacatatagtaatttattatattttctgaatgcctataatgcaaatattttccccagctaagactttatctcttaatttcattgtgtgtgtgtgtgtgtgaatgtgtgtgtgtgtgttttcatatagaagttttaaagttttagtttgtcacatttagtcattttttaaatggcttgtgatgtttgtgatttgttggaaaaattcttttttaactgaagctcaaaaagatattttcctattttttaatattcttaatgtttttgtttctcagatttagttctttcatccacttgtggtttgtttattaagtccatactgattggacctcaacttaagtgaaagcctgaattccttttacgccctttctgaagcagtacctccccccaacacaccaaattctgctacaacatgtatgccagtaattttctcttctttgtaaaaaagcaacttgaaaagcaagtaatttttacttttaaggagacattctgtgattataatctcagacgatagagacattaggaattatgaaaagtatataacattttttaaaagggctaatatagttatttttaaactttttttctcaacgtgaatttaaacagtgagctgttgaagatataaacaaactggtttcagtgacaaggatattttgaaatttaatccagaaacatggtctatcacagatcagtgtaattctgatttatgctatactagattatgattcattagaaattatcccaggatagagcctcaacaaccatttattgaatatatattctgagaaacacacagtaaccacagcagtaataatagttctcaaatataaatgactatattttattaaaaaaggtatgttaagtgtttaatttttctttcagtactaatataataaagaatgtcttctcatgcagttccaaaattaatattatgtttagaaatatttatatatatttttaaatttaaatttttttttgctgtgatgtattctgagaatacttaaaagaaattgtttccctaataacaatcttctgctaatttgctattaattgcaaaattatagcaaaaaccagagctaaggattattttatttggcaattgtatcatgaattattgaataaatacccccaatgtacactattaagttcctttaaatatgacttctgaacttaagctacttaaaatgtctgtaaaaaatgttttggtcataatttgaagattgagagaaagtaaaatactaaattgacattatagagacctctataaatggagacttctggacactcctatccatcctattaataattttgcccctacaaactggaagcaactaatttgttatgcagtacagagcattgaaacttttccttactgtagtcaggaaatgcttcttaaaaaaaaaaaaagcttcaatgtcttcttaaataaagaaaaacagtttggagtagaagaggcgtgaaattgggaatttcatcgctcaaacaaaatgtatgtaaaaatgaaaatagaaatataaattaagggcaagggaattctgtgaggaagcatgtccaaaatctagtattatttaaagtcagtaataaaaattttgtatgtaatttaaatagtaaatttacaatgacactattgaagcagtgggccgaaaaatttgtttatctgtggtatatggaacatctgtgtgttattaaataataaatactgatttgcatctattactaccataacagcagaataaatgtaactgaaaacagatataaaaaagtggcttttttaaaggtgatattttctttagagcatagagcaaatctaaacagaaagacaaaaaagccccacaaaactttaaaaaattaaaaaaaggaaaatcatagcatgaaatgtattaatgctatagaaatttgttcagtgtgactggattttcctttcacattaaattgcataaagtttcttttcaaagtaaatttgagtaatagaaatttcagaaaaaaattgctcaaataagatattcttcatgatattcccatgtggaaaaaaattcagtattattcattaagcatttttgtgccattcacatttttaggtactgagaaacatacaaaccctgggtgagatgaacattaaatacattttatatactttagatagtacaacaatagagatattctgaaaatattttgggaaacatgagggagtatatctaattttgtcaagggaaagggtcagggaagtctttaagcttgaattatgaaaaaaatgacagatgctttttcaaatacactatttttagtgctgcagttcatttaattgaagcacgtattctacctgagggatgttatcttatgtaacaccacacgtgaccaaaacggtgtacttggtcaggtttatttaaatattttgaaagccaattcaatttaaaatgaactgatatgattcagacaatttgcggagggagaattaacataaagaaagttttcacatcttttctcctaagaagaaaatagatctagttttctcaattaagaagaatttattgaaaatgtattggtatgctaatatgtaattacactaacattaaccactgttgttttgtgccaaaatcatgtgccttcatccatataatttcctgatcacatctaattgcattttaaggttttgtggctcttctaggaaattcagtttgcaaaagatatggccactgaactggagtttattttttacgtattttattatgatagtcatctgatcaagtcttttgtattttttaaacattatccaatttggatcattgaaaatcagaagtaatgtctgtgggaccattatagagcaaatagtctcactgtccagtgtgcacaaaacactggcttttgaggaaaaaagggctttatttgccttttttcgaataggcaagtagtcagcaaggagacaggagtggattcaaatctgtctcctcaagttagggaccccttgcttctgaaagagttttagtattcaggttccagtcatgtcccagttttaccggtatagaggggaatattgattggttttgggtgttgttagagatcaaagctttttctattgtgcatgcctaggctacatgaactgcagattttggttttattatatctgaaaggtaactcaacattttgttaccaactaagcaggcccaatttgggctagtccagtaggtacaggacttattcaactaaaaattcaattatgaatttatgtgacagtatttagtttaatattaaacagcattaaactatcctttatgtccttatattttcacttccatgaaaatgaatgattttgataccttgtaatctactaaactatctttgttcactgtagattaatttgcttttaccaacatttagatttaaaatattctcattttactttgtggctttcaatacatacatcattaaggtcctttcctagttagaatataagctgtgggagggcagtaactatatctctaggacttagcatgatgcttaatacacagtagaaaatgagtgtttgttgaatgcataaatcctgtttttccatccaggccagtttgtccaattcaatgtataaaactacttataatcaggaatatgccacaaatggattttcccaagcattatattttattgatgtacatgttttgtttcctctgtgtaggtgtcaatgtcttgtttgaggcaggaatgatttgattttcttggtatctttcatagcacttgccacaatgctttacacgtagtcaagatggtcaataaatatctaccaaataaatgggtagatataaattatccacctaccctttttttctttccacactaaaggagtgcaattaactttacattgtacgtgtgattacttgaaaccatagctataatattatcacactttccttcagaaaaaaaaattgggtaaagttggtaaacttattaacagagttttgaagtagagcaatatgtcatagctatcgaataatagataaaggcattctgaaacacataatatttaaaacatagactcataaaaagtcattttcaagtatttcttaagcagatactgtcagatatattggacgatgagataatttgagagcacgtgttctgaaaaacagggtaagacacttggacaaagaagttttatctttaaatcctgcaaaataaacatacacaaaaatcagaatttttaccaattatattggcgtacttcaaatgagatttgattacctatatacactatcaaaaatagcatttttgtcaggcaggagcagaaaggaaatatagtacatgctgtaataaaagtataatcaatataaaagtaaagattttagcatcagcatgtgaagaaaaagtcatcctgggcaacacatggtttatcttttaaacatcttaataaaatctttttggatggatcatttctagaatgtattacatgtatttactctttgaaactgcaggacagtgagaataaaccaaactctagatgaaaatttcatgtctgttttgatgctttcataatcattctatttatatatttatttttttaaaagtatttcatgaagtgtcttctttttctaacttttattttaaattcaggggttacatgtgcagatttattagatggctatgttgtgtgatgctgaagtttggagtgtgcatgatcccataaccccgatagtgagcatcacacacagtaggtagtttttcaacatttgccccctttgccccaactctagtaatccccagtgtctattgtactcatctttatttccatgtgtacccaatgtttagctcccattataagtgagaacatctaatatttggttttcttttttggccattagttcgcttaggataatggcctccatctacacacttgttgccacaaaaggcatgattttgtccttttttatggctacgtagagttccatagtgtaaatgtaccacattttctttatccaatccattgttgatgagcacctgggttgattccttgtctttgctattgtgaatagttctgtgatgaacatacaggtgaatgtatctctttggtagaacaatttattttcctttgggtgtaaatccaaaggatttggtgagtcaaatgatagttcaactcagttctttgagaaatctctaaaatgctcttcacagcagctggactaactgacattcccaccaacagtttataagtgttcctttttcttcacagccttgccaatatcagttattttttgttgttgttgactttttaacaatggccactctgactgatgtgagatggtatctcaatgtggttttcataataattgtatacttcacattgcaatcacccaggaatataaaattcgtgtctatccaatttcttattcatggtttgacctagaaatgtggccaacattaacccagtaaccatttactgtattagtccattctcacagtgctataaagaactgtttgagactgggtgatttatgaagaaaagaagtttaatcgactcacagttccacatggctggggaggcatcaggagacttacaatcctagtggaggggaagcaaacatgtccttcttcacatggcagcagcagggaaaaatgctgagtaaagcagggaaaagtcccttataaaaccatcagatcatgagaactcactcactatcatgagaatagcatgagggtaaccacccccatgattgaattacctaccatctggtcccactcaccgaacatgggcattataggaaccacaattcaagattagatttgggtggggacacagccaaaccatattaccatcagttttattctttcacctctttgtaggttcaaatgagcactcatcaataattcccccttcccatcccctctgaatagcatgtactcacctcacattgtatctcatctttttcatcttattccctattatcatttacttactccataattcctcacataaattatgtttgttttctacacaaatattaaatagattaagtaattttatgtctgttttcaatgagaatttaaatcctttgaaagtcagaattttaaattataggttgataataagctgatttatgagccgagctttatgaactgagaaaaacattgaacatatttaaagcagggttcactccttagcagagctgcaaatgacagtgataccatagtgaagatttcttgattctggttctgaatcttagttatataggtccccaatgcttattatgcatttatttaggaagtattgaggtagttaaacacaagtgatttttaaactggacattaattttttttaaattatacattaagttctagggtacatgtgcacaacgtgcaggtttgttatacatgtatacatgtgccacgttggtgtgctgcacccattaactcctcatttacattaggtatatctcctaatgctatccctcccccctccccccaccccacaataagccccagtgtgtgatgttccccttcctgtgtccaagtgttctcattgttcaattcccacctatgagtgagaacatgtggtgtttggttttttgtccttgtaatagtttgctgagaatgatggtttccagcttcatccatgtccctacaaaggacatgaactcatccttttttatggctgcatagtattccatggtgtatatgtgccacaatttcttaatccagtctatcattgatggacatttgagttggttccaagtctttgctattgtgaatagtgccacaataaacatacatgtgcatgtttctttatagcagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgttcctatttctccacatcctctccagcacctgttgtttcctgactttttaatgatcaccattctaactggtgtgagatggtatctcattatggttttgatttgcatttctctgatggccagtgatgatgagcatcttttcatgtgtcttttggctgcataaatgtcttctttggagaagtgtctgttcatatcctttgcccacttgttgatggggttgtttgtttttttcttgtcaatttgtttgagttcattgtagattctggatattagccctttgtcagatgagtagattgcaaaaattttctcccattctgaaggttgcctgttcactctgatagtagtttcttttgctgtgcagaagctctttagtttaattagatcccatttgtcaattttggcttctgttgccattgcttttggtgttttagacatgaagtccttgcctatgcctatgtcctgaatggtattgcctaggttttcttctagagtttttatggttttaggtctaacatttaagtctttaatccatcgtgaattaatttttgtataaggtgtaaggaagggatccagtttcagctttctacatatggctagccagttttcccagcaccatttattaaatagggaatcctttccccatttcttgtttttgtcaggtttgtcaaagatcaaatggttgttgatgtgtggtattatttgtgcgggctgcgttctgttccattggtctatatctctgttttggtaccagtaccatgctgttttggttactgtagccttgtaatatagtttgaagtcaggtagcatgatgcctccagctttgttcttttggcttaggattgtcttggcaatgcaggctcttttttggtgccatatgaattttaaagtagttttttccagttctgtgaagaaagtcattggtagcttgatggggatggcattgaatctataaattaccttgggcagtatggccattttcaccgatattgattcttcctatccatgagcatgggagtgttcttccatttgtttgtctcctcttttatttcgttgggaagtggtttgtagttctccttgaagaggtccttcacgttccttgtaagttggattcctcagtattttattctcttagaagcaattgtgaatgggagttcactcatgatttggctctctgtttgtctgttattggtgtataagaatgcttgtgatttttgcacattgattttgtatcctgagactttgctgaagttgcttaacagcttaaggaaattttgggctgagatgatggggttttctagatatacaatcatgtcactgcaaacagggacaatttgatttccttttttcctaattgaatacctttatttctttctcctgcctgattgccctggccagaacttccaacactatgttgaataggagtggtgagagagggcatccctgccttgtgtaaactggacattaatttttaatctgagtgtaacaaggatgagtgtttcccattcctcttaatccttgttgataggtgcaattagaagccaatttacaaatcggtggacaagaaaccaaggacaaaacctcaataagagatctcttgtcctttatcttgggggtatttctttttaagtactatcgctagtcatttagaatcggagcatcctttcttagagataataatctacacatactattttttctttcattttgcttggtagaccatcatatatctgctcagccaaaacagaaatgtctcaaagatgttacagtgcaattgagtaggctattttttttttacagaaataactacttttcctaacttaagaaagtagtaacacagtaattatttatttctgatgaaaatttcatttctgttttctaaatttgctttcttcttgtttttctctttacttcttttacattgaatgagttttcttttgactcattgttttttcccctccattaattggaagttataagctttatttctctttattctttaggggtttttatggaaattttaaccagcaaagttaacaagatattgataaccaatattttacccttcttccaaacaatacaaggaccttaggaagcttagactgatcaaccattctgctgacatctgctattatattagttctaatctgattctttcgtgtttagattgaacatattttacacacttgtttgctttacttgccatttattatttatttcttcttatagacagtcttctgtggagtcctgttttcttctagaattacatatatattgtgtgtttatgtgtttgtgtgtgtgtgtgtgtgtgtgtaaagatctctcatcttgggatcaacattacaaataaaaacttaatttgagttcacataaaatcagaagcctgtatttaggaagtcaaaatttaagaagaaaacatgtttaggtgagcctgttaattatgtaaatagtaaaattagtttgaaacacgaaattgtcatttttgtaggctaaaatgaagtgttacacatttcatataacctaacctgtacatttttcctccttataatgtctttaaaatgtttgcagaagcttttcttaccttaggacctaaatatacaacattaaagattaatctaaaaaagaatctggatccttttttataaataataattgtgatagattcctttctggtatttcacaagttttcttaagaacccagatctaattagaaatgaaaacaagtctaaatgattaaaatatggtttccttagaaaacaaaaacaaacacacacacacacacacacacacacacacacacaaaacctcatccctgcagcaccattcagggcccacttattctgaaagtgccagaggcctgtcaccattgttggaagcttagcaaagttcaaagagagcttatcaatgcacagtgagatttaatgtgcactactcattatcctggtgagaccctttgttaaaatagtcaatttctatgctgtttgtaaggttgtgcagttgtaattcctggatgactgccagaaatagccttagtaacaaaacacccagcatccttctgttctcaaatcaatcagtcattgtgtaaagaactttttgatttataatgaatcttgtggccagtatttttaggttatttcactacactaagtcaacagtatgttacttctaggtatgttattataaatggactcattcccctacatctctatacataagcttcttatgttatggtttgtcataacaggtgaagttgaatttgttaattaaaagagtatgtaatatgcatacaaataataatactagcattctgatatgcttttgtattccctctatacaaattatgggccacttaagaaacaaatgagcttcatagttttcctaaagtaattggtgcaatgttacaactaaacacagacgaacacacacacacatatatatatgtttatgtttatgtttttatacttcacatatatatgtagagtatatatgcatatagatgtttatgaatacatacagttggccagttggccctctttatccttgggttccagattcaatcaactagggatcgaaaataccagggctagggaaggatagttgtgtctgtactgaacatgcagactattttttgcttttcattccctaagcaatgcagtataacaactatttacatagcatttacattgacttaattattataagcaatctagagatgatttaaagtatacaggaggatgtgcataggttatatgcaaatactatatacttcatataaaggatttgagcaccgatgaattttggtattcgacaggggccctgaaacccatttcccctggatatcaacagatgactatacaaatatgacatttatgtgtgtatatgtacgttaaaaatagttttaaaagaataaaaacatctgagtacaaaataagtatttgaatagactaagattcagtattttgtcaaggacaacaactcatgtttaaatgtcaatattaactttgataacttagcaaggaactgatacatctatgtttgctttttttgttgagctctatttttcaattcattgttccttaatacattttcattctatgtggagagataaacagtccatcaaatgtattttgttttttaaaaggctttgtaactgtaacctgtagaatgacttgggaatcagccaagttttcaaatctccctccactctttatttgaagtgtgatcttagacaacttggttatgttctctgagcctcacttctctcacttaaaaaagggcattgatgaaagcacacacttcatagtaatgattaaatgacctaaaatgtatgaagtgcttagaatcgtgccaggtatattatattatattatattatattatattatattatattatattatattatattaatgtactgaataaatgttagctgtcatttgtatttttttcttgatggaaataatagcaaaatttctgatataaatgaaaacataaactcaggcatctcacttcctcaaccatttacccaatttcccatggaaattatcaatagagtaaacaaataagtaaaagtttgcattctcaatggaatctagggatggagccttcaaagtgtcaagtttttttttctatttagtctagtgcatataaaattagagtgaaggaagaatagaaggttggtaactgatccccttcataaaatatcagtgtgtctgagaattacatgggaggccatgagaaattgccatttgtattcccagtagtgttttgttttaaacattaaaagattctgtgttaatctaaacacaatatacctcacaaatttattactattagatattttaaacaattttgagactctctggtctgtttaactctctctgtatttttatttccagaacacattgagctctgttgactttctgacttatcacgctttctcttacaagtcattcgttatcgtctctgaattctcagtgtcctccattatgagtaatctcccttcattcctaatctttcttcattatttgctatcttgtttcacttctcttctattcaaactgctcattccgtagctctgccagtgctggctgctctgtctctcacactccacttattttaagagtctggttcagattcttttgactacctggatcaagcagtatgtactgattattttactgttataaactcaaaaatcttagtagtttatacctacagagattgtttctcattaacactgcttataaagcataggtcagctgaaggctctgttccatattttctcactcaaggactcaggctgatggagccactaccacgtggtgtgcttttacttctgggaagcgaaatgagagaacatggtgaactgcagaccgtctctcaaaagtttctttgcagaagtgaaagtacacaacttctgcttacattccttgatcaaggtaaaccatattactgtgctcaacttaaaggtaagaaaagagtacaatattccatgtacacaaagaaagacaaagtggaatgtagttaaatagccctaatgcttaacctatttcccattgctgttttaattcatggtttctctagaacccagaaaaaaatacatgcttctttgaggctcatttctctggatataccattcctttcattcttatgttatcacctactcactttctgatcacaattacatatgcaccatttattttgggaatggactcatagcctttcactttaagagagccaatttcatagttttatttgaattcagtgtccttacggaagactcatccattaccctggactctatgcttcttgggttcttgaacctctcagccacctagtcctaaagtcacatcatagtcatgatcataacctaaaggacagcgacaattatatcaataatctgaaaattcaaatcatttctgcttgcttgttaatttggttgatctcactacatttttttttttttaccccatccaacccctgagttgggcaactggaagaagctgtattagcatgaaaataagtagccccagaactccagaaactgtgtgcctttatgggctgatactcctatttcggggtaggtaaacttggaccacagaagttcactttcaaatggaaagtgaggtctcacgatttcaagcagtgaaactcaaaaactcagccagacaggcatcagtgacgttttgactttacaagaaattggaggaaattttgtccaccaacccatagcctaaaaataaaactgctgactcaatagggccctagattcatatggcttattttaaataaccgacaagttgaaacatcatgttgtcccttggactactgtggctatctagtgtcagagccaactacacaaaaactaaactgaatgtgatcattctggttagtgggcagaactcaaggctattcttatgtctagctatgatccttgagttgtttccagtgacctgaatatttggtttgctcatcagactagcagattaaatatacccttctttggggtaaccaaatatagaaaaacattgtggctgctaattggacagtttgggtcactaatgagttcagaatctgtgtttatttactgctatattgctctttctcactcataagttatctcaaatattccataaatcttctcctaaccactccactgatctcttgcttatataatttattgtgttcttatagtttctctgggtatttcttgcttcaaagagttgtgtataagctctgggagggatcatgtttaaatatcttgacattcttactctgccaagtctatcagtggatactgattaatagattctgtcatattatttcacagtcgagaaaatagaaatttactgtattttactatgagatatatttatatgaactcttttaactagtgaagggatgataattaccttctgaaattagggatatttaacatttttataattttgtcttagttccaagtcttatttttatatctaaacagaagagtaatttgattgattattacttcattttattcctggaaaaactgcatgaacatatgagaataataagaattggtagcattcaaacatagtagctaacaacatcccacaacatattactttatatttgatatcagagattccatctgaattgtttcaattaaaatatatttataaaaagagagcttagttttccttgtcctcaaaatatgcaacatattgtcttcatttcagcaactaaaaataaagcaaaacaatcactaaactatttactcatttcatgtcttagtagtttattttcagaaaagagttgtatttgtactgaagtcactctacaaacttaggccaaataaaactttttatatatgcatctcaatcttcaaagtcttaaatttaataaccataaaaaattttgtggacttactttattgtttatagttgtgttttatttgattaatgtttttcaagtacttgtttgataaatatataataacattacattttaagtaatagccttgttttggttttatgtatgtttaaatataataattatagaatgtaacaccatattttatatataggtaattatctttggcagaataacttttttcacttaaattgtgatttcaaaagatgctaattacttcagaatcaagaaatcagtaatagctaaatcagaaacagaaaatattagaaacattgtttagtgcagcactatgctcatgaacaataaaaatgacagacatagtaatatctattataataatagaaataatacatatttggagtattgatatgcaagatctcagattatttttaaataaaagtttagtcttttaggaattatcactgtgaagaaaacaggaaatttctgcgtactgatatttttctagggaacaaaagtaacttgtctagtgcattaaatataaattccagctagcctgtgcaacattatcagaacacatctctaaaaaaaaaaaaaatagaaaaattggccagatgtggtggtgcatggctgtagtctgacctacccaagaggttgaggtgggaggatcccttgagcccaggattttaaggctgcaatgagctatgattgagccactgcaccctaccctgggtgacagagcaagaccctgtccctaaaaaataaataaataagtaaataaatttgtcttagtccattttcacgctgttgataaagacatacctgagactgggtaattcataaagaaaaagtagtttaatgaattcagttccatgtggctggggaggcctcacagtcatgggggaaggcaaaaggcatgtctcacatggtggcagacaagagagaatgagagccaagtgaaaggggaaaccccttataaaatcttcagatctcatgagacttattcattactatgagaacagtatgggggaaaccactcccatgattcaattatcttccactgggtccctcccacaacacctgtatattaagggagctacaattaaaaagagatttgggtggggacacagccaaaccatatcaacatttattccatggaaatattataataattctagtatagagaaatattaatatttatgaagcatacaattgagagtgcacaacaaaatcagatttgggtggggaataaaacaaaactaaactaaaacaattaatatcctcccccaaaactctagaaacattttagacccatagttattctgaagacatcagttaagtttatttttcattgtcattaatggcaagtttgataagtttactcaatattatttgaaattattagcaggcttatttcaccattagcaagaaggaggtgctgaagcagcagctaaatctattactttttttttttaaatgatttcctattcatgccctacaagtgtgagggaaatctctgaattttataactcaattgcccactttactttctttctgttgggcactgtgtggtaactacttggtttggtgaaaatgaactaaattaatatttctaaaacataagtttatgtttttgtaaactgcaaatacatattagattttgtatagtatgggaaatatacaatttaaacaagtttaatttttttatattttaaacttacgtagctttaatctcatcagttttttcttaaacaatacctagtgagtgctgacataaccatatgcggtaacttgtttatggtaataactaaaacagttaatcacagagatatttatgaaacattttagcagttattgactattatttatcatagcaaaaattaaaaatcatgcacataaaaaatctcattttttaaaattattttttatccttttatatgatcccagtattaaccatataatccagcatttctcattcatgctgccagagatggagacctcaacagaaacagtgggctgaagttgttggagagatgggagggttgaagtacaaggacgtttttattaaatatccctacctttactactatgcggtctttacaacaaaaatgacccaacagctaatctaaaagaagtatttgggtgaaaaaaaatcaatgaaaatacaaacctcaagagtattctctttggcaaataataataataataataataataataataatataataaagggggtcctgagggtagaattaccatgtgcaatagtgatagttttattcattcaaaaaatagttgtttagtgactactttgtgccagtcactgtactagacactggagttacagaattgggcaaaacagtgaaactccttactcaaaaggaacttacattctaatagaaaaagactgacaagtgacaatgtctgtttatggcacatttcatgaagaaaattaaagtactgtatggagataaagagtgatagaatgagtgttcaggaaagacccctttgagtaattgtcaggcaaatgtgataaccactatgctctggaaaccccattgcgaaagtgacatcaaagcaagcacatgaatgaaatgaaagaataagccatttgtgtgtataaagggacgagctttccagggagagggaatagcaagcgtaaggcctggaaaaaggaatgtgtacactcacttgaggattagcaaggcagacagagttgttgaaacaacagtgagaaagaccagaagaatgatggaactaatgttgataaagccatatcttgcaatgctttgtaggcaaacatgttctataagtcattggaggatactgagcagaaagtggtaatctggtatgtgttttagaaagaaccttctggagttaggatagaaaagagattctagttgggcaagaatgaaaataggggaccagttggagtccattgtaagagttcaggcaatgtgactaggttggtagtggcagagatggtgtgccatgtgtacagaagttgagttgtgttttctttcaagtgtacacagagacaaattatttgttcacattatgcattgtggagagtttaggaatgcgtggtattacttacatgtgacattatattgaatatggataattaactagcttaagtgtcttagttagaataaatattaccaatttattcgtatgaacttactactttaattattttacccattttattaagcatttaacaacatcatggaaaagaaaacaacgtttagaactgattttccagcgttaaactgcaagaacctttagaagtatgcataagatgtttcactgatgagatcatgtattataaaaataagatcattatgttctttgatttctgaaacttcataaagaagaaagcttcacaacatattcaaatttggagtcattgtgccattcatgaagatatgctttgttatctaatttttggtttaagtttccagaaattagaccaataatttttaccattgctttataagatataatcagtagattgctattagttatgtaactctgtaaaaagaattaatctgttctatctagatggttagttcaattgaaattatattattgtacaaataaattttatttctagagtaagactagaaaaaagtttcaattaaaaattctctgagtggttttctttgaaaattttagtaagttaaattgaaactgtattcagcaaacatttactaagcagttccttggtgtcaaattttatcctatgccttagggatgttaggttcattatgatcacaaagatgaataagacaatttggaagagtttcacatagaatggtggaatattaaattagtgcttattaagttaataagatagctgctgtgtaggtgtctttgttagatttccagggagggaaactttaccattccctcagtttagagttacatgctttgatcgaagggtatgcctgccggctttcaagtgtttttactctcacaggaactgagacaatacagttacaataatatgtgcattcaaatttctcatatcttattggttgacttatatgtgaaataaccagaaataacacaacataaattattgctacatgttaaattacatgattctgtttataaattatatacaaattcactgaagagaaattaatgtggatagagtattcaggaggaaaagaaccagagatgtgtcttatagaattcgaatactagagaaaaaagaatatcattttgggcagggaaataacaaagccagtaaaacaacagaaatggatatgatatatttgaatggttgtacagaaaaatagtgggaaatgagcattgttaagtcatctttggagccatactttccttaagatctcaggtttcgggttagctattctggttttgtttttcatttgtaaaaaggaaatcacactacaaattttgtagggttgtagtgagtatcaatagaggtgaaaatcttccaaataatatagcacatttttccctcataatagacacattaatgctagctattactatgatattcatttttctttccccttccaccttcccagtccagggctgcaaacacagcaaagttgttttaacacaatatatctactaactgaggatatggtaaaaacaacatattgttatttaaaaatatataatttattttttagtgaaatttgaggtttacagatgaattgtgcagaaagtagactttcctggaccccctccctttccatttccatacacattttcccctattattaacaacttccattagtgtagtacatttgttacagttgatgatttattattgatacatttatgattaaagtccatagtttacattagagttctctctttgtgttgtacaattttaatgagttttgataaatgcataatgtgtatccaccattatagcatcctacacaatggtttcaccaccctaaaatccttctgtgctccacatattcagcactatctcaattcttttgaatccttggcaaccactgatcttttactgtctctataattttgccttttcctggatgtcatataattggaatcataaagtacatggccttttcagaggctctgaacttgaccctctaaattctctggtgtctttcacttagcaatatgcatacaagtttcccccatgctttttcatggcttgaaagctcatttatttttataaatgaataatactattccattgtatggatgtaatacagtctgtttgtatattaaacttttaatgaaatgtctgaatgtgtctatctgtatccttttttttaagtggctaatatctttcataattaaaagtattatagtattacataatttctatttttctctttcatatttggaatagaatttttattttaagcaatgctaaataaattttaaaatttaatatatgactattcaatcctattaatatattcctatattacaacttttttggaataatgtagctgtgttcttttaatatgtgttatttgaatttttttctaacttttttgctgtatatgaattagaaatattttaccatttttcaagaatgcaatatattattacctataataatcattttatacaatagatctcttgaacctatttctcctatccaactgaagttttatttcctttgaccagcatcttgacaacctttcccgctacccctataatcagcccatcccctagtaaccaccattcttctttctacctttttttttttttttttttttttggagacagagtctccctctgttgcctggctggagtgcagtgttgcgatctcggctcactgcaacctccacctcctgggttcaagtgattcccctgcttcagcctcccgagtagctgggactacaggcgtgtgccaccacacctgggtatttttttttttgtattttagtagagatggagtttcaccatgttggccaggatggtctcgatctcctgacctcatgatcagctcacctcagcctcccaaagtgttgggattacaggtgtgagccagcgtgcctggcctcttctctctacttctatgaaattaattttttaatattctatataagaagagagtggatgtagtattttcaccataaaaatgataactatgtgaggtaatgcatatgttaattagctagactagtcatttcacaatgtatatgtacttcaaaacatcctgttgtgtacgataaatacataaaattttatctgtcaattaaaaaataaaaagttaccactttatagcatattcgcttatatggtttgtatgtgacaaaattttgcttttcatgtgcctaagagaaaggaggttacagaatgaagtaacacatacataaattgtgctgtgtagtcaaccctccaaacacagacaaactactactttatgttcattttttacctgaagtctatatttcttaaaataccactgcattagtccattctcacactgctataaagaactacctgagactgggtaatttatgaagaaaagaggttcaattgacttacagttctgtaagctgtataggaagcatggctatggaagcctcaggaaacttacaatcctggcggaaggagaggggaagcaagcaccctcctcacgtggcagagcatgggagagggggaagggggaagggagaagtgctacacacttttaaacaaccaggtctcctgagaactctatcaggagacagcagtagaagactggtgctaaaccatcagaaaccacctccatgatgcaatcacctcccgccaagcccgaccttcaacacgtgcagattaaaattcaatgtgagatttgggtgaagacatagagccaaaccatatcaactactttatttctgttaacaaagttgttcactttttcaaacaatttttagtttctcccttacgtcttagaggaagtgctgtttccttcctgcagaaaatactccctctgtctgcactctacacctgaacctctagattctgaaagactgtaatctatcaatcactagagttgtttctatatatttccctttccatctgtacaaattattgaatgaatgaatgaatgactcttctatgattccattgttggtttttgagatgcatgtcatggttacactctaggtatagattcccacaccttgactttatatcctggttccaatgattaattaactctatgaaaatgaacaagttttctaacttcgcaaggtttcattttccttatctgaaacaggaaataatagtaggattatgtaagttttatggggaatgtgacaattcctgtgaagttcttaacatagtgctgttgtacagcagctacctaaagaatattagcaattattgttttaaattgatattttatttgatttatgaatatgaaatgtgatgatgctctcccccagaatttttaaaacctttttcttcctagtttttagagaaatatctttctccgtagcccctctcaaagatactctttccaagcatttcaatgttctttctctgcacaccaccaacacacaaatgcacaaaaacacacacagagaataatattgtcaacaaacttttctaagtttcttcgttaagtcctttgacattgcctgagacaagaaaacatggagggataatttcatttttttatgtctttctctaactcttgacggtgaacattttgttctttactctttgaaagtttttacatttattaataataaaatgaatgtagcaatatagcttctcatcacagatgctttcattattttaaaatattgtaattatttcttacaatatattagagcttaagttcatctttgacagatgattataacctggtgagtgaaaagcattactaattcaacatatttaagctactgtggaaaattagcaactttgtgaaaatggaaaaactcatttcctaatgcgatttaggcaaggctgcaaggattttcattaaataatataaaacaaattagagggatagaaacaaaattcagaggtagtaaacagaatcacactgagagatgtttcaaacaatattttaactatttaaagactaaaatcttttaactgtattctatattttaaaatcagaaatgtctgttaattctcagctatataatttgatgtagttattattactattataatttgaccaatgtattaagaaaataattaatattaaatagatttttaaagtttaaaataaaagcaattttgaaaagtctagtagcataattcatgtactgagtgtacaatagtttcttcagttttttaattctatgaagtttttttttctatatctacttccaataaatgctgatttgctaatctagaagaacatagaaatgattagtgcaataaatcagattctttacttcagagtaaggaatgctttaaattttaacataatcgttactgaggcaattaagtgtaaagcctttgttttatttaatttgattactgattttttcttgtgactgaaaatcaattttttctctctttctttctttcttttttttttttttttgtttgtttctgtctacagaaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtaacatgctcacttttgtgatttttttggcaattgttacctcctttatctaactaataattgtcaaaagtcacaatcaattttactttttctgttctttattttccatggggtgctgagaaataatgaaattttaagaatcacattcatttattaaaatgtactgtcctgtctttgtgggcagagagcatgctggttgtgtcagtaagctataagtgttatagggattactgttttcttaaccagaatataaaagctttttaaatcaatatgataaatgaatcattgcctcacttcgaagatttctgaagaaccaaaactaaaataacatgttttactaacttgagttaataattcagttataagaaaaaccaaagtactaaaatttaaaaggaggccttttttaaggaaccaagacatttataataaacattctaactataaaaggactaccttagtattctacataatatttgtggtttttttcttgttttttcacagaataaatgtcattaccaaaagtactttattgtcattgacatgtagggtatgtttcaagtcataggatcagaagataaaatgccaagctggcaaggtggctgatgcctataatccaaacactttgggagcccaagataggaggattgccttgaggtcaggggtttgagaccagcctggtcaacatagggagactctatctctataaataataaaaattaagaaaaaatgcctaaatgaaaaatatataaattttatattttaatagtggcctttaaaatctgtgatacagatcaatctatgttgatggtattactttattttactctcggaggtgtaaatttataatcatgtttatttatgcctacctcactatcaaactttcaactgatagattgtgtcaatatgatttaatttaacttttgctttaattaagaagattagtattgtgcctcaggactgatgactctattgacatggagttaagccacatattcattatattctttgaatttttacgtttttttaaatatcaaaaagataactctgaattaaaaatcaattagaattctacacataatttttcatggagataaaaatacctataaagtgtacatatatatatatatatgttttgtgctgtataaacaaaattaaatatgcagtgccttttcaattacattacatggattcttttgataaatttatcagtaagggtatttgtaaataatcgaactcatttttcaataaggaattaaactttttttttttccaatgaagtaatgtattttttttctagccataaaaatctttagttcattcagttaaaaattgatttaaatcaattagaagtagcataatattggccgggtgtggttgctcacgcctgtaatcccagcactttgggaggccaaggcgggcggatcacaaagtcaggagattgagaccatcctggccaaaatggtgaaaccccgtctttactaaaaatacaaaaattaactgggcgtggtggtgtgcacctgtagtcccagatacttgggaggctgaggcaggagaatcgcttgaacctgggaggtggaggttgcagtaagccgagatcgtgccactgcactccagcctgggagatatagcaggactccatctcaaaaaaaaaaaaaaaaaaaaaggtggattatatttttatatatttgcacacagataattttttacatatttatatgtaattattttacaaatgcattatttttacctaattagttagatattaagaattgtgttcttcagataattattatttgcatttgcctaaaactatgtattggaagcatattgccatatagcatttgaagctgtacagtagagcttattaaaattttatgtgacttttggggttctccccacagtaatgagaatttgaagtatgaagttcctaacattttagctccagctttttctaccttctgtgaaaataaaacagccttcacattttttatcatctttagaccaactgcatcttttttatagtgacagacacagccactctagtttatgtgttcagagaaataagtgcaagagtttcagattaagcaattcagtgcctagaaaactcttcagccagcccacaggtcaaacagaaaaataaatactccaaaatatacaaaaagtcttccttaatgtttgcatgtacccttgtttttttttaaattaacaaatttcccaggaggatagaaataaagcctagacgaaagtgtcatgagacaacttcgaggtaactgtgtgggcattagtcaagctgaattaggtctaacagtacttttctggaggtcttagacacagagttttgggttacttcaaatttgtattaggaaatttagttattcctaattttccaagcccacggcttttgaagttagattcaaagcaaatactgaaacatctggtttcctttctagcttaaaaaagtacatttgcaaatagaggcatatggatggatatgcacttatctaacttttcaaaatatttctgtaactcacttgataaaccatcatagacagcatctgtataattatggtaatctgtactgattttacgtgaaagaaattcaagtatgtcatcctatttgagaacataaagtcagctaatgtaccagttttttttttactgctactgcttttatattttgaaatgttactgttatattttgtcatagtttttaagtgaacagataggaaaatgatactatttcagcttcttattccacaatttcaaaacaaattgcctcataaaaaaataagtttaaatcatcatttatgggtgaattaatagatattgcattaagtaataatggtagacaaactgtattaagcaatatataatattagagattcttggtaaagtaataacacaaggataaatattttctggattttctcagaatattttgttcaattttcaatcttaaaataatcttgtttaaaatatttctgaatttgaaaaaataaaactgaaaaatcagattaaaagcaaagtctgaatatggtcaatttaaattttaaattctgaacatccaaaaatcaaatgaatttgtttaattaaaatatactctgacatagtattgaacttttactataaaagaagtttgtgacatgcaaaggcaaataaaatgttcaagtttaaactgtataatttaattgcctttgtaatttaaatggaatcactatctgttagaatttaaaatgcatttattttaatgcttcctttagcatttttattttacctatcgaaaaaattatgtcttatgtcatatagaggtcactgatatactcattgacataattgttgatatcataattaatatggtattttaagtatattctttgtctccataacaattatagataaaagaaagatcatgtttcaaaaaattcttaagtatgtattttattttcattgaaggtcacagaaacaaaggcataaaataactaccactttaataacagatttcgtatttattaattattggaatctacataatattaactgttagggaattatgtaatacttaggaataaaaacgctgtatctcaaaactaaattataatgagtgatttaaatattgtcaaaatttctcaacattattaattttacttttgttttggtcattatctgatgtcatttctgttattattattacaattaacctgctatatcttcttagctaccaaaccacacctttgattggttttgtttcctcttttgtttaattattctatcaactgctcactcaattagtcaaatatttgttgagcctctagtaagcactaattagatcccataaaatattaaacatttatttctcatttattcatttatttattcaacaatatctattggctacccgtaagtactaagagttgtgccaaatgcttgaatcccagaatgaacccaactgaatatgttattttcactaataactcacaatcagtgcatatatctggcaatatatatctattacccttgaataaatttataataatacttaaatcatcttaaattctgtaagaatgccatgtattttaaatacgcttttctgaaaaatatcttgtaatatatattttgctggagagaaacatacaactagaaaggaaatatgaggaagattgttatgttgtcattagactactagattagaagcttattgaatatctgctctactatcatattaataatattaattttattacaaattaagatctaataataattgttagaatttatgtttttaaaattggatttaaaagtagattattttgtcaatgccttttaaaaatttcccctcacatgttaagaaaaaatatctaagaatacttaataaatgttttaaatatatttaaccaatactgagaaggagatgtatggtgttggtttttgtctccatatagttttatattttatgatctcctgtaagcagttatattattatttatagcataatgacataatcagcatgcttatctgaattagctctgaatgttaattaagagtaaggattagcctgggatagtgctttctagacatagaatgaccttatcccaaaattctaatggtagctctttgctgacagagaattaggaagaaatcttgtccgggatgggttcatgcttactcagattttcccctaaatgttttctcctcctttttctttctcttttctttcacctaggcatatgattatagagatggcagttagtcatataaaaagtctggttagggcacccaccccttacattaataataaaatatatttttcaccttgcttcaaatatttattttattaaactaaagctactattgatataatagaaaatgtttataaaatgactccattaaaattcccatatatgttaggttttttttcctcttaaccatatatatctccaagaaaattgagctgttctgaaattcattattggtctagggttcttagcagtttgatgtacagagatgaataactgaagaccaaacctaaaagaaaggaataatggtacacacatatccctccaacaggattgatgtaaccttaataattattcactaagtctttaatagtgcatatcttattttgaaattggcatttacaaatacaaataaactttggagaataaattactataccaaattttgcaatatgagtactattacataaaaatgcattaggctatttaaatgaacaaatgattagggtcaaatagaggagaaagtgtaaaggaaggcaaacagtattaagtaacctggacttcttagctagaagagtaaatcaaagaatattcaatgtgttacatgcataacatttttctaagttaaaagaatataggaattttttgtgcatttctgtatataattgcctttaattatttttagagtattagaatattatctatcatattagtgggttaggcagcagggcatggactccccagaatctactcaatggtttattatttacagtgaccaccaacactgtcttaactttatattttggcttaactgtttgatggttgaactgactttagaaaaccatatccaaagtgcttacattaacagctttgatctcagctatggactagcgtgcaatagctttcatatttttgtcacagtgatgggtgacatttaatgtacggtgaaggacaacattgaattattatgcacttaaaaatagataactgttttggtgggatgttcagtgttaaactaatccgctgtcaaaacgactgttgtcacattaaaatgaaatgccaattttgttgtttgtctttgccaccaacttgccagctttttaccaaaaaaaacgatttcaattttaactttccataacataactttagatatattttatttttaatgtcctattttttacttaaataaattgcagaaaagcctatttattattattcttcacacttagcaattttcctaaaatttactgaaaatttagttttaaatacgtgctgttctgctaatatgcctgtcacatattaaagtgattgctaaaattgattaaatattgacaaatatttatctaaattatggacctaaaagtaaacattgatgaaaattagatatattttcaaactgtggattaaaatatttccatagtagatgaggctacttctgcactaaataatatttttaaaattattattttttgttacaatgtacctctttattttagtggttccagtgatgtttatggttgcaagtatatgtggagtcaccaacccagaaaaaattcttagtttgtatctttagtagaaccaaaccaattgaaactaagttgaatcaatgacttcttttcagttgtgataaatatggtattgaggtaattgaggcaacagagctcttgactgaaagtatccatgtaggacaaagaagataatttaatcttcagaggagaaatcaaacatattttccacctctcaatttttaaattatgccagacatttacaggtgtaaaagatttgagaaaaaattgagtaagacaaaggcaatttaaaattaatgtgctttttctgtaattttctgtaatcaaatgctagttggcattttttaaggataaacatgcttatttattttttagaagtatctacatcaatctacaaattatttttttcacataaatataatttattgttaggccaaaattaagtataaacgcaagagcagaaatttgatagcccatctttatttttcaaattctatggataaattattggcctctgtatccttctttgcctccatcaccagaattgagtggaaagactcctggaagcaaaaagacttcctctttctagtcattttaagtgtttccactggaaaaatatcttggccaatgaacttctgagaactatggtcatctgtgatgatttgtttccatttagaagtttcataatgtctagctcagtaaatcacaaaattaattataataagttacagtttatggggtgatatgaagaaactcagagtgctaaaacttgaagtacaacgcttattaaattcttatatttgctaccaaaaaatggcacctctgttcttaatcaattctttatggaacatgtcattgtatttaacacacacacacacacacacacacacacacacacagacacatacacatgcacacacatctgataagagcagcacacgtataaaaaatttttttaaagatttggacaatggagtgtagtgggttctttggcagttactaatgtgtcttttatacatttctcactagctaattcaagctgagaagctaataggacaagaataatactggtttatcttccactttattctttttttctttttcctttcttccttttttttggaccagaataaatatttttttgaggtgtcttttaagaaccaacaggataaggaaaaacaatcattttttaccaagtgatacactttttcttttatgttttgttgtttctagatagcaacattttttcatagcggcagaatactgtgaattgcttgtaagaatacacctctccaggctggtctgtctgtggtaattctcaaaacaaaatttcacttctgttttccatagccactggaaaaatggtgcccttggtctttttggaagctttctcagtcaacctaagaaaggtcttctcaatctgaaacaactattccagcaaaatcagtggctttaaaaaatttcaatttttttaaatgaaatattttaatccacaatgtctagtaaagacaggcgacatcttttatatgaacatatacctttaaaaagtgaagtctgtgcaggaagccagtgacataaagataatgaagaaataaagaattgtttactaggtatttttctttcattctgtatgtcttaatgattaggagtactgtgctcataaaaaggcaattgtcttgagaaatgtagaaaaataggtcagtattttttttctttaatgccaaacatgacacttaaattagttacaattttacttggataaagctgtccttttgctgtaaattatttggggtaagagtcctttcaaatggatggttgtctatgcagtcttgtaccagagtggtgggtcaggtgagggacaattgagagaaaaaagaagaaaactaatacgtattgcatgtcaacagtagccagattatatttgagaactataaagagattcatttattacctttttttaaaattagtaactgtgtgtttttatgatatgatttaaggaataaatacatatatagcagcccccagcccctcaccctcaccacaaatgagattagagatgttttctttttgttgaatgctgttattgtaacactttttaattttaacttattatgaagaagaatgtgacactaaagaaaaaataaatttagaagaaaatggaaaacatattcagaaaagcatttgtatcacttgatttgttttgcctatcatgttaactttaccttctagtttttcttcccaaaatttagaaacttggcagttttttttatttaaagtatgctctattaaatatttttactacatgttagtagtatacggttttacagtaacagataattccttgaaaaaaaaatccttagttagctgtacttaagaagtatgtctttttctttagattgcaaataagaaagcttgaaaactttccaatcaactgggcacctagacaggagacattagcaaccaaatgtgtagatttgctttataaagctagtctctggaaatgctaacactttttccctgaaaattattagctacgtgttataaagctagtctctggaaatgctaacactttttccctgaaaattattagctacgtgtattaaaagaataaaacaacattgtgagtttttctgaagactcaagtggtattagtattgttttttcataattcatggatatgagagaaatatcaatgttaaataataatgtacagacaaaattttagtgataaatcacatctttctttatactaagtaaaattatgcactctatccaaataattaatgagtaggagatatagtgtcatcaaccagtgtaacttcattcattagagcatctcacaacaccttaattgctataattttttacattccattacataattacatcattcaagttaaactgttttcatatcaatcctgttgggtatacatatatagaaagagagaggtttctttttgttgtttttgttttttttttttttaagaaaaaatatcgtggctgtcctaaatagtaatgggaatttcaatatctttggatagaaatatcttggttgatctatttcgtatataaatataattagtaaaacaaatgaccatgcaaactattctattaacttttaatatgtatagtttttctagttagctcttgtgtaataaagctgactatgaaaatataaagttatctctctaagaaacttgttgattttatactcatttttgaaattttgtttggaagcccagaaattcacgtttcattcctaatgacagtaaaccatattaatgaagttattatatgtatttgcatttcaagcctatagttattttttctattttatttaatgagcattgattgaaacagactttcagttttaataccttctaacttatataaaggatgatttttctctttccccgcctggatataacatagtttcctgctattctttataagagatgttaaatcctaaattaattacttttaacatttcgctttctcatgggcttctgactacacctgagatgataaaatgagatgaacgcatttgcagtaaattttcctattaaatggataaacttaatatttgaagcaaaggtgaaattgtaggttttgaatgttactggcatgataaagttataaacagaatagggctacaactgtcatctaagttggttcagaatatgcacctgaatattattttaacataataaaattaggtaagtgtttccctgcttcccttactattcttggtaatggggggtgctgggaggtgtatttcagtataagttcagcaattcactagactgaagatatgttttggaaactggtaataatctagtgattttacaaaataagaaacattaaaaatagagaaaattttgcttgtaaatggacatacaaaaataagattcatacttagagaaatgtgtatttattttaaaatgttgatattactacttcaattttcaattagagcttcaatatttaggaagatattaaaaataatgttttaaatcatccacctaagaatttaaacatatttattttggagccaggcgctgtggctcacgcttgtaatcccagcactttgggaggccgaggtgggcagatcacctgaggtcaggagttcaagaccagcctgaccaacatagagaaaccccgtctccactaaaaatataaaattagccgggcgtggtggcacatgcctgtaatcccagctactagggaggctgaggcaggagaatcgcttgaacctgggaggcagaggtagcggtgagccgagatcgtgagccgagatcgcgccattgcactccagcctgggcaacaacaacaactacaaaatatatatttattttgatattttagttgaaaacaaaagtaatacatgatttccaaacatatttcagttgttttaggtagtaaactgtgtatagaatgcatatatataattttaaaatattttattgatttgtttgatacaatagagtgtctattttcaaaagacatttccaatttatttagtggggatgtagaaaacccacaagtcattcagctttgtgaaagatgttataaaaattatttttataggtaaaatttcctgcaaaaaagaaaactttacgtgccttatatcttgatggtagctgtggctatttttgtgtcatccagataattgcatattagttaattcaatttaaatggccagatgattttatcctttccaatgctagcttcaagtccttgttgataacatcatttacttactgagtgtccttgtttttttttttcttaaaaaaagcatagttttattttttattattagaaatctcttgaccttctgacttatctgaggacagtctgcctgaagtctgttaattctggatttactgctattaaaatccttagcaagtttttactgcaagctaaacatttgcttttgacctgtgattaattcaaatgtaaatcactctcatagttcttttaaaataactactttttaagtttggtattttatttgcaaataaatagctatattggtaagaaataattttttacaagacaaacctatgtttttttatgtaatattatatgtgagccattttccttactattctcaatttaaagccactcttaatttgattggacaattgggtgttttagaaaaaaaatgtatattgatagccagtgaatggaactacatgatagccattgtatattaaaaaatagaatccagttttgaatgtctaattatagtttttattttactttgacatttgtaaaattgcctgaattcatggcaaacaatattatgacttttcttcagaaatcttattataaaatgatcaatagatgattataataatttgtaatcccataacaatctcataaaataataatctcataacaataaggaataatcttggctacattaaataaactaaaatacagtataccattataactttaagtaataagaataagtcataaggatctgtaatcagcttattgatgaagttaatttcctataacaaatataaattttaagtggaagttagaagtcataaattctaaagttgattattttattgtttttagttatccatttaagactaaatcatatttatttttcattaagattatgtattttaaaaaattgaccacgatttaaatttgttatcactaacatattacaaatcagtagaactgatcattgttatcatttcactaagcctttcaaattcatttggatctactaaataatacatttaatagcatattattacaatgttaggtacaaaaatccttctacttcaccatgtacatctggtaactttctggtactaacactaccaattaaataatgtcgagcaattcatgaatcatctataaaattggcttaaaaatttaatataaatgatatttattgttcagtgatgtgatgatagtttaataattggctatggcagtgaaaagggctttcctttgtagcatttgccaattttcatagtttaaatattcccacaataacaaatatcaaactaccaatgggagggtcaccgaatacagatttgggaaaagagatgcaaaattagttattgcaagccagaatgagcaggccctaggataccactaatatgtaatatgttcaagagaagggaaaaacagtaagctgtaaaagttaatagcaggtagttcgggtggaatgtattgacatacaaatatacacaatgtatgaagaaggatatgtggaagataatgacaaggttgtagagccttgaaagcaaaagtaaaaagttaagttgttattaagataattacaacctcggaaacaattctaaacttaaagtaaatgtcagtttatcctcttgctcatttaaataagtttatacctaaacaattagcataacatttttgagttaactgtatatgaacatatctatggacaagagaaattataccaggaagactttagctatatgatgttttcagggaatgagtcattgtgaatattaatgttttcttaattattgagttttcaatactaaattacaaaaatttaactatttacatggaaatttttttaactacaacatattctttcctgcttataatttttaaccaaaagttcttaaaggaataaaactctttaagataatttagttgcaatattataaacatcaattatttttacctgaaatttcagtaatagcttcagggcctgtattagaagaaataggttccctcgcaggtaataggaaacttcaccatgttgtttgaattaataggggatgattgtgttcatagtctcaaattagacaaaattgaaacagcagctgaaaggtgttatcaaggaaactaacacctctatctacctgctacatcattcttagagacttttatcctcatagttacaagatatccattgaaaggccaggcattttatctgtatcccaggctgggaagaagggagaaaagagaaagagcaacctgcaaaagtcttcacctttttattcagaaaggagatgcttcctctctgtatatcttattaactagaattattttgcttagatcgccctagctgcaagagaggctgcagaaatggctttcttttatctgagcttactgccacttcagttcttttgttagaaaagtgatattattgggtatgttattggcagtggctgcccatagggatttattgaattgtgaagtaatgattcatcactcatgcaattctctcaaaatttttatttcaagtgctcatttctgaaattttctttttccttcattgtcatcagttatcagaatgcctgtctctaagcagtataactgctcccttcttgtttgttattttaaaccacattttctttaaaacaagttaatgaaacgtaaacaacgtatgaatagtaagtgcaagtatttcatgtcttagatttctgttatactttctttctggttctggtttatattgttgaaattcaaatttgccgaactagttttgtgtaagaaacatgaatcattactctaatattttaagtgatgctaccaaaatgtaaatttttaatgttgtagaaaataactctgatttattttgatgtgggatattcaaatacatcaatgtttttcccaacttctctatagccatgaagaagttggagcaaaaaaaaaaataatagttggtaaattgatacccttcataatgcccatataatataaatgcatcatagcatattttaggagagcttttacaaatcatcagatactaagctgtttctaggggaaaatatctctatgatcaaataaggtcaggagaactatgtagtagagttttcttttaggaattcactattaacaaattaaaggctctgaaaattcttgcaataaagaaatctgattaggtttgttgaactagcattgccccaacacttagccatggggccttttttttttctctgttaatctattatctctaattttatgttctctattagttaactttctgaatcaaagatgtgaagcattgctttaacatataagttcacttcaatttttttatcttcatcgtacacattctaaattgattaaatcacttgtaacaagactaagaatctagtctcctgattcctaatggaattatcagtgctcattttgctgatgtacatggaagcataagatcgtgtcacatctatttaagtgatagtttatgacttcatagaacttgtgtatagataacaatttgaagtttttaaaaaaattactgaaacaacatcattgcttcaatttttaatgtcttcttttaagaaagtacatacaataaatgtgtaaatttacatttagttataaaattaaagacatttaattttttaaaaaaatggctggtcttaggacaacctgttattatttattagtgaacttggtcagaaattcaagttttgttattaatcaaaaagataatcattggatacttaagaattttctaaatgcataaaaatttatgaaatcattagaaagttgggaaaaatcctcacaacctagcaaacaaattcccctttttaatactgtcaaatcataatttggaagcaagcatatgattaatgtaaagtccaattttgttagtattattaccttctgtggtaaaggagaaagtatgttagaaaacagttgataatttattttgtgtttattgcaagaatgaaattagttatctattctttataaatgatcagtactcaaggtggattaattatgtagattttaatttcatccacagttgtgaaactatacattttttacgattataatctttttgttggagtcttattagtctagcttatgacaaacaatgtacaagcagaactgaaagaaggtcattgtattttaaatctcatttacatgttagacaagaaatgacaattattaatgttctacttttggaatacaagtatatagtacaaaaagctaaaagagaagtagtgaattcagttcatatgtgagtctagagtgtctaaaacttgactgtagtgatattaaaatggtctgtttagagacaactagcaatttttatcttcatgtctctagtttgctcatcttgtgtaggttggacaggtagcaattttgaatggctcatcttaaaatgaatgcaattatcaaaggattatatggtccatcctgcaaggcattcactcattttaatctttcatttgcagctttctgactccttttatacaatttcatttatagttaatgggaagtgttatagcttagttttagcttactccaaataaaatatgtcgttagacaaaagcttcataaatagcagttattctttctcaaatttgaccaagtgttgtttgtttcttaaagttagtaaagttatattatttatttagtttgtgatcataacacacaaaacagcatgtatccaaaacattaaactgattatcataatttatagctagattgagattatataaattcatattccatcctaaacattaatgcacttgtttttttatttagtgatcttttcaccacctaaaatttattactactacatctatcaatcatctacctacctatttctattcatccatgcatcaatttatcaataagtattagcatataaatcagtgtgcaaaatttattttttaatgtctcgctcattcataatttctaatatgtatatatttggaataacctgccagtcactatacctactctttcagaaataaaaaatggaatttttatttattgtttgattaaatggaatagtactacatggggaaatgatgactttatgaataaatattctggataataaaagtagtttttactagagcaactaaagaaaatatgctgtagtttaatacagcaactaaaaatagtttgattttcttaactcaaatattaaagtgcgtttagatattttattgtataataaatcatatacaaaatattgtttcaaaaattccactcattgagagaaattaatgattaatgttctacttcttttggaatacatgtaccatagtacaaaaagctagaaaataactagtgaattccgctcctatgtgagcctagaatattgaaagcttgactgtagtgatattaaaattgcctgtctagagacaattagcaatttctcttttcatttttgacccagggaatttgaaggacttttgtgtgaaagaatttcctgcagattattaaactttcttgaatcataactataaaacaagatctgtgtgtgtgtgtgtgtgtttgtgtgtgtttaaaccttgggataaagactgtaaactccagagacttaaaaccatttactcccaaatttttgagtatgctctcactaagaagtgtggagaaatgcaaacgtaatgcatgttctgtctaagtggagggatttaaaatttattattgggaaaggacaaatgtacatgggaaggcaccagatgctattcaattagtccacctgaagatagcactgtaaaaggcataaaaagcaggctcaagaagtagttaataagaatggatggcatttcagtgttgagaattgcctgcagaggatgtaatcctaatggtatatttgtctataatgtatctaaaaacaatacaccggagtacaacaagtagcaattttatttgtagtttctgcctctattaaccacctgttgtctacctgagatttgatttacttgacctcataaatactggtccgcactagagtgtggtagcacagcaaagaacaacaaattgttgattgctatttttcctcatatgttattttacaaacttatcacttgttgcacagttgtgaactttgtacaaaggcaagaagcattttgaataacatggtaaaatgactacaatcataaagattttgctaacagtttctcagagatttgcagtataaagctaatgaaactgctgaatgtaattctgaaaatcttctggatatgatattttgaaagcagaggtataaagaagtgtatcaactgtacaacatgttaaggaatatatattagatatataacatttaaataagacattgggacataggtattttattttctaatacaaagtcttaagttcttgaaaaacttttaaatagaccaaattaggttagtggaataacaagaatagtttataaacatcatctgaatgctttaagacatttagggaaacttaattgtgtgattaaaaacgataaaagtgcatacagcatttcaaataaacctatggagttctaggcccctgtctgatttaaaagaaaaaaaaaagctgagcatatcattattggaacctcatgcttgaatgaagaagctgaaacttaaagaaataagatgacctaacaagaatccatatttaatcatagaactggagccagattggtgaccgcctgcagtgcaccacagtacgaaagcaacatttagccacccagtgacagaactttactttcacaactgtaagtaaagttcaaagtttaagtcttgagcatgcaggactttaatactcgtagctaacattgggttttgcggtttttaagaggaatctgtttcttcataatatttaatgttactttaggtattaggttattcttttttatctttttttctttcttcttttagaagatcttaaaatggtttcaatccataaaatatgactacgacataaactttagagttctatcagctatgtagtgtgtagcaatatgctacattttagtttttcacttatttcctcatttatcctttaagacattaagtagacactaatctttgtgcattcactcactgtttttcagggtctttggaattttcttcctcctctccccttttatcttcctcctccttcttcattttctgtaagaatgaagagcacatttctgaatttcccctttctttctcttcctactgtttcagtagttactgataggagcttttcagcatgatttggccactgttttttcagtcctacatcattctgtccgagctgtcatttagtaaagattaaatttagaagaaaattttatttattatattgtatttggttgttttaaaatataaataaaaatttgaagctggactagatttaataagaaattgttgagtcattttattatgtgcagctagtaagttggtgcaaaaataattacggttttgccaaaagtacattaaaattaatggcaaaaaccacaattatttttttaggcaaaattatttttaggcaaaaaaaaaattaggcaaaaaccaccagcctaatatttttacatactagtatttatggaactttttccttattatccttcatgcagcttagataatatatgaatgtttatatctaagctaacttgaaggaggaaagatttttgttgtagtcaatttacctattccttgattattatctttttagtacattacagataaatatatttacctataatgctatatttatataaaaattttaggacctataagttaatgttaccataaaaaagatccagggaagagaaagagagtaaatagatattagaacttacaagaaatagtaaataattatatagaataatgtaggctaatttattaaacttgctgtctttcaattaataaatttgcaaagtgtaatatgcttaacaaatgagtgcatacattcaagtaaaaatatttctatgaaaagacagataagataggaaggataaaaatggagatataatgttcatagaaagcacattcagacaaactaaggcaaatgaaatatcaatcatattgagaacatcataaaattcttttggaatgaaaaggtgtttttatgcccctcccttgttttatacataagataactgaggcactgagtggttgaaagacatactagagatcacacagtcaaaggtacaagaggactggaaatagggctctcaactagtatagaaattaaaggattctcttcaaaaaaataattttaaacagtgtttgaaattattagtaaaacccaacttcaaagtaaaaaacacaaaggttattctgtaacttttattaaggtactaccagctgttacacagggataaaatattattaataaaaataattgacctcataatcagtataaaagagattttgatggtaaatatttggacagattttactgaagtacaccaaataagaaaaaaatatataaacaggattattgttataatgtcctataaatctctataaataggaacaggaaggaataatttaaatgcctgcaatgagggtttcagagtgagtaaaaaatttttggatgctgaaggaagatagggttttttttttttttttttttttttttttttttaaagatcatttgggatttagggaaaaaagtgtctactgctataagaagttggaacagttctatttgtttagtgaagtagatagtcaagcttgagatgaaaaaatattttgagaaattaaataactgatagctcaaagaaatgagtagtcacagatggacttcttggccttctttcgtgagcacatttcctgttttattggctttggataagtaaagctcttcaaatgaataaaaaatgaagaagaaaaaagcatccttgtgaaatgcataaaatatgttcattgcctttttgaaaaaaataataatgtgtgtatgtgtgtaagtgtgtgtctgtatatctgtgtacatatacacacatacagatatatatgcattgtataatacagaacacaatgaatagatatatatagattaattctcattaaccagaattcataaacaattctcaaaggcattaagaaataatgcaatttttaacatctacatgtagagaataaaaaattttaattatgtaaaataatataatgcagcactatcagaaataaaaatctgataaaatcagaaatgttatgagttttgagaacagataaactgatagaagtgttgtaatgtataaaatctcttatttagtaattgttttaaaaataatgtattattaaaactcttagtatatgtagttatagaatttgagtattaaacagaatcacttaaattattttaaatatctttataaagaatcagaaacatttaataaatattggcagtggtatatgtttctacattaaaaatagaatgtctgcttataatcaaatgcataaacatgctgtatatgctaaacagtttagtcagtttttgcactaaaaactattatctgccagttaaaatattataattaaacagtcatttttatgactatctagcaatatggcccacgtgactgggggattttgtttggtttttttaaatcttgattttaaatttgcgtcaattgttactaatttactattattatactctctaatgtttgctttggccataagtaataacataagaaaaaatatattcttccattcttaaagtgaaaggagatagaagccaaatagttaaatatgaatgtcatcagttcaaatcaagtgttagcaatgtgtaattttgtgaggtttttcattggtaaatacatagtacatatttataaggaaagaacatagatctaatcatattgtatatttgagcatgttgtacatgtgaatcatatgactttcaggtgtattctctgttttttattttatacaaataaaataatagatctgccttttaaataatagatcttaccatttatcttgaaattgaaacaaagaagatcattagagagctacagaatgccatagaaattacaggaaaagaattaggtgactataactaaagggggtcacagtaaaataataccaacatacaccacacacacacacacacacacacacacactacacaagcattggctaataatttttcaagtatctttatctaagataaataatttttcaagtatctatctaagataatttttgttttacccttcagtggatttacttcacatatatgtatagtggccccttaaagagaggcagccaaacaaacactgcatttgtgttattgctttcttatttctaccatataaatgtaagggctgttttgtcttctgttggggatacagtaaacaagggagaaatgagctggtaaggagaggataaactacatctggaaaagtcagagctagtttgagatgggtaagcatgtaaagagaggaagaaagaaggaataatgaatgccaatcaggaagttggggctatagccaagaattttaactgtagcctccccagcaatatgaggtgcctgtcacaattacaaaaccgtttgcctcattacatgaatcagtcaaatgatcagaccaaattggtattacatttcatcaatagattcttgatttttactgaatcaagaatattattatttatagttttataaaattcaggaaaatatgtatccactcttgtaaatgtatttgggtagctttattgtatctgctactggttcagaatgttttattttgggagatgctgacttaaagattatcctagacagcctttaaacttaaaggtaatcattatttgtaacactttgatttatttttaatcaactattttaacattgccgttcctttacctcatattgaatcttaacttactggaagcccctattctcaaaaatttgcctttaatactattcaaataatggtcccatccaaagttctcacaaaacattgtttgttttctacgtaaaacaacattcaaagagtaaaaataacttgagaacatttagtctaatatgatcatttttcagggaggaaaagtgaggtgaagtgactcatcttattacacaataatacacacacataatttaagtatgtaagttgaaaatcatgagctttaattgcattattataataaaggttttacaaaatcctgtcctgcttaagtaattacccttgtaatgtctacccttgtgagtgaatagataataagtaaggatttattttcaaaaagataataaatttgtgggttatcaattctagaaagaagctttagtgattaccaggggcaacacacacacacacacacacacacacacacacacacacacacagaccgagagagagaaatcagcactatagacaagactatataatctgttgtatcaagacaactatcaattatatttttttttgggtatacggctaacttgcacagacatcctaaaacattatttaaaaaaatggttggcaaatagaacaagtaatcagaggaagagtagaacctttaaaaaactcgttttcaaggcagcaaaaaactctaacagactctcttaagaagtgttttagctcccactacttagcattaataagtgtgaaagggattcccagtctcaggcctacatccctgtcagctcttagtatttacgtgcagctccttaattcatgctcaaagattatgttatcaacaatgattaccagtggtgggaaagccgggcttgaaaaggctgaataatggctaagactcgcttctcttcgtgcacatttaaaagcagtgctttcattgatagccaaaatcctgctaacaggggtgggtattattgtgcctactcctcagtttcatgaagagatctgttgtttcttagaatttccacgccacctcatctagtttcatgttgtttttccttgtgtcattaaaaaataccttgttcccactttttctgagtgctgtttccactgaggctggccatccagcagtggcctgaggttcttaatatttctctttattttttaaaggaaatgcatcttatgaggtagtgtttacaaaccagtcatattttagatcccaccactcattctgttgaagaaacttgcacttaagatgagagtaatacaaagctcatttaaaaattctttatctttataggttaataatcattctgatattttgtttatttttcagaaaaatatgttactcgataaaacatagaaatagtatgattctggatatattttatttttgaatttaaagcagtaagattgattccatcagtagtttaaatacaaaataaatctgctcaagaagtagatcacaaaaaagacaggtagactgggtaaacaaggaattcatacaaatactctttgtccaaagtgtccaaaatttacttgctatcaatattactacattgctctcgcttaataaaatacacacggaagaacagatacattttagtgattgttttattaactctataatacctctattatgcccaaggaactcctgtgtgcaatttattgaaaagcattagtatgataattattcatggaaaaagcagctctgctctgaatcttctacatccactggcatctacattctacataacactgaacaaagtgctaaagaatttcatttttctgtgtatatggacccaatgaaacaatagtatttttgagcacttattctattttcagtattgttctaatgctgtaagagatgtaaaattaaaatgacatacttcattcatttaatctattagtaagtgaattaaggctttaacatatgaaaatgatatcaaatgggcaataatgaagtgagcattttaggtggaggaggctaaaataaatatggagtagcatatttacctttcaaggagtgtatcatccaaaaagtaaattatgctttaaaatataagtagaatattaatgagctgtaataaaggaacatttttcctgggagaaagaacattaacaaagtaaggagatcttaatatgaatgctatgtaagatgttatatgagtgtcatgtatgagatatttttgatctatttagataaaccataagactcttgttagagcatagtagaaaaaatgatatgactcagctttctaaagccttgaatattgggcagaagaggttagagtttatagaaaagaaatattggtttcttgcagattcttgatcaatgaataaaaagtattaaagtttgagaagatttacttaatagtcataaatagaaaagacaaaagagatataggtgagagaatcaaaagatagggagatgtgttggtttggaggtaattagagcccaccaaaaattgtagtaataaggggagtgtgaaataaaaatggaaaggcaaattcaggaattattttgaaaaaaatagacaataaactttggtgatatactagatgtggatatttaagaaaaagatagatgattttaagaattctaatctggattgtgggacaatgcttggattacctgccacattggttgaatatagacaggttgtcagtttggtatggagagcatgatcaatttgatattggtcatgctgagtatgaagtatagcattacccccagttacatctatctgtggtcagatgtaatatggaatgggttgagcactggtgagataccagtgaattcagctatatagatattctagctaatccaaaatcggcaaggggctattccaagaaaagagcaaataggctagctgtatattagtatggatgataatgactatattaagaatctgtcgacattatagtccttgcaatgtgggagttactttggtttggagtgtgagtcgtattactgatcctgacgatgtgttgcccccccaccacacccaagtgttactctttctaattggaaaccttttggcatagtgctaactagctaatatgctgcattcacttttatttactcttatcaaatgggattatgagtgtatgatatcaggtttcttgagctttcagttatattcaattgaaccaaatatatttacattcagttgtgtttattttatttaaaaccatcttcctaaattgtaaactgatatattatttcttagcttacataaaagtgttttctaaatgttttattactttcattcctttcttaaccatagtttaacttcatccaacttcaaaacatcaccatatcattttacattatgaagccttttacatctaagtatggaaaacgcaatatagccttaactaacatcctgctcattaatgatttggaaggtaactgaaattaattatagctaggaaaatcttttccttagaaactaactctaaaagtacttaaatatgtacaattaaagaaaaaatgatacgggctgtgtgactcaaaactaatgcacacacaattactttttaagtaatatgggtaatttattgaacaataaaaatattttgggatatatgttatttataactaacaacagaagatttataatagcaactgataacagaataacaaccattcttatttaaagaaattgccatgcaggttacataaactacgtatttggaatgatgactaaaaattttcaggctaagaagattgtttattattcattaagaaagtaaaaaattaaaaaaacaagcaaacaaataataaaacctaaaagtgaagtggtacttgctgaatataagaagatcacacagtttcacaggataatttggtatgtttgcagagcatgccactgaaaagaaacctttattttatttactatggaataaaacagtattttaggaaattatctctatttcttagacttgtaataacattataaaagataactgcacagactaaacttcagggtggcaaggatatttttacagaagattcttgtagtgaatccttgagtttcatatggatattataaaagaatgtaatggcagtgtgtttgatatggtgccttccccaaagttacatgacattatgtttgataattgtttatcgtagacacatacaatgttttaagcttacttcttaatattttattttctgaaatcaatgtcaattaaaaattaatggttttgaaaaataagcaatctatcccggaaggtattttttccccctctcttcaaatatgtttagttaaattcctttaatttgatttatttcatttgagagatactgtgatctttcagaaaaattgctggggctcttgcttttagtatttcttcatggatttaaagagataactttttctaacagtgtaaaaaatagcaatattctattccatgtgaaaaataattcaaattcaggtggcaatgttaaaatatagtacaaacataatactgtaaagtttaggcttcaggtaaatttgaatgttccttaaggatttcatatctatgcatatattatttaattttaacatttgaaatatttatattattaggcttgatatggcagtaaataaaaaataacatttattccataatatttttaatagaaattagttaatacacttattaactaaagcatgatcttttcttgagcatttgtgacgttttttgtattctgataatatcacagactttgtgaccaagtcttaattattgaatgctctcagtgtgcatgatttggttctacatagtgaaggatataaatatgttaaaaagtgatgaagcaggaagtcttctattctgagtgaaaattaaggaattactcattgattggaaagtaggaaaaactagaaatagtattcctctataattaggaataaattagatcataggaattcccttttcttgttttatgggaaatgataaagattgaaatgctgactggaatggattgcaataagagagtaggaacattttcacaggcgatctccattacagacctgactcaaaccttctgtgcacttcagagatacctgatttatacaaaactgaatttttatactaatgtaatagttttcttaagtcatttgttacagttcagaatgaaacaatatagctaagtttgtttcataattggcaagtgtgacacaaacatcaggtgatgttattattcattatatgtaacattttcaatagtttattatttaaatttgccatctctgtaatgcctcaccttattctttcatggcttgttttaaacaattttagtcgcaggcaagtctgctttacaaaggcttgagatgttcccattttatgcctgatcccactacagatgtcatgaaaatggcataatttcagcagattgtacttaacagatatgtggtaaggttgtctattatctgataagcctgtagagacctcatttcctttcttcctgacatttaatctaattttctgccaagtatgatagtagttataactggccctcctcaggccatttatgggttaaactaatagtaatttcataccctagaagtagagttaccctagcaactctcagtccatctagatccaatttctaaaaatactctctcatttctggctattttctttcgtactggagacacaactatgaagtccatttccacattctgcttctcaagaaaatgccaaacacaccagtggatccatgctcacttgtgttggcaccaaactggcctgatcacctatgttgaaaaagcacatggctcatttaaataatgctgaaaagttgagcatagctgaagtgtaggatgattttaaaaaaatccagagttgagcctgaaaacatggcttatagtcattctgtgaaagtttttaacgtatatgggtttttagtgtagcaattacctgttttccatttctctcctaaataaccaaattagcattaccttgtcacttgcctttttttttttaagtttggatgatgtaacttctcttattaagaaggactactgtattttcttttgagaattttatatttttattcaacaaaatgtaccactccttagcaaatagtaatcatccttcaaaatattcttttttccccacaaatacagaagtaacaattgaaaatttgaatatcaaattttgaatttttaaattactttggaaattaaagtaaaaagtagtaagagatcacgtcttcacattattagtttaactatatgcccatgaaaagaaaaacaaagtcacagtaaatatgaaaatagtatgtaatgaaaaaaaaaactttgtattcctcgtactagaatgtttgtttatacttgattttgaaaatgattgtgtctattttgtttaagacaaattaatgtgaaaagctatttattttccctattccaatccatttactcccatctataaaatgaggtggggaattaatatgtcaacaaagcaattaagtagaacaaaaaaaccagaatattaccgttaactgctgttaaatttttaaacaagatttgctttgaatttttcataacacgtgaaagttgaggattgttatgtaataataatcatgatgatgaaaaaataaacacatattgaatttaaattctgacatataaataggacacattctagaaaggccatttcagcttaaggaaaaaaagtgttcaaatgcgtaaaatatatcactaattggcttaaaattatatatgttataaaaatcatttttgtactcttcattagttgtaatgtagtttgcctgtgatatgacaaagtgttcaaattaatgttgaattagcttttttttcaaaaaatggtaatgtattccctcaatgagtagtagattattttatatattttctaaattatttctttgctctaaaggtctagagtaagaaatctttaaacaaggattatatactttcagctaacatttatgtagcaatatgtagtttgaaaacggctttgcacatattatctctcatgctgagttttcccgcctcctctttagaaataaatattcagctcagagagatttagtgatctgtcaccacatacaaagtatgtatttggctggaattcaaaccttccagtctcaaaacttgtagtcattctattatgcctcttttaggcactgaagtaatgcaagtgctaataataatgaggaggaggagaatgttttttaaaagtccatctctcaaaggcctcatgaaactctggaaatacaaaattgatacatgaaatcgcattagtgcagcaaaagacagtaggtgataaatagatatttgaaacagatcaacttttgggcaaaagcaaacactatggaatttcagaaaggagtagcatagaagccagttgggtgaattaactgaagaggaagaggacttttcacttagtagaaacagcataaacaaaggcataatgagacaatgggccagtctacataatagtttgaataaagttaaaaatattgtgtcatattatattgagccttgaaattcagagacagagaaagttaaacctaataattcagtagttaatagatattgattctacacaaggggagtttcatgatgcataacttaatatgaggatagttttacaagacaaaaatggagaaaaggagaatcaagtagagacagttttagaaagtccgtgattaagaatggaaacaaaagtgcaatgaagtcggtaagatgaatcaaagatacatttttaaaaagttgacatgtcttaagcatagtttgtatttaagtaaaaatagtaaaagaagacacactttaagtctcaagagctcagagaagtgacacatcaatttagaaaaggagaaattgggaaacagagataatatgggggaagttatttggttcaattttaaacattttaagcatgaggtaatggtgagctacctaggtaggaagttacagagatggatggaaattcattgagggagaatttatggctgtaaattaagagagttttgtaatcatcagtatagaagttaaagtcatgagtgtgttaagtgattaaggaagaaggaaagttttgagagctgaaacagagccatgacagattatctgttagtggggcagagagtgagaaacaagggtgcatgtcagaagttcaaagggaaggcatcattcaataataatggtattagaagttcaaaaatggttaaaaagtagatttgaggaacaagacaatggatttaaaagcaagattttaaaacaatggaagtttaggattaaggagaaattaggtgtaaagatataggagaataatcattttagatgtttggccagaatttgaaaaagaaagagagaagtaaaaggaacatacaaataattcaaatatgtttcaaatgctcacttttttaaaaaccttgtgctaaaaatttgaggagatgcaaagataaataaagaactctattgggatgtattcaattacaatataatggaaaagggaaaagatgtgcattaatttatagtgaagaaaccaggctgtgataagtatgacttgaccctcttcattttataaatatggagaaaagaaagatatacttgggttacacaagtagtggttaagcgtctctaatgaagacagcccaaaataaaatagcttgaattagtggacatttatttctctctcatccccaatcgagagaacagtccagctctggtgggacagctctgttttcctcagcaaggggcttctaatacttctctatttagcaccatttcctaaaatgaggaagattccagggcaaatgtctttaatgagaattttcagaaagttgtgcatattgcttctaatcatatgtcagtggctcaaattgggttgaataacaagagtagatgagaagtacagttttagctgggcatcaatgttactactaaaacccaaggaggaaaacaaatactgagccatagtcatcagtctctattatagatatcctccatgaagagagaatgaggaaagttactgaatggtagtactgggtagtattgaaggatgggtgtaggatttgaatatctatggagtgaagagtagggaattacagggtaaatgacaatatgagcaaagaaatgaataagaataaatacagggctttttttttttttggaaaggggggtcagagatcacatttgctaagaaaagtggatcataatcttgaaatgtttttgaaggaaagtgtgaagaatcttgaattccatgtttaaagtctggatattttatatatggacaatggacacaattaaagatttttaaaatagagatgtgatattatgggaattattccacattaaaatcaactgggaagcggtatatagagattagaaatttgaataaaaagtggaaagtccagttaggagactactgctatggatatgacagcctgaactagtatagtgccaatgggaataaacagaaaatgggaagggcaagaaatgaaaaagacattctagaagtttaccgacataatttgacaactgctggagttttgggttatgaggcaaagaaatataaagaatggaagttgattcaaaggatattaagcctaagtgatttaagggctagtggcagggccactgcaattgttcatttaaggatgctggcaggtgatggtattaacagagataagaaatgtaataaaagaaaaattaggagtaaaaattgtgaattaatataggacactgtggtattggagagtctactgtcaggacagtggaaattcactttaagtcaagggagtgaataggatttaatatatatatttggggaaacaaataattgtatgagcagaaaaatattaatttggaggccaattgatttaaattatgatttaaatttaaaaagtgaatccgaaagagttggaagatgaggacagatactgaagcaagatctggaaacagggaagatagaattcagtgggacagtcaatcttagaggggtgagatgatttagcttaaaaaaataaataatggagctagaataagagttgtgttcacgttaatgtgagagagataaggtagaccacagacaaagcaatgcaaggccagtgagtaagagtgtgtgtgtgttgggagatattgcttgaaagtgggaatcggagataaaaagaattgacttacctttcctcactattagaggaatggtaatgaatcaaattgagaaagaggaaaagcttcccaagtattgccataaagagcaaattggaaattcatattggagaccatttttcttagcctgtatttgtatcttttggaagctttatccttttggatatcttcagtttaagaaaaaaagcagagaatgtgaggtaaaacatgtacattattttaatttaaatatcaatttaccaaacatttatttttttctcttttgaataaattatacaagagacttccttgaaaccagtgtcagtgttcccagattcttccttcctacctttctccatttccttccttccttccttccttccttccttccttccttccttccttccttccttccttccttccctcccttcctccctcactccttccttccattctttccttcctcttcagattatatagtctgagaaaatagaaaataaatttttcaaatgtatatgtataaatttggatatctccccaaccctacaaccacgtctcattcctctcatttcccatggaatcccttgaaacatctatataatacttcagggcttaaggaactctatgaaaaaactagtgatctcagtcaaacaaattacacagtctcactatctttagctatgtttctaggagttgtcatatgggaaaactaaatctagcttttatagaccagtttcatgttaatagctaatatacttttaagagtaggaaaaatatgttttaattatcaagaaattaaaattggaggttgaataactatagttgaagtcatagcatctaataatatttacttgctattattgtgtcaaagtattgaatatttgccacctgctggcactacattaacccatacaatcctttagaatacgcttatgggttaggtcttcctatttttctcatgctttgggcaggggaactaatggcatatggctgtgagggatggagatgggtgctctagcagcagagcccgttcatgatctaaccactaaatcacattgtctctcatgagcaatcaatgttttagatagttaatttaaagcggtaatattttttaaagaacacattcttgtataaagactgatggccaacattctgttacttggaaatactttaaaaaacgtgtataaactattctcattagcatgaaagtaataagggaatttaaatgaaaataaaatgtctaaaaccaaagctagttctatttcagtcagacacaacaaatcaacttactcttcaatcaacctttctgtttagtgtgtcagtttaacttagagaaccaaacaaaacacttttttgtttgtcaaggataggctattaaaacaagggtgttctaaaattgcattagaaagatgaaaatgatttgtttaatcttctgaattttcatatgtcaggaacattattgtgaagaaaattgagctctctgaagtgacggatacattattcaaataactttgattggatgtaagattttttttaatgctttcacaaagcggacatattctaatttggtttataaaagagtggctttaaaatttgaaatactgggaaaaatatttttttagttcaataattagacaaagcatatttaattgtgggtgtaatgtttatggataattccattaattgataaatatatctggattataattagcataaattatttgcaccttaataagtcctcagtttgaactacattagagatgttaagatttctaaagtcatctacaactggccttaaaaattagatttgattttttaaatcttaaaatagtggttcagataagttatagatttgaaacaaaataataaatggaaaacagtgagcctcagtatgaattcctgcttctaaaactgctttgatggctcggcgcggtggctcacgcctgtaatcctagcactttgggaggcccaggcaggcggattgtctgagctcaggagtttgagaccagcctgggcaacacagtgaaaccctgtctctattaaaatgcaaaaaattagctgggtgtggtggcatgcacctgtagtcacagctactccggaggctgaggcaggagaatcgcttgaacccaggaggcggaggttgcagtgagccgagattgtgccgctgcactcactccagcctgggggacaaagggagattctgtctccaaaaaaaaaaaaaaaaaaaaaaccacaacgctttgatactttgatatcatgctgattggcatgttctctgaaacctataataatgtcagaagcgtgtattagaatgcagtagattcttatttttttgtttctttagagttgagattttacacataaatatgtaaattcatagaatcattttgttagatacataattctgcattgattattttaatctctgttactttggtggtttctattatagcatgcaaaattcttatgatgattttatatttttttctgtctttaaaatactctacggtctttaaaaaatgtttcacaactaagtttgttttctactttaatgactttctagctttcaaatttttataaatcctgtacatacaatgcctaagtcttaaaaaatgttattggtttactgatatacagattttcctctaacaaataatgtatagtaagaaaatgcaatttcttactgtggaaattagctgataaggacagggatctttaaaatcgaacacttgcaggcacgtatatgaaatcttgtaaaaatgtctgtttctgctttctacttaaacttatctgtctttttgtttcttttgcagcaaaaaatgctggatagaatttcttcccactgcaatttaaatgtattcttttttctgtcaattaccacaggtttagtccttatgagtggtataatccacacccttgcaaccctgactcagacgtggtggaaaacaattttaccttgctaaatagtttctggtttggagttggagctctcatgcagcaaggtatacgattcagcctgctatttcctttgggcaccatgtcccactctttgctgggggtgacagctcttgctggcacaagtcgcttgcatgggtgcctctgtgcatgtaaccataatccagcttttccatcgacctaatgcatttaggccttctcaaatcccattcaagagagattctgagaaaataattagcttttgcaaatccacatagagtatactcatctatttttttccttaacctacagtagatacattatttcatagataaccaagctaacctgatcattagccagaagctgcatttaaactactacaaagattacatctccttgagacaagaatacagtgttatgctcctgtttcttgtctcattttgatgtaaaatcttctctttcatattaattcttggtgattagatgcatttgtattgcatgattagtaaatttactgcctataaatttgaagagttaaaatattaaaacatgaactttttgagtaaaatattagctgcatttgatagcatataagaatataaaatattgcatgctcggaagtgcatgcaaaaatactttttcgtaattatttaaactttataatatacatgttaaaattaaggctatatcttagaaaatgagataatacatgtactaatacgtcttaatggtttatatgtaactatgaatctactattttagtctcagtttttttcaagcagaattttaatatttgatgctatggtttcttttattaatcttttcacatttaaataaagtttaacaaattgctatgctagacctattactcaaaataaaatattttattagtcaaggtctaagactagttttgccaatttaaaatgtaacattttaaagttttaaaattagtaaataaagcaaaaaaatcccaaatttgaaaaactgacagtaaaggaagaaaaaaaaccatatttcttcataagagttatcatacctatcataaggtttgattttaagtttttgttgtgtatttaatatccactttgaagaaattcatttagtgattgcattacagatctgaagaagtggaaatttatgttgttataaaatgttgtttctaaaaaaggcatcgtgctattgcatgtttaattttatgcagaaatgcattaattcattactgtttcatttataaactatttcctaaagtgaaaatacataactacatgtcaaaagaaaaagtttaatttaccaataaataatctttaatacatattgtaagcatggcctactaaattgaaatgtttattgtataattattaatatatatgtaaactatatttttatatatagtttatgaatatttaaacctaaaacttgaaaatccagaaaacttttacatgagctaacctaagtttgtggcatctctttctaaataactcaaatgaagaatcagtagttatatttttcctttcctacattttcttacattttgggtccaagggttttttgtttttttttttttttttcccttaggcttactctacccttagaagacattattgtagttctttcaaaataacagaagtgaatgaaaaagcccgtcatatggcacaaggttattttataagtagtgttgagtaatacaagtcacccaggcaaaactgctagtcgtctgttaataattagtagtctggagggagttatcctcataataaacatctgaccatagcaagactttcgttttaaaagtttcatatctctttgacaaagaaaacattctttttttctacttatattttaaaaaaatatttggaggtctttgagaatttgtatgctcataggacaaacttgctattagtagtatttaggaattagaggtaaaactctatgttattatctctgaagataatgacaagcaattcaagcaatgaaaaattcaaatatacatttgcttcgccacataactacgtcactgctggtggatacatgaaagaggaacccatactattctggctgatgcccagcttcccaggaattagtgggatatagtgctggacatgacgttaccttgagtacatgacagtcagcccctaaccaggctctgattcacaagactaggaggtactcgctttaagtccttgggtaagatatgaacttgtggtaattgggccatttatgtcaaatgtctccactattcttttctttcccagtcttgtttgactttattggtgttgttgtttaaacaaaacaaaacaaaacacaaaaaaagcaaaataggcagccaatgctgctcatcatcttgggagtatttagtgtttcagtgtccgagtgtgtgtctgacagggcctaggagcaactacatcagaaaggtacttttctgtttttttttccttacagagctgtaggcagaatctggagctggagttggctgtcatgtccaagtttgtctgcttttaaaattttgtttgtttgtttgaaattgcaatggtaagatgaactgcagtataagatgggctgttttgatatagtgcagtcataataccacttatttttcaagcttcacatgaataatttgttttattttttattccatctaaagatgtgttaccttactgcatcagagattatactaaagatatgactgtaagtccgtctttgcttcattccattttactcaaacacaaataaaattaagtacttttagtctatgctttcttgatagattcaaaatgattaaaagtgaacagtaatatatgcatatctacaaatttagtataccttacttataaaaaaatcacacatactgatatatgtttatttaagcattaagaatataaacaatgtggtaagctgtaattaaaatttaaataacagaccaaattttaaattggtaggattttgttttatagtctaaatgaattaaaattaataatagtcaaaagtaaaatataattctcagatcccattcttttattaagatcatgagcaggcaactccagccgtacattctgatatagttataaaagatttatatatgtataaaaataaatgtgacaatttagctatatattcttattctaatttttttaattgatgctaaccatagtgatgggagatccttgcttatacaggagaacataatttattatcttattttaaaataaacattacactaaaaccccacatcatttcaagaaatgtgggcaatagtagttattttattattatacgtaacttttaaaaataacaagatagacaaaatgtttgagctacatgcacatgaaaagtgaaatttacaaaaagcttaagaaatggatccaaaagtatatttaagcacttcctctgaaaccctcataactaacaaaatatgaaaaaacaataaatgtggtttataaaccagaaagcctaaaaaatctcttctaatgctatttttattaaaaatgtttactcattaatattttaattggaactttgcatcatctcaggtagaacgtgagtctcctgtcactatatttaaacaagaatgtcctaaaagattgtctattttctgaaaatagcctctgctttcccaatggttgttgcttgcttactaaagaaatatgtaaatctttgatttaagcttttattacacagtgattccattctgccactgtgacaaaaagtatctgattgctgatcaaattctctatattcgtttcacctttcccccactctctgttaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaaggtaagttctgctggttacctaaaatttacaaattaaaatgatagagcgcaaacttctctcgattcacaaatgtaagagtgtaacaacgccattatttgtgcacaattcttaataatagcatatacctcaaggggtggagaggtgtacaactgaacgtatgctcatcaagaccaatcattttaatctctgaaaatgctaaggaggttttgctttacaatattttgttcctgttttgaggaaaatcagcccaagggtaacattttttcccagtaagcttttctttttgaataaaacaaaatgtattttttgaaactgtaatagtaggatgttcagattctacaaaactttgctattccagaagaatagaataattactcggaaaaatgtttcccatacgtacatttacttttgttgaaatgaggcaagatttaagggctgaaaatacagagacagtccttattatctatacgttcaccaaggtaatagtctgggagacacagagttgaaaggggctgtcccattgaactcacagtggtttccagagagacagccctgtggaacatttaaatgaaagtgtgcttgtaaaaagtttctgtcatatagagtgccttgccctcgtctattttttctctcttctccttactcttgcctactcactgggccaaagtagaccagttgagggatttcactttaggtagctattaccactttataattccttttgtatcttaccaagtatttttacagtttttgtaggttgggcaaattttaaaacattgatattttctttctgtgttcacagaaacacaactggcagttcaaatgtacagtggaaatagtattttttttaaaaaaatgattaattcaagctataaaataaattatttcatgaagcattcatcaggtttctatcgagtgccagaagttacacgacacattgagtattctaattctcactatcgaggagattatggtttagttggagacagaataataaacttaaaacatcactgaatttggttttatgtgacttaagtcagtattttgtcaaattatgcaactttgtaaaaatttttataaaattaactttaaaataaatttctggaggacatccaattcccccaaaaataagataaattagatttagtcaaatatttaaaatttaattattttcaaagtgaatttctcatatgactagattaagtattggatatggatttcacatttacttggaaaatcactgttatttaatcaaatttattgaataatcaaatataagcaaaacaatacgttcagtatggtcctatttgactatattaattgcgatggatcagtttttcttaattgaatattgagaatttataagatttcctttcttatcaaacgtgttaatatttttgtgtttttataaagaaataagctgctaggccaggcacgttggctcgtgcctgtaatctcagcactctgggaggccaaggtgggtggatcacttgatcccaggaggttgagaccagcctccataacatggcaaaattctgtctctacaaacagcccaaaaattagtgtggtgtggtggcatgcacctgtattcccagctacttgggaggctgaggctggagaatcacttgagccggggaggcagaggttgtagcgagctaagatggcgacatagcactccagcttgggcaactggagtgcaatcctgtctcaaaaaaaaaaataaataaataaaataaaataaataagtcgctgaaattgctaaacgtgcgttgttagtgtcaacaacttgaaggaagtgaatgcgtgatgcatttaatttattccaatatccaagtgacttttgaattgaatttgtaaaatataataatacaacctattgtacctaacacaaaaatttgacaccagaagtgtttatttctggttcataaacatttccgttttaattttattttttccagaagactcaaatattttgttttaaagttcaaatatactagtagcaaagttcatttttgaaaaatcagttaccaaacatatgtattttttctttataaaatttttatttttaagcttattttcttaattctttgtcttttcattctttcgttctttttttaatagttcaattgctttctgctatgcaatttttgcctactttcacttttccttgctactgacttttcttcttactcttttttatctcttgtttttctctcaaacacgagtgcctctagcaccttgagaaagtcgacacgacacagctttctatttccaacagcacatatattatttctttagaattgtatttggaatgtacacaagtcacaataaaaaccacacagtgataattactaagttgacaactaccttatgttgctaatattatcacatgctgagttctattttcctactgaaactaggaaaagaaaattagaactcacaagactacattaaatgttgatatttttggtattttaatgtagccttaaaagattccaatttcaatttcatgttttcactttttaagtgtatagttattccagctatggtaagaaatttaaaaaaaattctagcagtctggaattcaaaaactacctactcattttgaaactgtacagtgaaccagagactattttgtagtgtatttacattttatacaattctttcatttttcatttaacagccacacatacaaacactctaggaagcatccctaagacattgacttctaaaggaatctctatcttgtttttactaatttagcaagaccttgctgttaactaattgttctggaatacttccttccagaaaattattataaaaaacgatacagttttgttactactagcaagaagagctggctccagatatctggtgttaaagggtgtaaatcctcagcattgcaaagacatagcagagttacatagctgttcttcaacatcgaataattccatttccaaagaccatgattgattttgttcactgagctcaaggtgctcaaagcatattatcttcaagaaaaattcttccttctttttttctatatccattacacaccacacagactctcctcagagataaatgtaaagccatgactggaaaaaataattcaaaataggagatagtggttctcacattattttcatgtaagcaatagaaaactgcatggtatcaccaatatgttcttaatcatatttagatagtaaaatggatgacagtccaagaattttattaagaaacattaaaggaggagtcaaaacctacttggaatctgggaatttagtgtactagaactgaagtttcacccccgggctaaccattatgcaacatgttaccaagcaacaggaacattcttttctccctgaagtataaaggctaggagaatggaagcctatacattataggatcaaaaatcactcagctatagcctgtaggtgttatggctttttttgagaatgcttgtatttttgaagtgagtcacatgttttacaaaatgataccgagtgcccttgtttctatgaaatccatgactcaagttttccagtttttagaaattatttgtctggatttggcctacctgaaatctctgactttattatgtgcactaatacatatgtccatctaaaagatatagtatcaaaggaagaaacatgtgctcttttgtatggtcattaaacaaaatgttggcacatattttaaaaatgtaagctccatccaaattgatgtattcctagtcctgtgttgcattctatacctttacatctctttctctaatgcccattatgctcttttttcatccccatccacctctaccaacctaattggttatattctctttattccttagattctaatctatacatcacttattccagggaaactctcctgacccttttcataccaaaatctacccagtctgggtacagtgctcctcttttacattctttgaagttttttttttttaaacttacattattgttaaattactaatccaagatatgttttcttggttcctgtatgtttccatactctactgcacagcaggagaatagggattgaatgaatctatatcattcatttttgtatctctagttcttggcactgaacttacatgtcttgagcttgtgttaattattaattgccaccagaatattgcttaacaaacagccaaaaacttagtgacatgtaacataaacctttatttatcttccaagtcagctgtccttctcacagaaacttgagagcccaagtttctacatttacagactcagttccttctacaccagggtgacagtgcttttaccagtacaatttcttcttaacctttaaatgtgtctaactgaatctacttatactgtaaaagccacacacgccgttcttttaaaggcatgcctctcttcagactgaatcgttgctactttgggctagaggatctttatccaaatgagaaaatctacaaggtattgccttgacttttttagaggttctaagaaagcatctaaggcatcacgcttaatttgattcttaattaagccttgtggccacgttgagaaaattttaagaactttcgctggcagaagattagaaatacgtttgttatccaaccatgcaagttttatcccctctacatcacctctaaattcagcttgcaaagtggtcagtacttttaaattttcttttcctctcctcctcttcctcctctttttccttctccatctccttgctgttgtactgattactcgtctatctctttcttgtcctaccttacatgtagctaaaactagccagctgatactttgaacattttgtcattttgtttggctatcttttggctaaatccaaaagattattagttcattttctatctttcaagtcactacaactacaacgtgtaattaaaaataatattttcccctgtattcatggattcctattttcccagcctccccaaatgatgatttgattattatctgctatgtgtgccctaaatcaatgccacagcttttctttattgcagcaccttgttacttttgtcaaattccacacagttatccattggcacaatgaattttacatttactgatggaaaacatatgacagaggctttcaggtataacgtgattatgtgcaaaattttattattctacagggcagtcaaaggtttattcaaaacatagagccctctatagctttcctattttaattatctgttaaaagtcattgattttgaagtgtaggtaatgaagttaggaatgaaaagcaagtgggttattccatcctaggtagaacgttttaatttttggtactgagcaaaagaggatttttcttgggagatttttctctttctttcttgttttctctgtctctctctccctttctttttttttcctttaacttttacagccttcctctgcaaagtacattctaaattccagctcatttatcttcagacaacttctaaggaaggtaggaagcaattatcattatgctcatttaacagatgaggaaactgggccacaaagaggttaagtgacttattaattataacggctataaccaaggaatgcatagtatcacaataaaggtaataaccaaagatatcgtcacataaaccatcgttactcaaaagagctaagtgtattgatcattttggctcacccacatgacctcaactgcttgattatattaagtttctaaaacatttgccttacagcattggggcagatacagctataacatgttctttatagtctgccacttattctgatcttaccagctcaatagtcttctaaaattaagttatgctggggtgattgtatatgatagtatatggtggggtgatagtatatgttttgaagtctgaattgctagtgtggcatgcctgcaataatttttttgagagcttgagtgattttgctttcagtatactacaagaatgtaagtaacttttccattgagagataaaatgtaaaaagttggtagtttactgcaagtccttattagatctaaaaacatatactattcattagagattgctcctaattttgtaaatataggcaaaacagaattgttgtccgtttttatttagagcaatggtggtaatataagtataatatatttactgtgaagagatttactcattagcagagtaaattctcaaaattgcaacgatagtgtgcttttcacattgaaaaatgtcttctgaaatgaatgtttattttcctcttgctatattggtggtaaaatattttgaaagttccactttgcatatgcagaaaattaacctaaaaataatatttaaagatgagaaatattatctagaacttttttgaattttagatatgtttggttttagagcttattctttaaatgtttttcatattttatatagcaagatttctagttaagtgtagttgtctgtaggaaaaggtttaataattatttgtcagcacatggttagaaatcaggttatgtcttttagtttgcacatgtttactattacgcggattctaataattttccaccactatccagaaggaatgcttttacaatatgacaattagaaattctttatggtacttcagtaagtatagggaggatgtgtaaatagctactcacttgagttggcttgtttatttaggtgctattaactagccacatagctttttctcatgtcatttttatttattttgagttgaatagggagtcttttcccttttgagcacttgtgtttctcagagatgtattttattttgtatgtctaagtgaaaattgagaaaatacatgttctcagggacctgaggaatgaacattcatcttttctttgtaaacctttatcgtaggtttttctatcatggggattgaaagcataaaggtccatatttgagacttgggagaattgtacatgagactttgtgtttacctaatggagactgaattaagaagagatgacttttaagtgatattaaggacatggtattaattggcctactctatagatttatattgaattgggttctgagcaagagctttgagatttgtgttcatgtagttttcttgcctgagcttattttactaccctataatatttagtgaactacttctgctcctttccttgttgtgaaaaaaagcgctattttaactggcaaaagtaaattagtacacaattctaatttacatattgctttgtgttacttgagaacccctcaatattcctttgcagatctaaactaaaacaaaatgttcctcaaacatgacatactgttctgacttggaagatgaaatacctaatatacttaggcttctaagccaaaaactattcttgccaacttgctcacaaattactgattaggaaatagctatggctgtttaggacacatagaaactttatttttaattttttgtttgtctcacatattgaagtttatagataatcttttttttttctttgtgctttaatgagttaaacaaaacataaaagcttgatgtggttgatcaccaatgtatctgggcagtaaggttaggttaatggttaatattgttaatgaaatttttgtttgttcatgttgctgtgttcttcattgtccatcagacatttttttctagaagtctggaagaaatatcgcagtaaagatttttatagtcatataattttcctaacgctcccaaattatttttcctttattaatggtgttgaaatatcgaatgtgggaaattcactaatgttaacattagattacgtggtagtattttgttcaataaaataaggttggtattttaaagtgtcattatatttttattagtgtctaatacagttttaatataaattggtcatgtttgatataaatatttaaaacatgactatttattatgtctttgatttatttgtgtagtaaggaagttatttttactcccagaggttgtctccctccccctttcctcatctaacacacaatttattgtacgtgaggcctgatcctatgtttattacagggatttgcataaggactacaggaaaccaacaccattttactatgttcccattgcaagaaataaaatggtgcctttgagtaaagctgcttcatcagacactagttcagcatgccaagttaaagccatcaatggtgaaacagcagatgtgaaggctagttggcatgaaagcatatgagtcaaagactttcctatgggaaagaaagtgcttcattacactttatctatagtgagaacattgggtttatcaagctgtctgaaaattagaatatgatgagttttattactcttgctctgccagagtgaattcaatggttaaaaagaaagcaataacaccattttaggaattataagaagtgattaggtttttagcgtatttaaacttggaaggagcagcaacttttatcttcgaaagtagcctctctaaaatatctaagggacagaagtttaatccttttctaattgctacatttgcaatatgtattaacgcagctttgggcgctttaactgaataaagaagttgtatgcttgactgaagtgtaaaatctgagaaacaatgttttaattgccttggaaaacatgtgcatgaggccctgccactccagcatacactagtatgctatggttctctccctcccttgtcctccctcctttactctgtgcaaggaccattcctgctgtttgtcaagtcaggttggcagctcaaacactgtgtcccaactcatcagtcttaggagagagggccccacagggagtgagaaaactcaaaagtcagttaatacagtgatgttgagctaacatgtcaagtgctggataatggataatagttgtcactgcaagagttcatagccactggttaggcaacattctgaaggaaattcaagaaggacatattttggatgcaaaaaataggctgagataaatattatccaaaaataccttgacattctaaaaattttagtgctttatatcttacataaaaaaactaaaatgacaaattccatttcttctatataaattgctgaatagaagcatcatttggtatttttaaaacaaacatacaaacaaaaaaacccagactctactttgttaatgttttgaggaaattatacttattgacattgtggctatgaaatatctattgatcgttttgggggtggggggtgttgctgctctgacttttgagtatcagcaaagacatattgttctcatttcttagatagcccattaattacaaggtgaatatcctgaaatttgtacttaatttaaaatatccttggcagtttaatggtcttgattttccacattattatgctgtcttttcagggagaagctattcttttgttgcaaaggcattttagactaattagcatctttggtcagctgaattttcatttgttcatttgttttcctgtctctttccaaaagccacattattctaaaaacagtaatatcactttgttgtttgttattaagagctgattgaagataccacatactagttaagttttttttttctttctttatgaagcaaaaggagatttactattatttgctgctactgccatcttcaatattagactcttatttaaagataatactgtactatttttccccttgggagcaagcaagatgtcaagtgatgcacccttctgatgctcaataatcttaccactttatcatgcatatttgcaaggatgaagcacagtttataaatcatctctgtttattttacattcttccccttaactccagatagatcaggaaaaggacaaaataaattttggtgcttgttcataagtgttgataactgcaaactgaatataataaattcctcaaaaatactgctttaagaaattaaacttggtcaaacattgatggtaaatgtcttattcttaaagagatcttattctgaaacaacttgaatctttgtttttatgctgtgatattagtggctgtggcagtgcctagaattgtttaattgcctaatgcacaaaggtgagcactttgattgatgtgtattcagagaagtactttaataattttataaataaagaactctccagatgactgaatgtgtctgtgtgtgtatgtacatgaagagtgtgttctgtaagaataaggtatgctttcttaatttgagttaaattatggatggttatataattcatttttctatacccagtttccatcttaaatctatttagagaaagaatagttcagggttggcgataaaatgtacttttacatttcctgatagtatttgaattatgcttctgattgtcattagcctattgtatacaccatagcacaagtgagttcagtgaaaagatttgattatctctaaaggtaggtgtttcatttattaagtattgtaattacagctaattagaagctacacattatattagtttgctttgtaggtcccttgactgttttcagaacactatgagcttatggttcatttcaatttattacaaaaacaatttaataaaagccaaagaattgggaaacagcattactaatggatataatttattgttgagtcaatataatagtttaacataattattaaaggcatagaccaagttgtggcgtgaaatcctacattcctcaatcaatacagatttatttaatttctctgggtttctgcttttttgaatttatctcccatagataaatcgagagtatatgtcttatatattgttcgtattaccactgaacatgtactaaattcccaatatatatttgctattatccttattgtgaggagcttaaatgttgaattgttaaatttcggtagcagatgaaaccatttcccccaatatgaataccgtacttttgcaaatacaggttacctatggttaatgctacaatctgacactcagttgcattctcatttcattaataatttggtcctgattttagattattaataaacaaatattctggattactctctaatctcactgaaaagataaagtacatcaggaatctgtttccatgtacacattacagatagtcaatcttttaaaacggattttattattttagtgcagttccatggtcacagcaaaatcaacatcgtgggactttaaatatatcaattcacattcttcaagagtttttgtcagccttctctttcaaaaccagaaaataaaaacccagcctgactccaacaaatagatataactaaactgagggacttaggattccatattgtcagaatgaaaagtggtgacaacccaagatggttatgactgagtgaaatgaattttattaaacacgaccttttttatgatctacctggaaaattttaacaattagggaggtgtttcagaaaggatgcccccaatttggtggtgatagttatgatgagagttgtgttgaaggaagtgttgattgtgacagaagcccccttggaaatttagaaacaaatgtatgtttgtgagaaaaaaaataattaactttcagataaacagcaaaagttcttcacaagaagccaaatatactagtattagcaaaaggataacacttccaaatttagaaatatgtctgcctttgaagctggctgagaactaatttttgtgcaggcaggattcttgagatcactgtttgtggcttttgttttaatgaagcagcttatgagtagcatcaagtcttccaggctttactttcaggactgctgtttccctgggggcctaacaattgcaagtggccctttcattgatttttattaccaatgccagagtgtacataatcattttagtcaaactcttacagctgaaacaagtaaatctattgcattttgaaaataaaaatagtggctaacctgtttccatctttatttattattattattttttctgcattgttagtaaccatgtaatagctgtcacgtctacctttctcactcatctttattctgggtgatgtttctttcctaatctcaggcctaatgtgttgcccctgctgtgtcctggaaatgaggttgcagtgatttacttttactagccattagagaaacactttagtattttgtcttatttcccttctttgaattccacaaacttcgaaagtatcaaaagtagtagtgtactctaaaactcttccaagaaattttactatgtaaggctaaggaataaactagatttttattttcttatggcttctaataaaacatgtgtggttatagagcacatgtaatacatctagtgcactgaggagtaaaatatgaaatttcaattatttaatttttattaaattgaaattttaaaaccaaagcagtgcaagacatttttgcaataaacttaaacatatatttcattttaacctttgcctcatataagatgttgtattatagagcatgtgatttgtgcatgagttgtttccaacacatcagtgatgtactcagtggcaatgatttgattcagtttaaatgatttcttctatgtactactgtaacattgtaatgtgtttatttgaatattttatgtaggtgaaataaattacaattataactatctaaaccatatgattattaaattgaaatgcatactattattttaatcaaaatataattaaattatttttctagtttaaaaatacatatgggcaaatttctaatttaaaatgaagttacactattaagaagaattaaatgaaaatgtagaaactggtactacaactggaagagtaaagaataagagagtctggataaggatatgttaactggtttcacaatgaatgaacattgcaatttgctgcaacaaagcaaaatggaaaagttgtttgtcacatatatatttttaagatattaaactggtcattatcaacatacattctcagaaaatacaaactgaatttgatatgcaattttttttttcttaatagtaaaaaaaagaaacaaggaagttaaccaaagttagagtcaaatgttcaatacatttaaaaatatgttttgacagagtctgaagttacacttttggactgttatacaatggcttggatttttaaacaaagagaccatttttggatggaaagatggtaacatatgttatttcaattatgattagtttgttacaaagttgtaaaaatgagattaaaagaaatattgtaaataagcaaaagatctttaattaatcaactaaaaaattgcccatagtttacaatagctttctaaccataggaaaaatcagttgatcctaatttttaaaaatggcaaaccagtgccttttttaagattagaatgaagtatacaatatgagaaactgtccaattaatactttgggtacattttttcctcaaatgactcccagatttaggagaaaaatttcaatttttgaaataaataaagaactagtggcataggttttttttgtatctcttacagctattaaatattaatttcagctagaaatagaaaatttagtttattacaagatggtcacgatgatggatgctctagctatgttaggttaaaaaaaaacacagatttattataattttaaaacaaaagactgatgtttttccttgatgtgatttggctctgtttccccacacaaatctcatgtcaaattgtaatccccatgtgttgaaagagcggcctgatgggagatgactgaatcatgggggcattttctaatcgtttagcatcatctccattttcaagtagttctttatagcactgtgaaacagactaatatagaaattggtaccaggagagtaggggactgctctaaagatacctgaacatgtggaagcaactttggaactaggtaacgggaagagatttgaacaattctgagggctcagaagaagacaggaatatgtgggaaagttaggaacttcctagagacttgttgaatggttttgaccaaaatgctgatagtgatatggacagtgaagtccaggctgaggtcgtctgagacggagatgatgaacttattgggaactggagtacaggtcactcttgtaatgctttagaaaagagactggtggcattgtgctcttgctctagggatctgtggaactttgagcttgatagagatgatttaggatatttggtggaagaaatttcaaagcagcaaagtattcatgatgtggcctggcttctactaacagcatacagtcatacatgttcacaaagagatggtctgaaattagaacttatgtttgaaagggaagcaaagcataaaagtttggataatttttagcttgaacatgtggtagaaaagaaaaattcattttctgaggaggaatttaagcaactggctgcagaaatttgcataaatgaagaagagtagaatgttaatagccaagataataaggaaaatgtctccaaggcatttcagagatctttgtagcagctcctcccttcgcaggcctagaggcctaggaggggaaaaaaatggattcatgggccaggtccagagctctgcagctctgtgcagcctcaggacatggcaccctgagtagcagccactccagctccagccatggctctaaggatccaaggtacagctcaggccattgtttcagagagtgcaagccccaaaccttggcagcttccatgtggtgttgggcctgtgggtgcacagaaggcaagaatgaggtttggaatcttcacctagattttagaggacgtatggaaacacctggctgtccaggcagaaatttgctgcaggggtgaagccctcatggaaaacctgcagtaggtgtggaggggaaatgtggggttggagcccccacacagagtctccactggggcactgcctaatggaaatgtgagagaagggccactgtcctccagactctagaatagcagatccaccaacagtttgtatcttgcacctggaaaagccacagacactcaacactagcccgtgaaagcagctgcagaggctgtaccctaaagagccacagaagcaaagctgcccaggccttgggagcccacctcttgcatcagcataccctgtatgtgagacatggagtcaaagaaggttattttggaactttaagatttaatgactgccctactggattttggaattccatggggcctgtagccccttagtcttgaccagtttttccctgttgcaatgggagcatttacccaatgcctagatcttcactgtatcttggaagtaactaacttgtttttgattttacaggctcataggcaaaagatacttatcttgtctcagatgaaacttggattggacttttgggttaatgctggacactgttggaaaagcatgattgcgttttgaaatgtgagaaggacatgcaatttgggaggggaaagggtggaatgattggtttggctctgtgtccctacccaaatctcatgtagagttgtaattcccatgttttgaaggaggggcctggcaggaggtgattggctcatgagggcggtttttaatggtttagcaccgtcctcccaatgctgtctcataagtgagttctcatgagatctgataattttaaagtgtgtggcacctaccccttctctctctcctgctaccatgtaaggcatgtcttgcttccccttcaccttccatcatgatcatatgtttcctgagctctccctagccatgtagaactttgactcaattaaacctcttttctttacaaattactcatttttaggtagttctttatagaagtgtgaaaatgaactaataaatccttttagctttactatatgacactgaaattatttgtgttcagttttctgaagcagactctgtgacaagtgtcatagacacagttgttaatattatttagtgtatatgtgtaagtgctatgactcattgccagtttgtagaactattgaaagaaatagaagataacaaatgttaatggttttgtaattttttgccaaattgctctttggttgagtcaaagaatacaaagatttactgtattgtctattcctactcaaagatgcatgaaattaaattatttctagatattcaataatcaaagataaaaataatagtttgttttatgttttttgtgctaatatcacactgaacaaaagcaaactaaattgaatttcaaaagaaaaaaatattttttatctagaaagctgtaataattcattataataggaaattatcataataaaggtcaataaaagtgatttttcacatttttttaaagagtcaatatacagattttagttgctgtcagcagtattatagcaaacttgtagtctcaaaaactacatgtaaaatttaaaaactttgttttgagattgataaatttagagattttcagtttatacaattttcctttgacttcagtgttaataattcttagttgatgtaagcattagtaaattacttcacttggaaagataaacagacataacttttgaacaagaatatgtgctttgaagccaaattaattcttaaaaagttaagaaagatgaacaagttttaccaacatgttgtgtatattacaggaaaattgcttttagtacttagttcaattattggaaatttgtttgaaacaacttgggtatatggaactagtattttaactgatttttttttagctttttaggtttatgcaatcaatacaacttaagcgtcttaaatgaaaatttagtgtctgaattgagatatgttttcagtgtaaaatttacgttggatttcaaaactaaaataatgtgaaacatctctctaataatttttatattgagaatgtctcatagtcacttaaaatccagtaaattcaaaatggagtctttatttgttcccagtttcatcattccatgattattctccattctaacagagggcaatgccatcaatgctgttgctcacctctcatatctaacccatgagcatgtacttttggttgtaccttcaaaatacattgcatctaaaagctattcacagctctccatatctatcgccaacaccttaatctaagtaatcagtaagccatttagtaagctcaacaccttaatttaatcagtaagccatttagtaagcttataagtttactactattttgtctgcatcatcagttgttccatttcaatcactttcctaagagtatttaaagggatcacaaacaaacaaataaatcaacataactcctctgtaaagtgagttttctctttactttttacttataacacatgttccttccatgataacattctaaattcattgttttcatttatgttattcttcttgtgactagaatgtgaatttcatgaggtcaaagacttagtaactagagcattctggtagataatagattctctatctactgttttttttttttttcatttttatgagatagcaaattaatccttgtaagtaaattaatcaatataagattattaatcataatctttaatcatgtttatgatatagtaaattaatcaatataagtaaaataagccaggataaaccattttacataccctaattgttacaaaatataacatatacacagaataattttccaaaacataatttgtataacattaggtgttttgagattagtaaagttagtatgttaagaaaaatttagaaagtgaagaaaatggaaataagacaataattattaatgagaacacaaacatgcacacatatcttctgatatatataatatgtatgtgtgtgcatacacacacatacctatatctgtaatgaaattggggcaatgctataaacataacttcagaagattttctaagcctgggcaacaacccccatctttacaaaaaataaaaacattagccagggtgtggtggcacatgactgtagttccaactacacaggaggctgaggtgggaggatcatttaagcctgggaggttaaggttgcagtgagtcgtattcacctcattgcacttagtcttggattgctgttgaaaaaaaaaataagaaaagaaacattttgatttttaattagctattatgaataatgcttatttgtaaatacgtaacaaactatctaatcattgaattaaaggaatatgacagtgtcttcatcgaagccatgactgcaccagaacaagttaacacaggcaaggcgattattgtagtaaagaggagatgccaggattcagtctgaactcaattctactgctcaaaggactggagggtgtttaaaagttggagagggggatggaggcagagtggtattgtaaaccatttatttttgctagttggtcctacccaatggaaaacaaactttttgatatcttcatgacaggagatagttctacaacttggagcaaggtacccactgaagttaaatttctaccctcccacagagaatgttacacagggacactagcttcctagatgattacagttcaaaaagggctcctaggaccttgagcaaaacgttgctaccttgtaatattagcaagaaacttttaaaaagatttacattccaaaagagtcaaagaaataatttacgattataatttttcaaaggtgtgctctgagaaaagagaggtcaggggcttagagtccagaagaagcatgcctaaagtttaatcaagctgaaatgaatgaaattgtcttgatcacttgatacaacaccctttagagacattgaagtaatttttaatactaacaatatgtaactgggtgattcttcttcctattctcatttttagtgtgaattatagagtattgagaatttttaatgagggaaatattatcattattttattttgaattgttttgatcataacaggaattaaacattttaaaatgtttataacaaagaaactttaatcttacagacttaaatgttggaatatcattattttaatttggtttaaaaaattgtatgcagtctgcattccactaagtttcttaacctataaaacaagtattttttaaggagcattataagtacagagattcatgctaatggcattcagctcattaataattatgttgtagtaaagctgagaaaatgtgatataagagaaacacttgcttatttaaatatgtcagttttatttccttctgtttgctttgttaaaacatgcatataattttggataaaaatgtgttggatactgaaagcctgcctcttattataacaaaggcattaattagacatgagaggtccgcaccatgatcccaaatgttatatttcaatacacatgttcagaaagtaatctttcagacattagtaggtgtgttaaatgactataatcctgagcacctacatcgacactttatcctttgatatttgtcagacatgcttaaccccaactaggagaatgttgtttttattaataattatttcaggtaatacctgattaggtctaatgagtgcttggcagtcttcatattggaatgaagtctgtgtgaacgtttaccaaaatgtagaaaccttggaatatttgacaaatgtttatttttaaaaaatggcctctaatctcagtttgaatttacacttattttatttttcagtttatttgtttggaaaatattcctattacctttaaattgactttttagagaagttttacaaatacattatttttaaatacaagaacaaacaggaaaacggagttaagttttatatggcagtggtgatagaatggttgggtaggagcatgaatactgagtaattatatttattatgtccttattcctgtgtcttcaaaacagaaaatgatttgaagaatcttagaactgtctttttttttttaaagtctcttccgtttacccagtaagtgacataagccacaagttactattttttacatctaaatcagagccagtgttaaccatcagtgccattttaacgtgtgatcagttccttaactaatatatatatatacacacatatatagttatagttatatatagttatacataatatagttatatataaatatatttatagttatatataatatagttttatatagttatatatatacacatacacacatatatatgatacaatatatatgcaagcagatttttcagacccagaataaaatgttaaaaggtttttttattgttttaattaaatagagacagggtcccactacgttgcccagactagtcctgaactcttaggctaaagtgatcctgctgcctcagcctcccaaagcgttgggattacagggatgagccactgtgcctggcctaaaaagggttttaaagcaaaacaagaaaacaatcaaatttcatttatttattaaagaaagtaaataaacagatatcaaattgccaatatgaggcaaactcagggcaaatttaatttgcacctgggcacatttacagaattttgacatggcagttacttgactattcatcaaatgtgtaatttcctccagtcgtagcacacccactgtttaaatttgtgttctgaaaatataaacccaccacttaaaataattgcttattttattaattcaaatatacacacccattgattcataaattatcaacagtttaactttatgataaaaataatgtatatgttctatcttgtctcatcatttcttctggctatccatgatggaaagggagaataagagagcttttgttgttgttgttgtgtttttgcgattttttttttttgtgggtaccaacacttttcttttgcctccataggatttttaaatgcagccttataaccatgttaaatgcctagatttgattataatagaaatttatcaaattcttttaatttacacactcaggtttcttgtcaggtctaggaactcctctttgattatcttttttttgttatccttttaagttctggaatacatgtgcagaatgtgcatgtttgttacatagatatacacagtggtgtgctgcacccatccaaccgtcatctacattaagtatttctcctaatgctatccttcccctagtcccccatccccaaccggccccagtgtgtgatgttccctgccctgtgtccatgcgttctcattgttcaactcccacttataagtgagaatgtgtggtgtttggttttctgttcctgtgtttgctgagaatgatgctttctatcttcatccatgtccctgcaaaggacataaactcatccttttttatggctgcatagtatttcatggtgtatatgtgccacattttctttatccagtctatcattgatgggcatttgggttggttccaagtctttgctattgtgaatagtgctgcaataaacatgagtgtacatgtgtctttataagtgtagaattatttataatcctttgggtatatacctagtaatgggattgctgggccaaatggtatttctggttctagatgcttgaggaatcaccacactgtcttcatctttttgaaaatattatatgtctcaatcatgctgatttcatgttcaggaacagaacagaaatgagaaaatgagaaatgagtgagatctgacattggttttatgacctctatttattaaataactttctcattttttatttctcattttaatctcctgattttaagaaaatcagcctgttttgtaagttttttctacctgtttcaaaaagtcttataggcttgtatcacattgggactacaaaatgtgtttccattttgttgttgttgctggtaataaatcattttctaaaatctcttctccctctaagttatcaagataatactccttttcttgttttttggaccaatttttatagctttatgtttatctcaatctttggtgagaggaatttgattgggatttgtggttgaccagaggtcacttgaataaacctctctctctactaaaacttgaaagcaggcctacatgcaaactttgtagtccagttatcaatctcaggatccaaaattgttgttttgtgttttaacatggctctttgggcctgagatagaatggactcttaccctcaggaccttaaatctgatactctgaatgatgaagcagccccctttttagggcttctcttatcttccccacattttcatgacaaatgaagactattcccacctgcctctggaataggacagtcttccctgcccactacttgcttagttatttcctatcagttgtagcctctatttttttgtttttcatttttttctttatgtttttttattttgtctttattttttgtagcctctaaattagcacagaatacaagtactaacagtagtgggagccaggaaacacattccactggattcaaaattaatatctacaaaggtgaaggataactgctaagtgtactggatcagggagaacttataggtggcatagtgtagacaaagaaacaatggtatgcctaacacctttcaacatggtagtagcatttgacttcaagcaagggcgggccatagattttatttttaataaagtttaagcgtcattgtagttaaggacatttatttcagacttcagcaagaagttgtgtgtcagttccaatgttctgttgtgaatcgtcatttgttgtgtcttaccatattaatatattttactgtgatgttagtagagaaatcattgagtgcagtcatccaaacaccttttaaaactggaaatacataatctttaatgctttaaaatgtatttgcatatatgtgaaagtatcatctaaactgcaatcattataacccatgaagtgtgaagaaatcctgtattttctattttctttaacatgatggataaaaggtatttaagagagttgagaaactaacctttagtcctgtgtcaaatctgatagaattcatctttcaactatctgttaccactttctagacactgccaatagtaaaatcaattgttggagtaaatggaatggcttttggtataatgcacaaatgggtttaaattgaggattcaatatatgcgtgttttgtttaaatatttttgctttaagtgtaggttcatatgcagctgtaagaaataatacagagacattccatgtagactgatatggtttagctgtgttcccatccaaatctcatcttgaattgtagctctcataatccccacgtgtcatgggagggaaccagtggcccagtggcaagtaattgaatcatgtgggcagatttttcccatgctgttctggtgatagtgaataagtctcatgagatctgatgattttataaagagtagttcccctgcacatactttcttgcctgctgccatgttagacatgttttgctcttcttttgtcttccaccatgattgtgaagcctccccagccaagtggaactatgagtccattaaacctctttttctttacacccagtctggggtatttcttcatagcagcatgagaagtaactaatacatagcctttaagagtcccacaatgtaatatcatgaaaagcaataggacattatcacaacgatgttggcattgttagagaaaagacaggtaacatttccgtcatcacaaacacatcatgttttccttcaacagtcataaccttttttctcccacatccccttcgttagctcttgacagtgcctaatctgttctccatttcagcaattttgtcacttcaagaatgttacataaatggaatcatcctctatgacggaaccatccagtatgtaaccttttggtattagctttttccacttagcttaattctctggaggttcatccaggttgttatgagaatcaatagtctgttcctttttactgctgagtaaccttcaatggtatggttttaccacagtttatttaagcatttactggttgaagtacaactgggttgttttggggttttggctattttgagcaaagctgctatgaatatccatgtacaggttttgtgtgaacattagcttttctttccatgtgaccaaagcccaagtgtgcaattgcagagttgaattatagttccaagttttgttcagttttttttttaaataaaagctctattaagatgtaatttatataccatgtaattcacctgtttaaagtaaaaagttcaagaatttttagtatattcagaactgcataatcaccacaatattttttttttttttgaggcggagtctcgctccatctctcaggctggagtgcagtggcacgatcttggctcactgcaagctccgcctcctgggttcacgccattctcctgcctcagcatcctgagtagctgggaccacaggtgcccgccaccacacccagctaattttttgtatttttagtagagacggggtttcaccgtgttagccaggatggtctggatctcctgacttcttgatctgcccatctcggcctcccaaagtgtcaccacaataatttttaaaactttttcaacattttgaaaataaaccatgtactcattaacaatcattccccatttacttaaaatgtccactctccaccatacctaataaaccactaatctgcttctgactataaaacttcttagtctgaatatttaatgtaaacagtgatatagaataaatgctctttggctttaactgaactttcatctgtgtttcagtgtgtatcaaaattttattcttctttttgcagaataatattgtactacattgatataacaaattttatttatctgtttatcagaggatggacatttgaattgcttccactttttggatattataaataatactgctataaatattaatgtatgagttttggggtagatgtatattttaatttttcttgggtctataagcagaattcatgggtcaagtggtaaatatatgtttaaccatttgaggaaaatcaaactactttctaaatggctgcacaattttacattgcctttagcagtgtacaagggctccagtttcttcacatcctcaccaacacttactattttctgtttttatgattatagccatcctagtgtgagaaagtgctatctcctcatggctttgatttgtacttccctgatagctaatgtggttgagcatcttttatgtgcttattcaccatttgtatatctttggagaaatgtttattcagatcctttgctcatttttaaattaggttgtctttttatcattgaattgtaagagtatttttacattttatagatagaaatccctcatcagaaatatgatttgcaaaagttatttttccattcttgggttatcattttactttgttcatcgtgtcctttgatatacaaaagcttttactattaatgacatttattataattatttattgtttggatccttgcttttgatgttatatcaaaggagacttttcccaacccaaggtcctaaagagttactactatatttttttctaagagttttatagttttaacttttatatttagttctacaattcactttgatttaatttttgtgtatgatgtgaaggacaaacacaattccatccctttgtatgtagatatcaaagtgtcccaacacagtgtgttgaagactattctttccctctttgaattgttttggtactctagtaaaacaagaaatgaccataatgtaagggtttatttctgaacctttaattcttttcaattaatctgtatgtctatccatatctacataccacatggtcttgcttactgtagtttggaaattaggaagatcatcagtttccttttttatttcaagattgttttgactatgtcaggttccctgcatctataagaattttgggataactgacaaatttctgcaaaaagccacatgaggtattaattttatgtttatttgggaagtattgttatcttaacaatattaagtcttttgatccatgcacttgagatgtttttcaaattatttaggtcttctttaatttctttcaaggtgttttcacttttattattagatcttgcacttctttaaagaatagatccctctgtattgtattctcttcaatactattataaatataacaatttttataatttcattttctgatagttcaattttatatatagaaatataagtgatttttgtatagtgattttacatactgcagtgggttagaactcttctattaattctcaaagtgttagtagatatatctggatttcctatatacaagatcctgtcaactacaaagagagatagtttaaggttttctttccaatctggatgcctttgtgttttttttcttgcctttatggcctggcaatatgagaattacagtataatgttgaatgtaaatgagaaaggtgtacactgttatcttgctcctaatatcgggggaaaacatttttccttacaccattattacattaggtgtggatttttcacagatgccttaaacaatgttgaaggcattcccttccttcattgattgagtgcttttcaatcactccagaggtactgaatttgtcaatgcttttcctgagtttactgagatggtcctctgatttttcctttattttactgataaaatatattatatttatttgtttgtgcactttaaaacaacctcacattatttaattaaatcccacttggtcttggtgtataattatttttctgtgatgctggagtcagtgtgctggtattttgttgatacattttgcatctatattcataagatatattgatatgtagtttgtttttcttgtgatttttttggggggttttgatatcaggttgacactggcctcatggagtgagttggaaagtgtccctgcctcttttgctttttggaataatttatgaagaaatggtattaattttgctttaaatgtttgacggatttcaccagtaaagccgtttggtcctaagcttttatctccaggaagtgttaacaattatatatccagcctgggcacagtggctcatgtctgtaatcctaacactttgggaggccaaagcaggaagtttgcttgaatccaggagttcaaagctaccataggcaacaaagtgaggtgagttcccatatctaaaagagaaacaaaaaaaagcagacaggcatggtggaatgctcccacacacccagagtcccagcctgagcaacagagcaaggccttctctctctctctctctctctcccccccatttcttttacagtcagatttggtagtttgtgttttttaaggaatttatccatttcatctatattgtctaatttgtggccacacagctatacatattattcccttttaatcctttttttttctgttagattgtaggcaatcatctcactttcatttctgatattgataattttgttattcttgctaaaagtttgtaagtattgttgatcttttcaaagacttggctttgtgtttctttgattctctctctttttcaagttgttgcttcattagttttcattctagtttttattattttcttccttctgctttattcgagtgtactttgctcttctttttccactgctttatgttgaaggttaggtcattgatatgaggtcatttttctttttaaatataatcatttacatttataaatttctctctaagcactgctttaacttcatcctacaagttttattatgtcacgtatttttattcagctaataatatgtccttatgtcagtgtgatgtgttcttttatctttaaattactaacgcattttaaatttccataaatctatttctttctgttattaattctttgtttttaccctttggcctaagcaaaaaacttatgactaagtcctcatttctatcagaattttgggataactgaccaatttctgcaaaaagccacatgagatattaattttatatctatttggagaatattgttaccttaacaatattatgtcttttgatccacgaacttgagatttttaaatttatttttaaagatttcaggggtacaagtgcagttttgtttcatggatatattgcgtagtggtgaagtcttggttttaatgtgctcatcgccccaatagtgaacattgtacacaataggtaattttcaatcctcactcccttcccaacctcctaccttttcatagctccggtgtctattattaccctgtctatgtccatgtgtacccattgttaattcctacttttaaatgagaatatgaggtatttgactttctgtttctgaattatttcacttaagatactgatctcctgctttatctatgttgttgcaaaagacatgatttcattcttttttatggctaagtagtattacatggggtgtatgtgtgtgtatatatgtgtgtatatatatataaaattttcttatatatatcaataaaaattatacatatctataagaattttatatataagaattatagatatatacatatatatatataattttctttatcgaatcatcagttgatggacacttaggtttattccacaactttactatggtgaatagtgctgtgacaaacatgtaagttcaggtgtctttttgatatagtgaattcttttcctttgggtatatacccagtagtgtgactgttggattaaataactgttctatttttagttctttgagtaacctctatactgttttccacagaagttatgctaatttgcattcccaccaacagtgtataagcattcacttttttctaaatgtgctacaacatgtgttaatatttgaggttttaataatagccattctgtctggtgtacgatggtatttcactgtggttttaatttgcatttctctgataatttgtgccgttgaacatttttgtcatgttttttggctgcttgtatgtcttattctgaaaaatctcttcaaatctttcacccactttttaatgggcttgtttttgtcttatagagttgtttgagttctttgtaaattctggatattagccctatgtcacacacatagttttcaaacattttcttccattctgtaggttattagtcttttgattgtgattttcttatttatttatttttattatttatttatttatttattttttactgtgcagacactttctagtttaagtcccttttgtctgtttttgttttagttgtgtttgcttttgaggacttagttataattttttgttgtttgttttggccaatgtccagaagacattttcaaaggttcccttcaggaatttttatagtttcagatcttacattcaggaatttaattcatcttgagttaatttgtatatggtgagagatatggatctagtttcattcctctatgtatggcaatccagttttcccagcaccatttattgaataggatgtcttttctccagtgtatacttttgtcaattttgttgaagatcagttggttgtaggtatgtggctttattgatgtattctatattacattccagtgatctatgtgtctctatttataccagcaccatgctgttttagttactgtaaccttgtagtatattttagacaggtaatgtgatacatcaagctttgatttttgcttaggattgttttggctattcaggctatattttggtttcatattaatactatgattgttttttctaattctgtgaaaaattatataaattgcattgaatctgtagattgttttaggaagtatggtcattttaacaatattgactcttccaaactatgagcatagaatgtttttccattcatttgtgtcatctacagtttttttcatcaatgttttgtattttttcttttagagagctttacctacttgtttaaatgtattgctacatatttgtgtgtgtgtgtgtgtgtgtgtgtgtgtgtgtgtgtgtgtgtgtgtgggtccattgcaagtgagactgcattcttagtttggttctcagtttgtatgttattgattatagaaatgctactgacctttatacattgattttgtatcctgtaacttttctgaagttgtttaacaaatctagaagtcttttggatagtctttaggattttccagttgtaagattttatcatcagttaacatatatcatttgacgtcctcttttccaatttggatgccttttatttcttcctcttgcttgattcctctagctagaaattccaggactatgttgaatatgagaggtaaaaatgtgcatccttgtcttgttccagtttttaaagagaatgttttcaactttttcctgtttagtatgatgttgcctatgggtttgttatatatggcctttattattttaggtaagtttatatgatacctggtgtgctgagtgtttttatcattaatgggtgctgaattttataaaattattttttctgaatctattgagatgagcatatggtttttgttttaaattctgtttatgtggtgaatcacatttattaatttgcatgtgttgaaccattcttgaatccctgaaataaaacccacttgattatggtgtattacatttctgatgtactgttgcatttggcttgctagtattttttagaggattattgtgtttacattcatcagggatattggcctatagttttctatttttgtggtattcttgcctggctttggtatcagggtgatactggcttcatagaatgagttagggaggattctcttctcatcaattttatgcaacagttatagtaaaattgataccataaaattgattgataccatcaataaaattgatcaattttatagtaaaatttatactggtatcaatggcttcatgtggcaatcatatggcttcacatgtctggtaacatttggctgtacatccctctggtcctgggctcatatctgttggacaattttttcattactgattcaatgtcattactcattattgtctgttaaagatttctatttcttcttgttacagtcttaggagaaattttctctagtttttctagtttgtatgcctagtgatactcatagcagtctttgatgatcttttgtatttctgtggtatcacttgtagtcacacctttatcttttctgattgtgcttaagacttctctccatttttcatggttgatctagctaacaatctatcaatattgtttatgatttcaaaaagccaatttttattttgttgatcctttgtatttttttgttgttctcaatttcatttagttcttttctgatctttgttatttcttttcttctctgagctttgggtttggtctgctcttgaatttctattcccttgagggacttgttagggttgttaatttggaatatttctatctttctaatgtaggtttttaacaccgatgaaaattttgttgagagtccctttagaagtgattagacacttctctcttgctgcttttaggatttttttccttcatattggctttggataacctaataactatatgtgataatgagtttcatcttgtaaagtatgttccaagtattcactgagcttgttgtatttggatacctaattccctggccagaccagggacattttcctggattgttcccacaaataagtttccccagctttttcttcttctccctcaggaatgcctataattcataggtttggttactttacgtaatcttttatttctcaaagcctttttttagtgttttgtttttttttttttgtctgacttggttaattcagaaggcttgtctttaagctctgattatttttcttctacttgctctaatggtaaggcttccaaatgtatcttgtaattatttcaataattttttttattttcagaagttctgtttttttaaaaattatctgtaataatttttaattaacatcctgatttttcttctgatttctttggtttttagctttctcttggatctcattaagcttcctcacaatctatattttgaattctttatctgtcatttcagaattttcatttagttttggatccattgctagacagttagtgtgttcctttggaggggttaaagcactctgtttttccatggtgccatagtttttatgttagttccttctcatcctggagaaattgtcatttattttttaatttactttcttttagatggtacttttttaaattttttctcttgagggcgtaactgtaatgtatgttgtgtagggctgtttggcttcaattctgggtgctttcaggggccaagcctctgtatgagttccttggttgtagataaccttggttataaatacagttcctttatgtggtggctttttcaaatgctgattatagtagcaatgtactcggcctatgagcaggactaacaccttctgtgggactgaggttatggaagtctcaggaaacttaccttattccgcagcacaatgctcttctgacagaagatttttaatttgattgtgcagtccaatctccagttcattaggtggtagttacgggtaacagctgtctgtggtatatacttgatctttgtttactgagaagggctctgttgtcacatgtagtgggctggtctgtcaaatgactggtgtcctgacttccctgctgaagggtacaggtgggacaaagctgggcagagctggaccaccaaactcaccctcagataccccaatgataagttaatgtatccaccttgactggagtgacagggagaggttatagtgaaagcctcccatgtttctcccagttccacatcatgggcaggcaggaaagtggtcaacctccacatcacacccttcttccagggctcaggactttcatttcagatagacattgtagttcatcttcaggactcaatgtaactgagggttccagcaaatccctaccccatagctaccaacaaaatgacctcgggagaaacctctttcctcaaccccaaacagacagctttgtggctcactcacctgtactctgcagcgggaatgctgctgttctgtgtagagtgagggatggactccaccattcttgcaagctgggctaatggacataccaggagtgggagtgcaactcctcctaatagtcctataatagttctccctaggcatacccatgccaacgccccccacgaaagaacagctagctgcagctgcatccgcagctgtgggtcggcaggcagaagtccccctatccatctttgttcccaggcaccagtgccacctgctgctgggatggaaccacactctccctgacatagcctagcaccatgcccacatttctcatgcaatgggcgcagtaatcttcagctcacaagtggggagctcttgtgcagaggagagtgcacactccggtttttgttgttccaagggcacttcggcatgtgacactctcccttcccctagggagagctcaccctgaacgttagaattccgggaatcccacagctcccctttatcctgctggtcctttctggttgctgctgtccaagtagattctaaggaatgtctataagggatctactggtgttgaggcaagagctgagactctttgggtaggatagagatccacaatatgtgcccaactggtatggcacctactacctcagcttgggtcttgagagtggagggatggtaaaactgcatgagctagcagcctagtgctttgccctcaagaaatttgtaaacacaacccacagcagtacttgggttcatgagggcagaggggctctctgacattccagaaatcagcagtatgacacaggggtgaggggagcataaagtacccccatctaccttatccatgggactccaagatcttcaggggtcaatctctgccagactcttgcttccttctttttgtgtgccccagctttttcccatgggttctttaatagactgtggcactcttccctcggtattccactcaggatgtgattactaactggcaactctggttcttctttatgaaaactggcattcaatgcctctagtcagccatcttgaaaaaaaaacctcaactctgttattaatttgtaatgttattccattgtagcaaggcacatgctctgtgtgctttgaattatttcaaatgtattgaggcttgtttcatggcctggaatgtagactaccttggagtaccatgtgtacttgagaagggtgtatattttgctttattttgggtggagtgttccataaagacttcttagttctatctatcctattgttgttcaagtcttctatttcctaatagaacttctgcttatttgtcttatccattattgaaagtgagctactgaagtcctcaactctttttgctaattctccatttcacattttaattctgtaattttttgcttcatattttggggttatgttgtttggtgcatatatatttataattgttccttttttgataaattaacattattaaactagaataacaaaattgatctcaatataactataaaatatattttttatatctagtgattgtttttgtttttcaaacctactattccttatttctgtatagcctctctgtcttgtgatggccatttgcctgacatatcttttgctatctttatttttaaccttcctgtatctttgaatataaactgggttttctagataaaacaggcagttgaattttttttttatttttaatccagtgtgataaactgccttttgatttgattgtacaacagattagaatttaatgttattattgatatagttaaatttacatctgccaattaatttttatctttctaatgtctcttttgtcctctctcctttaccagttttgcattaagataatattttcttgtgtaacattttaatttaatgatttttctttgtattttttgttattttctttgtggttgatttaggacttatatatcttaatttataagaatctatttcatatttatacttatttaggatttttttttttttttttttttttttttttttttttttgagatggagtctagctctgtcgcccaggctggagtgcagtggcaccatctcagcttactgcaagctctgcttcctgggttcatgccattctcctgcctcagtctcccgagtagctgggactacaggcgcctgccacagcacctggctgatttttcttttcctttcttttttttctctttttctttctttctttcttttttttttttttttgtatttttagtagagatggggtttcactgtgttagctaggatgatcttgatctcctgacctcgtgatccacccgcctcggcctcccaaagtgctgggattacaggcgtgagccaccgcgcccggccacttatttagtttaatatagaaacaatcctagaaagctctatttcctcttatccattttatgctctaatttttgtacatattatatgtatatatgctccaaacccaaccatacatcattatatatgctgcaaacccaacaatacatcatggagctagcagtctccacttaattgcttaccaataaaatttccattatttcagagagtacccttcaacttgaacttgcctacattcttttctaaataaagttaactcttttgggcagaacttcagaattctcagttcttattacctggctctcttcttgggcaaaatatgcaccactgctctggagctaatgggaaggagggtatgggttaaggttcaaattacatagatgcttgctattgttactgagatttgtgtttcttgaaaaaaaatacatataatttgctgtatatcttagaacaatttctggagactttaaatgtagatatataatatatacataattatatttcattaatgtataatatatacatactatatcattacacatataacatcatatataagattatagatacatgatatataataaaacaatgctaacacatatatgtataattaggtacatgattttgtgtatgatataacatatatgtatattattatattattgttatcaattgtgaatgtttcactggagaggaggtttgtgaaggtcctctgatcccagttagaagtggattttccttgtgttttaagagcctctagctattggggtttcagtaccagacctgttagcaaccctgtcctattgggaaatgaaggagaactagacatgggtgtttacagtgtgacttttgtgggatactacttctacctgctaggcagcctaatgtctagttctcaaacccgtgaccagggggtctcgcacacaggaaaggtgtttatattggaagatgcccttgtggctcttgtttgatccctgttcagtttatgcctgcctaaccattgctgcagcactgggatcctgactttttgttcttcctggcatcccagggaaattctggcctggggaagctgtagttctttgcatggaaggtgcaaatttgatacaccaccacagtaagaaacaagctcaaagactttttacttatggatcctaggcagggagaacacaatgagtcaggaggacagttctctgtctccaggtcatgcaaggcagaaatgtagagtcaggcatagagagagagagaacatgtggcaattagcaggatacataagggcatagggtgtagattatgttaagtttgcgggaaaatacctgaatagtttttttaaaggaagtagccggaaaatggataacctggtctgctaggcaggagagatgcatctaagctcttatctggagcctctggattgaggcatttgggtgtggtgtagaactggaaactgagtcaagggtgaccaaaccctgcttttgctataagaaacttaaacctgtattcaaaatgaacaccaaggcaacataaaattataagaatttactatacttcattattcattttttgatctcaggacatgtgcttaactgctttgcatcttaggtgtcctcctgtaaaactggataaagtaccaggtgtatagtgctgttttgcatattggcttagaaaaaatttgtaaaccttattttttcaatgtctgctcataaaagctatccaatacaatttagttccctgtttttctttcagatatccaaatctgtcactctcatcatgccatttctataacaagtcagagagtctatcttcagctttatctgtcattgttctccctcattttgcagtttgttccttgggttgaataatacctctgtaaaatgtttcacattagtcttaataaaaaaagtaatgtttatttttgtaataatttatgtaagatatagctcagtgaaaacatattctccttgcatgttatcacacacaattgtttttgaatgacacaataatgtattgacattttatacttctgatttcacagtatatttgccattacttgttagtaacaaagcatcagtcataaatttgaagtctgtggaattggttaattttacctcatttgagtaaatctcaaatgaggtaaagtataggaggtaggaggaaggaaggaaggagaaagggagtataataactaattggagaaaaatatatttgataaaataatccttgtctgtataaaacaattttcaataataactgatatgtttccctaaaggtagtttataatctattattctttttataataattatgatgttatgtggtttggatttctttgtaatccacattagatagcatagaaactagtatataaccaataaatatttcgtgactgcatgtactttgtgtataactttatgtgccaaattcttgatacaaataatctgtaaattttctcctcatcagaaaattgtattctttgtctaccgtcattttgccattatcagaatgtatattttacatggcattcccaaattaaagttaattattctcccctatgaaacaatgtactttgtattttaacaaattgtttagctaaggaagaaaacaatttatttaggtaatgcaaatatgtcaacagataattgcattatagcagaagtttaatataaaagacacaaaagttttaggtgtgtcctgagaagtgattgatttctgtagggcagaagtaaaggagaaatttaaaaaatatattatgaatgttgcgatgcccaagtagatcttgagagtaacagaagtaatagagtttgacaaggctggagttcctgtaagaaaataagcatattactaaatccactttattctaattaattatttgttcagatcttaacttttataacaggatatgttgaggacctgaatgttctagtcatctgtttcccctgagcacataatgcaatcaatggcctgtgataggtgctcaagaaattgtcaatgcataagtgattcaatggataaaggaagagggacgaatatttgacaggcccatcccctcctcacttgctctgagctgtgtcctgagattatgattgataggatatcttatgaataaatccatcaaaactgagcaaactgggaaaatattaacaatttaatggttgatttttagctaagtcttataatccaaggcaaatacaatttcctcttttatactctccagtacttgttatgtactcatgttttgtagacaataaaaataaacttaattttatgcttggtaatcaataatttatagtgttttattgtgatattatgtattcatgataagtaactcaatgtaatattaagctaagttttaagttacctaaagatcttgaaaattttgttcaagctgacaaactataaaacaaaattatagttgaaataaaaagattgagagaattatgattcaacttctttaaaatatatttttataatattaaacatttttataggaatacatttttattttattagtaacctagtatacaaactttcaggaattcagattaaatagacttttcatgaggaaccaaacctaaatcttataaaaattaaattgcctacttgtatattacttaacattgatactttatataaagtcatataactgtttttcttctttaaatcattattaaaccagttgcgatttgatattttatagaaaatgcctttggggaattttttagaggttatcacaattcatgtattagaaattattttaaaatattctatgtatttgggaatattcaatttacataagcactttttaaaaataaattataacagtgattctttagcttaagagatgccacaatttaatgtacttttatcctctggatatagaagtgaagacctttctcaatttcaaacacagttgcatagtcacaaagacgacttgtacctgcagtctcatcacttcagtcacgggtcaaaagtgaacacgaaaacccaaccaaaaactttctagtccggatatcaggtgttttccttcccagtgggcaggaaacactttcccagttgatttgagatctacgcaaacaggtaaacaaacaacaagccaacaaaccagaatctcattcatgtttaacccaataacgaatagagtttcattattcatctcatagaaattaccaagtggtcagaacagaaaaccaaaatcttagtcattgctctcactaatgggggataatttatgcaccaacaagatctagaaataaaaatcaaaacaacaacaaaccaacaacccctcccaccccccaccatataaacagtaggagaaataggaggaaaaaagaactggagagtcaggaaaattaaagttctattgacgcttgagattctctctgagaactagaaaagatgtgacttcactcaaagatccttgaatgtgcccttctccagtaatacaatttatttggctctgtcaagtgaaacaataaaatataattttcaaaagttaaaaaaaaaccatgcatcttatgcaaatataaactgaacacatgatgaagattttattcaattattaattatggttcaaaggagaattttaaggacataaacacataggtacacacaatcaggaatgctgaaatgcatttgctaatagatgcaaagctttttaaaaccctttatatgtgataaaataagatgtttaggagttatatttcctacagagttaaagcaatttttttctttactgaataaaacaaatttgcattgctattaacaagaataatttgcattagtgtcagttttttacatgacaacttctactcctacaaaattgctactagtctggtcaatagaaggtcagtcaaaggagcatatcattatggaatcagacaatccccggagagtatgcaggtaatatccagcactctacaatatgaaacaatcattttaatatttctagatcctcagtctcaagatttgtttcttcacattgatttggctgagaacataaagatacatactttatgttcgccttatcttctcactttcctttcacacttgcacttcttgaacttggtaaacataaatcacactttcatccacccatcaaaaatgtgtgttctctgaggggaaaaaatcactgtggcatacacaaaaatattaattagaagtattgatgtttaagaagacttctaaaatgaggatactgtaaacctaccccttatcttcataatagatgcatttccaatataaatttattcattgttcataacacaatgaatacatttgtccaattgtgggctaaaaatagttttaattgtaactcaatagagaagaatattttaaacattaaagactcatgacaataaattttaagtaatatttaatcttaacactatataaacattttgaattataataaagtgactgaataaaatatttgcaagcataaaatatatttccttagaataacatgttatagaagtagggaacaacaatataaaagaaaatgaaccacatataatttataactgttgaaaagaggagttgggttgtgtattttttaaatgcatgattgtgggtggcaaacagctattgtattaatattctacacaggatgcatttgaagaagaatgtaacacttttccttaaaatatgaatagtgaaagtatgctagaagttatgtttatgcattttttagttcaatgataaaatatttgaatttgtatagcttcaaaatatttgttctatagcctgtttaatttatgttatttctcagtggcttacttttaatttcaggttcatttttccccaaattttcacttgttattttttaagagaaaggcctatgaaaatatgaacaatgacctcaaataattgatttcaactcataaaaataacaaagaataaaggagtaatactgagacaattgccgctgtttgacaactatgatagagcatatgaaaggataatttccgaactgatagtttttgttcactaatggaattatttttgtcttcataggatatacttttagtcttaatgcataatatttaatccatcacattaatctttgtagatgaaatgtcaatgactacatatataggattgtgtgtcttagataagtccacataaaacataaattggagtaatcataaggagcagcatacgagtttggtcagcaactgcttggtttgcaaattgtatgtgaaagacttggagttataataatggctctaggcttaaaaccaccatattaaccctcttgtttttactatcttcaatttattatatggcttggagagtgtgttctgcatgtgtagctctgtctctttttcctataatgttctcaaccatctcacctaattcaattttgtcagcactttgtaaaggcctgttagaccaatcccactgaaatcacatgcctatttttatatctacagcattttatgccctttttttggtgtttgaaaccttatacacagagattttcctcaataaaaatttgttgaattcattaataaattaaaaaataaaccaatcaatcaaatctaatgccaaagggccagagtaatgatttttttttttctctaggatttttggggcaaaaatgtggccatctcaagcagcttcaacattttaatttagggcaagcaagccccaaaatttgggcttggcccaggatggttcttgccatcacccaggaaagaatttaggcagccagtgttattagacaacaaattttattgaagtagcagtatacagcagctgtagaggtactgctcctttcagaccaggtcaaccccacagacagtgtgcctaaagtagcagctcagaggcagtttggctgtcgtatttatacccactttttattatatgaaaattaaatggtggattatgcagacatttataggacaggggtggtaatttccaagtcatcaggtcattgtcatgttctttaaagaagcagtaacatctgagtgttgttctggcaagggtaaacgacatggcacactggtgggcatgtcttatggaaagctactcatgccccatcccaatatttacagatgtgaacatctgtaaacattctttctgcaaatacatcctgcaattgtatttagttggtcctcaatttcatctaatgtctgagtcctgtctctgcagttaagtcctgcctcctgagtcaagtcccacctcctacctcaatttgagtttaagttgaaaaaacaaattttgcagaagtgaaggcaaaaaatgaaggcatatccaaatgatacaaatgacaatcattgtcaattaatcttctgtttttataagggcaaatatgattccagaagctcagcattattttggcataatgggaactgtaggaaaggcagatgatttccatagtatttatcactgcattccttgctgtgtatttcaaattctcttggagtttgtacttctaaattttagaaaaagttgtgaattttgaaattttttcagaaattggaaaatatttgtagatcaaattaaacagaaagccaatgagatatattcacatctgtaaacattcttttttatttcaaatatattttgttagctaaaaagtactcctgttgttatattatttagttttacaaccatttttctaattataacaaaaatgtatttctgcaacagtgatatatgtgtttatattaagagaaaataaatgtaatcttcttgtaaacattttattttgaaacaccggtctaacatctgtaaaccaaggcagtattatgtttccatatacttaagaataggtactcccagtgggagatgatataggatagaatggaaaatgtattatccattggaaagattctgttatgtgggcatgtcaaggttattttctaaacatttgtgtcacatccttcaaaaattcttatttttttcttttatttttataattgcaacttttattttagatacagaggacacgtgcagatctgttacatgggtatatttgtgacatttgttcagtggtagatacaaatagttttaattgtaactgaagtttggggtatgatcctgtcacccaggtattgagaatagtgtccaataggtagtttttcacccattgcctgtctccattccttccccttctagtagttcacattgtctattattcccatctttatgaccatgtatactcaaagtttagctctcagtcatcagtgagaacatacagtatttggccttctgttcttgcattaattcaccgaggattatggcctccagctgcatgcatgttgctgcaaaggacatgattttgttctttttttggcatcatagtattccaaggtatatatgcaccatattttctttatctgttccaccattgattggcatctgtgttgattctatgtctttgctattgtgaacagcactgtgatgaatgtatgaatgcatgtgtctttttggtagaatgatttattttcttttggacatatacccaataatgggattgctgggttgaaaggtagctctgtttttaagttttttgagtaatctccaaatggctttccacagtggctgaaatattaataatttacattctcacgaacagtgtataagcattcctatttctcccgagcctcaccagcatcattgttttttgtctgtttaataatcaccgttctgacgggtgtgagatggtatcttattgtggttttgatttacatttctctgatgactagtggtgatgaacattttttcatattcattgtctgcgtgtatgtcttcttttgagaagtatcggttcatgtcctttgcccactttttaatggaatcatttgtttattgcttgttgatttattttagttccttatggattctggattttagacctttgttggatgcagtttgtgaatgttttcttctattctgtaggttgtctgtttactctgtcgatagtttctttaatttggtcctacttttattgcaattgcttttggggacttggccaaaattatttgccaaggtcaatgtcaagaagagtatttcctaggtttgtagtcgaaggtcttatatttaaatctttaattaatcttgggttgatttttatatatggtgaaaggtaggagtatggttttattcttctgcacatggctagccagttatccctgcaccatttcttgaatagagagtccctttcccatggcttgtttttgtcagctttgttgaagatcagatggttttaggtgtgtggttttatttatgggttctttattctgttccattgatctatgtgtctatttttgtatcagtaccatgctgttttgattattgcagccttatagtttagtttgaagccaggtagtgtgatgcctcaagctttgttctttttgcttatgatcactttggctctctgggctccaaaatctaatacacttttctatgtctagtagggactaactctctgcccagagtttaatcatgaaattagtgagccagtgttactaatagaaatatgacctatctctcagacataatagggcataaaaacttcagcggctgaaaaatcatctgaaagactttttaaaaatgtacaatctgagccatttttttctgatttactgtatcaaaaactctagagttggatctagaattcagtatttttagcaagcacttgaagtaatgtttctaaacactaaaatttcaaagcaataactccttaataaatgacaccacttttacatacatttatgactatagttgtaagtatgcgtaataaacattcaatctcaataatatccaaaaatgcaagaacataaagatcttctacaatgaaagacacattaaaacttataatgcaagacatagaaagattctcactaccataacctttcaggagaaagttttttgctgccttttcctcagaaatttagaatcactatgatattttgaaatctttatgaacctcaagatgtttacttttagatcttgttttaaacatactaccaattataagattgtttatattaaatgataattttaaaggatcaggaatgtgataatattgtcaagtattggggggaaattgccctaaatagcattataaataaatcatccaatcatcagtgttactcaaagttcattctttggaaccctattaccttcagatacagtacgaactaaaagcattattgttatcaaataggtgtgagaaatgatgcattgtatagcacatctgattgcagtgaatcacaatgcacaataacatatctaaggctctggagaggtcttacaagtgctcaaccttcccaatacagtttagcccaactaatacatagtaatatattgagaagaaatatacatttggatatactaatttatatgactcgtacaattggtccctttaaattggcaatcaacatatactttattaaattatactacttccaagttctgaaagttatttttaataatagagtctctactatacaaatctaactggttatgtctaggaaaatttagccatcttgtctttttgtaaataattgtgaataaaaattcattttataaaatgtaaataataccaatgagtattataaagtaccaaacaaaaaaaagacatgcaaaatcttttatactttattttaaaataatttttgagtacgtactatgtctgccagaaaatgtgcaagattctgtggaaattgatcaatagtagatatacgtcctgccctccttgaggttatgatatcatagagaagataaatgttaagatactattaggcatatgttgaatgctagctaaaaaagtggcgggtgctatagaaactgcattagtcaaagttctacagaaaaacagaacatacacacacataaagaaatttaatttaaaggattggctcacacaattatagggacttcggaaagtctcaatctgtaagcaagccagcaggctggcaactccggcaggggaatgctacagtattgaggaagaatttcttttctgagaaatcttagattttgctctcaatgcctttcaactgattggtcgaagctcatccacatcatcaaggacaatctcctttacttaaagtcagttgattgtagatgttagccacacatacaaaatagcttcaagcatcacctagatttgtgtttgattaaatagctgggtactaacctagccagattgatacataaaactaactatcacagcaatatataagggggcatatataaaacagttaatcaatcaaactgggaagctcaagataggttttatttaaaaatcgaattgaatttaactgagacttgaaataaaaatagagttaggtaaaaattaagggtaaattatagggtaaggtaggatcaagaagacaaaaaatcttatatagaaatattcaaacatgaaaagaatagtgctgattattttgtttctttcttttatataggaagcacaaaaaaaggaaggagtcaaggatgattttttgattccacagagtgagttatagaaccacaaaaaggaaaatagtagagaaaaatcgtagtttcagtttggggtctgttaactttgaaatacctatgagccctccacacagagatatctagtaagaatataagaatatgggcctagagagattaggtttggtgttgttaactcaagtaatctaaatcttgggaatagatgaaatcacctggggaagtgtagggtgaagagacaggtatttagtcagtgacctgtggcacttaattcaccaagatttaataggaaaataacccaaaaaaggagattgagagagcagccaaatacataggtaatgtggagtgtgatatcagggaaaccaagaaaagggcttgttgtaagaaaagtgttgtggtcaagaatgttacgtcctgctgagatgtcaagcaagacaaggataaagaggaatccattggactttctgacatggaattcattgcagaagcccaatttgaggtaagtgaggaaaaactggacttgaggaaatagaaacagcatgtgtgaaaataagagtggaaaaagtggaaaaggcctaagagtggaaaaagacctagtgtgccaaaaatgaaggtcaaggtgggcaggtggagtcaggtagtttttaggccatttatttgtaaacagttattttatctatgtgtctatctgtctgtctgtctgtctatctatctatctgtctatctctatctatctatctatctatctatctatctatctatccctccatccatccatccattcaactgtcatctatttaatctatttttctttggggttaaattatgaaagagcaaggagagaagagatttaaaaactataaagacagggaataattgataacataacatccctgagaaaattgaagaggatgatatacaaaaacaaaatcatttagttttggatggagggtagaggtagaggggtctgtcattgtattagaaggagaggaggaaaaagaggtcaaagtgaagggaaaggtagcaagatccgacatttcaggaaaatggaaagtgtttaaagatctacagtgagaaattggagatgaactcactgggtaacagtaaacatagggcaattttgaacactcagtggaacttggagaccactgaagaaatttatcttctgttatgtaatatatttttctcagtggaattgagtagcttatatatactcatggaataaatggctatattttttccagattgtttagatgagtgtgacaacaggataacaaagctgaggaatttaggttactggaaaaaaagggcagtttaaagtgttctgtgcatctgggtgtggtggctcatgcctgtaaacccagcactttgtgggcctgaggagagaagatcacttgaacccagcagttcgagaccagctgggcaacatggagaaatcgtgtctctataaaaatattagccaggcatggtaacacacttgcattcccagctatttgggaggctgaggcaggatgattgattgagcccaggagtttgaggctgcagtgagctatgatcatgccaccactgcactccaacctaggtgacaaagagacatcctgtttcttaaaagaaaaaaaatggtctgtggaatatggatttagaatagaggtaagtgacattagaaaatagaggaggcatagggaagagaaaaatgtctggtggacagaaatttcattgtttaaaaaaaaaaaacaactgtagtgggataaaccaaatagataagtaagaggacagaatttgtagttgtgcagtagaatgacttactgaagagtgggggaatagtggaatagtggaatagtggaatggaggaaaattttgcagaagacaaagaagttaagcctttaactagctgtccatgtgtacatgtaattgtcatggtatcaaataaaaaattggagtggaaaacatgatgacacaggtactaatgacttaaatgagtgaggaagtaaccaggcaagtaggcaatgacagtaatgaagtgacaaaggaatttataaagccatatgatgtgaactaaataggagagggatttattattttttttttacaagagaggctataataggaaataaatagaatgtagtatatacctatttattagtggctatgttatgttatgttatgttatgttatgttatgttatgagtctgagtcttctgtgaaccagatgccaagatggaattagaagagccaagatttattgggaactatctatgggggataaagaagaaggggaggaagcagaagtaggcaaagaatgccttcagacagcaattcagccctgacatgtgtgaaaggagataaggaaggaagggatatttggtaggaaactcatgactacgtgggcattctgcaaaagcctcagccagaccaatgtggagtccccaggcaaatgtttctccttggaaaaatcccacatcaggcaggcatggcccagatttatagacctcaccatatttagtcattggctgtgagcagagcataggatgtgtggctttggagtaaaagccattgtggaccccaaggtgctggaggctgtcggccaactctgcttccacggaggattttctggaagggagattttagtggaagacttctaaaacctgcgtgcttcatcttctcaggcatcccacctcttccacacaatcctctaagccttttttgaccgcacttattttatttggtttgttttgctttctttcctagaaatactctatttagaaaatgacacctactaaataaagctcctcgagaaactttcctggaggtggactatatgacaaacatacttgaaatggactgaacaaagttattcttgtgagttagatgcagcaatccatatgcttacttgtagaagaaaaaaagtggtttaaattataatctggatgtaaaaaatcttaaaatcatgatggttacattcctgcctgataggaggtttttttctgagccccacatatttctatagtcagagactaagtccataagcctagcttccaggtggcttctgatcttcatgcagagtatggcttggatatcagtgtgttatggatcaaatttgatgggttaaaagtctgtatatcacaggtgtttcaagattaaaggcaggggagtggtctcttcatcagggaactgagagttgttatatgcacttaattatacatttctatatgtaattataaagagttttaagaatagtatatgcacatctctgccatggatgatctggaactttaaaaatggcatttgttatgaaatgactaaatatagtaatataattgctattgagttgtccttttcttgactgtcaggcagtaacctcatcatatcatttaattctgattggcagctgtttggtactattcatcttacttttttctccttgaacattactcactttgtaatcattgtatctttaatatcttgtgtcatacatttgaagcaatctggcagtttctgacagaaagaagttagaaaataaaagccaacttccctgtgtttttttctggtagaattgctgatatacctacaaccatagaaatattatgaaaaagtagttgaattaaacaatgtcagtgggttataaataataattggctcacttttataaaagctatgtatataatatttagaattatttgctaatgatcagttttctattcaatagaaaagctgtatttatttactaacaataaataaatgacaattattttgcagcataagctgctgtctctaaatctcccctctcccccagtttctaatactacttaatggcagacaaatggatatatttctcaactgctattttattcctatctccatatgttatcctaatcatgagccacaataccccactttccatggtcagttttggataacatatcttattttcaaccaattagtgtatccagttatcatataaaccattttttgcatagtaaaaaacaaacaggaacaagccagttttatgctcccaaattcagttaatatgatagcaaacaaagggtaagagaaagcaagaaagttttaggactgaaagattgttggaaaaataggaagtagtagtcagagagtggactacaggaaactattatggaagagttgcagtttttagtaatggcaatgctcaggttatgacctgataacatgagattttaaagcatgttagagtttagagatgaacagaggaaaatggtgtgaaaagggcaatgatagaaaaagagagtcaatatcccatgatattgaaacaaatagctaccgctgcaaaggatggtggaggaagcaccaccttcaggacttatctgttaaaggtggaaggtgagtagaatgttcacagaagagattgagcatgaaaggacatttgctgaatgccagagggcaccctggaaaacttgtgagtgttggagtataagcagaggtgggtaagaagaaatggctccctcttaatccctcttgatggaggtgaggttgtccagggttcactttggattgctgtgggaggaatgtgcaagagctctaacttggtaggtaaagtctattggtgaagctagttcttctagcatgcacacccccttcatcttggtgatagagggacacgaaaaagtgtaatttgtctaagttagacattttctatatgttaagcccataaatattttaccttctctttattcactcatcaaatattcattgagttgctgctcagcatcaggtgcagcagcgagcgcttagtctctgtcctcctgctgcagcagagagtacggtatgggaaagagacagagccagttatttcacaagcaagaaccaattaaagctgtggcgatttctgtggtggagaagtgcatttggcaggaaagtatgtaactggaggcttagatttgcttcagttgtcagaggggcttctttgaaggagtgacatttaacattttttcgaaaggatgctggtgagcgggtgaggaaacatgtcagacagaaggaaatgaatggataaggatctgaagcctgcattctacatagtgctcttccactccctgttatatcccataccctcccaaaacacagagcttctgaggctgttcaaagagcaaatatttttggaaatctttaaagataatttgaaaagtacaaatgattctttccagtgggatgaaggaagaatgttttaccattttacttatccaactgcttttcttgagtctgagagaagagggagagctcttttttgagggaagcaatattttagagatctatcagtagaattggagtttcttagatttataaagtattttttgttagtgtcagaagaatttgaaaagcaggggaggaatataagagcagtattatggctaacttaagactttttacaacctttgctcttatctctataataaattgtacaaccaacaatctttaaactattagtaagtcagtagtatttcctatttcattactatgtgccaccaaactatgcacatttctttggtcagaactttttaaggatatgatgtgtatacttgtataatattaatattgtataaaatgcctcatttggatttctaaatatctaataagatcttttcaagtttctaatacagcttaatcatggttttatgaaacagttataatgccacgtggagtcatttaaaagatttgtattagttataagaaaataaacagagcatatagtaaataataaaaattacagttcttaaaagtataagcactgaagtaacaaattaaccattaccctcccattttttcctttttttttttttttttttagaacaggcaacttagattagtttctgatcagtcaactatcttttcctttttgttttcttggatccctacttggggagctttttataaggcttattcccaggcaacagaattccacttaatctgttatgtgaaacagtgatccaagttccattttgccaccttgcctggaacacatgtgttccattaaccacattagctgaattcccagccatgcctgcccagaagcagacccaagcaggttgatgacatcatcccactcactccttctattttgtttcaagtttataaatatatttatcttttttgggcatgaaggacttaaatttttctctttgtataatactattttaacaaaaatattctgatatgcttcttagtttatgaattgatctaaatgaaatcatgatataaggcagttttacattttagatgcctgggataaaccagctgagatccttcacttggaggtacagggatgtggcaatttaaaaggtaatacagtgcattgattgtatcatcttcatcattcagcccaaagatcaactgagcatcctcactatccagagtctactaaacactaatagtcaagttaaagagataaattatcttttaattcaaagattttacaatttagtaaaggtttcagctatgtaatacagtggtattaggaaaaaagaaagttagtacaacgatgacgcactttttctaggaattcaaaaaatgatggttaaatacaaaatgggaaatcaagaaaggagggagatggggacagaattacagagcatctattatttgaacaaggccttgcatgagagaaaagtttttaagggaagaaaaaatggaaaagaaagtgctttctcttcctctgagataaaatgggcaaaggagaagaaagtggaggtaaaaaaaaagtatatttcaagttgaagatgagaaagtacaattctcttggatggccttgattttcttagttgagcagatgaaagatagaagtgcatggttaggcaaaatgagaaagaaaatcaaaggtagaataattagatggatgcatagctggttagatagatgggaggaaaaatatagaaaatataaaaaacaaacactttttgaataattagtccctgccaggcactatattttcacattcgctatttgaagccaaatatgaagaacacagtgatactagaatcttacaatttgtggtggagctagggaaatccacttatatcaatttgtcatcaaacttcagcaaatagaattggtgggtggtctttttaatccttaacttttgtggttgcagatatcttgagtatagtcttttccttttagaaggcaaatactgtaattttcatgtctgtctcccatgtctttctctaattacttcattacctgaatggtctcttcagaaatataattttctggtaaaaataaaattatatggagttaagtgacaactctgtgctttttgtatatgcagccactctatcatgcagatatggtagttaagttgctcagttttaatttggggcaatagactgagcagccatttaagaagctgaagagtagcttctctttttcggttttgtgtgaatcgtgggtgtaatttaaaaggcaaaaatggagaaagcctttctggtcctggatagtgaagcttacaggaataagaagagaaaaattgaatttaaaaacaacaacaacaaaacatctgtttcctcagaattagctgctactacccccttcttctttttttttttttcaatgtgtacgagaatccagaatttcttcagtgccacaactgaaacaaaaggtgtctggattagacataagtgtagactacagcaaaatgcttcaaaagatccaagtggcaccacttacataagccctcaggtacccgttaccttacaggatgaatggcatctcattgcagcatgtaagaacttagagacagcatgggagccaaacatggtttggctcctctctttacttccacaaaggtaaatcagcttctttctatactctgattctatatttggaaaaaggaggaacagggaagttcccttagaggggaaaaacatgcctaaaagatggaatccatatattcatttttcctaattttcacctgctatgaatgaagtaatgtctttattttagcaaaattatccatttggacaataaatggccaccttattatcaacgagcttgaactttcaattgatttaatatgtacagtaaactgacagttttaaattggaagataataaacttggcaagtctactcagcaatttgcctttggttggttttctatccctactcccaaattccctacacatgccccattatcattggaaataaaaatttccagagcaaaatgaagttagttagagaaaatgatggttgtttttgcatgttagtttaagcatttaatcttaattctgccataccaatcttgagtagacaggtctgtgtgtaatacaagcagagtattgccacaatgtctctaatcaccggttttttattcacattggtgaatgtcatcaacttttagatcatccaccaaaaatccttagtgtaactgcaaacctagagtttttctctattttacaaacacactaatacatgtcctcatgttttattgaatttctaatgttaaatgacccattggcatatattattatctgggatagaaaatatataactcaatgataaaaatatattttaatggcagatttacttggtattcctcttacatttcatacaaggtatgcacaaaacagaaattttaacttttctcacctgaaatatctacaatttcttatcaatctcaaagaaaatacattatgtttgaatagggttgtcctaggaatgtacagaaaccatgtatttctaatcccttaaactaggtttgttgactttttggaaaccttagacttccaatacttaaaattcatacactggtctttacttttagaaaacaaatttgagaatcaccatatatatatttttgaaaattttggaaatatgtttgcttatagcaaggtaggaaaatagattgcttatagcataaacatcgttgacatttattttgaagaaaaaaagcaaactaagtaatttcacagacagaacaaagccaggctttcaaaaaaacttatgtgctctacatatactacagctacatgaaagtaacttgtaataagttttaatattcacatgtcaaatggataaaataattaaaaattctcaaaatattaaattattaatttatgaattaccttataagtgcttatttaatgggaaaagaccagcactttgaacctagagctttggcccatgttcaatttaaatgataacctgtgattctaaactagagggtttaacatccccagtagaaaggtcaatgggaaatgtaggaaatgagattttttttcagtcaccctaaggaattcttaactaccttgcttgggtataagataagtgtctgacaaggaaagaattgtcccctcaaaaaatccatctttattagcatccccgttgactggaacttaattaaatttatttatacttgctggacacaactgaacatctaagattccttccagctctgaaatactcctcaacagttacttaggaagaattaaactgatgcagttactctagtagaatcagatatacttgtggtttatatgtgcaggaatacacattaaaacacacacacacacacacacacacacacacacacacacacacccttcaactttaacagcatcttttctgtaaaggaagtcagtaaaaggctgctctatttcagaatcaatctaaagagagttatgcaagtaaaaatggtcttttcataacattttttcaggaagatgatccctatatcggaccccaataatgaaattaaactacattttagtacagcaattacaaaacatcttttttctttatagaagcaatgcatgctttttaaaataaaatagtaatacatagatagccaatatatacagtgaatgtaagttgagttcttcaatgccccatgatctgctccttcttcacatcttatcttcctctctggtggaaccccggagacttctttgttaaacccaaggcttcacataacacagtggaaaacttattgctataaattagacataactaacctcggttaatagagaataagcaattgaagtagattgtgccagtcctggacaatcagtagtggtagaattgaagtaaatttaaaacttcataccattccctcaaggattaaaattcaatgaaaaaaaagtaggccaaagaaaacacttctataaattatattttgtccttgaggggtatttttgtattgtattctaggctacatgctgttacatcattaaaggaaactttgtttattctttctaactagaacatttatcccagaagccagcaagcacctcaatattaggtcttataatatgataaagtttcacctccttttatcaatgtagagaagtagtttcttatcttccctggtgacattctggcttttggcatccttcttgaatatagggtataaagtctccttttgatttgaagaacttgtgccttctgatatatccctgcaagtttgggaccatatttggtatgcattgtgtgtaagctttgcttagtgaagcacagtttgtccataaacgaggctcatccttaccagacaaactctgggattataaatacacataatactcttagcccttagtaatagaggtcaaaagataatcactgggtgggataaaatgtgaaggtataatccagaatagtcttaaaagaaggttcttagaatagttgcagataatatacattgtagtagaagggtgtggaaaataaaattaagaaagaaagtaataataaaatagagaaaatggtgaatggaagtcaatgataaggtaaacatatctggaaattaattcatgtcaaattttgtgtatatataatattttcccctcattacaaaattatgccatatacctttctaaaaagagaaaataatataatgtaatatattgtaaaactcattgcatattttgtcctgatgctattaaaaagtatttcccacctaaagtttatgccacatgcattttatactatgagaaactgcatttgaatataaatttatgcacttttatctcaatgtctggatttcaacctcttgcaaattagcaattaaattgaactagatgcactcgtgatgtgatttaaatgccatttgactctttcagagcactcataaatatgattttattttcatggattataatgataaatcccccaaatgtagacttattttttatttcttcaagtaacaaaggaatatagaatttagaattatgaataatggagatttattcttaaagtattcttttaattttacattcattatattttgtgtatgtgagagagttatacttcacactcagaaaaagtgatatagctactagttaatgtggtagtgtgattttactagttactttacctgagctagccaaacattactcagttttcatattttcttctgcatagtttgaacgtgacagctctcttttttaattgcattagctttgacagtcataaggagatgaaagcattttaaatgataccataatgaaaaatacagaggtttgtttgctttttctattaggtatggttgagcataaaaactcatattttcagttttgttttgatgcattggtacttcacttccttgcatgaactgacggaactgtggaagagtattatgtctacacctgattatgagtatcggcaccagacaattagtaaagcttcattctattacagttcatgcctgaaacagtccccagcactcactggttgactaagtgaacctttcaaaaacagaagttcattacaaagatgaaaaacatttaaaagctaatcttagttttaaaactggccggggacagtggttcatgtctgtaatcccactactttgagaggcaaagccaggaggattgcttgaggctaggtgttcaagatcagccttgacaaaacagtgagaccccagctatattaaaaaataaaataaaattagctgagtctggtggcacgcaactgtagacttagctacttaggaggctaaggcaggaggattgcttgggcccaggagttcaaatttgcaatgagctatgatcatatgatcaatccacggcacttcagcctgggtgacagagaaaggcattgtctctgaaataaataaataaaaataaaaaagaaccttagtctacatatccctacaagagatgaatattatcattccctttatactaatttttgggaacaattttttgtgtggacggcattggtgaaaaaacacttgtggctacattttacattggttctttagaatcatagcaaataaattctaatagtatgcaaacaaaacgaaaacaaagaagtagtaatcctttattaatcacatagttttgctttagtaatttctatcatgttttatttgcaagcataatgcagttatatctttgatctttttaatagtaagttcgctttctgtaaaagtaatgaaaatttaactgccttttcaattcttattaggtgtatgatatttaatttaaacatataggattaattaaatatatactaagcctattaatgacatcctattaaacactattagcttcctgtattacaattaattagatgtatactaattattaagacaataatatataagtatatagttatatttaattatattaatcaatttatggaaatttaaatttatgaatttatattttaatatcttcattttttaaactagtaattatagatttgtaacatttgtaatatgtgtaggtaatcaacataaatacaatttctataacttttctctgtttctaacagatttaaattttttcatttgatttacattcatttttctgaaatagtagcattaatttctcttttttcctgagcttagactcctcaatacccctatttatagattccaagtccataacgtgttaccttggaaactatttaaagagcatcgtctctttactatttgtttttatcggatcataaaactgccttttttctccttcagctactgcttcaaataactcagtactgtgagaactgataagctcagggcttatgccagtattatagtgtgtgtgtgtgtgtgtgtgtgtgtgtgtgtgtgtgtgcgcgcgcacatgcaagagcattctcatgagtatgtgtagatatatgtgtgtttatgttttgtgagtgactactaaaaattaatcattatgtcttatacatttcctcacaccattatgattttgggggactacctgtgtgttgaaaaactggtttttgaaatgacttcttgtatgaatagtctaatatctgaatctgtagtatgtagtattttaccagtacaagatatatagcattgtaatactttatctcaggcagtctgaggttatttttagctctaattttctctataaaaggcagcacaatacagtgacaaagaatattagctctggggctgcactgcctaaattgaattctggttcaccacatactagttgtttgaccttggacaagctacttaatgctctgtgacttatctgtaaaatggggttaataaaagtgcttgcctcataggcttatcagtcaattcttgtaagtacctagaatacgtggttaatggatgccaggggtctaaccaactggcttgaaaaagattgatcttaaactttaattaatgcctgtggatatacactcctgatgatctaaagagaaatttaatttacatcaacaaattcacagtctgggtgttaaatgtgaataaaatcaaatagttaactgcataaatactatagatttcaagatttatttttcagtccaaattttgaagtcaaagtataatgaatttataccagaccctcaggaagttattagcatagtgtctggcatatgataaagtctcaataaagagtgaaattaataatcattgtgtgattgagactcactagcactagtaattaggatgataatatcacatggaggaaaactatcagagtccatacttgttatttttgtcaatcttgttctattatgaatcagtaagagcaacttatggaatgaccattcatgctttagcatgtgcatcttaacatctatagaatctttccatgatatgttttgttgtaaataaatatttattgacataatttattatttacttgtaataaggcatttagtatgcatatttactattgaaatgaagcaacattagggttttaaaatgttcctttataccagaccctcaggaggttattaattatttttggatatccttgcaaatagtccacttcacagtaattcacactggttttgatattttaagattcttactgtacgaaaggtatttattaattaagttagagtctttgagtatctcatctgcattatggattcagatatgcttgcccggataaagcattagatttttaaattcttcatgtcacttaggacatttttacttgatatcactttttaaggtgaattcatttgtaggaaaaaaagcaaatgaaaagcagaaaaattagttaattagcttgggattagccatggattttgtccatatgagaaaattcagtgaccttaagtaatgatttattttataagaactcacagacctttatttattactatgttacattgtaaaaatgcttcacctgagccttggtttcttcaatacaccatggagctaaaaagttttattttgcaggattctgtatatattgcagttttattataaagcacacttaaagaaggctaataaactcctcattgatatgcaataaatattagtttctctatttcctttgtggaaaccatgaaattatatatatatataatttttgaacactttcatcaaattaatttttaaaagcactcatttactaaatatgactacagtggaaagaaggacttaatagtaatttagattatgcttcatcaatcattagaggaaatgtgagattggatcaaagaaacaagtcatcttccaagaatagttgctctgaaactgtcattttttatttcagtgtgaatattacattgagtaattgcagtatattttgttctgtgtggcccctaacatttgcattccctcttattgggaggaaagatttattgctgccaccctaatagtacagtgagtctttattcagtgagtgttcactgtacaccaggcactgtgttagccactttacaggcattttttcttacaattcttacaaccaacttgcaatgtgagcattcctattatccacattcacatttaagcataaagaagttaaggtttatgggatgtaaagacttgcccaaagtcatacagatttaaaatgccagacccagtatttgaactcaggccttatttcagagcctctagtccatgcctctatgtactatatctctgttcattttctcactccaatttccacttaatattttgttctttgaaactaatgaatgaacctcatcacttgtaactgcacactttgaagcctgaatatctctggggcaggaaatgaaaacttagcatgagagagacagaacatgctatgaaaatgtaagtctgtgtgtcatgtcaggcaacttcatgagcagcaattccttcaaaattcttattctaatttcattaagggaagtgaaagggaggattttgagggtgcttctagttttcagctggtgccttagtgtcttgttttggaaatcactttcttatgtctaaggaagtaaataatgaaaaattacaatggacataaataataagttaataggatcattgtggggatacttatttcattgtcattaatttcttaatttttttgaccttccttagagactatgtcataaaaaggaacattttaaaaccctaatgttgcttcatttcaatagtaaaggtgcatactaaatgccttattacaagtaaataataaattacatcaataaatatttatttaccacaaaagatatcatggaaagattctatagatggaagatgcacatgctaaagcatgaatggtcattttccataagctgctcttactgattcataatagaacaagctggacaaaaataacaagtgtggattctgatagttttcctccatgtgatactatcatcccagtttctaatgctagtgagtctcaatcacacaatgattattaatttcactctttattgagactttatcgtatgccagacactatgataaatagcttacacataaattatttttttcagctcttcattcccatttcagaagtgaggaaatttaagcttgaagaagtttagtaacttgttcagtgacaggcaagtaatagtatgaagttggaatgtctgactccaaagcctagtatcttatttgctatgtttttttttttacaatttgttgcatattttcttttgttttgtaaataataatattgaaaaatatgaaacacaaataaatagaagtgtttgttgtatagctttttataagactaggtttttatgttagcaaaataaatataatattaaaaagaaaatattttacacctttaatgtaccaatggaaaattctttcaaaaaaattcagaaaattatagccaattgccccctaattatctgtggtgtttaattcaatgcctaatctattatctgtgaaatagaaaaaacaaaaatactttcatattcataattagactttagtactcagtagtaagaaaaaagaaaatattgcatatatgattctgttgttgttggtagcagcatgcaaatttctgcataccttgtttataactgacattaaaagttctatgttttcctcttgcttctttagcaaccatatcaacatgcttttggggaataagaaatgccaagttatatcatgtatgacagagttttcctggaaatatttgtacatgtgaagcatactatatatgtcatggggaaaaagaggatatatgtaaatgtatagctttacgtttctggtactgagcttggaaaaatggtagaagttttcagggatgccatttagtgttggattgctgcacagtgtatttgcattatttgcaataactgaagtatttagtatttgtgcaggcatccttgtatttaatattgttaatatttatgttaattaagagagaactataaagaagcagatcagtcagttgcagaaatcatctgtaaacagcttttctacaaaggttcaggatgttgctcccaaggaaagacaccgttacatgacctctgattaatctcttccctcttatttgatttctttgaataaatagattgctctacgttctcaaagtaaaaagggtgatatattctaatattgctgtaccattttaaattgcatagataaaagcctatttagtggggcataagatcaccataagcctcttggcagttttcagcgaattcatacatatcaaaagggactcaaagaaaaataacaaagagcaaaaataatgagcccgtcaaagcaaatgcttaatgcagctccactttggtattaatcagactgtatgtgggtgagggtcaaaccaaccgaggtcaatagagaggattttggtaaagacgaaaaaagaactaagctagtgatttcagacagattgaattttttttaaagtgaaataggaaggtcacaaaatcagattcagtttgcagaagcacagtgggcaagttttaatgacttctcagtagagctttttaagagaggcacttgagtttgaactatctaaactaaacttttaaaaaatcaacaggaaaagggaaggaatatttgtaaagattaaataaacttataaaacttgcttttattgaagaatttcactactttggaagattaaagtagcttccttaaaaaggagattttaaatgtgtgcagattttatttaacacataatttagatattgctttatgtcacagaagagcagtatgtgcatatgtgtgcacatataattgtaaagatgtctttataagatactttccataattaaatataggtgatttgaatatttataagactttaaaaatgtttctgtaaattgtgtattctgagcttgctaaatccctctttgacaaatcctgaatgggagagagccaataacattcttttcctctatcaaaccattcttactctacatattcttcttctgctttctagcagaagaagaaaaaaaaagaatgaggaggaataagaagaggaggaggaaggaaagaagaacagaaacacaaaatcttactgtgtcattacatgacctatgattaatctcttccatcttatttacattttggataaataggtgactcttttctcaaagtaaaaaggaagatatatttacttacttgccaattatcttattgaagtgttaaagttttatttttctctggattattttaagatgtacttactattaattcattttattgaaagttaacatggtaaactatatttccaggactatagaagattcaaagatgataaaatatgtatggccttttcttcacaggctttaaaatctaatgacaatttcataagcaaccataaatttgaacatttttgatatctgtaacaatatagtactttatgtaaatggttatagcaaaaataatgccatagttctatgaggaaagaaattttaaaattcctgattcttctcctttagaaatatgtacatatttatctatctatgcatagatactatttcttgaaatatagttaaatctattatacttccatcatattaggctatatatgcatgcttctatatatatattaatatatatgttaacatacagaataaaaataaatatatatgttctactagcaaataatgtatttgctctattatttaatataaataggtacattgatatatattatacacacatatattaatatacattgtatacaaatatgaatatatacattataaacaaatgtatatatctatatatacattacatacaatgtatatacatacatatatacaaatgtgtatataaatatatacattatatacagatatatacattaatatacattatatacaaatacatacattataaatgaatgtatacatatatacattctactggcaaatattacattctgtccattcataatgccacccattacttcactcaagcatcctagattattgtataattggactttatgccaatagtcattcctaatctctccatgatacgaagttcaacatctgcttttttaggttccaaatgataggacctttaactacatttctagcctcattttatcttcctttgtatttttagtacataatgttatacatagcagtgttcattaaatgaaataattcataacaaatgaaatgataaatctttttcatgcatatgtatggttttcaagcaataatagtgaataatttgtttttctcttgctcctgaattataaaaattatggtagaaatgaactagcattttaaatactttttttatatcacaaaaatgactgaattcttattaaattatgtgatttttaaactcacaataatcttggaaattagacacagcaagagttagtattctgacttataaaggggaaattttgtctaagatagataaaggggtttgtgcaggatttctcccctagcaaatgatgaactagcactggaatttaggattcctgaccatctgtgctttgtctttttccattagagctaggatgaacatatgccccattttttccagaaaatttcacttaatacatagcatcttgaattgataattaattgtgccctatttcactctcctgtcctggtttaaacaataaattatagggcaaccataactatagctcacagtaagaaataagagaaaaatagaagtaggctatacccaggataagtaattttgatatcaaggttgatcagatcatattaacttgttaccatcaaaatatgtcattttaatgattcacaagttggaaaacttaccttgtgaatattgatcactactgtgacatagattcttattattttatcttatttgaaaactactaaattgtctatgaatgtttctgagtgttgtctacacaaatttaagacactacactatgtgaaaatgaacccatggtagttccaaactactcaggtttgacatgccagccatcacatgagatgagaacagagagtaacttgcttgatggaaactgagtcagattgggtgcttaatcagccactgattaatcagaatgcaggtctgactaggagaaccacaaatcaaaatgggcattaggctgtgttccctattaaattaataactgactataaagccaagtaacatttcaaatttcatttgattccatagatttaaaattggtggtatgacaactgaacgtattttaaaacatgccttttttttgaaggcaatgtatttctctgcagaaataaactcttgacattaatgatattgactcttttatccagtttcaaaactctattttgtcaagaaagttataattattgatactacttgacagcaaagagcagactgctttaaatgctcatcaacgtcttttcaaaatagatcattattcttctaatttatttccaaataagaaaagagctgacagaggttgagatttgttcaaatatttcaatcctagagtatgtatatataatacatatgcgagatgtgatggggtgtgtatgtgtgtgtgcatttatgtgtgtgaatggcacataatctttccaaattacctggagaaaattgtatctgacaatcctattatagaatgcaaaagacaggaatgaaaaatctatggtcatacctattcacaaaattgtttaagtctagtttaaacaacatactaacatcactattatttctatataatcccaataactatttgggcttaaaatttatacaattctatttagataaattcatagtatgctagaaatgaagatatttcaaggagaatataagaacggcaaggtctttgtagcatcactgcatgtgactggactaaaaatccaccgtgagcttgctgagtaaattgtttcagatttgatcccttcaagtgttattgaagattctcccacatataataccttaatgttactcaattcattgttctaaggttgttctaaaattgttctaaatttctggctatgccgaagttcatttctaaaataaaaggtaatgcaggcagttaacattttgataaatactacttcatacttttgatctcatttcctgttttttattacattagattttctatcaaaagaggccattatagtttagggataaatgcttgacaacagagtgtgtatgtcaggatatttcaaacggtgaagaaataatgtttttaactactttaattatgcttctttctttcctattggatttgataatcatggccaaattattcattaattacttttacagataaccaaaaaaatgccaaaaagtgctgtttctactaaaatctcttagcaggaggatcttcatgtttggattgtgcacaaaggtattttcatttgttcagagcacttaaacaaaatggacaaaatgtgtattttttagaaaattacccatatatgacagagcatcaccagtgacaaacacgttattgctgaagagtagacgtattttgcatctgcttatgtcttaatctgatgtactttattcaagaagcaggaagtgagggacagagtcctgtagttggccttaaaatcctgccccacaggtctgtgccccttacacttactcaccaaggcttggccgtgggtttgttatattgaatcactacttagaaacttagtttcctccaccattggccaattttcatgaatgttgtcaatgatagaatttctcgatttttcagatatctcaaatggctttaagccctggatgtaactcaattaaaaatattactttcagttatgttgttatctgttcacatttgagctgctgataacatctgttatttgagttgttaaaaaataattatttgttgatactcttttccatgctattttacagaaacgtgtaacttgttaaaagtgttagttctatcttttttctctgtaaaaagtagaattctaagaaaaaaattacaataaccaactaaggtaaagaataattaagtttgcttttgtttcttttatttataggtatagtgagttggattaatctcactcctaagttgcactattattagtctatgcaaggtctttcttttttatttgaaaaatagttttaaaaattttaattattaccttctcagccccattgagacccatgcccccactatctttacgtaatgaaccactctaacgtacattagtgtatgtcctttatcatggttatatcctcaaagaatatatgctggtacttttaatatgcatctttggtatttttaaattttaaatgtatatatttgttttagttttcactcaatgtgattattaattgttaattgtttctaatccacaagttttatacagtacctgctcatcacatagtatttatttcctagtgatggaaacttcattgacttcaacttcctgctgtcagaaactatcctttaataagagtcaccacacagtgttaattcattcctaatcaatttgtggtgccagttaatgtgtcaaagtatctgtctgtctatatttgtctattatctatcatctatatatcatctacattgatctgttttccaaagtcttaattacattctattgattttttttctatttagctccacttatttttactaaaaattttagtaggatatttaatattgactaattcctcttttttcttctttttcaaaatttgctcttctatggaagtttattatgatatgtaaactttggaatacatttgccaagtaactaaaaaaatctgctttatttttagctttcagatttattgagataaagttgacatacaataaacttcacaagtttaaaatgtaaatttgaaatttttaacatacgtatacatcagcgagaaaataccacagtgaagatagtgagcatatctatccactcccaaaagcttccttgtatcccttggtaatatggaccacacaccttttctcaatactgctcctaatcataggcaactactgatctgctttttgtcagtacagattagtttgcattttctaaaattttatataaatcaaattgtatagtgagccacaatttaaaacttatgaattgttagtttctgaaattttccatttagtatttgtggaccacagttgactgcaggtaaccatgtaacagcagataaaggaacattactgtgtgtactcaatttgtgctcctttttgtctttcttttttcattttgcttaaatattttagatttatctatgctactttatcttagtctatgacttgtcttttgatcctcttaaaagtggctctggaatagcggaatcactcaagtttaatgaaacctgatttatgtagggtttttttgctgtttcggattgtgtttttgttgtcttatttaggaaatatttgccatattcaaacccacaacaatttcctgctatattttcttctagaagttttatagggttaggcttaaaaatggttctaagattcattttgagttaattttttgtacacgataaaggtatagatgaaagtttttgcttaattttccttaatgtataatgttacatgacagtatttattttgaaaagattatcctttcttcactgaatttcctttgcatttagtttaaatcacttgagcgtatatgtgtgagtttttcttttttcttttctttttttttttttttttttgagttggagtctcgttctgtctcctaggctggagtgcagtggcatgatcttggctcactgcaacctccgcctccttggttgaagcgattctcctgcctcagcttcccaagtagttgggattacaggcgtgtgccaccacacctggctaactttggtgtttttagtagagactaggtttcaccatgtttgccaggctggtctcaaactcctgacctcaggtgatccgcctgcctcagcctcccaaagtggggtttttctttaatctgctgcatttttctataacaatactacactgtcttgttgactgtaggtttgtaataattattgaagtcaggtagtatatatccttcaactttttttctttttcaaaactgttttcactattctagatattttgcatttctatgtaaactttagagtcagcaagccaaattctataaaaatacttgctgaaaatttcattggaatgtcattgaatttatagatcatttggggaataattgacatcttaaaaattgataattttactatataaacagactgtatttcatcattaatgtttaatttctcttagtaatacttttttagttttcagtttccagatcttacacaaattttccagctatcctcaagtatttcataattttgatgctattgtaaatggtattttcaaaaacttcacttttgtagaaacacaattgattgttaatagtgatcttgtatcctgagacatgtgttaagctctcttattagttcaagaagatttttcttttttttgtagagtaatatgttgtctatggaaaaaaaaggttttcctcttccccaccaatccaaatgactatataagttttttgtgccttactgtattgactggaaacttgactaggaatagtaagaaaagatgtattttccttttttcctatcaaaggggaaaacattcatttttacataattaagtatattagcttcaggttgttataggtaacttatatcgggttggggaattttcctttcttctttactgaaatattcttttttagtgttttaaaatcaggaacaatagctcgatttatcttatactttttagaaatctattgggatgatcatttgtgtatatgatgaatgatattcttttttattctaatgttaaagcaaccttgtattcctgagataaactcaaattggtcttttttttgtatagtgttgaatctacttgttaacattttctgaaaaccttttacatctatgttcatgagggatattggtctaaagtttgcttctgttgtttgctagttctgttttcggttatgtttgttttatatcatgttaagaatattctatcctcaattttctggaatagtttatttaaattttttttaatgtttggtagaatttattatgatactgtgatatcacctgggcatagagttttctttgttgaaggctttttttttttttttttgatacggagggtacacatgcaggtctgttacatggaaatattgcttgaagctgaagtttagggtaatggtcctatcacctgggtagtgagcatagtacccaactacctgttggtactatgcctcctccctacctcacccctctggtagtccacagtgcctattgttcccatatttacatccaggggtgctcaatggttagttttcacttagaagtaagaacatgaggtatttggttttctgtttttaatgacaagttctgtttttcataactacaggattacttaggttatccatattatttttagtgagctttggtaatttgtgtctttcaaagtatttgtccatttatctatgctgttgaacttattggtttaatgttttttacaatgttgccttattagtatttttaaaaatatatctgtaaaatctacaatggtgtcacttctcgcattcctgctactggtaatttgtgtttctctcttttgtttctgatcaatctagtttaagcctgataaattttactgacattttgaaagagtcagatttagattttcattgattttctctatatgtctgttttctagttaatcattttccactataatctatattatgtcctttctctgcttactgttggtttcatttgtttttctttttctaattcttttttttctgatatcctgacattctttacctcatattatttccacttccaataaaatatataattgagctgaattttgaaaaaatatagatacttcaggatacttctaaatagtgagtgagtgaaagtcattatttgccataacataacataacattcaattagttaatcaaaaacccaaatgcccgctaggtgcccaacactgttccaggcattcttcttctttatttttttttttttttcattttactttaagttccgggatacatgtgcagaacgtgcatgtttgttacacaggtatacatgtgccatggtggtttgctgaacctatcaacctgtcatctaggttttaagcaccacatgcattaggtatttgtcccaatgctctccctctccttgttccccaccccccgacaggccccagtatgtgatgttcccctccctgtgtatatgtgttctcattgctcaactcccgcttatgaatgagaacatgcggtgtttggttttctgttcctctcttagtttgctgagaatgaaggtttccagcttcatccatgtccctgcaaaggacatgaactcattcttttttatgactacatagtattccatggtttatatgtgccacattttctttatccagtctatcattgatgggcatttgggttggttccaagtctttgccattgaatacttaagtggaagttgaagtactggatttgaatcttttcttatcttttccagtctggtcgtgtagtgctactgcttcacatagtgttactactgtacctaaaactgatatattttatatattttattttcattttcattcagatcagaatgcttttaaatttctcttttgattttttccttcacttgttatatgaaattgtgctattttctaagtaatcaatgattttctagctatctttctgttaatttgattgctaatttaattttatcagaaattaatttcaaagtttttcgactctttacttacaaggcttaatagttttaatatattttattaaaatgcatataagtttgttgagagtggatacctaaaaaaaagtgaacttatcttggaatgctattaatgtctatctccttcaggttttgtctaagccatttaaaagttttaaagctttcttctttattcctagatatttgataatttatattattatttatatgatactagccctattgatatttgattattactatttaggggaattattttgattttattggtctaccttctatcacaatgagcttgattttttaagctaaatgcctggattatgtgtgtgtgtatgtatgtgtgtgtatatatgtgtgtgtgtgtgtatatatatacatactatatatattatatatgtatgtagtatatgtgcatgtatatattatgtatatatttatgttatatatatgtatatatgtatattatacatattagcatatacatacacagtatatacacatatatgtatatataattatatacacatatgtgtgtatgtatggatatatgtttttagctatttttattgcattttaattctatttaatgagtcactgagaacatattatctgctcttgagtgttgcaatttattaatgctttcattgtattctttacaaggtctatttttgttaagtttacttatgctataaaattatttttggttattttgggtaatgtacattaacatattgaatacaataatcaaatatttgtacacttctttattgattccttcataattattcagtcactgaaagaacaatgataaaaaaaactctcattacaatcccacctattatcacagatgtattcatttttacctataatttcatcagttgttatttataaatatataaaaaggctacatttttagatatatatatagatttatacttgttatattctattcatctatgtttaaatattgcatggaatttgactttatcctttatgatttgtatacttaagttctatttttaattatacagtggcttgaataggattctttgattttaattgtcttatttaaattgcaatgcttttatttttaaactttctttgttcttctgattgtatctcttatagatttcagaaacctagaatattttttcttatccaatctgaagttagtgccttgatataagtttaacttagttgtattagctttaatgacatttgtgttatgatttactacagcttttccattttatattcatttgtttatcacaattccatttatcctatgtttattcatatatatgtatatttatatatgggataaatggaattgcacacatatacatatatgtgtgaataaacatgggacaaatggaatgcgagtgcatatatacacgcactcatgcttatgtttctattttgctatttacttcctggaatcatcttggaatcctctggctcactgatatcacaacacccaaaacacatatcatattgatattatataaatttcttgattgtaataaacatactacaatcattttaaaactttgtttcttatttatgttgatggcattaatctttaacaaataatttagtgattattgttattcatatcccaaatatatgacatattgaaattattttttctttctatagtatattgtttattaacaaaagctgtccttgcatgacaaaggctgttttattttgtcattgcatatatctgccagtttgctggaaaaaattagactacaatattttctgtcaactattcaacaatattattcctttgacttctcacatctagagttgctgttgtgaaaaccaataagtatctaataattgttccttttaattgatataatttcctttttaagagaattcagaactttctgtatagtgtaactagaagttaattttaaaaattctatagtgcttagcagtctgaaaactttataaatctgatttataatataatcatattgactaggtattaaagttttatttttgttaactatattttcttttttctctcttattaattccatctatgtttctgtagatttgtattcatgtaagctttctttaattttaagtgcacatttatttctttcattatttcaactaccatattttatcatctagtatcaccaatgtattttatatttgcatttatatttgttcatactccgtttttgagttttatttatttgattatatttgtatgcttattttatattacattcatatttttcattaattctaatttgctactcttgttcagtatgctgtcctttatagttctttatgtcccttatatatccattttttttcctgtaagttcatttttttttttttttggaaccattatctacctcagatcataataacaaactgaggggagggagaaaaagactagtttctggtttataccttataaagcttttaggatgttagagagtgaggtaggggatgcctcaaagtacaaatctactgcttttatgatctggtctcatttgtccacacacctccttatattaaaatataacatgtccttttgaaaatgtttctatacctccacttaaggcctgcttaattctaagatttatgtttcaaagttaaaattactaaatccatacaatgaccatatgatcacagagggtcagaagcaattcaattcttgggagtgaaagcatcatatatacctgttgctcatccttcattccgtctgccctctagtgcaacattgtttttgttctcacttctcgatacaaagatcagctaatgttatttcagctccttagaatcagagtataatgtgcctactatgaaggagagaaatgtatttatatagaatagcttttcacattatattgttatagttaaactgcccccccaccacctttctccagtgcattttttttttctttctttctttcttttgtccacagcaggatctattccttttgcatttccaggaaattattaagattttaatattaatttctggcataaaaatattttttaatttgtgtaggtggcaggagaacagtagcctatatttattaatactcttgtcaagaaatagcagcttctcatgtacttctttttacatattttgttactcctgaatttttaatcttttggtttatgtttgtactgactagaatagaaggataatatttcatatgtgcagtatatatattatgtatatttatataagtatatatacacaattccctctaagatatgtacatatatatgtgtatagacataatacacacatacaatcatataatcttataaatattcacaatatgagactctgtgaaagaagttctttaaaatgctgatcttcaaataaaagattaatatataatctataagttgtgatctttattttggctatatatttgggacttcttatttataaattagcataattttattgatattatacaatttaagtgagtaaatgccagagtccaatcattgagctcgggatctatgcctaagtgtgattcttggccaagaagaacaattgatggttgactcagtcttatgcataaccctgagggaataaatctctttattggccttcctatataaatctttccatttatataacctttccataaaaataagctttatctttggtatattaaacacttatcttgttcattaattttttcattgaatcattgtttggaatgcttaaagcataacatttagtccagtaaatttgcttttacgccaaacctcaaacgtaatcagtgaaaatatattttatttcttatccaagtgtattatattactttggtatggctactataacagaatattatagattgggtaactgaaacaatagatattaagtttctgtcagttttggaggctggaagttcaagatcaaggtgctgacagggttggattcttctaaagcctctctctttggccaccttctctgtggatgcatgtggtctctcttctgcatgcacacgtgtccctagtgtctcatgtgtgtcctgatttcctcttataaagattcaagcttagttagattaaggtgcactgcgatggccttattttaacttaattacctgtttaaaggcatctatctccaaatacaagcacattctcaggtattgagggttaggacgtcaacaaatgaatttgagggggatacaatttagcccatagcaccaagaattctgctcagtaaatatttttcataacattagtgcagaaaaaaatataacattgtgtaataaaaaataaatactttcaaaaattatttaattctgtagaatagaatcccagagcaattcaatgaaaatgaaggaggctatcttttatttcttggtacaatagttaggaaatgttagtagaaagggtatttgatttgagaaaagatgataaaccttttatatatatatatatatatatattttttttttttttgagacatacagtggagtacagtggtgtgatgatagctcattgcagcctggatctcccaggcataagcaattctgtcatctcaacctcttgagtagctggactacaggcatacacctccactcctggctaatttttgtattttttatagagacagggtttcgccatgttgcccaagctggttccaaacaactgggctcaagtgattctcctgccttggcctcccaaagtgctgagattataggtgtgagtcattgcgcctggtccagcatactgtcatactgagataatgatccttattaagccccttgacccctacaagccctgtcattttttttcatggcatgtttatggaataatgttttgggagatcaaatgaattatatatttgcaagttctaatataataaaatcgcaaataatcatatcttattgtttgatattactatcataattatcatcatgttcgtgtaacatacatttgacaaaaaataaatgcatattttctgggtaattttaaatggaaataattaatattaattttgttgaagaactttatgagacccttttcagtaatttagaaatactcctaattctgtgaaaattaatgtatatttttaagaacctattatgtataaaaagctagattgggtgttgtgcatgatacaattgtaaacaaaacgtattccagtttttaagacaattgtttccagtaacagtaatataccaaattgaatatggatggttccttaaagataactctacatgaagtgtggttgtagcccatgagagtttgtagaaagtcatgattgtaactgttttgtgcagagtgagaagataagaaaatacattttgagaaggtaattgaaaaggagagaaatgggaggaaatgagacctatgtaagaaaattcatagtgtgagtttgagtgagaagtaattaggtcctgaaataaagtaaaatttgaaaactggataaaggaaagataaatgacataaatatttaaatgcagggtttgcaagctgttagaatattcttttcctgccaccttcactttgtgacagtactcattctaccttgcatcatcagcaataatagttgtattcttcttttgatcctgtatttatggaggtggcaatactacattttgttttcctcccaccaaatagcatgagaacaattacataaaccatttgtattaagcttgaagaattgaattgcattgaaacaatgcaattgttgaaacagatggaatcaaaaattttcatattagatgatagtggtggaggaaagtaaaaaagggtaatgccatttatataaatacaaattgcaaaaaagaaagttttcttaggaaagaggtttaattcactctgggctgggtctagtttaagaggctgggattaagtagatggcaatgttaaataaattattggacattttattgtcccttaggggaatacctctatccttcctaaatgtaggaaaaaatctccctacatttgaagtataagtaagggaaaggggttccattaacacattattattctagtttttaaactgatggtcttaccaaggtgaagttgataagaaaaggcaatggtagaatattaagaaaatcaaaagttagaaggcagggaaaaggaaaaacaacaacaacaacaacaaaattttaaagtagattagaaaggtggaaccagaaaagtaaagtgttttatgccaaggagatgggcagatgtcatgaagtctagctaaagaatgtgaggaaaccattggtctgtgactttaaagcttcagtgtacaaatagaaaggaacaacttgaaaggtcaagatagaaaaagacaagaaagagaaagcatgctttttagaaagaggacttggaagacacaaaacagcacatgaccaggcaacagaacagagagggtaaaaacagaatggagtagttttgagaatttacaagataggcataagctgtttgatggaaccaattttaatggcttcagcaaagttgaaagcaatgtcgcctgatgacagagaactagtaacaaagtatttcaatgataaagaaaagtaaaaaatattttatatggacacaccaagaggtaagcacaaattacaattaacaaagaagactcgtgtgacccatcattaataataaactctgggaatttaaagaattgaattctagaaggaattttgcctctaaaacatgagatgctaacactaagtgaacaatttaaggcttcacttttgtcttttccaactgtaaaatattttctaacagtatttatctgatcgaaataattttatgattcctaatgaatccatagcaaactcctagtgaatcatagtgactctcactgaaagtgagtgcttcaggactttgaaaaataatagttactatacagccatttataaccagaaccatgctattataatataaatctcaaggaaaaaacttcaaaatgttgtgttatacatattttgtaaataaataatatgtaatatacatgtatacacacatgtccatagttaaattatgtttaaagaacaaactttttagtgtcgttaagtaacagaagaacagatttagatcaaattacttaaaattaacatcaaaaagtattattggtataagttaattgaaataaatttgtacaaccagttattttgagaatgtatatctaagtatttattagattgttttttattatggttactagatggtttatgtagatatgtactttatgttttctgaacacataaattgaaaaataattgtcaggtacaactaatgaatccttttgattttgcattttgtggttctgtatcacagacttacttttgtttgctccattttgaatggtgccttactttattattattacaatgattatttcttgttgggcttttatataaatttcaagtttattcagtttctacttctagttgtttaaatttaagagattatttgcatttcctgaaactatagctctttaattctgtaacattacttgtcctggattattaaaatgcaggttcatatgacttccgttaaggttcttcatgcatctccacttctctctctgtgaaataccttcaacagaaactgttaaaaaggaagaacttctctttccccaagtggctgcagtaaagggaagtaatagactgacaaggcttttagatgtaagaaaatgtcttctggattaattactccctaaaactttatatacaaaaagtctttgatactctaagtttccttatcaaactaatgagtttactcttgcctatacctgtttccccatccttgattttacttttccaaactcttacggtgtaaactgcctaattttgctatgtatgagatacatggacacactcaacaactatactatattaggtagaaaatcatattattgtgtgtgagatgcatggtaaattgagtgtatgcagtcttctgggaaaaaccattaataagtattaccttgttaaaagattttagaaaccatgaaatacaaaagcagggcatgtgaatgtatttatgcttttaatgcttgagtgcaatatgtaactacagctttatgaaaacttaagcaacatgtatatatatacatatataaataataaactttattttagagcattttaaagttcacagcaatattgaacagaaagtagagaaagttacagtatactcaccagtcaacacacatgcgcaatctctcccactatcaatatgctgcaccagaatggttatatttgttactattgatggacttaacactggcacatgattatcacccaatgtccatagtttatattgtttcactcttgatattgtattttttgggttttgaaaaatgtctaatgatatttatctaccattatagtgtaatgcaaaataatttcactgccctaatcctgtgttctccctattcatcccgccctcctttcctcctcctcctcctccccccacttcttctttttcttttttcttttcttttgagacagagtctcactctgtcgcccaggctgaagtgcaatggtgcaatctaggctcactgcaacctccgcctcctgaattcaagcgattcttctgcctcagcctccccagtagctgggactacagtcatgtgccaccatgcccagctaatttttttgtattttttagtagaggctgggtttcaccatgttagccaggatggtcccgatctcctgacctcatgattctcccctctgcctccccaagtgctgggattacaggcgtgagacactgcaccgggccccctcccttcttcttaacccataacaatcacttttttttttttaatgactccatagttttgccttttccagaatatcatacagttagaattatacagtaagtagtctttcaagactggcttcttgcactgagtaatattaattttattttctttcatgtgttttctttcttgggtagagagttcatttctttttaataaatagtacttattccattgagttggtgtacctcagtttatttatccacccatctcatgaaaaacatcttggtggcttttaaatcttggcaattatgaataaagctgctgtaaacattcatgaataggattttgagtgaacctaagttttcaactcgttagggtgaatatcaagaaacatgattgctggattatatgagaagagtaagtttgattttataagaaactgtcaagctgcctgctaaagtgtcttctaaaatggcaccattttgcattcccactagcaatgagtgagagttcttgttgttccagattcttactaatgttagatgttgtcagtgttctggatgttagccattttaataggtatgtggtggaatcttaatgttgttttagtgtgcaattccttaatgatatatgatgctaaaaaattttcataagcttactttctatccatagctcttccttggtaaggtgtctgttttgatctctccatttttaaaatgcgttgttcataaattttaagagttctctgaatattttggttaatagttctttattggaaggttttttgcaaatatttttttcccagtctgtcatgtcttctcattctcttgacattgtcttttgcagagcaaggttttaaattttaacgaagtccagcctatgagttatttcttttttttttctttcttttcctttttttttttttttttttgaggcagagtctcactctgtcacccaggttggagtgcagtggcgcgatctcggctcactgtatgctccgcctcctgggttcacgccattctcctgcctcagcctctccgagtagctgggactgcaggcacctgccaccacgcccggctaattttttttgtatttttactagagacggggtttcaccatgttagccaggatggtctcaatctcctgacctcgtgatccacccgccttggcctcccaaagggctgggattaacaggcgtgagccaccacgccaggcccaagttatttcttttatggataatgcttttggtgttatatctaaaaagtcatccccatacccaaagttacctagattttctccattgctatcttctataatttgtataggttagtattttatatttcactctatgatccattttgtattattttttgtgaaacgtgtaaggtctgtgtctagattcatttttctttttttaaagtttttctagcactatttgctcctttgtattgccttttttcctccgtcaaagattaggtgactatatttatgttggcatacttctggtctatttattttgttctattgatcaacttatctattttttcaccaataccacactatgttgatcactgtaactttacagtaagtgttgacactgggtagtgtcagccctcttactttgttcttccctttttttatttgaattgagtattatgggccttttgcctctccatataaactttaggatcagtttgccacaatgcatataataatttgctaagattttggttagaattgtgttgactttatagataaagttgaaaaaaactgacaccttcacaatattgagtcttcctatccatgaacatgaatgtctccccatttatttgattcttttttttgaaatcattcatcagagtattatactttttctcaaatagaccttgtgcatattttgtgagatttatacctaagtatttcattttggagggtcctaatgcaaatagtaatgtgtttgtttttaatttcaaattacatttgctgctatataggaaagtaactatcatttgtatattaactttgaatcctaaaaccttgttctaattgtttattggttccaagagggggttgtaggtatgtggccttatttctggattctctgttctgttccattggtctatgtgtctgtttgtgtaccagtaccaccctgttttggttactgtagccttgtagtatagtttgaagtcagtaatgtaatacctctagctttgctctttttgcttaggagtgccttgactattcaagctctttttggttccatgtgaattttaaattttgtttttttctagttctgtgaagaatgttattagtagcttgatcagaagagcatgaatctgtaaattgctctgggcattatagccactttaatgatattgatttttcctatctatgagtatagaatgtttctttatttgtttgtgtcatctttgatttctttgaggagtgttttgaaattctcacggtaaagatcttttacctccctgatttgctgtatttctaaatattttattccttttgtggcagttgtgaatgggattgcattcctaatctggttcttaccttggctgttgcttgtgtataggaatgctagttattttcatatgttgtttttgtaactgaaaccttgctgaggttgtttaccaacttattgagcttttgggctgagaatgcagagctttctagatatagaatcatgtcatctacaaacagggatacttttaatccctctctttctacttgggtgtcgtttatttttttctcatgccacattgctcttgtcacgactttcaatactattttgaataggagtggtgagagagggcgtccttgccttgagccagttttcaaggggaatgcttccagctttttcctatttagtatgatgttggctgtgggtttgttagatagctcttattattttaaggtatgttgcttcaatatctaatttgttgagagtttttaacatgaaaagatgttgaatattattgaagccttttctgcatctattaagataatcatgtggttttgtctttagttatttttatatgatgaatcacattagttgatttgtgtatgctgaaccaaccttgaatcccagggaaaatgcctacttgattgtggtggatttgtttttgatgtgctgctagattcaatttactagtattttgttgaggattttgcatcagtgttcatcaaggatattgtcctaaagttttcttttttttgttgtacctctgccaggttttggtatcagaatgatgtcagcctcatagaataaggtagggaggagcgcttcctcctcaattttttgaaatagtttcagtaggaatggcaccagctcttctttgtacatctagtagaatttggttatgattctctctggtcctgggcttgttttttggttgacaggctacttattactgattaaattttggagttcattattgttcttttcagggaattaatttattcctggtttagtttttggaggttgtataattttgggttcattattgttcttttcagggaattaatttattcctggttagtttttggaggttgtatgtgtccagtaatttattcattaatttaccaatttcttctagattttcacatgtgtgtgcaaggaggtgttcataatagtctttgatggttatttgtattcctgtggggtcagtggtaataatcccttcattatttctcattgtggctatttggatcatctctccttcttctttattagtctagctagtggtctatgtattaatttttttttcaaaaaacccactcctgccttcactgatcttttgaataggttttcatatctcagtttctttcagtgcaggtctgatttcggttatttcttgtcttttcctagcttttgtgcttggtttgttcttgcttctctagttcttttaattgtgatgttaggttgttaaattgagttctttctaacattttgatgtgggcatttagtgctataaatgtgtcccagaaattctgtgtcccagaaattctggcatgttatatctttgttctcattcatttcaaagaacttcttgatttctgccttagtttcattatttactgcaaagtcattcaggagcatgttgtttcatttccatctaattgtatggttttgagcaattttcttagtcttgaattctattttattgtgctgtggtccctgagagtggttggtatgacagggggttcttttgcatttgctgaggattgttttatatctgattatgtagttgattttagagtatatgacaagtgtagaagagaagaatgtatattctgttgttttggggtggagagttctttagatgtctatcagatccatttggtcaactgctgaatatctttcaagtcctgaatatctttgttaattttctgactcaatgatctgtctaatgctatcagtgaggtgttgaagtttcccactattattttgtgggaatctaagtctctttgaatgtctccaaaaacttgatttaggaatctgggtgctcctatgttgggtgcatgtatatttattatagttagttcttcttgtttaattgaaccctttactattatttaatgcccttcttttttttttatctttgttgatttaacgtctgttttgtttgaaattagaattataacccctgcatttttctttgtttctcttgcttggtagatttttctccatccctttattttgagccagttactgtgattgcatgtgaaatgggtttcctgaagacagcataccattggatcttgcttctttacccacttgccactctgtgccttttaactaaaggcatttagcccatttacattcaaggttagtattgatatgtgtggacacacacagtcctacaccagagccctgccctactgctaacactgctacgagtacagatgtgcaaacagttgctatcaggtcctttgccccccagatcatactgccactgttgctgcggccaacacctgtacagaggccagcaccctggcacccactagcaccccacagcagctaaatgcatgtactccaccgtgctgctgctgctactgcttctggcacatgcaaatgagtatggatcccactgccactgccctgcaaagtgctttggctggcaccacccttcagagtgttgtgaccagtggtccaggagcacttcaccgcctccagcacagcaggtccctaaccttgaggaaccagaaatcaaagctataacctaatatcaatggctccccaatcagatttagaaaatccagtccaggagtcctgatctgagccttggcacccttaaatcttccagtaatgaagccagttgactgaacccaccttatatcacaatcaaacccccaaggtcatcaaataggataaaagaaaaaaaatccaaagggcagcaactttaactactgaaggaacatcagcccacaaagatgagaaaaaaacagcacaagaactctgacaactcaaaaaactagagtgtgtttcctccaaatgactgcactagttgtccaacaaggattcttaactgggctgagattgctgaaatgacagaaatagaattcagagagtgaacaggaatgaagatcatcaaggttcaggtaaacattgaaaccgaatataaagaagcaaagtcaacattatagatgcggacagataaaatagccagtatagaaaaagaatataaccaatctgataaagctgaaaaacacactataataattttatattgcatttgcaagtattaacaccagaatagaccatgctgaggaaagaatctcagagcttgaagactgtttttctgaaataggagagtcagaaaagaattttaaaaaaagaatgaaccatgtcacatgtatacatatgtaactaacctgcacattgtgcacatgtaccctaaaacttaaagtataataataataatacaaaaaaaataaataaaaaaattcaaaaaaaatttaaaaaaaaatgaaaagggccaaacaaaacctccaaaaaatatgggattagataaggagactgaatctacaactcaatggtgtccctcaaagagacggggagaataaaagcaacttggaaaatatatttcaagatatgatccatgagaacttccctgatctagctcaagaggccaacaatcaaattcaggaaatgcagagaactcccacaaaatatttcacaagaagattatactcaagacacatcatcatcagattctccaaggtcaaaatgaaaaaataaatgttaaaagcagctatagagaaaggacaggtaacctacaaagggaagcccattagattagcagtggacacctcagcagaaactctatgagccagaagagattggggcctcatattcaacattcttaaagaaaagaactcccaaccaagagttccatatccagctaatctaagcttcgtaagcaaaggaaaaataagatcctttccagacaagcaagttctgagggaattcattacctctagacctgccttacaagagttcccgaaagaagcactaaatatggaaaggaaagacaattgctagtcactacaaaacacacttgtatatttagaccacacaaacaagttggcataataaacaactgaaaacatgatgacaataaaaccaccacacaagcaaggtggcaggagatggagagagtgaagggggaactgccaaacacttttaaaaccatcaggttttgtgagaactcactcactgtcatgagaacagcatggtggaaactgtccttatgatcccatcacctccccaccaggttcctcccttgacatcttgtgattacaattccagatgagacttgagtggggacataaagccaaaccatatcaattgcatatgatattcctaggtatagtttttttgtttggtttggtttgttatctgtcctgctttgtgttctctgtactttctggatatgtagtttgatatctgacattaacttgaggacaatgcccaggcattattgcctcatacactttttctgcccctttctgtctttcttctccttttgctattcttattctgtgtatattatatattttatagttttcccacagttcttagatattttgttctgatattattttcagtatatttctctctttatttttcagtttgagaattttccattgttgtattctcaagttcagagattctttcctcaggtgtgtcccgtctactactaaaaccatgaaagtctcattattcatttctttacaatgcctttgatctctagcatttctttattagaatttctatccctctgcttacattgtcaatctctttttgcttgttatttactttttccattaaaggccatagaaaaataatcatagtttttaggcgttcttggccggataattccaaacttactgccatatctgactcttgttctgacaattgttcagtctcttcaaacttgtgtttttgcattctagtatgccttgtaactttctgttggaaggcagacatgaggtactaaatgtaactgtagtaaataggctattaataatgtagtgggaagatataaggggagggtaacttttttccagtcctattattagatctcaggcttttggtgagcttctgcttctggtctacaatctcgcagatccctcctctgtttcaggtgaggcagaatgactggaaggaactggaattgtgtatttcccttctactccatggaagaatagacagagcttgagttgagtattttccttctcgccaaatatgttaggctctgatataacaccagcaatttaggctctggtaaaagaatttctcctgaggactggccttgttaaaaaggacagtaaatatatggtgaagtatttcaaaataggtcctgcaccatgactgggttcccctagagtttatcttttagtttccccccacttctggcacccagcaattcatcaattaattatcagcttaggattttccacctcagtgttacttgtccccattgaggtttctactcatggatatctgcttcagtaatttgtggttctctatatccacctatctggctctctaatgttggggacagcagtttgccctgtgacatctcttctctaaaaaatctaagaagcattgttgactcttcaatttgtttacctttttacttggtaagacataataaagacttttgagctccttaaatgctgggctggaagcagtatttttaaaaatggcactgttgctaggaaagaccaattaaatcttaatgtttaatgattgtagtaagaatgcagcttgttttctaaaagtaagcaacacaaaatattctgagacatgtcattttcttttgtttaaaataaatttttaaattatttttttctgcgaaggggtttgaaataatagttttgtattgtgttttcagttggctatataaacttttaaaaatagataaaatttgacttggctttatttaaatagatttttgttagtagcatttgctctggcaaatcagttggttatgctagcagttctgcttacttttatcaagtcaaaatgatgcatcagctgaaatttaaggctagagtcagtcaaactgccatctcaaaactagtctttaacatctggtttgataccttcttaacatggtatcttttagatggatggtgttacaggaaaatcctcatagcaaaggcagcattcctggacatctgcagcctttttagaatcaacagaaatgctctggtgaagtagctgtgacatttacctcagcaaatactgaaattatgctaactgtaaaatgcacttcctcttcctactgcaactgctcttttgggaaaatttactatcacaatggccccagactaacattcttactcagatgctcacattttatcctgagtgttcaaacacctctctgcctttccagaaaggaatgaaaggagtgcagttgtttttcacaggtgggcatttactcttcagctttcctaactgtatgaggtacaagctttctttgtgtcaatctatacatgagatttgtgtcagtcttttcagtttatcacttttcaaccagtttaggattatgagctttacttttacacacataccaaccaaggcaaaggaatattgggaatcacagcaagagcattgctctcttctaacaaatcatccttgacatatctactcttaatcttttaaaatcatctttatatatccctttttaaattaaccatctaactgcttctagatctcctactatgaaatgtctaatggttgtctatttcatatttacttagtgtattatgctcatgatttctttgcgcatcaattgaaatgtcaaatttatcatcatattacccatacagttgctaaaaacatttcagacagatgcagcatttttaaaaatattgttttctgctatataaataaagatgtttagttaaaaaagtcctctttaggttaaaaagactatattgtgtagaaataatgtagagtccttacaggaagtaaatgacattccacagagtaagtatctcagggtcctgtctttgatatgattgctaagaaaactcttagacctttcattctgaaattgtttttagaatacccttgcttatgacataagaattagttgctttatttatagtgttaaagaaaaaaaaatcagtgatacatgttaaaacattgtatggaagactttcttcaggacctttgctatagctttagggttcactgcaatgggatattgtagtagggaagagatattgggatcaactcagaatacatcatgggcaagtagaaatttatagccatggagcagagtgaggctcagtaggtgaaaaattagtaaaaggaaacatcagggtaaggagattctagctaaaccatcctaagaagattctgctgaagacaggccaaggtgatcagacatcccttgccggatgatgaagaatgaggaacccagtgagctattttgggtcattggacattaagaatgggagcttcttgctaaactgacttaacagggttctttgctaaaactggattttataaagaagttcatagatgtgcctaggtgaaggttcgaaagccttgggaaagtttgatcagagaatatttgtcaatagctattcctgcttttagaacaattacaaaaatagtatataacttatgcattattttacttaaaataccgtgacatttttcaaaaagaaagactatcctaatgtgagaattgttattaataaggatattccgaaggaacaatataacatctgaaggcaatttcaaaagaggaacttgaaacattcaagcaaatttaaaataaagtgactattttaaaaatggaacagcaatttatatgtacatatttgagaatattcatataaaaagaagttgttttaaattttcattctatagaaaactatgtgcttcctagacatggtcacaacactcatatgggaagtaaagatggtaagaaacattctaatgaaaatgataatgctttttatgaaaaatttcacattttatgttagctttctcaggaaggatagaaaatctgaatgataaagacaaatagttaaagtaaaagttcaaatactattgtattacagtctaagatgttgttattactggcattgattccctagttattaagtgtcagagtaaataaatctttgtttttataaaatccttataaggaaatgaaataaatgtgagtactgaatttttatttcatagaaaactgagggtaaactagttcctttatttttagtttatctgataatagacagttaaaataatattctttacaagataattatgtaaatatattacaaataaatcatctacattatgttgactgaactttagttttatttcagataatttttatatttaatactgttttcactaatgctattcaatagctttcaggtagtagtttgctaattaatatttgaagtaaaatattaaaacccattaataataatagaggtaatgtcctagagttttactgtttgttcttttagaggcttattagtattttttcagactcgtatattatattcagttttcagtttgcaccatattttcaggtgatgtttcttttatttaactaaattcatccatatctaattctcatacatttttagtcacagctgagctaccctgcttatgtattaagaaggttgaattataattatgatttctttaaagtgtccttgaaacttcacccagtctagaatgaattttgaattttaaaatgttagttttgtgagcgggtgtcacttttgttttaaatagtagcgtagacctttcttcacttgtttcaaacacaacgtggccaggatgctgatacattcggaaaaaaaaaaaaactatggatataaatatgcaaaaattttatttttagaagggtagatttagatattaatataaataatttatattatttttaaacttcactggctctatgaagcatagttctcttggttcctaaaattcattctttttctttccttttaaatgagtctgtctatataacacacacatacacacactcacacacacacacacaacatatatttatatataaaaatttaacaagtaacttatatacatataactgtgtagtatttcaaaacagagtccataaatcatgaaaaaaaaactccatacacagttgttaatgaattaaaaccatgagtcatttctcagtgaagtagttatttcttattctaaaatttgataaaattggctaaatacagacatacactcacaggtacacacatacattttctgtgactatactttgagagcctggtttcctagttacttttgcatactattgtaccttacattttggtaatccaaatgtgagtaagccatgattgtgccactgcattccagcccgtgtggcagagtgacggcatgtctctaaaaacaaacaaacaaacttatcttaatgcaaaagaaattggatacattttcatgattaatttgaatgtttccttcagctattctataataactttatgcaaagttcatactgtcagaattaagaaagatgtattattgattttttttctgaagatacatcttcaatattatattttttataatctagtgttccattgccattgtaccttcatcacttgattcagtcacttcattcatttcttcaaatatttatagagcaaatgggtagaaaactagctgtgcctgctagagctttggcatcagttattattttcttttttaatctttagcataatagagagccatgttttctatcttaagagtaacagagctttataagtgagttaataaagtaagagttgatatgatcaagattgagatttaggaaaatcatcctgtctcagtgtagtgaacagattgaaaaggacagtggtggatgtgagaagttgttagagtgttgcaagaatgcaggagtggttaagagaatggcatactggagagtggccaagtaacctgtgtccaaaaaaattaatttaaatttaaaatatatggtgatcattggtatattttctcagatttatttcactaaggaatctagtgggctaattagaaaataagggaatgaaattatgaataaaattctttgattaattctgttgtgaagggaagagagaaagtatggcaactactgtggaaagtatgttaactagaggaaagaaaaataagacctgaaaggcttgaacatgtttaaatgttgtcagtaaaaagggaggggtaaaaaaagaaagaaataattatataagattcctgtaagtaatgtaagaatgtgatggaatttaaagcagaaaatgaaggattcgctgtggcttgtagggtaacaaacagaaggagaagaggagagattttgacagatggtctttgacataagaaggttttggattgatttttgagtgtgtttccataaatggttttatttttctctgtaaagtaaaacccaggtcaactactaaaagtgagttgagtccacagaaagttttgagtgtcaggaaaggagcaatttgaaattgacgttgtagagaataagttgaaagagatactaagctttctgggcagggttgaacatgtgcttcagtttcactcttgttagtaccactttttccagcaatgctgtgctgcttcagattcagaagacattgatagttgagttactccagggctggggttgggttaaacagttcaaaggaaagagagagtttagtgagtttaagatattggcaaaagtaatattgagatttatatcatggaaaaatcatctgaacatggtataatataaaaaaggagaaaaatctaatgaattgtaagactgtaggtctttaatgcgcatgaggctccagtgggattggaaaatattaccggtaaagaaactgaataaacaaagtggggagaaaaaagagtctaaaatcatagagcaggaaagttgagtaattcattttgaaagtaaagtaaattcaggtgttgaaaatagtgttatgtgaccatgattggctgaagcactaaaaaaagtgttggtaatgattttgaatgactgacaagtcactctgagtcctgtgtgaagggcactctgtgtgaaggactctgagtgacttgtcagtttcaagctggtgaaagagaaacagaggtaggctggaaatgacttgtactgactttcaggaaataaatttacagaaattttatgatttggctgacataatacctgtagcttgaaatcattaatagtggatataaaatcagcaagtaccacaagtaaaaataaagcaaataaaaattggcaaacactacaaatcagggcaagtctcccttttccagagagacaactgttaaacatttactagttcatcactgaggagaagcaaacatctgtatccaggaaatgaatagaagactgtagtaaaataaatcaggtagtaatattgaatggttcgaaccttaaaagaacagggttttgtaccttcgcttcctttcaagaggagtgtggaatgtgtgatttagaagtaggaaagaaacaaggatacatttcccattcttgatgtatgtggagtgtgaaatacatttttcattaatgtattaaagctgtactcaaaattaaatagaatttaaaattatttatgtagagcaataatgtggctatccttctattttgctttaaagctgggtcaggtatatatacatatatttttcttattgaatgaagccatgaacagaatatgagaaaaataagtacaagtctagttattcttaattaaactgatttgatcattacaaattatatgactgtattaaattatcacatgtgccatgatatatatatatattatttataaataaaaataaaaaacaaaaataaataaatattaatggatatatagaccatctccactgaaaaatatcttggaatttatatagtctaatccgtttattccacaattgaacaaattgacttctagagagataaacttactcactacagatcatttagctttgtaatgttagagctgaaagtaatatgcctgtcttctaaactccagcatgataggaataatttcattgtatgcatctagtcattcatttatccatttttttctaatttattcaataagtatctattgatatctatgatatactagacactgttccagatacaagagctataaggataggggaaaatccttgcattaatggaggttttcttctagtaggaagagagagaaattgaacagataaataagtataaagaggaaatacataatatactacctagtcattaagaggtatgaatacaaataaaatagacggaggataaggtatatatatggtgagtcgagggttttaattttaaatagggtaaatattagaaattctctggaaaaaggaatgtatcagcaaacatcaagaggaagtggagaagcgaggcacatggatatgcagggaaaatgcattccagctagagaaaacagcatagtcaaagaccctctattaaattgtacccctaattaaaatgtgctgtaaattaatgattaatataatcatcaactactttatacatactcatattgtgatatgttttaattctcagtgtacttgtaatgcattataagactttaagctttgccaggacaggggtcatgttttgtttttggtaaatctacgcacacacagtgcgtggcatggttatttataccaagctggtggtcaatatatattagaatgatagatcaaatgattgaatgaataatctagtgaattattaaatagaataagttgagttttaaactaaaacttttgtgcctctaagtctcctcacctgaaaaggcctggcgttaagggccatgttggttaaagctcctacctcagcaaaagctcagggtgctttttctattcttgcttactagggtgattaaataacaatagaggggaaaacaagtttccttatccttaaaaaattaagaattattttaatggtaaaggcatatacatatacacttacatatatatatatatatatatatatatatatatatatatatatatgaagacagtaggtatatgctacagtcatctcatgtacaagtactgtgtttctcttttgattgattatgtaaaacaagcaacgagaataaattctgattatctttacagagctttatggactgtcaaaatggctttagatgagttttctcatttatttatcacaatacttccacgatattgttaaagaagctttttattacattaggtagggaaaagaaattatggcttatccaaggtccttcattgacccagtgtggtaaagtttcttaattgtatttcagtttgtccacatgacagtaaaatatattcttgatggctattatttataagaaaagaaaatatttgatcaggaaagttgaagacatctcatttaaaagataatatgcaatgaaccttcattatgagatacttggaatggtacacaatgaactatcaaatgctgtttcaactacctaaaaaggataactgtctttaactgcaccaaatgatactaaacttgctgcctatcctattatgcttagtcactctgatttcttttattcctctattaactcacactaacactgagaagagcaattctctctgtttcattgtccttcccttcaaatatcctgttttaagagattacagatgccttgagataacactgccagaattatcccaaggctgacaggtttactaacaactgaatgcttttcagatcactgcactggactcagatccacctttgatatgaaccacatatggcttcagtcttgtttccctgaattaactctaatttcctagtgaccaaggtcagatgagtccagatagggctcagctgttcttacctagcacatatgttccagtattgttggtaatttatttctgtaataaaaaattaaaatggaaatctcagccagaatctcttttaccaagggagaccttgctatgagcattagggcttattacatgtaactttttcataacaaaataagaattattattatagcactatagccaaatatttaagttagcattataaacaaaattggtcatgtaaaatttattgaaaaagaataatttgagttagtaccaaataccacaaaatttacattgttaattttaaaaagtcagaaattagtttgcttttagcaattttactgtattaatctatacaccaatgttaaactaattctgccagattatttaggaggtaaaacttttatttataaatgtctgtttattaattcaagagaaatagaatttgttaacaataaagtctttttcagattacttcaagatattttgggtgttgtaccacctgattaactttttaaggtgtctgagctgaagtcaacatttctaatattatgtataacaaaacatattacaatatagtattcaattttctttgcatggtggatgtgttgttgttatgacatttaaaacaaaattaatgttaaaggttttaaatttcattcatggagaaacctttcctgtagaacatacttaaaaagttaattctaaatccttgctttaggaggttacacaaatattgataatgttattttcttatcacttttagacagtcaggttcataaaagcaagttcaatgagcataagatggtttctaaattttaatttatttttgacagcaaacaaaatgaacaaaggtgaggaatccatttgtgtacctaagatatctttaaaaagaagatacctttatatttgtcaaatatgttgctcccagtaaaagaaaagaagatctatgcaagtggttcaagagtaaaccttaccttattagcttttcataatattttagaagaaatttaaaacaaaattgcaaagcactattcttacactgatattttaccagttcactaaaacattcagaaaagaaatttaccctaaaatttgttagtcatttgagacttgcaaagagccaaataatttccaggttgcaaactttatttagtgttctagcagaaactaaactaaaatgtctataagttttaaattgttagatgtgtgtttaaaatattttaaatatttacattgtatgctctttttaatacacaaaatcatttggcaattgtgaattttaaaagggggtgtatttcttattcctttaaagtttatttttgacaaaaatacattattttgttgatgtttcacaatccatgaaaactgctattataagcagatagtgtcttctgaactgattttattggtttgtgctgatgtagaaaaaaacaaatcggcttacaagcctcggcatttttataaaataaacattgctaaacattgacatcccaaatccatctaatataacatagaaaaataagtttctttaaggaaaggaggaataaaatagaaatacattctagtatttttagtggcagataggataagtttagtgggaaaataagatgatttacgaaaacttaaaaatgcatttttcttacagtgctttttttaagatatgcatttcatgcaatatctctgagacattatttaattgattctcttggctttatctggctaattactctgtataatataactataaggataataattaagaaatcgttttttttatttttgtcaggtaagttataatctttttatgttttatgtaattaaaattcttttgcaaaatcatgatgccatgaattttatctattttcacttttttttaaggcaaggagctttggttctctcaactgtgtaggaaagaaaaatattttaactatttcttatcttttacttggctaccctcaaggtgagctctttatgatcctctaatttgttgttacctcaattatttgctaatagaaaattattttatgatgtgcttagcttactacctgtcttttattttatatatttctcttaggtactacattcttttggagagtatttcctaataaatttggcagcagctatggacagggcaaggatgtgtctcaattcctgagtctttcctggtgttctgtctcagtcttcactttctctcatcacagtggccagaggaccttcaaagactgtggacattttggctgatcagcttagtccttatgtttgattttaatcaggtcccttggcaatgatcagtatctacttcactgaaagacactagccattgttacaggtgatggagcaaaatgtatttacaggtggctccttcaacatgccggttgttttccacgtataatctttagtttatactgcaactttatatttcctttcttctatgtcaatttgcatacaactttcatattcaacatagaaatatttgattaatttcatttttacctcatcactgatcctaagtgcatttttattccttttctttaacttgtacagctcccatttattgatttttacgtttcaagttcctataatctatttaactttgagaatgttcaacaactttttgctttattaaaaataaatctagctaagtcttcttattttccccttacacaatatattttacagtggaagtatgaccccatgggtgtttaatataaatattttcaaaccagaggtcaagccaatggcagtgttctaaatcctcgtttattctactcaggacccaccttattaggaacattgccttattttttttcagcttcactgaggtacagttgacctcaataaaataataaaaactgtatatatttacagtgttggagagtctttcctaataaatttgacagcagctatgcacagagccaggctgagtctcaattcctgcgtctttcctggtatcttatctgtatctacatacatatatataaagttatcataatcagtttaattaacatatccattatcctgtatttttgtgtatgtggtgagaatatttaagatctattctcttagcaactttcaagtataaatttgcagtataattatgtgtagtcactatgttaaatgacataagctaggcacagaaaaacaaatgctgcatgatctcacttacacatggaatgtaaaacaagttgaactcatagaagcagggagtagaatagtagttaccaggggtttgaggggatgaaatggggagatgttagccaaaggaactttgcattattgattgttctttctttttctgacattttaaacctctcctttcttttgaaacatccgccattggcatttaaacatgctcaaatctcttcaatcttttaaaatcttacttaaaccaaaatattcttctatctgctattctggatctgctcatcttcagggttgtactttttattttattttttttttctttttggcacttactgctaccagtttactttcctcaaatcctttcttaatccactttgatgtgacttctaagagcttcactcccctcaattagcccttgctaaaataaccaagaaactctctgttgccatatccaaaggaaattattcagttttcattgtttgtagttttctagcaaaatcactacaagggaccacttcctcactcaactttctcttgccttaatttatgcagtacttagattttcttccttctctgtttactctttttacgtttcagcctcctatgccagctggtgaaattcaaaattccacaagccttaatcctaggactcatcttatcttcctctcctgtctttttccacatctatccacgacttggtcaattgtatctaatatggcattcaaaatctacatttttagctttgatatcccctctgaactccagacttaatgtctaacttcatattacagatccatttgaatgttcctcatgggtccccaactcactaggtataatctttctcccctaaaatttgatcttctttcagttttttcctctgtcagtaatgctcaagtgtaaaccagaaaccaaggacttgttcaacctaaacctcttctttttatatttcaataattaccaagtattatgcattacacacacacacacacacacacacacacacacacacacacacacacacacaccccctttgagtttctggatgtctttccatctccaacaccatttccagagtccaagtactgtttccttagactgatgctatgtgcttctaaatggtctttttacatccattgtagtcttagtgatctcttcaaaatgcaaatctgatttcatcatccatagacaatctgcttcataattgccttcacttctcactgctcctatgattaaggcatattttgttcttgcatgttaactatttatgaaacctggaccctggtcagtgtctaaaattgtgcctattacatgaaagtaattcaatacacatattttacttatttatttttattttaaaaatttttaataatttcaacttattttagattcaggagatacatgtgcagttttgttacatgggtacattatgtgatgctgaggtttgaggtacagttgatcatgtcacctaggtagtgagcatagtctgcaatatgttttcaaccgttgcccccatcatcttcctcccttggtaatcccccgtgtctattgttgctatctttatgtccgtgaatactcaatgtttagctctcatttatatctgagaacgtgcaatatttggttttctgttcctgtgttaattcacttaggataatggcctccatccagctgcatccatgttgctgtaaaggacatgattttgttcttttttatgactgtgtagtattctatggtgatacacgtattttaaataaaagagtaacttggctctgtgaaagcagaagttgcactgggaaaagttaaaccaacaaggaagacttttctattccaaaaaggaagagagagatcagaagtcaatctctgaactgggctgaaactctggagagttttaaaggatggtttgggagtttttaagggtgaaagagcttttaacaacaattgggtgggtatgggggattatgaccatatgtgtttgctaattgggattatccaagggaaatataaactttctcatatcttcgtcacagaaagtagttttacaacttggaagaagggaccctctgtctgaagttaggtttctacctttccacagagactggaagatagagatgcctccttccttgatgattacctttcaaagggttgggtccaggccctttagaaagacagtctggtgttgaaaaactgccaagagcctttcaaaaagatttacatttaaaagggacaaataaagaatttacaattacaagaattcggcagtaaattatctacgagaggggagggaaaataccttgatgcttaggctatctgaatcatataagggactgagtgagcttaagatggggcctggaggtcagaaggagcctgcctaaagtttaaaaagctgagggaaggcttcaggtcaccttcattactccttatttattttgctatcattttctagcactctgttccttagctcatggtgccccagccaaagaatactttcttcaattatccctcccatcgagttcatatccaaggtagcatctcttgagtgctttctctcatattagagagttcttgatgttgtaaatgcaagagaatgcattttgagtttttgttttgttgcatttgtaaaatatttcttaccactttgaggatcatttatgccattctgtttgctttagtctttatattttcagttggaggctctcctcaagtatctggttatccttggctgtttgatcatatttaatagattttaaaaggctcactgcaaactctaggtgcttactcaaagctgaaaaactgagtttcactgtggggtatatagtgggtaatttagttagaaaatccatgaaatgtatatttagatagagttggtgtagtgcactgattaagattatgaaacttgtaggaaatcttcccatgtttgagtcctggttttgccactaagtagccatataattttaggcaaatcattaacatcattgtgttttggttttcttgtttataaaaggggtacaaaaatacctacatatttttataaaaattaaaaattttagtatttgtaaataatttggaatagcatctagcacatgctaaaatttatatatgtgtaaacttttattattactattaatatttattttgcttgaaaaaaattctattattctttctggaggaagtatatgaatcaagacagacataaggctgactggtctcaacagtggttatggatttcaacttatttcttctggttttaatatggtcttccctggttcaactgtccagcatgctcttgcttcctctccagagaataaaacctctagtacctgcttgagtgggttgggggagtcatcatgctattcggagataggctgtaacaatgtaactgtttttaaaacatcccttcaataaattctactttttttaaacccacgtttattttggctttgaaagggatctagaactgactatctctggacatttgtggagtgagggtgtattctaaagttacctatttcctggtaggtgaccagcagataatcatatttcttaaactgagctttcatatttattatgagaactaaaacagtttgggtgacttttctatctaaatatattttgccattaaaataatagaaatgcttaaagaaatgaaaaatcagtgctggaaagtatttcaagaattttaagtgagtttatgttttgtaaaattcttattacactaattaactgttagtattgtagatcagatatttcaaatgtgaaataatatgatagttcttagtaatttaacatgaaactatatacatttgtaaaggatacagtagcaacatgtcttaaagttggatggttttcagttgtgattaaaaaaaaatgtttgatgtgtttatcacatggattacagtaaaatattcacaatgaatggatttgtgtactattataaaatataattatcttggccaggcatggtggctcatgcttgtaatcctagcactttgggaagatgaggcaggcatgttcagtgtttcactggggagcaaaggtttgcatttctacccggtcttagccctgattctgtccttgtctttatagagcactcattgtacctttttctttttcctagtaaatcataaggtacttatttccattttatcattgaaacagtgccaggatttttctctgtaatattgtgggcctgccttgtagtggaagtagtagtaatatcacatttatttccttgcacatgtagaaataaaagcacacttaaactgtaaaaaatattccatatctatttgcttgaaaagagttttaactttttatgataatacaagcagtatgatgaatatccttcctgtgtttgtaacttcaggattatttttggtatttgtataatataataattaaatgatgataagggtttcacagatgaactttcaaggagcagatgctaacgtttttcctgtttatgttttaccagggccttctgaacaaaacctattttcttcttttagtaataaaattctagtaaagccctcctgagaattttcagttggatataaacactattcaattgtattggtccaggaatctttagttatttagtaggcctgaataatagatttctgaagtccagcttaaagaagtactgaggtgatcaaattgtttctcagtggaaatgtagacatctttatttgtaacatccttatttgtaacacattctgctcgtctcttcaacccatacattttttgtgtatccctgggggttaatgtagcatctgtgttacgttaacccaagttgggggaaaacaaacaaactcttggagtcttacagtgtcaatctgagtgcagtatttctctcttccacgtttgttgtaaagaaatattgacaaatatgaaatactcaggtaagagacaagcacaaagaacttccttataaatcatttgttttctgttgtatgtatagctttcagtgatttactgggatgtgattttaaacatgaagatttttaaaaatatatttgttaaataaatctatactatacctagaaatatgacgagaaattgctatgagacagtcattatacagattcagacttttttggtatatatatatatatatatattccttaaaaattatattaagatggtacaagtaaagtaaatgtagttcattgtgtctaagcattataggagcacatggaaactaaagaataactttctcgtgaccaacttatatttattttcttcagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggtaggttatatgtcagctctttgttctttgttcattaatctgagttgctgtaagacaggggaaaaatagtgtgtccacgtatgccattaggaattttgtttttaccaaatgcatcctgctacctctctgattgtataaaagcaggttatcattttggacatattcttctgaatagataagtcaaaaataggaaaaaataatttctatcaaaatggtcagtagatatttttactgtatcagtgttgaaaaacacacagtataacccagctaaccttctcttttcaatcttaaattcaaaaaatgttttatgagtacactaaagtttttgtaacaatttacttttttaaatttgtggcttacaaatatagtatttgacttagagagttaacgaaaataagtgaggcataaatggctctcatgaatattatcagaattgttttacttaaaagaaggtagaaatagcagactatttaccaatgacatatctagaatatttaacactaaggattatttttaacatcccccttctttcatatggcaaatcatttttagtcaaaataatcaaatgagataatgaattgtaatttccagaaaaccataataaaactcttgattatatatatacaaacatgtatgaatatgtatatgatggtgccgtaagtaaataaacacacacacacacacacacacacacacacacatatatataaaacattacagtacatgtgtacatgtagtggacagaataatggcttcccagagatgtccatgtcttaatccccagaacctttgaatatgttactttatagcaatatactttgaatatagcatatgctttgaatatgtatcatagcaaaagatactttgcagatgcgattaagttaaggatcttgagatggggagattttcctggattaaccaggtgcgtccaatgtaatcacaagagctcttgtaaaagggagagtgtagggttgagtcatagttacgatgtgattatgacagggatgtgaaagaaggagagagagggagagacaaagagaaagaagagagaggagagagatttgtagatattattttttggtattgaagatgtaagaagaagccatgagccaagaaatgccaggtgacctttagaagaaatacagtccttcagagacatcacttttaggacttctgacatatagaactgtgagataataaattttatattggtttaagtcactaagttgatggtaatattttagagtagcaacaggaaactaattgtacagagggaaaaaagtcatagcatattttaattacatcaatgtactttttgaaagaaaggggaaaacatattcatgatttatcacagtaatatctaataatgctgtacatgctttggacctttacttttgcaaatttgtcaatgacttggttaaaaccgatcattgatttctggcaactctgaaaagtctaggaagtccaataattttctaccaaaaaatttaatattaaataaataatattacatttggaaaatcatctgaaatgtattatggtttaaaaaaagctcgaattagttttgacaaaattttgagatactaattcttgcatttatgtagtagagtcataataaagaataattgtgcagtcattattgaaatgaaaaaaaacaaacgagttcttactcccaaaataggcaagtgtagctgagtccacataattgaggggttaatggtgtaattggaattgtccaattttatttccaggtagaatacaatacttactaaagaattaaatataaatatttgctaatttgaaaaagtcaataaaagctcagttgttaaaactcaacaataattgtttagaacttagaccaacaaaagatattttggaggaggaatattttatattttacatgttttagacttcccagtgcataatgatactggatgccactgtttttaaattctccacagaaaatataccccctttattacctgcaccagggaaaggcttcctcaagctttgtccctgttattccaatattatgtacaaattcaaaattgggcaattttaatatactataaatgtattaaaatgattgtgttttcacaattatattgctgagaaacatttttttacttctcaaaatgtgttaaattatacctttatcgccagtaaggctttggtttattgccctagctctgtgtgatgggagtgctcaaatcttggcattctgcatagttaggtcagttatggttctttccctcaataagaaatgcatactgaacccagaaacttcatgagttaatgcaccagttatttggaatttgtgatgcacaacttctttgataatttttgaaatatgttttttcctaggaaaaatcatatactcttaaaagaagaggctgataatgtgctatgaatatcatcatgcagtattctgcacactgatattctgaacttattcttgtcactactgtgctcttggacaagtaacttgaaatttatggcctctaattttttaaactagtaaaagaagaggattgtatatctcaggtccatttaaatgctaaataatttggcaaataatgtgcttgatagattctcagagtttcgtctaagttaggctagactacatggagaaatatggttagctgatgtcttagaatacattcaaaaaatcaggcacactcttaaagtagttatgagaggtggaagcagtggtctgttaggctgccattatcctatagtttcatttgggaagagctgaaataaattaacccatgttttagtatcatttctgaaaggagtgagactcatatattactaccattttctccgggtttgcatcgtctggatgagactcatatattgctatcactctctcctggtttccattgtctggataagggcagagatatttgtctctcttttgctgttcattgtttcagccactatcataatctgcatttctcaactgggaaattagcatttgccttttatgttaccattgctgaagcatactgaaaatgataatagtgtgttaatatatttacttacttacttactttaaaaattgtacttaattataaacaacaaaaaaaaaaggaattcattaaggtgtgaaaaatattccttgaggttcttgctctttctttctcagcaagagttaatgagaatagctatattcaaagcagagcaatatgggctaaggttctgaaaaactcagattacttccagaagttccccaggctttttaatttatatattcaggagctataatccatagtgaaaatttcacctttagtaatatcctatatgtgatcaaagaggggaacttccttttctttgcttttattattgctcagattttgaggtattttcaagaaagcctatgtggtttgatgaggagattaaaacgggaaatattatgagtctttttgagtgggaaatcagaaaaaaaattaaaaattgtgcatatatccacccctgccccattttcccccaaattcatatattatcttcttagcctgccatgcctccttctaattgattcatttaggggcctccccatcaccattcatcactctgagtgtgatcattactgcccaaagtgtgctgtgagatcgctgaatgactcagaataagctatttaattaaggaacctctgtttacacaaaaatagcttagtggagcaatcaacaatgatgtgaaagtaaatgctaaataagcttaagcaggtttaattaagtttggagtgacattaaattccttcatagttttcctgactgcagcaacgttattttaatgtggcatttactgtgtggtagatttttgaagttgcaggagaccttacttggtaagttaactgaacttcttatttcattcaaaacaatatttttaaaggctcggagtgagttaaaagcaaggagcaaaatcatagcagtttcattaaggaatgtctaaattgtgtgagcaggtgccgtcttgtctcttatttcaccataggtgataatctatttatctgaactgggaacatttctcctccttaatagcatttttggctgcattgcttctctcctgactgcctgtacttaaaagccttcttggtttctctttttcaaatgttgagtgcatattgcactttgaggactaggcagactcagcagtccgtgagctggtaggaaagcagcagtctagaaaaaattccattagggccagttggtattattttgctttgctttatgcaatttggtagaaatattatcaaatgactgaagggtctcattaagatgatttctatgtttagcaatgagttagtgtcctctttctttcatgtattagttcctcacaactttaacaacaagcattgtatgtggcagctgaaaaagggatggagggaattgtgctcatatttgtgcatattattaataatgtaattttctataatttcagttgtttctattttacttgtgggattaaatcaatagtgaattccagtcagtgagtgtataattatttaacagtgagtaactatttctgtgaacaaaacccaaaatgaattagtcatataatagagaattactgaaatacacactatacatgaagaatgtaaagataaagtggacatatttacaatgccctttaatatgaagattaaatttaaaaataattttagccatacacaaagctgttatatacattttctctcatatttactgatttaattagaaatattagggtatattttatttagtaattgactttaatgttacctttacaagctaatgctttaaaacaatattatctatgaatatcaaaaagcagtagtaccattaataatcctcaagtaacttttatcaaattataatgtacttacccataattagcctaaagtaaaaaatgtaacattgagtttttatggtagaagtacactactttgacatataaacaaaatgaaatttcctttttttacttctgttttctaatgttaaatgcttaagattcactctttatttttaaatttctcattatttggtgaggtaagagatgtagaattggtaccagtggaggtacgttgtttgtttgaggcagatgccaatgtttgtaaaaatagaaatcagtatgagaagaatgtcgttccctgttttattcaccatccatttctaaaattctcaatttatgatataataagtactgaaatattcatcattatagatgcataaaattgccagccttccgtttttcagctttactgaagtgaatgaatacatttgtcttcattagtttaacataatgcacaaaaattgatgcaaattattcatctttctgcaggtcagcccttccattaaaatgcattctattttccctttgcataagcagcacaattttaatatttgaagtgattttgcagggctaaatctagatctaataattttcagagactgaattaacaaataaactcaaattacacctgttcaagctgtacattcctggcatatttgttaagtctagattatatgtcactgaaaacataagcatctcaataagttatgcctgctccacagacatcattaacaggctgcatgctacaatctaggaggcttcaacagggaatttgatgaattgtgagcaccactgtgaacagccgtgattaatattgtaaatgttgaccaaatggtacccaaacaatgtagaaatggataattctcataaaacagagttctgagagattttatacacaaagattggatcatttaattcatttacttattagtccaagaccatggcttcaaattttactttagatcagttagccacagactgtcagactatgtcagatagttgtccttgggttagcagaggtgggtaagatcaatgaggagtcactcttattagaaaaaagctagtcaaatgtttgttctaaataccaaacccaaatgctttgcatttgctgaccctcatgtgacagacatattcgtagcatgttgcatggagtctttggcctttgtagtcagatgacctgtgtgcaaattttagtttcacctggatgaaacctgaagaagttactgagtccctattacacttagtgtcctcatgtataagcagatataaccatgttcacataattggattgtgataaagattgagcatattatatttttagtacttgaatcagaataggtagcataaagaattttaaagaaatgttttgatcacttctaatacgaggttttagaaaatttaaaaaaaaagtgttttgaagaaatgttctctaataattgaaagaatatgttagtggtctctatttatacatttttagaactgtcttgtctttgtatgtttagggatattaaatatatagccgagaaagcagagtattagtatgacccactgttaaccagctggaaacctgtttctaatgaaacctacctgggattttaccatcagccaatcagtatattgtaattagataactatcattttgtgggaagagagtgattgatatctactatataaagttaagaaaattcctatcataaggcattatctgaacaagcaaaatggttttccatttccaaacatgtcttgaacttttagtaacagagctcaaaatgtattaggagaagtatcatctctaaagacatgtttagtaaacaatctttttagtaaacagagctcaagatatactaggagaaaaatcatctctaaaggcctgtatattttctttacatttgaccaatctacaagaatttcattactctttctttcctgcttagctctgtaaaataatgaacataaaatataaacataaatcatctttcttttttagaagaaagataaggaaaaacaaatttgacataaaatagagaaaaatgcaatattggacataaacaaatacctgttattagtgcagggacttagatagctggagcttagtgagaccaaagcagacagaccaaattgcaaaagggacttcagcaatacttaaaggatgggtagttcactgtcttgaaaaagatatatttttttcttccaattttagggttcttaatgattaatcaggataatgatttaatataaaatggtccaactcttataattctttccttggaattttacattagatttggaaaaaagcataatagtaaggaaatcattgctgacataaccattcctaacactattctaatgattgctgatggcaaaatcataagaaaggtagggtttataggataaaattatttctattttcatacttagtgtcagagtttcatggtttaatactcaagaaatatgacagcaaatctatttcaccagtcacttttaactaatatatatgaaatatgtcagaaccagtaaaaatagttggctgtttcattacaggttgataacattttctttttcacaagttagaggatatacagaatattaataaaaggcaactgtctaatacatatactctataatttgaattcttcattgatacattttatatgccatatataagcatctccctttatgatcttaggtacctgaatattttcctgcatattctataaatattccttcaattagaatgcgtttatattatttaaaaaaattttttaaactaaacatttataatgtgtatatttatgacgtaaaagtgacattgtgatttatgaatacaataaggaatgattaaactaattagcatatcaatcacctcagatacttatctttttatggtgtgaacatttgaaatttattagaatttttgaaatgtacagtacactgttactaattatattcaccatgttgtgcaatagatttaaaaagaccctgttcctcttatctgagattttttaccctttgaccatcatctccccatttctctcaaccctccagcctctgctttctgtttctatcagttcaaatgtgttagatcccacatgtcagtgagaatatgtgatatccgtctttttgtgcctgacttctttcatttagcataatattctcttgtttcatctaggttgtcgcaaatgacagaatttcattattttttagggctgaatagtattccattgtgtgtatatgtactgcattttctttattctctgatccattataaatataaggttgatcctataacttggctattgtgaaaagtgctgcaatgagtaacggaatgtgcacatctctttgacaaactgatttcaaatcttttgagtaaatacatagaagtaaaattgatggatcatttcccatgatggttgcactaattcacattcccaccaacagtatgcaagggtttccttttctccacatcctgatctgatggttttataaggagttttcacttttacttctttcacattctgtcttgccaccaccatgtaaaaagtgcttttcactttcctctgtgattgtgaggcctccctaaccacaaagagctgtgaggccattaagcctatttttcttcacagtctcaggtatatctttatcagcagcatgaaaatgggctcatacagaggaataccattgaaagaccttaattttatagaagtataagaaattcatgagcaaaaatgataaggatacaaaaagagtaatttcatctttaaaaatatatcaatccataacattttaatcaccaaatggtgtcagataaaagtgaaccaatctttctgatacctaataatcttttcacattgtgtatctgttcaatcagtaccttgctgaaaattttctagtggtgctctcgagctatcagataaaatactaactcctaacaatgtcatgcaatccctttcttttacctatcttaagattcctgtattagtctgttttcatgctgctgataaagacatacccaagacgggataaaaagaggtttaattggacttacatttccacatgattggggaggcctccgatttatggcgggaggtgaaagaattattacatgctggcagcaagagaaaaatgagaaaaatgcaaaagcagaaactcttgatgaaaccatcagatctcgtgagacttattcactaccacgagaacagtatggggaaccacccacatgattcaattgtctcccactggctccctcccacaatacatgggaattatgggagaacaattcaaaatgagatttgggtggggacacagagccaaaccatatcatttcctttctgaatttatcccctcttccctacatctaacctgataacaatacaaacaagttgggtttccttctgcctgagtttaccttttttcactcttcctccaattttctggttgaattctctcatccaaataaatttcttatgctgaccttttcatctctttacacacttttcctaggctgccacagaaatatatatgatctctctcttttggaaccatagcacattttcagatattcctatatagtatttggtatataatattacaatttttaaagtatctttttttccattaagatgataatatgagtgtcctaatggcaaggaccataaatgaatcaatttttacccatactgtctcactattgttgagtacataaatattacttagcgtagctgtgagatcctaagtatataatggtgaacaatataaccatgacccctgccctgctagagttctcagtgtaacaaagactacataacatttagcaagtttttacaaataaacagggtaatgtgttacagaattatgtgacagatgaaactataataaattagtcttcaggaaaggtaagcaaaaaagattacttctatttgataacaggcgtaagaatgataactcttcttttacttttgctacctttttcttacttctctctcttctctttccatctacattccagttttggaaaggtgtacatagaaaaggaaaaagatagtgagagcatctcaaatccattttgttcatttcttctagatttagaggataggatgaggtacaagatatcagggccatggaagaatttagccaactataaatgacactgttcatgtagaaatgagagaagagaggttaaaaatcatctggtatcaagagaagaaaaaaaatgtactaaagacatacctaataaataattatctaataatgcaaagaacttttaaaacacaatcataataaacaaccccactaaaaaatggtccaaagatcttaacagacacctcatcaaaggaaatacacacataccaagagagcatatgacaagatgctccatatcatatgtcataaaagaaatgcaaattaaaataatgctttatttaaaaagcaatgaataaaaattgcaagagtaagttgttacctatcaataataaccttgaatgtaaattaattcttccatcaaaatacatacagtggctgcatgtatttttaaaaagatcaaattacatgttgcatataagagattctttttagctttaagagtattcataactgaaagtgaagtgatggaaaatgtattccatgcacatggtaaccaaaagtcagcagggatggctatacttagagttcaagtgaaaaacatttataggagacaaagaaggtcattatttaatgataaaggaggaaataaatcaagaggacataataattgtaaatatatatgcaccaaatattgattcacctgaatatataaagcaaatattaatggactgaaaaaagaaattaaaataatagtaaaaggcaccaataccccacttttattaataggtaaatcaaccagacagcaaattaacaagaaaatactgggcttgaactgcacttttgatattgttttgctctgtccccacccaaatctcatgtagaattgtaatccccacattttaaggagggacatggtgggaattaattggatcatgggggcagatttcccccatgctcttcttgtgatagtgagtgagtgctcacgagatctgatggttaaaaagtgtgacacttctccccacaacctgcacccactgccaccatgtgaagaaggtccttgcttccccttagtcttcttccatgattgtaagtttcctgaggcctcccagtcatgcttcctgtgaagccttcagaactatgagtcaattaaaactcttttcttcataaatttcccagtctcaagtggttctttatagcagtgtgcaaatggactattaaaactttatatggaatgaacctaacaaacatatatagaactttccattcaagaacagtagaatgtgctttcttctcaactgtccatgtaacattctccaagacagggcatagtttaggccatgaaacaaatcttaacaaattcaaaaaggttgaaattatgtatagtattgtttctgaccacaacagtatgaaactggaaatcaataacaagagaaatcttggaaaattaacaagtatgtagaaattaaacaacatgctcctgaacaactagtaggtcaaataaaaaatcaaaaggagtgttaaaaaatatattgaaacaaatgacagtagaaacataatatatcaaaacctacagaatgcagcaaaagcagttctataagggaactttatagcaacaaatgcctctacttaaaaagaacaaagatcccaaatagcctgacattatgcctcaaggagctagaaaaggaagaacaaactgaaccctaaagttagcagaagtaaataataaagatcagaacagaaatacatcaaacagagaatagaaaaaccataggaaaaaaacccaatagtcacttctttaaaaaaataaacaaaatagacaaaccttttactaggctaagggcaaaaagagaggcgactcaaaatcagaaagaaaaagaaggcattaaactgaaaactctaaagcattactgaaagagattgaagacacaataagtagaaagatatctatgttcatagattggaagaattaatattgttaaaaattttcttcctggccaggttcggtggcttatgcctgtaatctcagtactttgggaggccgagctgggtggatcacaaggtcaggagttcgagaccagcctggccaacatggtgaaaccccatctctactaaaaatacaaaaaattagctgggcatggtggtgtgagcctgtaatcccagctactcaggaggctgaggcaggagaattgctttaacccaggaggcagaggttgcagtgagccaagatcacaccaatgcaccccagcctgggtggcagagcaagactccatctcaaagaaaaaagaaaaaaaaaatatttcttcctacccaaagctatctacagttttaatgtaaactctcttaaactttcattgtaatttctcataaaaaatagaaaagcaatcctatagattatgtgaaattacaaaaaggcctaatactcaaggcaataatgagcaaaataaaataaagctagaggcatcacaatatctgatttcaaattacactgcaaatcaatagtaatcaaaatagcatggtactgcccccctcccaagaaaaaaatagacatattgaccaatggaactgtatggagggtgcagaaatgaacccacactgtatggtcaattgtcaaaactatcaagaacacccaatggaaaaaaacagttcttcaatcaacggcgttgagaaaactggatatccacaagcagaagacgtaatttggtctttttctcacaacacatacaaaaatcaactcaaaatgcattaaagaattaaaagtaaggtcagaaattgtagaagtactagaagaaaacatagggcaaaaactatacaacattgagttgggcaatatttttttagatttgaacccaaaagtgcaggcaacaaaagcaaaaatagacaaatgggattacatcaaactaaaagtttctgcaaaggaaggaaaaaaaataatagtgcgaagggacaacctagagattgtgagaaaatatttgcaagccacacactcaataaggtgttaaatcaaaactatattaagaactcagacaactgaatagcaagaaaaaattatttaaatgagtaagggacctgaatagacatttctcaaaagaaaacatacaaatgactaacagatatatgaaaaataattcaccattgttaatcattggggaaatgcaaattaaaaccacagtgacatatcacctcacactagttagaatagctgtaacaaaaaagacataatgtattggagtaatgacaagctagaagaaatgtaatattattagtagtctacttcataaaaatattttcccagaaccaaagcgagcaactagtaccaaaccactacctaatactaggtcatatacagcatgtaatataatataattacaatatctgaataactaatgaatataaaataaaagaaacaaatgtcctttcggaggtggccagagaggatatgtcatatgaaaaaaaagcaatacccagtaagccctttagacttttaacaaaatgtatgaaggatttgggttctattaaggaagaacaaaaagcatatttttattatttttttcaaaaattggtttcatcaattttagtatacagctatatttaaagtgttcttataactcttgtcccacaaaattatcttgcaaatagacttcaaagccagttgtggaactgtgttttaatacaagcagtgtgctgtgaattcttatgaagcatatggagcaatagatgaaaaagggaacctacaaaaaatacaaattggtaagctgtgagttcacaatatgtaagttcaaaggcagaaaggagagtacatagggtcagacagaaaaatctaatgaaggggcaacatattttccacagagagaacacatgtaataacaatagtaattgttatctaaggttatcttactttacaataagtattaatagtaattattgtttctaaagccatacaaattgaatttaaaagaaaagaatttatggggacattaataagcgagagggaaaaattcttccccgacaacaaatttaaacattataaacaagttttatttaattttttctgttctttcctttaatagatagatggaagcctttactttgctaatgtataatgtgaatttgcatgagatatatttgatatgtagtattaatcaagattatttgtacaagtaatcctttacaaatcaaacagatgtacatttaccaaaaacagaagtgcatgtgggaatagccagtttgggaaatactgttgtaaagagttttagaaggagatatattataaaaagcaagaatgattttgtttctgacccttgtaattgattaaagcatacagaagcttgatttgaaagtaaagaaacatttgaaaggctgaatgagaggtttccagaatgtaagataatgcaatttcagcatgttaaatataagatacattgatttcagtatatatttttaaatataggataatgtgatttcagtatattcattattggacaatttgctgtgcaacctttaaagaaaagttatttatcaatgaataagcctccctcagaattaaaagaaatgctgactgcatttactttattagtcctatattatctagacgtaatgaaataagataaagagaaaaatgttggcatgtaaaattgagagtttgtacagggtagtaaaagggctatagaagaaataaatcaatatattgtatataatagacttaaactttaaaattaagtatttagaactacgtgcacatttcattctacaagtaaggttcctagaatgatagagaggaaagaaaggaagaaggaaaaaagggggaagggaaagaatgatagagggggaagggagagaagagcacaggagggaagtggaagttagggaaggaaggggaagggaacaaaagaatacagggccccagcacggtggctcaggcctgtaatcccagcactttgggaggccaaggcgggtggatcacgaggtcaagagattgagaccatcctggccaacgtgatgaaaccccgtctccactaaaaatacaaaaattagctgggcgtagggtgcctgtaatcccagctgctcgggaggctgaggtaggagaatcacttgaaactgggaggcggaggttgcagtgagccaagatggcaccactgcactccagcgcctgggcgacaagagcaaaactcggtctaaaaaaaaaaaaaaaaaaacggaataagaaataaaaagagagtacaggaaaggcaaaaaaagaaaaagaaaaaggaaagggaacacagaggaatgaaaaagtagggagggaaaaaaggagaaaaggagggtagagggagaaagggagggagggaggacagaaggaaggaaggaagcaaggaaagaaataaagaagaaagataagaataactcaatttaataaacccagcaagttagctctgaaatatttggtgagatttgtgtttactgtttataataatcacagtttaatctcttaaggagttttaatctatgtcttgggagagattctcatgaaatcacaatattacataaaaatatttgattaaagtttaacataaaagggacatttagagacaataactctattgttgaggaagttctggatagatacatttgtagtttttatgtgcccatccatacgctgtcattgtatgtcacttgaaactgcctctatacctcctttgagggctcatttggagcatcaggtcttatacatctgacatatgaagaggtttcactatgtaataactgtatgtactatgactgcctgcttccctccctcccttccttctttccttccttccttccttccttccttccttccttccttccttccttccttccttccttccttccttccactctctgcaagctaggacttttttttacttggtaaaagggatcttttggcaacttgtaaaaagataatttacaaacatgagttccttactgtgaatatggagaatttgtttaaattatcaaagaaagtcccactgagagcagcgatatagaaagtaccaaagattagagattgaaatgaagattcaaggcctaatttggctttaaaagtgtttggtttatcctgaattttttaaaataatttatttgtcaatgttttaaatgtgtgaattttagacaaaatatttcatatgatctgacaaaaaagtgaaaatatatggtcaccctgtgaccatatagtctcacaaggttttagtaaaactgcaactgaaggccgtctattttgagtgttgcagttttccagatatttttgtctaccttcctccactcatttatggttgtctgtcctcctaacagtttgaaaattgactctaagttacaatgatgcatgttctaatagacacatttataatttccttagtgttttctaattaaagttagaggccccttgaaaacatatacatatttcttgaaggtgaccttacagtgtgactcctgagcttctctcagttgacattcagcaacatcagttctttgtttgccaacatacagattcatgtgggagtttgaacttgggaggaactgtctctatctacataattaatgagtgttcacttcattagagttaagtgcatggctgttcatgtcacagggagaatggaagattctttcgttctttggtctcaatgtgtccttgagatttttcatctagctgaaatttcagtccacatttgacttcagctggcatatttgtagaaatacttccaaaggagcatcaaattatgtatcaaataagtaataattcatttttaattacttgtccttttaaaaaatacttaaactagatcaatgatggaaggacaagtaaaacatgtcattgatttattggcattgattatattccttatattatttcatcttgtttaaaaccttaataagcccattaactttgtacatttgattcaaatcaaatatcatttaaacattcctatgttcataaaagcaagtgtgctgaggtttgctagcaatgggaaatttgtatattcacattcaatgctggaaataggaagttcagctggcgaaaagtcaagcggtgtctcacttgctgaaaagtaggttgcttttgtttatttgtgtcttattttgttcttgagaatgtaatggagaatatagtgtttgaagatactggaatagacatcccagtgcagttggtgcatatagtgagttggcaataatattatattctttcaatagttctcaaaatgagaaatgagctctcacaaaataaatacttaagtggattaagaattttctatatttgaaagtctactttccaagtaatcacccttcacaaatcttgcttataattatatttatataaaagaaattacagtctgggcaccttggctcatgcctgtaatcccagcactttacagggcaggtggattgcttgagctcaggaggtcaaggccagctgggcaacatggtgaaaccccctctgtactaaaaatacagatgaggtggcgggcacctgtcatcccagctactcaggatgctgaggcaggagaatcacttgagcctgggaggcagaggttgcagtgagccaagatcccaccactgcactccagcctgggtgaaagagcgagactctgtctacaaagacaaacaacaacaacaacaacacacacacacacacacacacatacatacacacacaaagaaaagaaattacaactttttgataaccaggtgtggccattttcacaaacactatcaacacaagatttgttgcatatactgtttctaattcaaagaaatttgataaactatcattctgtttaaaatggagatactcttccccattaagtaagcatttattttgcagggaaaatatatcattatcagaataaaattgatctttcaactggcaccatgctagatatagcaaattaataaatactgaatagtcaagcaaaatgaccttagtttatggtgttttattacatatcacagagactcaagcaccatgttattgctcttacgttatgttaaaatgcttttagtcagttattatgctcctcagaataggcaaacatttgctgagagcctatgatttgaaaaatgattgagaattcagatggatggatgtttcattagtgttctttagtgtttatgctaatggatgtagatattcatctgcattagatattacataagtgatatttttgttaatttgttgaccagaaacatataaaaataatgaagcacatgcatctttctatatctgttagatggatggatggatggataaatggatggatggactgattggacagacagacagataatagatagcctccatacaaaaaagcttgtaatgtatttaggaaaatagaacatatctcaacaggtaaataataataccagggaacctaggctgaatgcccagtgagtgatcaagacagaaagtagtataagttgggctaacatattgaaatctgaagtggttaaggggcagaatttacactgcaccttcatgttagattagtattttaagaagagcacaggggagaaactgagaagcagaaattcccctaatatacttaagaattcttgcataatgaaaataaaatatttgagttctaattataggaatgggcaatgcccctatttaggaaggctgtaaaaaatgtagagaagccataaacttctacagcttttaagtagagaaaagatgatgttaaacaacttttcagttgagtttggtagatcttcatttgtccaactttttaaacaggttacttacattctatggttctcgtctttctacttttacattgcctactctcactaaaagagatgtatagatgtggacacatttaaatcaaaacaaaattacaggcaatgttgaatacaagctgaaatgtttaatatttttctggaagcaggaaaacactatgggtgaatttgtacacaaaaaatggaatgtgcagtatagtgtcttaggaaaaagatcacactttagaagcaggctatttctgggtgggggaaaggaataaaaccaatcccttggaacagatatagaaaaatgcatgtgcttcaatatttttatatgtttctggtcaatgaattagcagatattacttatcatgtaatatctaatgcagatgagtatgtacctccattagcataaacaatacgttttatttatattgttgcctccactggaaaaaaacaaaataaaaccttgtctcctataaaataaattgataaaggaacaacgccccaaatgtttacaatacgtggctgtatgccccttgatttataaagtaaatcaccataatgatttttaaattatctaagtccatacaacctgtgacttctgttatgcacatcacataacagatactagtgactgcccattatctgctaagtaaaagataccattgaatacagcttattagtaattattcccttaaattactgcatttaatctttggaaacaccaatttttcacaacttttctggtctaaaaatagagatagctgttttatcagtgctctggtttcagtgtagaataaattgtagatatgaatgaaacatctttgcactctatccgttttcctttgtggattctttcttactgttttacaatgctgtaagctgagtccaccttttaggagacatattctttcttaaaacaaaattcatttaattcctcaatatctagcaaggctatccattttaatgatcttgttaaacgtctatgtgttttttccagttgtttttctcttctgaaaaaacattggcacactttgaagcattttgaaaaatctctgccctcctctcatcttgctaacctttaattatgaaatttcaggttccttgaaatacttaacataacctctcttttcttaggttctccatatcgagacaaaattaccatagcaattcttcagctgcaagaggaaggcaaactgcatatgatgaaggagaaatggtggaggggcaatggttgcccagaagaggaaagcaaagaggccagtgccctgggggttcagaatattggtggcatcttcattgttctggcagccggcttggtgctttcagtttttgtggcagtgggagaatttttatacaaatccaaaaaaaacgctcaattggaaaaggtaaatgttacttgtttcagtttaaatttaaaacaatttttgttgttacaataaaacacaaaccaaaagagtttttatgttaccaactaatgataatgcatagaactattgctctaaattgtcttatgtcattcattacataacaaaatattatattttgtgaaatttcacagaaagactcatggtcacctttatgattttttatttaattttaatatgtttaattgtagccagcttcaggaaaaatagctatttctactcttattacagacttaaaaaataaacttttgttgtttgaatttcatcgtggtatatgatgagatacagttaattaagtgagtaaaaattagaaactaatatgaaagaaaaaatactctgcagattaaaaatgaggttttatatacaatatgggttaacagtttcaagttagagagtaagtttttatctgaatagctttagtccaataaatttctagtttaagaaagatattagctttcactggagaaattacagttaattttctacattaatgagtgtgtgaaaatagtatagtttctttttgccatttaatagtattcttaatcagttctttgtttttttgtaccagagtccttctaaaaatatgtataaacttcaaaaatattgaggctattgctatattttgcatttgaatgcagtcatttgtataaatgctttttgtattatccttgaaaagtttgtcacctcattcagattctatatttctagtgctataatttcctcatttttataaatatgatgaagactaggaaaataactctttcagatgctacatgatactttttgtatgcaaattcattgctctggatatgacaaaaccaacagtttaaagtcttctagtacattatttaatcttttgtatgtaaacatctcttttgtttttgaagaaactcacaatattttagacttaactttaaccactgtggcagagtgagatgatataatctttaatatttaagaggtttatgaactttagttggtaaatacaaagagcgaaaaagaggtattttgaaaataatgccatacaggaataccaggtaaatattttttctaatattctttgaagtgtttgtacctttagaaatatttttgaaaataaaaatcctcctttatctctaataacttatgtcataattatttatccttcctggaatcagaattttggatacagtatttgtacatttttgcttgattacagtacttgacactgaggaatgttatcataaatgtatatttttataaccccattttgtctatgactgaaataacaaattaaagtttttgaagaattcagaaaataacatgatttgttttcacaacacattcaggttgttatttatgcttgcttggctaactcaaatattggttgcatttgtgtgtctaagtacactttttatgttataatcatttttaaagtgtcaaaatgaactttgaaactaaatctaaagagctaaccaaagaagaaatattaactcattaattatcatttcaggtttaatttgtcagtaagtgtggtatttaaggcattaatgtgtaatataagaatgaaaatcatagaataaatatgggttttctacttggaacctcaaataatccatatgtaataattttctttaagttatagctcagtattaaagtaaaacgaattagtctcttgatgatatgtggtattctattgtgcttacctctatgtgtcccattcatttgatttagctaggccgtatctttagtgcagttttgttttacaagtatctggttaaaacaaaaacaaatgatgcgaggatttaattttgtaacgtatcgtgcttcattgttattacgaacacgtttagttgaatttttcagatattacccagatctcttgacattctatggatctatatgatcctctaaaaattagaaaaataaaattaatgtaccttttcaaacggaaacaatgaagcattaacattgcactagaaagaaataactgagtggatattacatgagcattatagtcacttcacaatgctttgcacactgtttctacatagctgccacaaagaaatccaaattccttaggttagcagatgagaccctttcacacctgtccctgtccactgctgtagctttatcttttgctcctctccgatttgcacctttactacagccacactacattttaactctcaatttcccaagtttatactctcccttttgactggagtaaatcttgtctattattttaccttgcaaactctcacaaacattttatattaggcacttaaaatgagacattaacttgcccagaaagctttccctaatcaaaaggtataatgggtttgggcacagagcatagcttgtttctaagaagtggaagtagattttcatttcctattgcaatgaaaaaaaatgtgactcatatatctcatctttatacttagtttatttcaggtactgtcataatctaaaaacatgtatctccttttgagaaagctgggaaggtattttgctcatttcaaaccattttcagcattaagtctagatatcttcacgctgcgaacccctaagcacatctccattatcccattaacagtattgtattcttgtttgttggcttctgtgtatgggtgccttttcacatattaaattcttcttgctgttaggacaaatacctagtattttttgtttgtatctccaaggcctcaattagtgcctggtggcataatatctatctacctatctatctatttgtctatctatttacctacctacctatctacctatcatttaaattaagaatgaagttgattgcagtaactttttaagaaaagtatcataaagaaacaaattatttttctatacaattcaaaatagtaaattaaataattatggatttaatggaaatgattcattttatttattctgataaattaggttcttgggctcagttcttcatttttcttaagaaaatttaggttggtctatatgatctatatggctgtttaacacattacttaatttattaaaattagccatacgatagtcctagattttatcatacatttgagaacatacagaaattcagtttacttttacttatcataattgtgtctttaacctagatgtcttatatttcaaaaataaggtaaacacttgtgagatccattatttactcaataaatatttattgataaataagtctacaatgaattgtgttttgcccattgaaggaaagcacgaatgtattggtgactaaatagtttgtcagatatgtcagatataatatatatgaagtttagctgaatgtgaactttgtgaataaaatttataaataatgaatatctttccatattaagtcttacttttaatgatgataaaattataatatattaatttatgggtgaaaataaaatgccttttataatacatattgtaaatactagtgaaaacaaatagctcttgataatgataggctttctcataagttgttggataaagattaatatgcaaagtttcacatttttaaatgagggcaggttaaaaataaaaacagaaaataaagctgaaatatgtggaccttcaagcatttaaaaatggaaattgcattcctttcagataaccacaagatggtgtatcataatttttataaaaaatggctttaattgtgatgtaaatattaatgcctcaaggacacattgctttttatttattcaaacttttaaaatactcagaaccttttctcatctgaatgtgtctgaaaaggtaactaatcaacacatgcattttataattatttttctttttgccttatctcttctgtgattttaaagatatttctactgaagtttcactgagaaagcaatccaagaaactgttgtgtatctgagacaattatcacactttgggtgtatggatttggttgaaagatcttgtgtccctcttctaagacttacttttggctataacaagctgcttaatatactgaattttgttgttttctctgataatatttataatatgttggctttgtaagcaagaattataagatataataattttaatttttataaactttttataacatggattgtttaaaattctgcatttcttaaatatttgcatatgtctacttttaacagacatacataatttttctttttttaggttttcagcaagaacagcaacataacttctatagtttgatctctttttgtgtgttttgtatatagaaagaatatttttcccatgtatttgaaaatgtatttgcttatacaaattgtttttattgaactgtctggatataaattattgagtttcctgacataaaaaaaatcttaagatgaagccaaaagcactccatttcttattaagtgtaaattaagtaaatatgtctaagaaataaaatatatatatatataaattattgctcagatactgaatttgtgcaataggtgtcccatcttgaacacacatttttgttgtctttaaaatggttaaaatgtatttttaaatctatgtggtattgttgtttttttaggacatagtctactttggtcaatgtagctgtttctattatagaacactggcaaattttacctaagacaatctctaaataattatatttttttctggtgcactgatagttcaaaaacattttgtgagggaacatagaatgttcttcagtgtttagaggaataaccaatttggaatacagctataaatcagagtagtagaagcacaaatgaacaaaacatttcaatttgggggatgataagaagaaaatcagagggtttagtttaaacacgcaagactagggatcctattttaaaggtcatttataaggaaaacacgtagcaaagccaactaattctgtatttcatggaaacagaagaatgaaaacagtttgtttacagatagctacgtataagctgctgttaaaattttaaataattagttctaacaggagcaatgctttttagaagaatatacttttggggtaaggtataggaatgcaaacagtgttataaattatcagtaaaaatgttatgtcaatatttatgttttgcccagtaatgcctttttagaaactataagatatctatactttttattaattacatttgatgtaagaaattttagctgaacttaattttacagaagttaaaatttctaagtaaattttcagtgtaaaaattatagctgtaaagcataattatataataatatcatattactttttcttaaaatgcgtttcacagctatattgactaaagttgtgttgattcttgtcagaccttatgtattaattttttaacttgttcttcacaagttaaaaagtataaataaactttggacaaatgtcaattttttaattgtttttatatcactgcctttctttgagagctgagtgtctttcaatttccatgaatgatctatataatgactaattggatgaatttttaaaatgtcttgatatacaaatataaaatactgtactttgaaatgaggtgtcaatcttcattttgcttactgatctacttccaaatcagctaaaggatttttaggtcatttgtttatgataacccatactctttgtatccccacaaataattatttttaattaaaataatagcttaatagataattttaccaccttatttttataaatgactttagtttttaaagtgtaataccacatttgaatacaaaactaccctaagagccatgtaaatattatcatctatatagtacagatgaggataataagtatctcaagggtgaagttgttttccaagttcaaagatgcctagtctaacagtgtttcaaccatatcaagctgtacagaatggaggcagaatatttaactattcttcctccttgaatttttcactaaggaaatatatggattaggagtttgaattagataaacagattatgggctttggtcataagcagcctaataatttcaccttcctagatagtaagcatgagttatggaattaaaaagacttggaaacataactttgtttaaccttagataaaattacttagcctctctattcttctttttaaataaataaataaatgaaacaatgaataaacaagttatgaatccataaaaacggtgttttaagaattaattaagatagttaatatacatagagggcttctttgcacataactggcttataacaagcagctcttttaaaaataatatcattattattatttgtaaagctgatacattttaactgccacaccttatgaaaagaaagttttctagcttaagcattagttatttggatgtaactcttaaaaaaaatcgtatcattatgactactagcaaaaatgtgatgattagtattattttttctaaaaatgcatttcgcagctatattgattaaagttgtgttgtcagaccttattttttttttttaactagcttaagtaggggaaatttaaaagtgtataatgatcctcaatttttctccatcccattgtgtttgcaaaatacaatatgaggatattgggtaactgtttctgttagagtaaaggtttctgagaatattttaatatttgataatgtttatcattgtgaaataatccaggctaaagcataacatgatttataatttaattcactaagaaagatatgtatttcttttgccctcataatttttttctgtctgctgtataatttagtattcaaaaaatttacatttagcaagaatagagtccaggtaaaaagctcagctgagaatgaaatcatcattaatgaggcaggctaatatgataaagctttcatagatggaagttaagataatagagttcctgtcttagctctgagactagttagatatataacttgacttcttaagttttaattttttctagctataaaactacagtgattgatcagtaggatcacgaaagatgctacatgtaaagtttcttttgactgctgaatagcttatgtaaataataaaacttttttttaaagatagctgctctaaaaccaaatatcaagaacaaggttgtatatatttttttaacatgagtgatttagccagtcattttccatctttcattgcttcactgttatattcatatagccttaggtcaattcatacttctgatgtatagcattaactgtttgatgtttttaaaaggctgccaatcaaaacagttatattcacaagaaaaaatttaacgggtcacattaaatgacatttatttttgttatttaacacaccaatattatgtaaaatattatatcttatatcctatgaatattttttccattttagttattattattatctaatgtggtagaataattttctgcaactaatcacagtgactgttttgatttgtttccactacatgtgacttactattcttgggcaaatggcctatagagtcagaaattaattggagagtgtctaagaatatatagtatatccataattagttaacaaataatttaaatgacaaacacaaaataaaagtttggttgatatgtactagaatatattagaccactgaggtacaatagtatcttatagataccattgataggagtagctcaaattttggtaggctccaagtaggataagtagaaattgtatgtagaaatggttaggaattattctgaatgaatactaaaatatcatttagttattttatactatcaaaattaggccagcgagatacacaaaataggatttcctccttaaaaataaatactaaatgcaggcttgaaagtaacatattttatgatatttcttgaccaatgaatacatatattcaaaaagagagtgatgagcataaaagttaaatcatgctggttatttttcttcagatactgtttttcaaaaataagtatattgctaaacataatggttttaactttaaaatgaagctacatatgtcaattatcaatgtggagcatgatttcaactacacttctaatataaaaagaaatctgtgcttctccaaatgctgtcacatcatgttattataaaaatatatcttttaattaggaagttaagcttttaagaataaatattctgtaacatcaacaatgatattcttgaaaacatttacctgtggactatttatgtattttcttattacatccaaaatacaaaatagagctctttaaaaaaaaaaaaaagctctataaaaaagcaatgtaaatatggccaagttcatactatcaagatttccagatctacattgtttcaagaattagagatgtgtaaatataaattgactaattaaatataatgaattttattaagagttttactaatttaaatgcaattatacatgctaacagctcaaagatttaaattttcattttcaggaatcttctatttggttagtgccaccataccatccagacactgtttagtaatcttttgaaacttactaaaagaggtttttaataatggttagtatccttgtgcctttcttttttctttttgtagtctgttatattaatgtggagaaacatttttattgttgttttcatcctaaggaactgaccttatttaatgacacagtgcgtgggtttccacccctaaatagtgattttaaaagcaagatagttgtctttctctttcttcttccctccagctttccctttcttcttctcctccttctcctccctctccttctccttctcttctccttctcctccttctcctctccttctcctcctccttcctttcctttcctttctttcctttcctctttccttccttccttctttctttctttctttctttcctttctctctctctctctccctccctcctttctttctttctctctttctctgtccatctttctttctctctttccctctctctctttctttctccatttcttttcttctttcttctttttttagtataaccaggaaaattactgcctagtgcacttgggttttgagacttatttcatagtccaataaaaagatttaaaataaatttcaatcattatataaagtataaaagacaatttgtctctatttaatgataatacgttagaattttacttaaaagttagacacagtaaattttgggcaatgtacagcacagggaaacaattatatttcacaaaactctgtatagtttcagctttagagacttatataaatcaagatatggaatttgccttgtaaacctttaaacaaaaagaaaagaatgtatatttgctctagtaccataaatgaacagttctttgtgatatccttgaatttgtttaatttgccatgttaattgtaaaatcttgctcaaatctaaagattatcaagttttaaaatgggttagaattattctacaaatgagaaaagaacctatcgtctcacagtaactttatcaataacctaaataaacctatttttcatgtaaacttacattgataaataacaaaagagctggcaaaattcatcttattcaaagagaaaattaataaaatttgtattttgtcattatgtaatcgagaccattgattgacttatgaaagattgcttgattaaatttttactttctaatggctttgtaagctaaataaagtctatgacgacaatggtgatttacatgtttacaattttgagatagttgtaaaatttgtaaatataatttatttaagacaatttcaaattataaaagataatactattctggtaattgattagaatgggcttttttcaatttacattatctattactcaacaatataaacttaatattatatgaaattgcttaaaatggttttaaatgttcttatttgtagtctgaagtaagtatggggtactaaacacagagtttacctcttaaattgctagaaataatattgagtcatttcatagttgagcttgtatgcacatgtgtaagattttttcctaagaaagttagttacttagcctactcccttactataggcaaattattaattaacatttatactctattctgttttgaaagtaatgtaaccaaaatatctgaaaattgagattgccaagaagaaggtgtcataaatttttgaagatttgggaaatttattggttttaaatgaaggtttatttcaaacgattcaatgttacacgtcctataacaattttaaatgtcaacgggatcaagttttgaccatgttatgtcatctaattaattcttctgttaaatgtttcaacagagagccaagactaagttacctcaagactatgtattcctccctattttggagtcagtttccatttctacagtgttgtcatcatcaccatcttcatcatcattatcatcatgttcttaataagtacatctaatagtaggtattaagcaacaagaaacactgtttccatatactggctgtcaggtgccacataaatcctttaatagaaatataattcatgaattgcagaactgcataatttaacacataatacataatgcatggcaatgactctgtagttaatggggaattcacaagtcacatttaatcatcacccattacaagtgctaatatattaatatttttattaatttaatgttattaaacaaatgctaaagttttgcctaattttattaggcaaaattaattgtatgcaatatattttcactaggtttctaaacctgaaaattttttaagcaattgaattagaaacattgttaaataagaattaaaatattagagtcctgtgtatctattgttaattcaatcaacatttaaagagcttatgtgtgtacaagcagtgccgtgagaacttgacctctgctctacacaattcagggagagagatacatagagcactggcaggccagacagaaaaacaggataatgagtggaaaatactgacagaataaaacaaaatcaagttgtgaaaacaaaagaatgtgcctggtcaagtggaaagggcttcctaattaagttaaaacttgagccatgtcctgaggtaggggataaagttgggatgatgtgaaagatgaaagaactcagcagggtaccagaacaaggagaaacaaaggaaaaatattaatggaagtcccaccaataaagggagtgtgaggagaaagagagagagatggaagcagtggggaagggagaagagggctagatcagagaagtcatgatggaaaaaaataatagatttgagtttgacttgtttcctaaaggagaaaatgctattaataattgatattttaaaaatagattatccgggtaattgtgaacctttacagaagagtggcgtagacgtagaattaggaagaccattaaggaaactctttaaggagtccatcaaaggaaaattaggatatagccagagattgacaggaaggtaatagagcagtgtcaaaatcataaaactagatatatcaggatatgttgctggaatcttaggtgtgaactgtagaaagttatccaacctctctctgaatcagttttctctgacacacagttacctaattaattcaaagtatgtttagactggcacaaactattatgaaaacaattttttaaatgtatttttaagttaacatataaaattgtatgtatatatcatatataacgtgttttgatgtatatatacattgtggaatggttagatatgtctaattagcaaatgcattacctcacatatttattatttttgcaatgagaacacttattcactcttttagcacttttcaataatatattattattaactatagtggccatgctgtggaacagagctcttgaaatttttcttcctgcctaactgtaaatatgtatcggaaaatgacacacatatggtcttaaatattttcatcatgttgtcttagaaatagtctaagttcataatcaataaagcagctaacgcacaaataagtcttcacatgtatctcaatcagttggggagagacactaacaaaattttgtttcatatatatgactctacaatataaattttgaggagctgtaacaataagccccagataaacagaggttctagcaaatctatttccaatgagatgggaactaagacaaaagcaacatagggtcatattttttctcatttgataaattatcagctctcagttatcaagctaatgatgacaaaaaagttaatatttgtttgtagatgtctaacatgctataatttgtcatttcatgattaagtcatatttgtttgtaatcactgtcaatgtttctataggcataatcacaaaaaagacataatgaaatgccagaaattgttttccatattttatgtctgtgtgagtgctatctttgttttgagatgtacaatgaagaatcaatgttcaaacaacatttgcatatctcatcttgtgatctgaaaagtagtatgatttgtctatttttttgtatcaagaatgggtttctggtatagaattgtcattgtatttaaattttaaagtagatgtctatgtcatgctaatcatttttatataatgtcataggaaaattttatttaatatatgtgtaatatatacattactagctggttgttcatttcagtatcgggtggagattttctttaaactagcccacttttatagaatattttaattatcatgggttgagtgtttaaagtgtgacatttgttataacttttacaatgaaaattttcaaaccttcaaggatgttatgtgacaagtctgttgaggatgattttaatattgatcttggacagttacagtttatgtatcttgtaatatttaatttttctgtgttcttctgtagaggtccttctgtagtgccatggtagaagaattgaggatgtccctgaagtgccagcgtcggttaaaacataagccacaggccccagttattgtgaaaacagaagaagttatcaacatgcacacatttaacgacagaaggttgccaggtaaagaaaccatggcataaagctgggaggccaaacacccaagcacaaactgtcgtctttttccaaacaatttagccagaatgtttcctgtggaaatatgcaacctgtgcaaaataaaatgagttacctcatgccgctgtgtctatgaactagagactctgtgatctaagcagttgcaatgatcagacttgatttacaagcatcatggatcaaccaagttacacggggttacactgttaatcatgggttcctcccttcttctgagtgaatgttaacatgcgcattttgtggctgatttcaaatgcagtccagtgagaaattacaggttccttttgaagctcaactgttgccaggagatggaatatcaatgcccaacagggcaaccaataaaagtgtcactaagaatataaatatttggaatcagcaaaaactgtagtgttacaggaaacagtacagtcttctgaacacccagatcatagaggtgatgatgttactagcccccaactactcagtataattattgtctgaatgcaaagtatgtgtttataggatgtgaaaaaatgtaatgcaaaacaaatttgaatcccatggcagttggaatataaagcagatgttcatcacttattttccttttttcttttcttatttttttttttgacagtctgtgtcactgattgagatagaaatgccaattatcaaggaaataatgttttcttaagttccctaaggcagaagatttaacatgcaattctaccagatcccttcctattcccccaacaccttttctctaacccccatatcccaaataataataataataataataataataataataataataataaaagcagttggttcagtgattctgaattaaaaggataatgttttgcaatgttcaagttgtaaaaactggccgagtattggctgtgtggaagactaaagctttcattctaacattcagacatagcaatccaaacccttgttcctgctgtaaatgaacttgatggagcatgggcagatttcagtgatacgagaaaggggactggtcatctatagaaaaatctgtgagagaacttggaagtggactgcgtttatcaatacagtcacaatgttaaatgaacaaaattcttgaacagttttttttcaaaaaatgttcaggtttatttgtggaaatgcaagatttctatgaaaatagtttttgtatggaaatttttgtaatactttttatcaacaaaacaagaacatgtgttcctgtcaggggtgtgatgtcaagcatgaatggtagtgcgtgtgcaccaccaacgtttggtgaaaactatttttatcaagaaaaaaggaatcatagaagagaaatattttcaagttagataatataaaagctaggtgcactaccaccactgcttaccatgccacacccctggtttccacgaggctgacaacatactgtaatgaacaattgtgtgtaaaatggtaaaagacacagacctcttgacaacattgtgataacagttgagtgcacacagtttgctgtttgaatccaatgcacaaaattaaaaaaaatcattaaaactatgttcattttactttcagctttgtctttcatttttctcttgtatgtgtaatgaatgcaccatatacttctttacattaagagaagcacatatcctaaatatttctagatcatcaaggatggccacttcccaactacctgaagaaaagaagaaaaatgcttgggggaggacctactcagatctggaaaagctggactgggatataaaaagtaatcttaagttcagagcagttaaaataagacaaacagtagttctagaggtgacagacatgatattaccttttcaatgagaggatattgactttgtaagttaggttgtataagactgtacagtgatcactaacatttaaagttcaactcatatgctatttaataattccttgcacattgataatttaatgtaattcagcataaaacagagaaagagataggtctaatattccactta

SEQ ID NO: 17306 - DNA, 19854 bp, Human; identical to SEQ ID NO: 12585

SEQ ID NO: 17307 - DNA, 42923 bp, Human
  misc_feature (1)...(42923): n = A,T,C or G
ctcactgcaagctgcgcctcctgggttcaagtgatgctcctgcctcagcctcccgagtcgctggggttacaggcgcctgccaccatgcccagctaatttttgttatttttggtagagatggggttttgccgtgttggccaggctggtgtcgaactcctaacctcagatgatccacccacctcggcctcccgaagtgctgggattacaggcgtgagccactgcaccaggcccttattgtgtttttaagtcaacaaatgtctcttcctgcaacgaatttcctgtgaatttttcattattgatgtatcagattaggcattttatgtgctttcacatattaataattgtatcttattatacatagattaatgccaaaatttcagcctttcatattttaaataggttttactttattataaaaataagaatattttctctttggagttctatctctaaagagacattgttttattctctactttttactactttaaaaaatctgtgtaatatcttagtagataagatctagttttacagatagtgcttctttttaattttttgagacggagtcttgctctgttgcccaggctgaagtgcagtggcgcaatctcagctcactgcagtctccacctcctgggttcaatctattctcctgcctcagcctcttgagtagctgggattacaggcacccaccaccacacctgcctatttttttttttttttttttgtagttttagtagaaacgtggtttcaccatgttggcaggcaggtcttgaactcctgacttccagtgatccccccccgcctcagcatcccaaagtgctgggattactggtgtgagccaccgtgcccagaccagttagtgcttcttaatggcattttgcacactgttttgcgtaatatcactgaaagtggggtgcttgtataccactcttctaagatgggtaggggacagtaacataatagtgatatccctgaactgtatgacccaagcatgataattggtcttgatcctagtatcattgccactcctttcttcttcacataactttcagagttgctggaatggacagtgctccgtattttcgtagcctagacagaaatttggaaatgacactgcttctttcaaacacttttctttcacaattcactttctaaaaaaatcagaatacagctttattgagatatatactgtgcaattcatttatttaaagtgtacaattcagtggtttttaatgtattcagagttgtgcaaacacagtcaattttggaacattgtcattacttccatcaaaaaccctaaaatgcattaatagtcactttaccctgacccctagtcttaggcagtcactaatttactttctgtctctatagatttacctattttggataatttagagttcactttttagaagactcttttaagctggaaaaaggaatattaaggcataaatgtgatagcagggagcaggggtggaagaattagcagcagttccatatctgccttttgagttcatagagcagtttacatgtagtaaggcaggtgctattgctgcagctctggattttggtgattcagtaagcagtaagttggagggactggtccaaggcttggtagctgcttgcctagccaggtcctaatttaacactacttctctcatttgaaatgccttctaatactggtaatggtagcagcagcagcaacagtagcaatagtattaaatgtctgacatttagtgagtacttatacaatgtgccagttttataagtagtttacatgtattaacttatttaacccaaacaacattcctgacttaggcaacattcctgagttattctattttatagatgaaaactgaagcacattttattgtagattttttttttaagtatagtttaaaatcttgaaactacccatgaagttaaacttgtttatatgtagggttaatactttttaatgactgcaaaaattcattccattattgctattttttccatttcagtgaaactgcttttggttacaagggtctaaagatcctgttatactatattgctggtagcctgtcaacaatgttccgtgttgaatatgcatctaaagttgatgagaactttgactgtgtagaggtaagaacagaaatactttttaaactgttttccaatttaatttattttaaaataggttttaggccaggtgcggtggctcacacctgtaaccccagcagtttgggggaccaaggggggcagatcttttgatcttaggagttcgagaccagcctggccaacatagtgagagcccatttctcaaaaaaaccacaaaaattagtggggcgtggtggcatgtgtctgtaattccagctactcaggaggctgaggtcagaggatggcttgagcccaggaggcagaggctacagtcagctgagatcatgccactgtactacagcctggatgacagagctagaccctgtctcaaaaacaaaacaaacaaacaataaacaaatagtttctaaaaattaaaggtttgggctgggtgcagtggcttgtgcctataatgccagtgcttttggaggctgaagtgggaggatctcaagcccaggagttggaaaccagcctggacaacatagtgagaccctcagctacttgggaggctgaggtgggaggattacttgagcccaggagcttgaggctgccagtgagccatgatggcaccactgcactccagcccgggcaacagaacaagaccctgtctcttaaaaaaaaaaaaaaaaaaaaaaaaaaaaaaaattaaggtttgagggaagagagaatctgttatatggtagttttaaaatcacattctcaggctgggtgtggtggctaacgcctataatcccagcactttgggaggccaaggtgggcggatcacctgaggccaggagttcaagaccagtctggccaacatggtgaaaccccgtctctactaaaaatacaaaaattagctgggcgtggtggtacacacctgtaatcccagctacttgggaggctgaggcaggagaattgcttgaacctgggaggcagaggttgcagtgagttgagatcgtgccactgcactgcagcctgggtgacagagtgaaactgtctcaaaaaaaaattaattaattaaataaaatcatatactcagtctttagttatggaggcatttgcctccctgtcattacagttaatcctgtgatcatgatcctgttctgtttcctgcatggaccttcttcataaaaatctttgcctttgtgatcagagttttatttttttgccaacttttgttttttattgtggttatttcctataagtcaaagaagatggagggaaatagctaaattttccacttttacctagtgtggaatctattgaagtttctcttgctgcatttctaatcccacaaattttgctaatatattcctttatggatggaatacatggatgatcaagctgatcacattataaaactatttaaagtgagtgtatcaaaaggggataaaggtaaagagagagatgaggccgggcacagtggctcatgcctgtaatcctatcactttgggaggctgaggtgggcggatcacctgaggtcaggagtttgagaccagcctggccaacatggcgaaaccccgtctctactaaaaatacaaaaattagctgggcgcagtggtgcatgcctgtaatcccagctactcgggaggctaaggcaggagaattgcttgaacccaggaggtggaggttgcagtgagccaagattgcgccattgcactccagcctgggtgacaaagcaagactccatctcaaaaaaagagagagagatgagtatgcatctgtggtagactgaataatggttccccccaaaagatatccatgtcctaatatctggaacctgtgaatggtgcctcatattgcaaaaagcacttcgctgatgtaattaaatatcttgatattatcctggaatatttgggtggacctaaatgtaatgacatgtatcctaatgagagggagacagaaggaaacttgatgacagaaaaggagaaggcagtgtgaccacagaggcagatgtgatatggccagaagccaaagaatgcttactcactagaagctggaagaagaaaggaacagattccctcctagagcttccagagggagtgtattaccttggttacagcccagtgatactgatttcagaacacctccagaccgtaagagaataaatattgttttaagccaccaagtttgtggtaatttattatagcagccacaggaaacgaatacaggttttcataccaggaagtgggatgctgctataaccaataactaaaaatgtagaagtgtctttggaaataggtagaggctggaagagttttgaaggtgcatgatagaaaaagcatagattaccttgaatggactgttggtagaaatatggatgttaaaggaaatatgggctgggcgcagtggctcatgcctgtaatcccagcaatttagaaggccaaggcgggaggatcacctgaggtcaggagtttgagactagcctggccaacatggtgaaacccatctctactaaaaatacaaaaattagccgggcgtggtggcaggcacatgtaatcccagcaacttggggggctgaggcaggagaatcacttgaacctgggaggcagaggttgcagtgagccaagatcgcgccattcattgcactccagccggggcaacaaaagcaaaactccatctcaaaaataaataaataaataaataaaggaaataatggactgttggttagggctcagaatgaagctaggagtgtaggagagaacacctgtatcatcttagagaatatatatatagtcataaacttagttttggtagaaacacgaacatgagctggatgcgttggctcatgcctataatcccacagcactttgggaggccagggcaggtggatcacgaggtcaggagtttgagtccagcctggccaacatagtgaaaccccgtctctactaaaaatacaaaaattagcccggcatggtggcgcatgcctgtaatcccagctactcgggaggctgaggcaggagaatcaccggaacccggtaggcggaggttgcggtgagccgatatcgcgccactgcactccagcctgggcaacagagcgagactctgtctcaaaaaaaaagtgcctctgctactgaggagaatgaggcaggaggatcatttgaggccagcaggttgaggctacagtaaggtaagtatgatcatgccactgcactccagcctgggtgacagtgagaccctgtctttaaaaaaaaaaaaaaaaaaaaaaaggccaggcttagtggctcacatttgtaatcctagcactttgggaggccaaggtaggtagatcacttgggctcaggagttcaagccagcctgggcagtatggcgaaaacccatctctacacgcacacacgcacgcatgcacacacacacacgctgacacacacacgctgggtgtggtggtgtgtgcctgtagttccagctactctggagcctgaggtgggagactggcttaagcacgggaggtgaaggttgcagtgagccaagatggtgccactgcactccagcctgagtgacagagccagaccttgtctccaaaaaacaaacaaacaaacaaaagaagtgcctctggttggtgagggcttagaataaaatgaggaacatgtatttggcaactggagaaaaggatatccttgttctatagtggcagaaagcctagctgagttatgtcctgcagttctgtggaaaggagaacttactgtaagcaatgaacttggatgtttagctgaggaggttttcatggaaagtattggaggtgtggcctgatttctggctgcttatagtaaagtgatgaaagagataaattgagggaagaactgttaaacaaaaaggatacaggacttgatgatttgggaaattcttaacctatccagattgtagaagacactagttaggatattcattgtcaggaaggtggaaagtgtgttctggagagaaagccgtgagtgtgacaggataaccttttgctagtgctgaagggattaggcacgtgactcatggatctcctcagttgtctcagcaaaaagctaggaatgtagatctggggaacatttgtggaggaccctcttgtctaatggtatgaaccctcatgacgtacacaggcgactcaagggttttgagaattaaaactttatagtgcagcttggattgacaggacaaaatgaaggaaggctgtatgaactctccaaatttcacaggcaggaaacaggctaataaaactgctcagctgccaacatgtgctacctttaaagaaagtggaagaatgactctgagggcaaagctttgggtccagagggtggagctgcaggccacagttattcttaggccttgaaacctaatggagtttgccatgctgaattttgaaattgcttggtggcagtggctcctttcttccttccatttccttttctggaatgagagattctataactgttgtcctatgcctgtcctaccattgtcttttggaagtgatactgtgttttctaatttcacaggttcatagatggagaggaattttgccctaggatgtatcatacccacagtcttacctatgatgagaggtgtgacttttgaactgactatatctagatgagattttgggcttgagttgatatggtaatggttgagacttttaggaatgtttggatagaatgaatgtattttgcatgtgggatggacatgaatctttgagggccttaagaaaattatattttaggcttgttctgtttccgagcattcctcatttaagggcattgaaacttcaccattgatttttttaaagattaaatcccattttgtcactaaatcatatttataaaattgaaagttaattcttatagcaaaatctcttttctttgcacttattaatccagcaagttttagtaaattatatctgatatactgttggtaatactgtgctagacacaagtatggaaaatgaaatatattacttcatactgtatgtcataactttcctctgcagaagtagcagttcctaaagaattaacaattaaaccaactttttcagggctttaaactgattttaactgttgactttacctcttttgccacccctatgccccatctatatttttggttaaaacctcctctcattactggaactgacttacttggcccttttttattatttaaattttgagggatttgttatatttaaaggttttgcccaaagtcatacaactagtaaataatcagtattgtactaggagatgattatttagtgttattatgcataatatataataatatcctgattaaaagatgttaggaatatttatgacctgttctaagaggatccaggctcttgggcttactgctttttctctctctctcccgttatttttttttttaattttaagttctgggatacatgtgcagaacttgcacgtttgttacataggtatctttccccttttgaccatgtgtttttccccctcattaaaaaaaatatttttttaatttttaattttttgtagagacggggtcttgctatagtgcccagactggcctcaaactcctggcctcaagcaatcttcccaccttggccttccaaaatgctgggattacaggcacaagccaccgtacccagccttctcctgtgttttatgccatgtgctcccagtttactgctatcattgtaaggagcttcacactagcaaaccccttatggttaaaaataccatattggtaagcttgatggaatctgattacttcatactgtatgtcataactttcttttgcagaagtagcagttcctaaaacattaacaatgccaccaactttttcaggactttaaactgacattaacttctgactttacctcttttgccaaccctatgccccatctataaaactaattgtgcgtagcatgaaaaagatctgaaatagtttcatataatatgaattgtgcatagcatgaaaaagatctgaagtagtttcatattcattattcaactttagtattagaaatattttgagttctatttggtttttttgtgtgtttttccccacttcccagccatgtttgagatgactgagcttgccagataaataatatgtaactacatttaatatttgttttattttatatagtttgtttcccaggataacttttgaaattgtgcagatacaaaagtgattctgagtaatactgtagtggtttgatgtttgaaaagatgtaatcttagataaactagcatttaacacatttattaaaatagagttttttcataatcaaatatgtagattgctaaattctccagacccaagcccagctagatattcttattaaaaatgcaggtgatgtttttccttgtgtgtaaacccactgttggagggtttttgttttttacagttgcagctgatagcactgaattgatttcttccaaaggaactattgatttagttatagataaatcttttaaatatttcatgcagtgaaaatagctgtgtatttgcattgacatctaattgttccattcttgaaaattaggtttttccatttagaaatactgtgttaggaataaggaatcaatcttttataatgtctctttgtagagttacttatttgctttgtggtcaaagatcatttatattgcgtattcaaacaaagacttttttccccttattaaaaacgattgggtaggggatatgtgggtcatgggcttgcttcttctatctcagtttgcagtgagtgttcattccatagtgccttctgtgttgttgatgccagcgatacagtggcagacaaagtcatggagcttacattctagccaagaggaacagtcagtaaacaaaatagtaaatacacaaattaaattcaggcagtattatgaagatacattttgctcatttctgaatgataaaggaggaaccagccatgttataatctgagggtaaagcttactaagatacaaaggctctaaaaatacagcatttttggcatttttgtagtccagaaagattaccagggttaaatcattgtggtgatggagagaggggtaggagatggttgaaggggatgcaaagctagatcatcatataggatcttgtgttctgtgataggtgtttgcaagaaataagagtagttggcattctttagaggcattcttaagtaggtggaggtcataaacaatgtgatttatatttttaaaatatgattctggctgctgtgcagagaacacactgtatagggcaaaagtgaaagaagagaccggaacattgcagtgttagaggtgacactggacttagttgtcagagtaaggaacattttggaggtctgctgttgaattagatgtgacagatgaagaaaaaaaacgagaaccccattgcccaagttcaattatggtactgttaactgggaaaactatagaagaaataggtttaagtggaaaaaataaaaaaattttattttggatgttaggtttgagtctaatatattagggctttgcagatcatactgcatagatggtcagcagccataacatctgcttagaagttatttcttattaggattatgtcattacattaatttttaatcatccattcttttacttttccaagctgaatgctctagttgcacctaaaattcttcagtcacaattaagatgcctataaaatctctactagccaccatctttaaaggaaacataattctgaattttacaatacaataaacttgattattcagacactgatgattttttcatctggttgtccttgacctttgcttttattaacacctcctgctctgtgcttgtaatgccagctactctgtaggctgactcaggaggatcatttgaggccaggaatttgagaccagccttggtaacataataagaccctgcctattaaaaaaaaaaaatgctgaacgtggtggctcaaacctgtaatcccagcgctttgggaggccgaggtggacaggtcacttgaggtcaggagtttgagactagcctggccaacatggtgaaacctcatctctaccaaaagtgcaaaaattagccaggtgttgtggtgcgtgcttgtggtcctagctactcaggagggtgaggcaggagaatcacttgaactcgggaagtggaggttgcaggaagccgagttcgcgccactgtactccagcttgggtgacagagcaagactctgtctcaaaaaacgaaaacaaaagctaggcatgatggcatgctcctgtagtcccagctacttggaaggctgagacagaaggatctcttgagcccaggaggtcaaggctgcagtaagctatggttacactactgcattccagcctaggtgacagagcaagactcttgtcttaaaaacaaaaacctcctgccttttcttgggggtaatttcattgccttttagtgaagtagtgggtaactaagattgttgtcttgctaattgctagcatttctgggaaaagtttggtacaggaagttgaaatagatggataaagtttgtattaactgtgaatttcagttattttatcctagtgtcccactaattggattgaatttgagaggatatgagagcagattttaaaaattttatggagtgtttagcctctttctaggaaaatcctacatccagaaatttcgaaaaaatctttggtagactagtaaaatttcaaattgtgatggtgttcttgataagtaatactttttatgaaatatcataaagagctttaaaagtatatattgacaagtttatcttgtttagttcaagtagcaaaatactaatgcagtgtaaataaacataatatgacctttgtttttccattagtgaaaaagttcacacttttaatttctcaacaatacattctgtagttaaagcttaaatattatcagagaacatgagattgagaacattaagtagatacagaatttcttttgcttgtttttttttttttttagcatattttaggtagtcttagaattatagttaagtctatgtaccactttagccaagtaaagaacaacatgttaccacctacttaacgtgcctttaatttcaatctcaaaaataactagacaaatttagacaaatggtgctgcttaagataagatgttagagaggttattgggttttcaaatgtgtataaatacaaatataaacattaaaaaaatagattactaattatcaggcatatcgctttattcaataatgaggaaatgcaaaaattgctccatatgaacatgttcatgtgtaataaagtacagaacactggaacttgaaatgaccatagttaaatagtatacaatctaaaaatatttcataatgacccacctaccagaatatctaactagaatacttttgcactttcctttttaaaaataaattaccaagcgttaggaaaccatttgtaagagatgtctttgttaattaaatatatcaggttgtattctggtttctttttttgagacggagtctcaccctgtcacccaggctggagtgcagtggcgcagtcttggctcactgcaacctccgcctcccaagttcaagtgattctcctgcctcagcctcccaagtagctgggattacaggtgcacaccaccacgcccagctacttttgtatttttattagagacagggtttcaccatgttggccaggctggtctcaaactcctgacttcaggtgatgtgcatattttggcctcccaaagtgctgggattataggtgtgagccaccatgcccagcctggtgtctttttaaaaatttttttgaaattctagttccctggtgtgtctagtcagctgaatttcttaccctttctatatttctgtataattttagttgaagtttagaataatgctctggaatacagggaatttttcagtgatcttcagaaatagattctaaacttttagccacaaacattggaattaaaaagtttctgttcatttttaactctattcaattaacaatgattaaatgaggtcttgctcttgtgctgattttattatctgatcagtaatccaatctgaaagacgaatattttaaattaaactaaattatatatttgagaaaagagtacagatctctaagacatggtagtcaggatttttttttttcttaaagcagaatccatttaatagagaaatgcagacattttccctttagtgaagcgaagttgtaaattctaggttgaagaactatttggttttaagttgtatattttatgtaagtatatcagatacatatttatatacataactatttataaatatatatttatataattatataaagattccttgctttaaaattgccctttgccccgtaaaaattcttaatgtgtaaacttacacaaagcaaactattttatttgaagatatttattacaggaaatagacatcctttgaaggctgaaagccctttttcaactttgttgggctcaaaccttctggttgctctgcccgccaccaaaagtgctacttgaaacttagagtttctgagaagtctttgaagtagatttgatacaagatatgtaaagtgatttgcaatgccttcttgagaagacaggacataaggaaagtttttaaaagttaaaattatacatgctatgaaagtcttaaagtgatttttaaactgatagattataaatccctttttaaaagtagtttttcttggctttttaaaaaccttaactaacatactatactgttttactcatcactactttggattttaattgctacacaacacatctattacagctatccctcattatgacagtttccttgatagctgttgaaattgtactgatactataaaatatgcttacgatggcctcttcatgttagcaatttcaaggaaaaatatttatcaaatagtactttaaaaataagcaaaaactgtcctatgaaatgcagtttatttgatctagagtgtgaatgagttgcaaggactgatgtacatattagaaataaactgttgggcaaaatgctgaagagctatattttcaataataggtcttttttatacctataaacaaattatatataaatgttggtggtaccagagcattgaaaataaaacttgtttgtgataaacgtcatcactggttctctatcctgaaatgtaactgaatcataataaagtgctattcatctgcaggtgcattgcttctacttagttaaaagatggttgaaaggataggaattagtagcatgttgtattagccttttgtagtgtattttgtcctaagcatcttaatttccctgttttgaatgctaagtagcaagggtcttggtttagaactaatacccatcatgcatgtaaacggtatgaaagagctgcttagtaagttaacacaaagtgttcttgtgtcagtccttgtggaaatagatacaatacaaacattacagctgaactcacggcaaactccattaagtaaaaacctggcctcattgttcaggaaaaagtttgaatagaatacaagctcattttgttgaatgtaatgtcaggcttttagggactgtattgagggataaggttttgttaagttgagaccaattcattaagttttattgcctggtgagaagcagcaatactttattgtaagacttcatcaaatattcatggttaaagagaagtagtaaatgtattcaatcaagtggtcttttgggattttgaaaaggattatgaagtctgctcagctgataacattgatagaggttgtttaacaagggtaattttaatctccgagtttagttttgttgtccagtcttgtctcttttttactgtcacaaatccaggtctgtaagaattgtgtcacattctaaggataaaagaatgatatatccattcatataatttatgttatttcctaaatatgtatatttttaagttatcatcttagtttgagtttggcatatgagggaattgtgacccatctagttgtgagattgctattcatttggtcagactctagtctcatctcaccactgctggtgatcttttcatgtcttggataatatgatttctttgacacatataaaataataagcaaccttttgccttggccagttcagactgtcatgaaggggtatagtcagctgtttctgcataatggaaatgtccatagcattgcccttattattgtacttggtatcaggtcacctgccttctcttatttacttttatattatgctcatctcagttttgtgtgatgcagtttgtgcacaggaagctcatccttttccaattcgctgtgtgtttacttctttagttttcaaccaaagttttgtaatttgtgttggttttgtcagttttaaagaaataaaccatattcaacttaaagtcgaatttgttattaattttttatatcctttattctttaggcagatgatgttgagggcaaaattagacaaatcattccacctggattttgcacaaacacgaatgatttcctttctttactggaaaaggaagttgatttcaagccattcggaaccttacttcatacctactcagttctcagtccaacaggaggagaaaactttacctttcagatatataaggtaaagataaatctaaatatttattgagtaaagttctatttgcctgaaacctgtatgtagttttgttgtcagtgatttattctaactgcagtaaacaagttttaatcagcattataaaccaagatctattttgtgtgtatgtctgtatctatgttcacatcttaatctgagacttctaaacattttcccacaggataattttgtgttctgcggactttcacttacctttgtgatgagtttcacctgacttttcctggctttttccctaggctgacatgacatgtagaggctttcgagaatatcatgaaaggcttcagacctttttgatgtggtttattgaaactgctagctttattgacgtggatgatgaaagatggcactactttctagtgtaagtacagttctaaagcaacagtagaccttattacctccacaaagccagcattttaattgtggcagcccaattattgggacagtataatgatatttttcccaggaaagaaaaactattgtttatgaggcttgagttttccttcattatgctttgggagaccttgagaatagagctgaattaaatgctgttgtccgttagggccctgaatgtaggcttaaacagtaaaatgagctttgcctgtgttttcttttacttgccacctattcatctttataataggcaagtgcactgaagtgatgtaaagaggtctgatttatccaagttgctgcacaccaattaagtgaattgtacattcagaacatagcaggtgtacccattgggccctcacagagtagcttgctgacactgaaaattcagtcagagaatggaaaagaaaatggacactgcatgggagcgcgactgtaattgacctgcttggctttctgttttatctgcagatttgagaagtataataaggatggagctacgctctttgcgaccgtaggctacatgacagtctataattactatgtgtacccagacaaaacccggccacgtgtaaggtaattggcagtataacacgtgccttgtcttttatttcagaagaaggaactgctgaagtttccaatacttgttataatagtgttgatttgtttaaaaaaaaaatcactattattcatgggctatgtactgatttatttcattgttccctttgaaacagtgtagaagattaaactaattttgagtatcttgataatttttgggtatctcaaaggtggattgaaaaaaagatcacacaaactttaaagtgtttgtaatactatagtgatctgcaggttttaaactggtcatgttatgatattttaattttaaaataatttctttactgtagtcagatgctgattttgactccatttcaaggtcaaggccatggtgctcaacttcttgaaacagttcatagatactacactgaatttcctacagttcttgatattacaggtatgtaaaatttgatttgttactgaaagagcctttctaaaaatgtcttcttactgattgattttatttttgtcagaaataactattttaaacagcaacattttcctagggtgtttaagccatctaaagatggcttaagtttatgttttagagcataagcctttgtggggattggattacatccctaactgtgaagtgcataatggaacaaattgaagataatgagctgaatatatatggggaagtcttggtcaggcgtaaatacgttgaaagtatggtataacttatttgttcactttatttggcaaacagttgcattatttagaggcagcctgcactttaatttacatgtaggggcagaatattataaactttactgagaaaaaaagtcaaggtaaatacttcttgaatagaatacacatttcctaaagtgtgtgttttgtattcctaaaatgcatgccttcacaacagtagtagataaggtgaaatgtaggcctatttgttttggaaatgtctttcagtatggattagccatagaagtagtagtatgaatagaatgcttaggagaaggaaagacgacttactcgacttactcgacttgactcttcaaaaggagaaggcattattagatggagtttcagataatatgttaaagtgtgatccaccaaaaaacaaagtggcccaaggaatatttatgttattttctaactttcaaatttgttgttcataaaattgctgatgaaactgaaagttacctttttcttttattgaaaaatactttaccagatagttacatgcaaattggtattaaaatttattaatcttacaagtttgaatttggatacatctttgttacaaactatactatttaacatgcactaaaacattaacatgttaaaaaatgctatttgggaattttgtttaaagacaccacctcccacccacccacccccaccaaaaaaaaaatggttgtaagactggcaaccacataaataggctagtaagcagattgtttcatccttctttatatagactagtaatccaaggtaaataaaattgaagttgcttcagaacagtgaattgatctgtagaataataaactggagggaaagcacgttgtctttaaaagggagtttcacatttatagaggtgaattatcttttcatctgactttcctgctactgttaaatgggttggaaactcaggagataaagtagtagttactaaacttcgtttataacaaaagttataaattgtttaagcgacaacttcactagcttagtgacttataaaattgtagaaacataatacagactatgtcacttcttttagttgagcagaaaattgtttagcttctattaacttatagagcttagacttgctgctacatgaagggacatttttggtgattttaatgtggagttcacataagtagtctttgtctactctagtgggtaatgtgccagcaggggttgtttctctgaagcctcttaaccactttcttctgtctactccaaccaataaagtccttgatacttagcaccaattagcagataaagaattttatttcttaaatctcagtgaagagtcatcaataatggtagcctttattcattggtgttattcattagaaactgaagtctctaaaaagaaaagactaaacatgctaaaggacttctgaatttgacaactgggtattggcctttattttcagcattaacatttctcagcatttaaaaatactaaaaatgccttatcagctgttctcattaagatatttatttctcctagatttccatacccagtccttaaaaaacaaaactgcagatttttctactcttctgtcatttagttgcctgtttctccattattgtgtgtgcttttttagctttgtggttcttttgcaggctctggatctccatttgcaatccagaatattctttatattgagatggccttttgcttacttgacagatagccagatctaataataattgaaacttcctgtagatggcctaagttatatcttacttccaatggatgggtgtttgtggtataattgccacccattttcatttttttgcactcaattttaaggtaaaatactggcagacaattccttgtataccatctgccttttgaagatactattctcttaagatgtacagcatttgaatacatctcagttgtataactttataaatagaatcaatgatcttgtttcctctggacttctgaaaggagttgcatttggcaatagaaatcgattctgggctggaatacatatcagtattattatctatcagtagtacattaagagctaattatatttgtcctttaaatgtactttattgttctgggatgtgccatatagctttttagaatattatgtgaattgtttataacttaggtgattgtgctgttatctcatttcccttctttagaatatgattttttatcactaatatgtatgttaatatgagaagctttaaaaaaacgattgctagatgatgtattacatttagaaaaaactcagtttttgatcctgcatatcattgtagatttaaattcaagaaaattttatctttaaatatgttgcttatctttgtagcatagaaacaaaggaattgaaggatgtcatacattattgggtgtcgttttaagttcatttcagactgacactttcaaagggcttaaagattgagtggtgacttggttccttatattaagctgcaaacaaagtattatcagtcataatggcttatttaaaactggaaatttttttgcatgttttttgacttatgtgaaaatttcaggtaaaaatgtggcctgagtagtttttctcaactgtaactcattttcctatgatacctatttcctaaacttttctgagggtatagaagttacttaaaatttcactcagctggttacagtggctcatgcctgtaatcccagaagtttgggaggctgagctggagggttgcttgagctcaggggttcaagaccagcctgggcaacatagggagattcccgtctctataaaaaaattttttttaattagctggatatggtgtcacacacctatggtcccagccagctacttgggggactgagatgagaggatcgttagagcccaggaggtcaaggctgcagtgagctgtgattgcgctattgcactccagctagggggacagagcgagaccctgtcttaaaaaatacacacacactttgggaggtcgaggcaggtggatcacgaggtcaagagatcgagaccatcctggctagcatggtgaaaccctgtctctactaaaaatacaaaaaattagccaggcgtggtggcatgcacttgtagtcccagctactcgggaggctgaggcaggagaatcacttgaacctgtgagccgagatcctgccactgcaccccaccctggtgacagagtgagactctgtctcaaaaaaacacacagattcacacacacatacacacacacagccatacacacatacactaaatgttagtttaaatcagtattagcaatgcagtttctttttttttttttttttttttgagacggagtctccctctgtcccccaggctggagtgcagtggtgcgatcttggttcactgcaacctccacctcccgggttcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggccgaggcgggcagatcacaaggtcagaagatcgagaccgtcttggctaacatggtgaaaccctgtctctactaaaaataaaaaaattagccaggcgtgatggtgggcgccctgtagtcccagctacttgggacgctgaggcaggagaatggcgtaaacccagaggtggagcttgagtgagccaagatcgcgccactgtactccagcccgggtgacagagcgagactccgtctcaaaaacaaacaaacaaaaaaatgttttacaagagatacttgcttaagcgtttgtctctagtagagtttttaattaaaacaactttattgaggtataatttccagaccataaaattcacccattttaagtggacagttcagtggtttttagtaaacctgcctgttttagaacatttccatcactgaaaagatccttcgtgtccatttgtagtcagtttccttccctacacccgacgtccattgaggtccttggtccattttgaataaattgttgtgtatgatgtgaggtaagtatctcgttcatcttcttagatgtggatatccagctgtcctggcaccatttgttgaacggagtgtctttcctcattgaattgccttggtacttttcttgaaaatcagttgaccataaatgtgaaggtttattaccgggctctctaatgatctatacttctacccttatgccactaccaagccgtcatgattaggttgatatagctttatattttttatttatttatttatttttaaaacgataatgtcaagtttagcctgtcaaatatacgagttgaatttgtggaacatattttgcctgtgtgctgcaaggtaaacagaagtttcttgaaatgctcgatggtgtagggttaaaaatgggtcctagccctggccaggcaggtgggaatgggacaaagaagggtagagatggaggcttcagagtggactggctgggcttgggccatgaccctcaaggacacaggagtacagggtcccaaagggcagcccctttctgagtgagcacccaagcaacacacataggggctgcatgttgcaaactcatcagtgctcaacccctggcacaaccaccccctactgtgtaatgtacctgacaaaaccctactttctaaggcactcctcccaggcccccgaccagaatcctgaactcttaaagatagtttttaagaaaacatttaaacggttacatatgaaatgctatctgcatctttccagggtttttcttttgtttttttttttgtttgtttgtttttgttgtttttttttttgttttttggtgaggtaggggtagtgtttgagacagggtgttgctctgtcacccaggctggagtgcagtggagtgatagcttattgcgccttgaactcctggggttaagcaaaactcctgcctcagactcccaagtagctggaactacaggcacatgccaccatacttggctaatttttaaagtattttctgtagagatggggtctcactatgttgcccaggctggtcttgaactccagggctccagctgtcctcctgccttggcctcccaaagcaagggatcacaggtgtgagcagctgcacctggcctggcacacacaaagttatagcaggtgccctgccccaacccccacaggcagcaagctgtggggtctcctagctgtaaagggctgctgcagtggcgacagcacagagtgggcaaggcacagcagaggttttggcagcatggcccagttcctggtatctgctcctatatagtccatgcttacttcttcagggagagtgactgcattcactttcctgacaaacatgaatcatcttttgctttcctctctttcttcctcttggctttctcctgctatttccagataatcacctgctctgtctccccagctaaatgcaatttcatgtaatgctcttttgctttctcttctcaatgtcttcttttcttgaaatctcctttggcctgcccagattcagttgtgtgacctttctggttatctatggcatccaattggggttcttcatgtcaatgagctgttctgtgcctttgtacttttgttggcagtcagtcatcttcattctcaggcaatctcttgcctgatgctagagatttcttcttttttggggtcacttgcagcctccattctccactctcttcttgtgtcttctctggccttctgcttttcaacttggagctgtgcgttgatctgcttggggaatattgtactgccttgcttagcctttgtggcctccctttctccttcctttaggcacagaggctctggcaaagcagcacctcaaccacatatgagtcttgaaatcagaagtgaaagtcctccaattttgttctttttcaaaattattttgtttataatgtcccttgtatttccataaaaattttagcataagctcaccaatttctgcaaaaaaaaaaaaaaaaaagtctcttgggtcttgatagggattgagggattacattgaatctgtcattaatttgaagaaaattcccatcttaacaattcagaatcctctaatccaggagtctcaaaatcccgggctacggactggtactggtccagagcctattaggactgggtcacacagcaggaggtaaatgatgggtgaacaagcattactgcctgagctctacctcctgtcggatcagtggtggcattagattctcataggagcacaaaccctattgtgaactgcacatgtgaaggatgtaggtcgaatctaactaacgcctgatgactgatctgaggtagaacagtttcatctggaaaccatcccttgtctgttcccctcatccccagggaaatattgcctcccacaaaatccctggtgctagatatttttggcacttctggtaccaaaaaggttggggatcactgctctaatccattaatatgaaatgtcttgggccaggcttggtggcttgcacctgtaatcccagcacattgggaggccacagcaggtggatcgcttgagcccaggagttcgagagcagcctaggcaatgtgatgaaatcccatctctacaaaaatacaaaatttagccaggcatggtggcaagcacccgtgggcccagctactcaggaggctgaggtgggaggatcactggagcccaggaggttgaggctgccgtgagccaagatcgtacactgcactgcagcctgggtgagtgagaccctgtctcaaaaaaaaaaaaaaaaaaaaaaaaaaaaagaaaaagaaaaaaaaaaaaagaaatatctccatttagttagatcttttaaaacttttctcaacaatgttgttttcagtatacaagttttgcactacttttgttaacttcatttgtaaatatttttgatgctgttggaaatgggattattttcttaatttcttaattttgtttttggatcattgattgttttagtatgtagaaatacagttgggttttatatattgatcttctatcctgcactcttactgaacttgtttattagttgcagtagttttttggttagaattttccacatacaggatcacattgtctgtaaataaagacatttttacctcttcctttgcagtcagatgcattttctttctttttcttacccgattgcttagctgagaactccaatataatggtgactggcaatggtgaaagcagacatctatgccttgctcccagttttagagggaaagcatttggtctttcaccattgtggatgatgttagctatagctttcatatgtgttaattatgaaattgaggcagttcccttctatttctagatagttgattattgagcgtttttatcatgaattgatgttggattttgtcaaacgctttgttctgcatgtattgaatttttctcatttattttgttaacatggtatattacattaattgattttttttggatgttaaaccaactttgcatttctgatataaatcccatttagttctggtatgtaattcattttatatattgccagatttggtttgctaatatttgttgaggacatttgtatctacattcatgagggatattgatttgtagtttttgtcttagatccttagtgtcagcataactctggcctcatagaatgagttggaaagtgtttcctctattttctttcttttttttttttttttaatggagatggagtctcactctgttgcccaggcaggagtgcagtggtaccaccttggctcactgcaacctctgcctcccaggttcaagcgattcttctgcctcagcctcccaagtagctgggactacaggcctgcgccaccactcatggctaatttttatatttttagtagagatggagtttcaccatgttggccaggctggtctcaaactcctgacctcaggtgatccgcccgcctcagccttccaaagtgctgggattacaggtgtgagccactgtgcctggcctgtttcctctattttctagaatagtttgtgaaggatcatcgttatgtcttcttcaggttgtttcatggaatttaccagtaaagccatctggttgtagacttgtctttgtgggaagatttttagttggtaattaaatgtctctgttatagtcagttcacatagtcatttactttttgagtcattttggtaatttctttctaaaagctgtctgtttcatctaaattgtctcatttgttggcataaagttcatggcatattcccttttaattcttgtgatttttgtaaagttggtaggaatatcccttctttcatgcctgattttggtaaatgttgttttctctcttttttttcagtcattctaactaaaagtttgtcaattcatcgatcatttcaaagaaccaactttgtgtttatgtgaacttgtctatttttgttttctttttcattgatttctactctattattattattgcttcttattactttgggtttaatttgcccttccttatctagttaagagtgactcttaggttatattgatttgatgtcttttttcttttcttcttttagacagagtctcgctctgtcacccaggctggagtgcagtggtagaacctccacctcccaggctcaagcgattctcaggcctcagcctcctgagcagctgggactataggcaggggccactgcacccagctcatttttgtatttttggtagagacagggcttcgctttgttggccaggctcgtcttgaactcctggcctcaaatgattggaccactttgacctcccaaagtggtgagatgacaggtgtgagccaccatgcctggcctttcttttctaatatagacatttaaatacctaaatatttacacataatatacatttatatataaatataagcgttgatgtagctgcatcacaagtttttagaaattgtgctttcattttcattcagttcaaaatatgttttaattttccttgtgatttcttttttgatccatggattatttaaaagcttgttgttcaatttctaaataatgtggattcccatgtttccttttgtaaagtttgaatttaattccactgttgttaaagaacatattttagggccaggcgcggtggctcacacctgtaatcccaacactttgagaggcggaggctggcagatcatctgaggtcaggagttcgagaccagcctgatcaacttggagaaaccccatctctactaaaaatacaaaattagccgggtgtggtggcacgtgcctgtaatcccagctacttgagaggctgaggcaggagaaacgcttgaacctgggaggcagaggttgcggtgagccgagatggcaccattgcgctccagcctgggcaacaactgcgaaactccatctcaaaaaaaaaaaaaaaaaagccgggagcggtggctcacgcctgtaattccagcactttgggaggctgaggcaggcggatcatgaggtcaggagatcgagaccatcctggctaacatggtgaaaccccatctctactaaaaatacaaaaaattagccaggcgtggtggtgagtgcctgtagtcccagctacttgggaggctgaggcaggaggatggcatgaacctgggaggcagagtttgcggtgaaccaagattgcgccactgcactccagcctaggcaacagagcaagactccgtctcaaaaagaaaaaaaaaacaaacatattttgtatgactttggtcctttttcatttatttatgtgattttatatttaatttttgcatgaccttccagtgaacctttttcatttattctgtttgtctatttatctacctatgtagctatcttttgagacagagtcttgctctgtcgcccacattggagtgcagtaccacaatcatggctcactgcagccttaacctcctggcctcaagtgatcctcctgcgtcagcctcccaagtcgttgggcctacaggtgcacgccaccacacccagctaatttttactttttttgtagaaacgaggttttgccatgttgcccaggctggtctggaactcctgggctcaagcaatgcccccatcttggcctcccaaagtgctaagatcacaggtgtgagccatcatgcccagccctttttcatttattgagttttgttttctgttcaagcttagaggtcagcaaactttttttttttttttttttaaggataggttgtattttatgctttgcaagctacacacagtctctgttgcatactcttggtttttgttgttgttttggttgttttaaacaaccctttagaaaccattcttagttcacataccatacaaaaaaaggccacaggcaagattggcccatgggccatcatagtttattgatccctggcttaacattaagtctttcctggatgactgttccttgtacacttgtaaagaacatgtattttgctgttattgagtacaatgttctgtaaatatcagttgggccaagttgattgatagtgccgttcaggccttctatatctttgccatttttctgtctaattgttctatcgattattgagagtgtagtattgaaatttcagactttttattgtattgtctatttctccctttaattctgtcagtattttcttcatgtattttgggactctgttgttagttgtgcatttgtttataattgtaatatcttcctgatgaataaacttttttatcattataaaatgtgccccttttttgtcttaaactctttttttaaaaaaaaaaaaatagagacagggttttgccatattgcccaggctggtttcaaactccggagctcaagcgatctacctgccttggcctcccaaagtgttggaattacaggcatgagccactgcacctggccttacactctattttgcctgatattaatatagccactctagcttgcatactgtttgcttggtatatcttttttctttttttttttttttttgagacaaagtctcactctgtcactcagactggagtgcagtggcacaatcttggctcactacaacttctgcctcccgggttcaaccagttctcctcccttggcctcccaggtagctggaattacaggtgcctaccaccacacctggttaatttttgtatttttagtagagatgggttttcaccatgttggtcaggctggtctcaaactcctgacctcaggtgatgtgcctgccttggcctcccaaagtgctgtgattaaagaaaggcgtgagccacagcacccagccttcttttttcatcattagactttgaacctatccatcttgaatctaaaatgtttctcttgtggacagcatatagttggaacttttaaaattcggtctgacacgctttgtcttttgattagaatattttaatatacatgcatttaatgtaattattactatgcttggaattatgcccgccattttgctgttttctgtatgtctcatttcttttggtggggaggggggacagggtctcgctctgtcagagtctgaagtccagtggcatgatcatggctcactgcagcctcaaactcctgggcccaagctgtcctcccctctcagcctgccaagtagctaggactacagtcgtatgccaccacactttggctgatttgttttatttttagtggagacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttcttttgtgttaaataatattttctattgaaccatttcaattcctttgtggttttttaaattttttttaagttattttcttaggctgggttcagtgactaatgcctataatcccagtactttgggaggccaaggaggaaggatcacttgaggccaggagtttcagaccagtctaggcaacatagcaagaccctatctctttaccaaaaaaaaaaaaaaaagaattagcagagtgtggtggcacacacctgtagtcctagctactcaataggattacattttttttttctttcttttttttttttggaggcagggttttactcctgttgcccaggctggagtgcaaaggtgtgacctgggcttactgcaacctccgcctcccaagttcaagcgattctcctgccttagcctcccaagtagctgggactaaaggtgcatgccaccgcacctggctaaatttttgtacattttggtcccatactcctgagctcaagcagtctgcctgctttggcctccgaaaatgctgggattacaggcatgacccactgttcctggccacatccttatgtattactataagccaaacactggtttataattattgctttatgtaattgtctttttttttttgagacggagtttcgctccgtcgcccaggctggaatgcagtggcgcgatctcggctcactgcaagctccgcctcccgggttcacgccattctcctgcctcagcctcctgagtagctgggactacaggcgcctgccaccacgcccggctaattttttgtatttttagtagaggcggggtttcactgtgttagccaggatggtctcgatctcctgacctcatgatccgcccgcctctgcctcccaaagtgctgggattacaggcgtgagccactgcgcccggcctgtaattgtcttttaaattagttgaaagaagaaaagagaaaaaataatctaacttttatatatatttttatgagtattcttaatttcttcatgtagatttcagtggtactatgttcttttagcctgaaggagttctttaatacttcttttgggcaggtcagctagcaccagatttcctcagtctttggttttctgggaatatctttatttcacctttattttgaaggatagttttgctggatacagaattcttggttgataggtttttttttctcctgttggtactttgaatatgtcatcccactgacttctgacctccttggtttctaatgagtcatttttctcttgctgctttaaagattttctgtttctctcacttttgacagtttgattatgacatgtttgggtgtagatctctttatgtttttcctagttgaagtttgagcttcctagatgtgttgaccagtgtttttcatcaaatttgggaagtttttgaccattatttcttcaagtattttttctgttccttcctttcctctcttatatgcttgaacaattttaatatagggtggtgtcagagttcagtttatattttataacacaggggagaataggtaaggagaatgagtttaaaaaaggttattagttgacaaaaatactggtggaagcagatagaagaaataaatgtcctccaggtttctgggtggcttgtataactggatgatgcaggtaaattaaagtgagaaaagactgaagaatgggatagggtgacaaattacataacagtcttaggtttattttctgtgtaggtctgtattttacttattttgttttactgttgatttcaccattcttaatagatcataatttcatcccaaattgatgcagtgacttgatttcaattcttcctattttaaagtcatagtcaaatagcacttaataactacatgcatatgatgtgtataattaactgtggcatagaagcataaaaaaggtatttagtacaaatcagttgaatgaatgaatgtgtttcttggaatcatgagacattaccctgtctcaggctttttaaaaaaatagctttattggtatataattaacacatcatacaattcattcacttaaagtagacagttttaagatgatatttacagcacaaccatcaccataatctttctgttggtctgagacagtctcactctgtcacccaggctggagtgcagtgtgtgattgcagctcactgcaacctctgcctcctgagttcaagtaactctcatgcctcagactcctgagtagctgggatcacaggaatgtgccaccacacctggctaatttttgtatttttagtagagacggtgttttgccatgttggccaggctggcctcgaacttctagtctcaagagatctgtccacctctgcctcccaaagtgctagcggccctagcgaataatctaattttggaatattctgttcccccataaaagaaacccccaaaagaagtccctgttagcactcctttcctcccctcaactcctatccctaggcaaccactaatctactttctgtctctataaatttgcctattctggacattggaatcatgcaatatatgactagtttctttcacatagcatgttttcaaggtgcattcttacagcatgtaacagtacttcatttcttcttattgccaaataatattccattgtgtggttatatcattttattcattggtcagttgaacattttagattattcccacattttggctcttatgaataaataatgctactaggaacagtcatgtacaaatttttatgtggacctgtgttttcatatctcttgggcatatacctaagactggaaattatgggaaatctggtaactatgtttaactttttgaggaatcaccagactattttccaaaatggctacaccattttacatttccactaccagtgtatcagggtttcagtttctccacatcttcatcaatacttgttactgtgtttttaattctagccatccttgtaggtatgaagtggtatatcattgtggttttgattcacatttcctgtggctagggagactgtgcatcttttcatgtgtttattatccacttgtatatatcttattgataaatgtcaacttagatcctttgcccattttttagttgggtctttttttttttaccaaattataagagtttgtacaccaatttatatgaatctggatacaggtgctttattagatacatgatttgcaaatagtctcccattctgtatgttatttttttcatttttttactggtgtcatttgaaacacaagagttttaaaatttttgtcacctagtttatttgttttttcttttgttgcttatgctttggtctcattatctaagaaaccattgtctaaccaaaggtcatgaagatttactcctgtgttttcttctaagagttttgtagttttacctcttaaatttgggactgtgatcaattttggttaatttttatgtatggtgtgaggaaaggggatcccactttattcttttgatgatagagatccagttgtcccatcaccatttgttgaaaagactcttctttcccccattgaattgtctttgcaaccttctccaagattaactgacctaaatctatggttttatttctggactatcagttcagttccattcatgtgtatgtctgtccttatgctagtgtcacatggtcttgattatcataggtttgaagtaagttttgaaatcagaacgtgttgagtccttcaagttttgttctttttttattttttcccagatggagttgctctgttgcctaggctggagtgcagtgacacaattttggctcactgcaacctctgccacctgggttcaagtgattcttctgccttagcctcccaagtagctgggattacaggcacccaccaccatgcccagctgatttttgtatttttagtagagacggggtttcaccatgttggccaggctggtctcgaactcctgacctcgtgatccacctgccttggcctcccaaagtgctgggattacagatgtgagccaccgtgcctggcctgctctttttcaatattgttttggctattctgggtcctttgtctttatgaagtttttcctttttttttttttttttttgagacagtctctgtcacccaggctggagtgcaatagcgcaatcttggctcactcactacaacctccacctccaagagtcaagtgattctcatgcttcagcctcctgagtagctgggaggaatgtgcgtgaccacacctggctaatttgttgtttgtttgtttgtttgtttagagaaggagtctcgctctgtcgtccaggctggagtacagtggtgcgatctcagctcactgcagcctccgcctcccaggttcaagcaattctcctgcctcaatttcctaagtagctgagattacaggcatgcaccactatgcttggctaatttttgtatttttagtagacacagggtttcaccatgttgatcaggctgttctcgaactcctgacctcaggtgatctgcctgccttggcctcccaaagtgctgagattacagacgtgagccactgcgcccaacctaattttttatttttagtagagataggactttgtcatgttggccaggctggtctctaactcctggcctcaagtgatctgcctgcctcaggtcccccaaagtgctgagattacaggcgtgtgccactgtgcctgacctgttcatccaaatttgaatctctcatttacacagctactgtaattggaatcaaaactaagatgcatgtgataccatgccagttaaaaagtttaaatttgaggctgggcgcagtcacttatgcttgtaatcctagcactttgggaggctgaggcgagttgatcacttgagcccaggaattcgagaccagcctgggcaacatggtgaaaccctgtctctacaaaaaatacaaaaattagccgagtgtggtggcgggagcctgtagtactagctactagggaggctgaaataggaggatcacctgatcctgggaggttgaggctgtggtgagccatgatcatgccactacactccagcttgagtgacagagtgagactctgtctcaaagaaaaaaaaaagtttaaatttgaaatgggtagcttttgattcacaaatattaatacaaatgtctttgcaaaaggattggatttattattttgacaaagataatagttttatttataaggaataatcctttcatgttgtaacttttgtatgtgtaattttttaaattacacattaaaaattttgtatttttttatgtgtaattaattttgtatgtgtaattttttttaatttgtcttcctagcctagcatatatgttgagattgcaaaagatgaagaaattatattgagtatcagggaaatgttaatattattctgctttatttatttagcggaagatccatccaaaagctatgtgaaattacgagactttgtgcttgtgaagctttgtcaagatttgccctgtttttcccgggaaaaattaatgcaaggattcaatgaagatatggcgatagaggcacaacagaagttcaaaataaataaggtatttttattctgtaggaggaaaacagatttaaattacaaacaaatttttgaagtgtataccttaactaaaatattataaagacattaagaatacatgtgtgggaactagcaatggttaacagtacagctttgaagccaaattgcctgagttcaaatctagctccaacacttgctctgtgatttatggcaatttaatttacctcgtgcctcagtttcctcattaataaaatgggaagataataggtgttattgctatattaagcataacaagcagaggaaagatggataataggatcttatttttactctttaaagtagttgtacccctggagacattattggtgggaagaatggttgaagtaaaacacgtatttcattttatatacttttatatatttatttaaattttaaagtggtaaatgtcttaagataggtacagaaaaaataaatatggaagttcagagaagaaagtttattacatttatgtaagcaaggaaatcagtggttatttcatagaaaggatggcatttgatataaaccttgaagaatgagtaggatttggattatgaaagtatgtgagatgggctgggagtggtggctcacgcctgtaatcccagcactttgggaggccgaggcggacagatcatgaggtcaggacattgacaccatcctggctaacatggtgaaaccccacctctactaaaaatacaaaaaagctggtcatggtggcatgcgcctgtagtcccagctactcggtaggctgaggcaggagaattgcttgaacctggggaggcggaggttgcagtgagctgagatggtgccactgcactccagcctgggcgaccgagcgagactccatctcaaaaaaaaaagaaatttgtgtaggccgggcgaggtggctcacgcctgtaatcccagcactttgggtggatcacgaggtcaggagttcgagaccagcctgtccaatatggtgaaaccatgtctctactacaaatacgaaaattagctgggcgtggtggcgcgtgcctgtaatcccagctactcaggaggctgaggcagaagaatcgcttaaacctgggaggcggaggttacagtgagccgagatcatgccactacactccagcctgggcaacagagagagacttcatcttaaaaaaaaaaaaaagaaaagaaatttgtttaatagctcagcttttaaaagaacaggcatatgaatatatatatatatattttttttttaatggtgctttcttaaaaaaagaattcaaactccctacctagagcacaaagagcccatgataatctggaccctgcctaccttgctagcttcagcctgttagtactttgccacatgctctggctactttgccacatgctctggctttactcatcttctagccatttcccaactctgccacatccttcttccttctgtattcctttacatattctgttctctttacctgaaatactcccttttcctaattgcctggccagatagtactcattttttcaggttcaactcaggttcccttccaggaagtcagaaaatattaccttcccaacctatccataccccaactccctgcccaaataaatacataagtgaaacaacatcaacagaaaaactgtggttctcctttggcttcagtgctaccaaaaacttcctgattcttctgatatttccttgataccatttgtctttttttttccttttcctttttttttttttttgagacagggtctcttgctctgtcacctgaggtggagtacagtggtgtaatcacggctacggctcactgcagcctcaacctcctgggctcaaatgactctcccacctcagcctcccaagtagctgggactgcaggggtacgccaccacacctggctaatttttgtagagacagggttcctacaggctgttctcaaactgctaggctcaagcgatctgcccaccttggcctcccaaagtgctggaactacaggcatgagccaccatgtccagccctgtctgctttttaactgtcactgtactagcaggtttctgacctttctccttttatcactgtatatgctttcctcaggtgaccttaaccagccttatggttttaactcttacctatatactgacattgcttaaatccttgcccttagactagaattttcttcagattttctattttctgctgcctcccaaatctctcctaggctgtgaaaactcacattttcacatccttctctcagtttttcctctcatatgtttctagagtccttgaccccttggtcttcttgtgctgttccagttcatgccctcatcgttttttatgtgatgtaataactcagcttcttgattggtctctatgcacttctttttgctaccatttctttgtagctgaaagagtgacttatttaaaactcaaaatttgtgcatattgcttacattcctatttaaaatctgtcatgaaggctggggcagtggcttacgccagtaactctaatactttgggaggttgaggcaggaggattgcttgaagctgggagttgaagatcagcctgggcaacaaagtgagatcccatttctacaaaaaaaaaaaaaaaaaaaaatagccgagtgtggtgcatatgcctatggtcccagctgctcaggaggctgaggtgggaggatggcttgagtctaggaggttgaggctgcagtgaactatgatcgtgccacattaaattatccataccataatcatttgtgttacccactagactgcttgagggcaactacttttattgcctttcctctggtttctagcacaattccttgctcatggcagatattaaatatatcctgtgttcttttgggaaagtgtcattatttttactttgaaaatgttcgcattttcttttgtttcattctagcaacacgctagaagggtttatgaaattcttcgactactggtaactgacatgagtgatgccgaacaatacagaagctacagactggatattaaaagaagactaattagcccatataaggtaggactttcaagaatcttaaacactgtattcttttcactgtttaaaacagaagaaaagctaccaaatatcagtatatgagagagtccaagtcattttgtaaaattaacttttacaaaagtagaaatattcttccagtaatttataaaaattctcactcatggccgggcgtggtggcccacacctgtaatcccagcactcagggaggccaaggcgggtggatcacctcaggtcagaagttcaagaccagcctggccaacgtggtgaaaccctgtctctactaaaaatacaaacattagctaggcttggtggtgggcgcctgtaatacagtgacttgggaggctgaagcaggagaatcgcttgaatccaggaggtggaggttgctgtgagccaagattgcaccattgcactccagcctgggtgacaagagcaaaactccatctgaaaagaaaagaaaagaaaagaaaaaaaacccgggtgcagtggctcacgcctgtaatcccagcactgtgggaggccgaggtaggtggatcacttgaggtcaggagttcaagaccaccctggccaacatggcgaaaccccatctctactaaaaatacaaaaattagctgggcatgataacacgtgcctgtaatcccagctgtttgagaggctgaggcacgagaatcacttgaacccaagaggtggaggttgcagtgagctgagattgtgccactgcacttcagcctgggtgacagaatgaaattgtgtctcagaacaaacaaacaaacttatcccaaggatagtctaccatggttagcttttctttcatttgtatgcatctttaaaaaatctgaatgcctagtctcttccctaacaaattatgttgtttttcccaagtttcttgtcttctcagttgttatatatatatattctcttttttctctcttcccagataaaagcaaagttatacatatatattctctttgcttttgctttcttcttcctaaaaatagcctttattgctatttattaatataatctttgtactttaccatagccgaaaccatgttagtactattatatttttaaacattcttcttgcccttttttcccacttcgtcgtcatcttccatattttccctcctagatcaaattggccttatcatttggacattgtcaggatggatattgtttatgccaccttatgtgaatgaaaatttgctatctaggcaaggcgtggtggctcatgcctgtaatcccagcactttgggaggccgaggtgggcaggtcaccagagctcaggagttcaagaccagcctggccaacatggcaaaacctcgcctctactaaaaatacaaaaattagttgggtgtggtggtgggtacctgtaatcccagctacttgggaggctgaggcaagggcatcacttgaactcgggaggcagaggttgcagtgagctgagatcataccactgcaatccaggctgggcaatggagcaagactccatctcaaaaaaaaaaaaaaaatttaaaaaaaaaaaaaggccaggtgcggtggttcacgtctataatcccagcaatttgggaggctgaggcgggcagatcatctgaggtcaggagttcgagaccagcctggccaacatggtgaaaccctgtgtctactaaaaatacacaaattagccaggcatggtgggaggtgcctgtaatcccagcttctccggaggctgaggcaggagaattgcttgaacctgggaggcagaggttgcagtgagccaagattgcgccattgtactccagcctgggtgacgagcaaaattccatctcaaaaaagaagaaaatttgtcatctagttgcagctgagtagtgggatgattggcagaatatttaatttattcaacatataattattgagtacagttgctcaatgataaaatgttgttgctgcatttatatatactatacctatagggttatacatcacaatagctgggaacataaatgaccaagttgattctacattacaatttgagaaagtaaattaactaactgtatcaggtacacatagttttggttttcctttgtaaatttaaagaaaatttaagttttatttgccatggattctgctttatagagccagtcttgaatgctgatggttcattggctgacactacttgctgaatcccaacttttccttcatagcatctttttactttgcagtgcaactgtatttcctaatttgtcattgtaattctgttcacattctgaatataaaattattatttgcctatgactaaatcattttatcttgaattcatacacagatgtatgaatagttcctcatagtgtcatttcattgcagtttaatagtttttctattttacagaccatcatctgcatatagcaggtttgtaataaattataatggtctcctcaaaagttatccaaagtagcattttattatttgatgttatcaattcagaaacatcagaaaatgggtaaaaatggtattttccaaaggttttgacctttaagtaatatttgttagctagaaaatgtcttaatgatgaaatttgggcacagagagcagtatagatggcaacatttaagagttattaagattttactaaagtaaaataatttattgaattatatattttagatattaatgtgacttttatataaaatataacaaatgaaagatggaaattctgagtacaaatagtagtcacacagctaatgccaaataatgggaacctctgtagttcataagtgcaagtattttctactcttaaagaatgataattcttttttatattattattaagtacctttacctgtccagccagttcaccagtctaaaaggccagaactgggccgggtgtggtggctcatggctgtaatcccagcagtttgggaggccaaggtgggtggatcacttgggcccaggagttctagaacagtatatccgaaacatgaaagcttcatatttgcaataatgccacccaaccaggaatcctggagttattcttcattcttccttcctcatatcacccagtattttctcccctaaatctgccctgtcctctccatctctgctgctgctgacttgatctaggctttcatcaactctggcttgaactactgcagtagctgcccagtcctccagtcccatcctaaacatctctgacacagtgtcctgcataaaagttgttatcagctacctgttgcaaactccttagcatagcggtatcctaagtcaaaccaggagggtttagtatgataatgtatgtctggaacttaataaagactcaaatgctatttaatatatttttaaagtatagcagttttccatttgtctttctgaaacatttctaacagtttatgttaaaattagcatgtggcccgtaagtacttcactgggtggaatttaaaatgtaattaattaatgactgaatagtaaaatgaagaataatagcacttaatctcagttgtctttcttcagctaatgtcttctatctattaagcaaatatttgagtgtctatactgcccagagttctttaaagttttggagggggctgctagtcacatgtctgtatttaccatcattggacacaaataccaggtcttcttgttaactctttttagagggtttgcaattcatggttaacattatgtttaagcttccttaaaaaacaaaacaaaacaaaaaaaaaacattgtgggacaagtttgggcgtattcatactattcttatttttaacattggagacttaaaattgtaagactataaggaaatatatttactttcttcgtctaacaaataattgtttgtcacttagaaaaagcagagagatcttgctaagatgagaaaatgtctcagaccagaagaactgacaaaccagatgaaccaaatagaaataagcatgcaacatgaacagctggaagagagttttcaggaactagtggaagattaccggcgtgttattgaacgacttgctcaagagtaaagattatactgctctgtacaggaagcttgcaaattttctgtacaatgtgctgtgaaaaatctgatgactttaattttaaaatcttgtgacattttgcttatactaaaagttatctatctttagttgaatattttcttttggagagattgtatattttaaaatactgtttagagtttatgagcatatattgcatttaaagaaagataaagcttctgaaatactactgcaattgcttcccttcttaaacagtataataaatgcttagttgtgatatgttaatgtgtgatgatatgattcttaaatacttacaataaacctcattcttaaatacttatcattccttccacactttgcttctaagattttacatctgacacctttaaaacatttctttaaggttatcctggtaattttattttttcaatatgatttttctttcttttttaacttttagattcaggggtacatgtggaggtttgttacataggtaaactagtgtcttgggggtttcttgtacagattatttcaacacccagatactaggcctagtatccaatagttaatttttctgctattctcccaacctccaccttcaagtaggccccagtatctgttgttcccttctttgtgtccatgtgttctcatcatttactcccacttgttaagtaagaacatacagtatttggttttctgtgcctgtgttagtttgctaaggacaatggcttccagctccatccatgtcctggcaaaatacatgatcttgttcttttttatgactgcatagtattctgtggtgtgtatataccacattttctttatccagtctgtcactgatggacatttaggttgattccatgtctttgctattgtgaatagtgctgcagtgaatgtttgcatgcgtgtgtctttatggtagaatgattgatattcctctgagtatatacctagtaatggaattgctgggtcaaatggtagttctgtttttagctctttgaggaattgccacactgctttccacagtggttggactaatttatacttccaccaacggtttataagtgttcccttttctccactaccttgccggcatctgttattttttgactttaataacagccattctgactggtgtaagatggtacctcattgtggttttgatttacatttctctaatgatcagtggtattgggcttttactcatatgcttattggctacacgtatgtcttctttgaaaagtgtctgttcacgtctctttttaatggggttgtttggttttttccttgtagtttaagttcttactgatttttcataataggaaatgttcttagtataggttttattttgttttaaataaaatcctattaactctattaactgtttgggaaggcaggtacgagggaaatcaaactagatacagcctaaaagccaaaattttggcatcaaatattatttgaagataacttagaagttagcataaacattctataaataaaaatagaagatagaaatcagtgtataaaatacaatttacacaccattattaaaatatatcttgtgtaaagtgagacgcccatctgttcggatttgctgtaaggttaccaaggtattgaaatacagcaagaaaaaataatgacaaactgcttaatatagtcttgtttttaatgaagtagagtataaatagattgctggaaacagaatcattcaaagtaaaagtttgagatgtttataatgtatgctagtaaacaaggtattatataacaaaaacaggatgtaagttgaaatttacttttaaaaatctgatttgatggatgcttggggcagaatcccaagttggacaggcattatctcgtcctttgatcaatttccatccgtaaaatctgtcagagaagtaactggtagcctctggacacaaaatagctgtggccagcagcataccaacagcactactgttcccttaaaatgagggagctataaaagtttcaaaccatctcatctcaga

SEQ ID NO: 17308 - DNA, 25992 bp, Human
gagggcaggggccatgtctgtcttgctcaggtctttatctctgtgcctggtcatgtcagtcacagacagtatcacttgataatattcacccaattaataaatatatttagtctccaaatgactaactagcaaagtcttcagaaggatacgtagggtggtgggtgctgtgattgtgaaacttgcccagatccctctcaggaacagaagactgggttctgtccccttcctgatgctaggagggctgccagtagacaccctcaaccgtcagcgttcctctggggaatgcctccatgaaagaaatggacagccccaaaatcatgacagttggtattcaatgactaatcagtgctgggctttaagacccagcccctcataccaactcaagacacctttacaaggccatcccaactccagagcgccccttgggagcctttactgggatggcatcacagatcaacttcttcctccgctctgcttcctccacctccccttcacagacgtttattccaagagcactccctaatcaatcaatgccttataccttaatctcgacctcagagtttactgccagggtaacccagcctgtgacaagtaccacaaaaatgtttacaaactggatatcatattttgtcctactccatagacgcctaaacggtaaagatcagttatttatccttgcatccttacaacgactagaaggtgtctttcatatagtggacatcagaaacacatcaaaggaaatattctccctaaacttagtctagattgagctaaattcttctgattcaaagtgtggtcctgttgaaaggggcaccagcatcccctgtgcattttgtccgaaatacaaaatctcaagacccaacctgaattagaactactgaatccaaatctgcattttatcaagatccccagatggttcacatgtatgttgaagtttgagaagtactgagctaagagatttattaatacaagtaaaatgatctggctgataatacctctagtttatatagtgtctttataaggattttccctctttaaaaattttccttaacactagtaatcatgcagtctttcactcaacaaatactaattgagtgccaagtaaagatgtcagctctacggagcttacattttagaaggagaagaaaacaaatatcaaggtgtatattatagtgtacagcaaggtgaaaagtgccatgaaaaaacagtagggcggggtaaggaggaggagaaggtgtgttgcaatttaaaatttttaacaaaagttcatgatactcagagaattgaaacaggtgagatcattagacattcgcatgtttgagcacaagcgctgaaggacttagcaatgtggctgcagtggaataggagagatgcaaaataacagacaaacccagagaggtaagagagcagacctcttcatgagaggctgcctgataaactgatttgacactgaattgctgagaaggtaatgcaaatagtttttttctccaagaacaaagtagttcttggtcaagccgatttgatttgggctgtgggaatctgcacaaaccatttcactagctaagtctcaggttcctcaaatgaaaaagcagggactggaaatggcttttgaagtctcattctcttctaaaaatgtcaggctccaagacaaccaggtgaagtccaagagttagtaaaataaggattgtggctcggctgtggcctaatgcaaacttgcacaaccccaggaaaccgaaaaaaactggaagaagaattgcagaatggggtgccaggttgaaagaccttaacctttgcactcaaattcctcccacacccagaagtccaggtcccgaccgcacgacgccgtgctcactgctgggtgctgcgcctgagtccgcctcctgcggcttcccggacttgaccccgcccacgccctggtcccgcctcctgccgacgccggcacagaccccggtgacggaagtgacgtaaggccggggctggagggcagtgctgggctggtcccgcaggcgctcggggttggagccagcgaccgtcggtagcagcatggctctcctctttctcctaccccttgtcatgcagggtgtgagcagggctgagatgggcaccgcggatctggggccgtcctcaggtaccgtcgttcgcggcagggctgcggccgggtcgggacgagagggagggagggatccgccccagccgggaagccccgccccgcttctccgaggtcgccctagcccgggacccctgcgtcgggccctgagcgggcgacggggacgcgaggtggggtcgcgagactggggctccgtggtttgaactcgtcggttgcctttctcctgcctcttccctggttgccgccacaacaaatcacgccgcttgtttttccgactcttgtaatccacttttaaatacgattatgcgctgcagaaggacgttgctggtcaatgtgggacagcgtggtctcaaagattataatatcgtcttcttactgtacctttttttatggttagatacgcagatactcactagtatgctacggttgcctgcagtgttcagtgcagtgacaggctgtacaggttcatgacctaagagcagtaggctgtgtcatctgggtttgtctgggtttctactgcccgaagaaattgcctaaggggacatttctccatttctcagaacggatctccatcgttaagtgacgcatgactgtgagtgtcctgatcagcatgtggcatcgtggtctcagttcgtggcttaaatacttctttcttagcgggggtggggggggggactcaaagtgcttagggtaggaaagtatgcattatgtcgccagctgagaagtaagtggcagctgagaagtaagtggcagtccgtcttaggtctcagtctggaagtggtggattgccggcactcactagcagatttggcagtaggtctcttcgtacgggtttgttcttcggagcattttatttccacctgcttattgacatttcctagaaaacaaatgttgagggtggcttttctgaagtgcagagtaattgtgattacgagctccagagaaaacagtaaaccttttcaattcagttttcttttttttattatgatttatgattcatagggactttgaaaggtccacgttttggttctgtgttcacaacaatcttctggagtaggcgttatttgtctctctctttatggacgagaaattgagttacggagaggcctgcccaactggcagagaggtcatagccactcagtggggagctgctcaatttggctccagagtccaagttcttaactgctcttctaggctctagtcagtcatccacatgggcagttgcagtactttgcggtaagagcttgcacttaggcacagactagtggaaagcaaggcggggtgcttgtctcttttagggaagtcagtgaagacttcacaaaggtgaccccagtgttggaaccagaggtgcagagactgaggtgcagaggtgtgatagcatgttgaattcgtggaatattaagcgttctattgtaaagtgtgtgtgagagcttacaaggggaggagataggttaggtggagaagtaggaaccaaataatgaattgccatattatgtgtaccagcaagaaacctagctttattaacttaagcaaaaagaggaatttattgtctcagaaaaaccagagttaaacagaaaattatagatgccagctgggtctcaagaggctagaaccaggaacccaaactgctaggactctccatttcttatttctgtctgggtattgacagctttccacacttggcaggaatcatggatgctgacagcttctgagttttgacatcttgcagcctcctccattctaacaaaatgccagggaaaggctctgatttgcccagctaggttcaggtgccagcttgcatgggaaggacattctcgtagagggttgggttgggttaccagaagaagcggaatggcgtgcctgaagtacaggtgttgagccaacaaaataatacacccactatgccttgctgaagtcagtcattatttactaatgctgacatcattggattatcaattacaaagggaaatgattttatgcaggatcagacatgccatttagaaagaccagtcatcttataaaatagtttgagggtaaacacaaggcccattaggaggctgctgcttaagttggagtcgataagtagtttaagtggagaagaggacagttagcagaacatttagaaggaagagttagtaggcctctgactggatgtcagcagagaaagaggataacgctagcgcaggcatagcgttaaagcaagtgccaggcccttccttctgaatacggggccctatgagtgcaccgtgtgacccctgtgagtgcacaatttgcacgtccttgtagcttgctctgggaggaggattgcctgtctgcctcccgtgggaagatcaactgcagccttctatattctgcagaaacttttgaatttgtctctgtacctctcgttctaaaactggggtcacttttgtgaagcctttcctgactcccctagaagagacaagcaccccggccttgcttttcattagtttcagtgagccctctttttaaagtgcatttctaacacatttctctagatttttcagtgcatttctctagattttgttgtgttccctgttcttttaaagttaatttaaaacacaaaatctccaaagtaggaagaaaccaacaatgctctggctcttgcttagcttcccagccttattcttactgttgctgggcttgactctatagttgaagttcatcttagatgagaggacctggtaagaacagggaagcagacaagtgaatatggtgatatagtcagtctccaggaaatccaggtgtttaggaatgtattgtgttacattcatgggctttcattaatacttcttaagtgaaaataaaatctgtgtgtgccacttaatcagtagtatttcactcttcatgcacttttacacataaaagtagtatatatttttaagtgaatcagggtgtgccactggctttcttcatccagatgagtgtcccactctgagtaatagctgaagagctaggctggacttcacaccaactggaaggctcttcactgaccttgtacagtttatcagctatgcttcctactaattatctgactttaggataaagctctgagtactgtttaaatttttcactatttctttggattctatagttatttcagagattcaaaatacacaggataatactttttaattatatttattgaatagggtattaaattttctttttcattttattctgattcataattcacacagactttgaaaggaccatattttggttctatctaaaagaaaacctaggctgggggcagtggctcatgcctgtaatcccagcacatcggcggaaggatcactggagcccagaagttcaagaccagcctgggcaacatggcaaaacccatctctacaaaaaaatacaaaaattaaccctgtgtggtggcatgtgcctgtagtcctagctactggggaggctgaggtaggaggatcacttgagcccaggaggtctaggctgcagtgagccatgattgtaccactgcactccagcttgggcaacagagcaagactctgtctctcgtgtttgtgtgtgtgtttgtgtgtgtgtgtgtgtttgtgtatgaaaacctaaagaaaagtaataaacagctatcttacaaaatttggcagcataccagtagtgaagttgctttacaaaccagatgagtaattaatggttcaattttgattgaacaaagaatcagaatgaggtttgaaccagaatgaagtgaattcctaacagaaaggaatttacttgtaattttcttattaaaggggtgcctttattttagattatcctaatgcatagtaatcagaatactaggtatctgtttaggtcttgtgtatttttaagaaattattcattttaatgcattgttcaacttttgcagtggccataatataattgtgataatgtaataaaatcaggaaacattacctgaagcagatgcttttgaagtcaccagaaaatagtcttctccaattccaatttaaatatggaggtaatttaccccttattttattaaacgatcacaaagatgttggaagcatttttcttaatgaaaaccaacaaaactttgcatattgtcaagttacgtaacttctctaagcctttgttttctcattggtaaaatatgtatggtaacattgtctccctcacgggatggatgtgatgagtatctgaggtaatgcattaaaaaggtaagcacactgtgtgtcttgtagtaaatacttaatatgttagggattattcaataatgtgcattattattttaacaaatatatctttaaatattaaattcccttagtcatatgtgagaaattgtgttggcttttaaaaaaacaaacttaaccagatcagtatgagaaacttaaaacaggctcagcagctaactcattcttccatctcttccaacagacaaaaaagtttggttttttagtagactggaaaggcctgcattgttttttcatttcctcaactgtttttcaattcagaatgagttagtccaaaagagaattagtgttgagaaatgacttctctcagggactagattggtctggtccagtcagaactaatgccagaccaaacccaactagatgaaattggataaataggagtaagaataaagccctggatttcaagtcagaaaagtggctgagcagatatttattggataagccccaacttggtggtggtgcgagggaaaaatataggggaggttagttacttacaagttcactgcaggccactatgtgttatgcctggctctttaaaaagaaaaatttcaattagaagatttcaatgaacacttgaaacatcacctgcaagaattatcaaaatgtctgtactcagcttaaacctgggggatgcggctccttgctacggtgaaagttggaaagcattaagaaaaatagtcattttatcaccactggaagccattcgggagggagattgtaatcaaatatgttctgacaaaaatacaaaggccttgatttggtacttttcatttattcagtgtggatttcttatgctggttctgtttgctgtgcagatgaaacctttgtgacagtccccattcctgtccctgtatctttaacatggggaaggtgttagatcttctctgagagttgttcttaaggaaaagatccagatgctttaatttgaaacatttgtttttgagttgtagtgtcagatgacttagaatccagaacaacagtttacttcatcctcacttccttatgcttctcagcgtgctcttcccatgaagaggttggtgagcaggttgtcagatgatttctgcagagtccatagccctgttccaccatagatgtacaaaccttttatacagtctttttacactagtgtgttaagatgggtgatgaactcctcgggctgtccttttttaaagagacacagatgcttttggtggttacaggatggactcaggtagcagccctggttcctgtcacccagctatgcagaggaaatggccagtgtcttcagactatactctgcaggtatctgtagtttgccatccaccctacattcaccaacatttattgcagagctatcacgactgctattttttggtcctttgtgacattgttatggtcccgtcgatagcactgctctgtatcacctgctgatcttcactggtcttttgtgttgtctctcttttttcatatcctgtctcttctggcttatcagctttctgaggaaacagttggctttaaccagggccctcctttttttttctgcattgtaattaaagtgttaggaaaaacaaattcttctctcctgtgtttagttttcttaaattatcagctgtgagttgtaggggagttctgggaattagatcttaaaatagctaaagtttactccggatagtatgcagatgtaatacactaaataattctgagtccatttccaaaagcaacatgagttacacaaaactatcttggcattttcaagagatgggaaaatctgtaagattatcttatttcatgaaatcactctggtaagatcttttcttaagccccagagataataatactcttttgctgtttctacatatatttttatttacatagtgtaaatgtattagaagttaattgtaagccttaattaatttaatctgaatatataacaatttaaacctcacattacaaaattctgaagcttaagaaaactgcttatgtctgtcatattattttggcaaataatatttggcaaaaaataatatttggcaaaacaaaggcagatgtctaataaccacacagtttctcctctggtagcattaaaaaccacagattacatcttttggtgtaaatttataagtttttcttttaacctagtagtaatttctttttgctataaaccattgaaatattttcctcctaccacctgtctgtcttgctttgaaagctatgatttaagtccttgtcctagtctaaccatatcaggcttttacttaaattataggaaacatactttgattcacgttaaaaactaatctaatgctgcacaagcctactcctgtttgtagttttccattgtgtgattcagtagccccttcctaagtacaaatgcactttgtttgatattctagtatgcagattgacttctatatgcctttttctcacaggaatttcaggttgagcgtataccattataaagccattcctactgggtataattaaaaagagagccttaggctgggcccggtggctcacacctgtaatctcagcactttgggaggcccaggtgggcgattcatgaggttgggagtttgagaccagcctgaccaacatggtgaaaccccatctctactaaaaatacaaaaattagccatgtctggtggtgcaaacctgtaatctcagctactcgggaggctgaggcaggagaatcgtttgaacccaggaggcagaggttgcagtgagcagagatcatgccattgcactccaacctgggcaacagagcaagactctgtctcaaaaggaggggagtggagcttaaaaggaagcaaaggatttccagtcttggaaacctagaggaaggggggtccttgctatgtagtggcagaaagctgagtgacactgtagccttcagtgacaccaaaagtagagaatgtctgaggagctgtgtgatctagctcaggaggtttctaaccagagtgctgaaagtgccacctggtttcttcttgcgtcttatagtaacaggtgagactttgctcaatcatgggaagaactgttaaaaagaaaccaggaccacctggtttgaaaattctcagcctctcgagaggcaaaaaaatgccaaaatgaagaaatggtctccgaaggaaggctcagatttagtatgagttttcttagcatcaagtacctctgttttccggttgaaaaagtatatttatatgtgtgattgttatttgatattaatgttgattgaacccaggtgaagaggaatgacttttatttctacctaaaatatggattgtgaagtatttgagttgtttcaggaggttgagatgcaaacgtgtgatagaaaaaagaccctcttaaggaagcctcagtatcccctgctatgaatggccatgggaactctacaaaaaacaaagagccaaggctactctggcaagaacagtgccttagggatcacctacaaggaagttgcttagagaaccagagatggcaggtaccaagagccttcagctgcgcctctggaagcagaaggagaaaacctaggtgtctggtcactggccacaaaaaggtcaagttagtagtatgaagtatttgaatcttcagaccctccccagcttgataatctcaaccttttggcccaaattattacaccattttggtaaataatatagaagttagatcttttggcaataaccaaatctattcatttgtttgaggggagccatgaaatatacaggtttactgtaaagcattctgtttttaagttagtttttcctcaactttttttttaaagaacacttaaattgtaaacataaagcagggtttctcaaccttggcactgctggcatttggggctatattattttttgttgtggaggctgtctgatgcattgtaggatatttagcagcacccttggtctctgccctctagatgccagcagtacctcccccacacacttcttctccaggttgtgagagccaaaaatgtctacagacattgattgcctaatgtctcctggcaacaaaatcacttcccacagagaaccactgcaataaaggaaaaaataatcagaaaaggaaaataataatggtgatagcatttaattgtccattagtgcctattatttacctaaaaaactcttaatccatgttctgctttgaaaatatatgtgttaaataattgtaaattaaggcaatataccagtttggtcttgaatattggaatttttgtttggggaaaatatagattttcccttcagcagtaagcaaatatcttagggatatgaaagtaacacctcatgacagatcaggaaatctgaagtatttagcagtgtggccaagaaagaacccaaatttattaatgtttgacctagggagtatttttcttatttaagcagtctgcttgatataaatataaatcatcatcattatcatccaaggcactttggaaaaatagaaacttctgtccctctcacaatttttgaggatgattataagttatgtttggaagccactgttcctatccacatggacattcatttatttgttttagttatataagtaaatcatgtttaatagagtgttccagggaggtgagattgaataaccataaatttggggtcacatcgctaactgtgtacattcatgtttatctgtaaagaagtgaagggagaaaggagaagtgtgtgtgttcagttttccaaggggtgttggataacaaccttttacaccaaacagtggggaaaaatgactcctttttttttttttctaagagaactgaatgcagtggcacagtcacagctcactgcagccttgacctcctgggctcaagcaatcttcctcagcctcccgagtagctgaaactacaggcacaggcctcttcacctggctaattttttaattatttgcggagacagggtctccaactcctgagctcaacagatcctcccacctcagcctcccaaaatgctgggattacaggtgtgggccaccgcacctggcccatgactacttttaataactagattttggtagtgtctgattagatgttaaaatgacttctgtctgttctcttacgtgactcaagtcttatcaacagatgttttctgaaagagtgaaggcaagaagaaatgttgggtatgttttgtaaaaagccctgcacaccccagagagcagagtgttgatgaaactggaatgtgtggctccattgttcaatctttaggtatctattcctgtactatagaaaaagtgtggaaggcataaatagtagtatgtgtagagttgagaggttgatggtattttagagtgaaattggccatcctcattgtagccagttcctctgtagacatttgtattagtctgttttcgtgctgctgataaagacatacccaaggctgggaagaaaaagatgtttgattggacttacagttccacatggctggggaggcctcagaatcacagcaagggcgaaaggcacttcttacatggtggcggcaagagaaaaatgaggaagaagcaaaagcagaaacccctgataaacccatcagatctcgtgagacttactcactatcacgagactagcatgggaaagaccagcccccgtgattcaattacttcccccaggtccctctcataacacgtgggaattccaagagatacaattcaagttgagatttcggtggggacacacaaccaaaccatattatgctacccctggcccctccaaatctcatgtccttacatttcaaaaccaatcatgccttccaaacagtctcccaaagtcttaactcatttcagcattaacccaaaagtccacattccaaagtcccatctgagacaaggcaagtcctttctgcctgtgagcctgtaaaatcaaaagcaagctagttacttcctagatacagtgtgggtacaggtattgggtaaatacagccattccaaatgggagaaattggccaaaacaaaggagttatagagcccatgcaagtccataatccagtggggcagtcaaatcttaaagctccgaaatgatctcctttgactccaggtctcacatccaggtcatgcggatgtaagaggtggcttcccatggtcttgagcagctctgcccctgtggctttgcagggtacaggctccctctcagctgctttcacaggctgccatcaaatgtctgcagcttttccagaagttgtcagcagatctaccattctggagtctggaggatggtggccctcttctcacagctctaccaggcagtgccccagtagggacttgtgtgagggctccgacctcacattttccttccacactggcctagcagaggttctccatgagggccctgcccctgcagcaaacttttgcctgggcatccaggcatttccatacatcttctgaaatctaagcagaggttcccaaatctcaattcttgacttctgcacacccataggctcaacaccatgtggaagctgccaaggcttgtgacttccaccctccgaagccacagcctgagctatatgttggcctctttcagtcacagctggagcagctgggacgcaaggcaccaagtccctaggctgcacacagcacggggaccctgggcctggccacaaaaccactttttcctcctaggcctccgggcctgtgatgggaagcgctggcgtgaatgtctctgacatggcctggagacattttctcgatggccttggggattaacattaggcttcttgctacttatgcacatttctgcagccagcttgaatttctccccagaaaatgggtttttcttttctgtctcatagtcaggctgcaaattttccaaacttttatgctctgcttcccttataaaactgaatgcctttaacagcacgcaagtcacttcttgaatgctatgccacttagtaatttcttccaccagataccctaaatcatctctctcaagttcagagttccacaaatctctggggcaggggcaaaatgccgccagtctctttgctaaaacatagcaagagtcacctttgctccagttcccagcaagttcctcacctccactgagaccacctcagcctggattttattgtccatattgctatcagcattttgggcaaagccattcaacaagtctcttaagtaaagttccaaacattttcctatttcttctgagccctccaaactgttccagtctctgcctgttaccctgttccaaagttgcttccacattttcttgtatcttttcagcaatgccccactctgctggtaccaatttactgtattagtcctttttcatgctgctgataaagacatgcccaagactgggaagaaaaagatgtttaattgaacttacagttccacatggttggagaggcctcagaatcatggcgggggagaaaggcacttcttacatggtggcagcaagagaaaatgaggacgaagcaaaaagcagaagccccaataaacccatcatatctcatgagacttattcactatcacgaaaatagcacaggaaagactggcccccatgattcaattacctctccctgggtccaagccacaacacatgggaattctgggagatacagttcaagttgagatttgggtggggacacagccaaaccctatcaacattgaatacaatctgtagtatcaaatattgaaaattctagtgatgaaatgaggattattaattcaataatcagtgcatttgattataaaacttctatcatattaagggaatttattgcttcatgctgtatttgtgtttcctttatattgcaatgatgtttccataatttaaaacgaatcagaactcttctatagatttttcaataaaattaatttctagatgtctactcttcatttaaataattttggtatcctggtgaattctacttttcttcaaatatacatatctgggcaatgtggcatcttacaataaggctttccaatattaatgttagtttcttacaattgtcccttttacttttttattttcttacagtgcctacaccaactaatgttacaattgaatcctataacatgaaccctatcgtatattgggagtaccagatcatgccacaggtccctgtttttaccgtagaggtaaagaactatgggtgagtgtcactcttttatttatcctttttattccatttttgtttaggtccttggaaattccacaactgtgttctttcatcagccttcccacgtggcaaaacattctaaactgcttatagaggtccaaaagtactaaagatgcaaattctttgccaaatatttcttgcctcttatttcctcttccttatcagtattgaaatagagaagtatcactaaacttctgagattagcatgacaaataaagctaatagttactatgtcatcttcctgtagtgtatttttagtagaacaatataaatttcaaaaaacttttttgacaactgttagtttttttaatgtgcttacttctataattaacatatataaatggaatttagagttgtttaaaaaaacagatttttaaaaaattgaatgtggaatgtggcttgcataggtcttacattttgaattgagcctctttactgtaacagagtttgtagttcttctaactaaagagtaagggtttcctactttctctggcgtctccatcctattcttagctctgctctttctaccgctttgtgctgtgaataaaaagcaaagcacagacagaaatggtttgagtttatttaataacaataaaagttatcttcgcatttttttattctttttagtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggtgagtagaatgtgtacacatgtaaattttaaattggaaaatatttatacatgtcttctgtatgtttgcttttattagcagttgctgaaaattatcacaatgcttaagaaacacttggaggaatttagagtcagtacaggttgagcatcccaagtctagaaacccagaatgctccaaaatctgaaactttttgagcgccagcatggcactcaaaggaaatactcattggagcattttggatgttcagatttagaatgttcaactggtaaatataatgtaaatattccagaatccagaaaaaaaaactcagaaaccgaaaatactactgatctcaagcgttttggatatgggatactcaacctgtatcctccccttctttcaagccccacaaaatagggctaacaggtggccatcacttagctgcttctatgccatgacatttccacttcatacaattatgggtctgtgctgcccagcggtcccctgcaccacccttgcccttcccatcttttgtcattcatttgtaagttatattcactaaggactttggcagctaactcttattctgaatgcctggggaacctgaataccaccttaatacattaaaaaattgcagagttccttattctcttcagccactgtgattttcaggtcttcagtcttccagcatcccactcccatagtgtacctgatgtttgctgtcacctcaaactcttgaatctttaattccagttcctgtattccaactatgacatcctgccttagctctcagaccctgactcctgggtaaaagacacctttagtcacttgactcctccctagtcttctagcccttgggtccctttccctctagcctcacttcctttctctgctcctgccttttagattgtgccacctcggtctcttctacaggctcttcctctccttaccctttaaatacttttcttccccagagtccacaattttgtcatatgattaccacaccatctgcatgttagatttttttccatatagatttatcaagggcctactacgtgccggaaagtatactgggccctgaggatacactgatgggttaaaaacagacctgcctggcacacagtggtacacagtaatatgtgaagactagataaatggttcacaacaaagtctcaaacatcaaagacctaataaatatttatggaataagttctgatttttcacagtaaaaagagttttgatgagggaagaaaactaatgccatttctgaaacgttttttagaatccaggcttcttaatccacagaagcaaagataaaggaaaaattacttaatagagtctatattatgtgaagtctttttttaaccaaagtttataactatttttatttacaactagaaatgaaattaaactgctaaataggcattcagattaaataagagtacttcttgcctgagatttatgaaacatttgtttattaaggaccccgagactatcttctagatatttgtggagtggtttaaatgtggtcctgctttagaacaaccagaacaaaaacaataggttgattgatagattctggtaattttatgaaatgtaccatttagttccaaggccagtatttattatacttcctcctcctccttccccaggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgaggtatgtgtttcacatttttcataatggaaattcttgtgtagctagcaaaagttgttcctttctgtagtgtaatgaaaataggatgcttataaatattcaagcaagactcacagatcatagatttgataagaaaaatatgtgaatgctattaaagcaaaaatgatacagagttagtcactaacactgaccatgtgaatacatttagtttttatttgcttcatttagcagaatggctctaatctaggatttttcccagtacacctccattgctccactggtaaaatgaggattttcttcctcattggcggtgacgtaaagtaatattaatacttctgtttcccaccagctaaatttctggacaaatgaataggacaaatgaacatttgttagtttaacaactaacaataaacattcctgcaatttgagtttttaaatttaccatttttataaggaatataacagatgcatagtatcgtgctgtgttgaagtaacaaattgacttattgatagtaaagctatttttagacatgttcaagtcaatcatatatatttcttcagttgtttgaccaggactaatatggtgattttttttttttttcagattaaaagaagctgtgcattttcactgttttcttttttcatctagatccagtataaaatactcacgcagaaggaagatgattgtgacgagattcagtgccagttagcgattccagtatcctcactgaattctcagtactgtgtttcagcagaaggagtcttacatgtgtggggtgttacaactgaaaagtcaaaagaagtttgtattaccattttcaatagcagtataaaaggtaagttcttgccattttttttctaaatatagagggagcagtaactaaaataggatcatgtgaggaaagcaaactcatttgcagtttcaaaagatctgttttaacaatattcatttgcattagttccattccttagagaagttcaaaattaaaaataaagcagtttctcacacatttaaagatatagaacaactaatttggaaagccatgtgatggccccttgacccaggaaagaaaaaatatataataagtacataaaactacacaaatgtttgcatttcaggattatgaattataagtcagtttgttacttcaccatagcaagatgttgtgaatccactaaaatgttctttatggggattgtaatttaaagactgaagagcaggaacgatcactggttacaactgtatgacgtggactggacaaagactcgagattaatatccaaaaaagtttatagatgggtttgaataatagataatgggtcatttttataacattttacaataattaattttatttcatcttttaatgtggggggtggggaggtagagatatatatgctagaacttgaactttagaactgttactctcaggtgtcaggaaccttaaagaagtttggacttttctttgcagttaggaaatgtaagtgttcattatagataatttataaaatatgaaaaaccagaagaaaacaaaataatctgtagttctaccatgcaaaaataccccattattcacagtttgatattttctttagtttttctacatagacatgatcatattgtatagtatatatgattttgtgtattgctttaagcatatattgtaactcatgctttgatgattatctttgtgtgtgtgtgtgtgtgtgtgtgtgtgtgtgtgtgtgtgtgtatacatatatttttttccttaggatttttttagaatagatttcataggtttaaaattttatgatgcaagtatattttcgaggaatggaaatataggctgaagagccagaacaaacacctaaaattcaatactaataacttcaagccattatatgaaggtttcaaataggtgatttaaagcagtgcaatgcattttatgctaattttcgttatgctatttgaaaaataaaacccttcttaatgctcaaaatttgaaataatgcaaatgccgcagatttgtttttagcctgaattatacactgcactgatagtatggccacacggtggcattgccgtggctcctgagcagcagccctgcctgcttgcctcaatgccttgcagccagcacttgctcagcccgtgggacttctaacagcactaatgttggttttgtagttattttcctttttacttttgtaatgatttaacttttttcacaccctgtaataagcgtaatagaagcattcattagtaacttccatagttagaaaattctgggtaacaaaatgccctaaaggatgccggacattgtcacagtatgttagagtgctgttaatttggaagagagaactatgaaaaaaaaaaaatactgaagattgtgctgcaaaaataaaaggcagcattacagcaaagtacacaatggtgattctagatgtatgtgcttggaaacaaatctttcctattttatattatttatgtctggtttataactaaggggactttattcctgtgcagcattgctgtgtgcatgtacatctgtgaagctttataagtatttgcagtcgtgaaataaatgtaacaggaaattctgaggagtggggctaaatcatcttaagagcaataaacattgccagaatttctttctttttttttttgttgttttgttttgttttgaaatggagtctcgctctgtcaccaggctggagtccagtggcacaatctcagctcactgctacctccacttcccaggtccaagcgattctcctgcctcagcctcccacgtagctgggactacaggcgcatgccaccacacccagctaatttttgtatttttagtagagatggggtttcaccatgttggccaagattgtctcgatctcttgacctcgtgatccgcccacctcgacttcccaaagtgctgggattacaggcttgagccactgtgcccagctgccagaatttgtttctaaggagaggtatttttaaaattattcttttgcatttttaaccgaaagaaatgcataaccctggaaacacactgtatgtagggctgtaaggaaattattgtagaaaagctattttaactatgttgtgtcatagtagaatagtcccagaaagttctagaattgcagagctgggaagaaccatattgctatctaagacagatacctaattttttactcagatttcctaacttctgcttccttcagtgttctttaaaactctggccctattcactaatttgtaaatctattcaagaatggcactaagactttttgatagataatagcagtattccatcttaattgtaacttgtgatttctgccttttttaaggttctctttggattccagttgttgctgctttactactctttctagtgcttagcctggtattcatctgtttttatattaagaaaattaatccattgaaggaaaaaagcataatattacccaagtccttggtaatgtatttaatttttttatatacactaaaaagttaacttgaaccttttttgatagtttcttaaattatgtttttaaagtagaatgatattcaacaagatgtcacctgccatcaatcagtcagtctaccacacatgcaaaatcacatactgtgtcttttgctgtgcagcaagtattttgtttttttttttattctcagggaaaaacacggtgagacaattctgttaaagatcttaaagtctagggggaagaaaagataaatatacattggctatataacgtgtgatagattcaaagatttatacctgagcccatgaggactttgtccagctttggggtggggttagtcatggcttttccagaggcaatgcctgagcagtcttgagggacatacaggagtttaggcactaggggacagaatgtgctgaggtccagagccaagaaagcatgactttgaaagctctgcaaatacagaaacacttcattatggttggagtatgaaaggaaagttggccaaaaatgagactaacgtaggagtttgacgattttaatgtccaacatttcaaagcctttgatgtaaagaacatttaaaggtaacagaatagtatctatttgagtcaaatatgacaggaataatatctgtgatgctcaaagggcacattaaaatttgctataaactacctttaaagtggataagaactctcaacagttagtagtcaactcacaaatgaattataatattttattcttactagtaattaagcacaaagtaaccttgcagtatgccattttacacgcgctagagaagaaaaaagaaacctggatatccagtagtaccagcagtagcataacgggtaaatgctggtgaaaagtaatctagccctggtaagaataaaagcacacagtgggtattcagtgtaatagtgacgtaaacataccatttctttgatatggtcactccactcttaaaaaatgtattataaggaaataatttcataaataaaaagatgtacaggatatttaacatgttccatagctagtaaaaattggaaacatttccccatctattaaattatttatcagtataaagaaataatatgagctactaaaaattataatgatgaaggcaagtaatgagaatattacttaagtagatgtgcccactttgtaaacataatgtgcgtacatgtggaagataattgtattaggattctctagagggacagaactaatggaatatatatataaagatatatatataataccaaataaactcccctttatataaatctatattttatatattatatattatatatattttatatgttatataatatatattatatataatatataatatattatatattatatataatatattataaattatatattatatataatatataatatattatatattatatataatatataatatattatatattatatataatatattataaattatatattttatataatatattataaattatatattttatataatataagttatatattttatatattatattataaattatatgtttatataatatattataaattatatattttatgtaatataaattatattttatataatatattataaattataaattatatattatatattataaattatatattatataatatatattaattatatttttcatatatatatatataaaggggagtttatttagtattatttagtattaactcacacgatcagaggtcccacaataggccatctgcaggctgaggagcaaggagagccagtccaagctccaaacttgaagaattcagagtccgatgttcaagggcaggaagcattcagcatgggagaaagatgtaggctgggaggctaggccagtctctcttttcacatttttctgcctgcttacattctagccatgctggcagctgattagattgtgcccattcgggttaagggcgggtcttcctttcccagcccactgactcaaatgttaatctcctttggcagcaccctcacagacacacccaggatcaatactttgtatccttcagtccaatcaagttgacactcagtattaaccatcacagtaacgtacaaaaagcaacatatattagtaagatatctgatggctttttaaaaattctaaaactttgtttttaatattactatgggacctttcattaaaaagaaatggcaacatctgattcacccattatcctaaatgtgccatttggtggtccattacttcagacctttgttttttttgagggtaggcacttaagcttaacaattttttatctttaatcaatttttctccccatagatctctgtggtaagaagtgctactttagagacaaaacctgaatcaaaatatgtatcactcatcacgtcataccagccattttccttagaaaaggaggtggtctgtgaagagccgttgtctccagcaacagttccaggcatgcataccgaagacaatccaggaaaagtggaacatacagaagaactttctagtataacagaagtggtgactactgaagaaaatattcctgacgtggtcccgggcagccatctgactccaatagagagagagagttcttcacctttaagtagtaaccagtctgaacctggcagcatcgctttaaactcgtatcactccagaaattgttctgagagtgatcactccagaaatggttttgatactgattccagctgtctggaatcacatagctccttatctgactcagaatttcccccaaataataaaggtgaaataaaaacagaaggacaagagctcataaccgtaataaaagcccccacctcctttggttatgataaaccacatgtgctagtggatctacttgtggatgatagcggtaaagagtccttgattggttatagaccaacagaagattccaaagaattttcatgagatcagctaagttgcaccaactttgaagtctgattttcctggacagttttctgctttaatttcatgaaaagattatgatctcagaaattgtatcttagttggtatcaaccaaatggagtgacttagtgtacatgaaagcgtaaagaggatgtgtggcattttcacttttggcttgtaaagtacagacttttttttttttttaaacaaaaaaagcattgtaacttatgaacctttacatccagataggttaccagtaacggaacagtatccagtactcctggttcctaggtgagcaggtgatgccccagggacctttgtagccacttcactttttttcttttctctgccttggtatagcatatgtttttgtaagtttatgcatacagtaattttaagtaatttcagaagaaattctgcaagcttttcaaaattggacttaaaatctaattcaaactaatagaattaatggaatatgtaaatagaaacgtgtatattttttatgaaacattacagttagagatttttaaataaagaattttaaaactcgtttttgtattcatttattcaagcacttaggcagtctttcatagttaagcagaatatttttatatccactgcttgtttccatgcattaatgctataggattatttgctaattgttcatatttaatatttaaaacaaccctaaaaataatatttttaaatggtccttataggtctatatttcagtgcttaacacccagtgtgcagaacactgttctaagtggtttgagaagaaaagatttagctgtagagcatgtggattgaggaatctagcataaaggtggtgggcagagccatggaaatggatggaaccttgagaattacatggtgtggaaagaatccccagtgagaggcaaaccaagagttaatatatatgttacccaaggatttcttggaattactaagaggatagaaatattcagaaattaatatgaatctgtgaattaatggaccaaaaaaaatgaaatacaatttacatgagtagcaaatcacatttctttggtttctggaaagatatttctcttcacttaaaaatgcaaattacaaatgagatactatcagtgaaaaaagtagtggtgtggtttgcagtggaactggtatagtcactgattttagggtaatgtcttgtaaattgcttttcaaactgataccccatacatatcacattccacaaaagtaatatccttcaacagactttgatctctcttgtgggaaaattacaaaaaaaaaaaaaaaactacatgaacaatgcacacattagaatgggaaaagcaaaaatatgaaaataattgaaatagccaaggaagaggtaatacttactaccctccaaaatgattataccaatgtgtactcccatcaaatgtgaatgaagtacctgtttttacaccctagctaattgactgaaataagtctttaatctcggtaaaacactttacacattaaatgcatttgcatttctttagtaaatttgagcatgtttttatatcttatttatagtttcatgccaactcatcttgttctttgtccatttttttatgggctgtttatatctttcttactaccctttatctgccctgagttacagatttattttataatttcctgccttttgacttaccacacagatgtttaagttgtttataaagtcaaatttatttatttccttctatttttaaaaagcccttcccctttccccaaaagatagaagttttcactcatgttttcttctggtctttggtgatgattgttttacatttaattcttctatccatctagatttttttcctttgaggacagagatagagatccagctttatttttttgttttagtttcctgtggctgccgtaataaattaccacaaacttgggtggcttaaaacaacagaaatttgttatctcacagttcagaggctagaggtctgaaatcaaggtttcaatagggccagattctatctgaaagctctaggggtggagggccccttcctagtttctagtgattgttgtcaatccttgatattctctgacttatggctgcattattccaatttctgcctcttgtcacctggcattcttctctgtatgtctgtgtccagatctttataaggacaccagtcaattggattgattagtcccactctaatccagtatgacctcctcttaacttgattacatctgtaaagacactttccagttaagatcacattcataggtaccaggggttaggacttcaacacatctttttgaggatacaactcaactcatatatttcccttaacaaattagttatcccaaatactattcattaaattatctaacttttctatgctgatttcaaatgtcacatttatcacatgccaaattctcagcactcctggaacagttttgttgttcagtcttttcccgtctatgtatcacacttttaatacacattatactgggatatattttatgtttttttgagacagagtctagctttgtcacccaggctggagtgcggtggcacga

SEQ ID NO: 17309 - DNA, 16835 bp, Human
attcactcattaattcattcaatcacaaaatattgagtacccaccatgtgccagcaactgttctaagcacttggaatataccagtaagcaaaacaaagcccttacccctctgtggagcacatattggtggagaggaggggattgtacaatgttagtaagcaaggcaataaaactgcatatctgatggtgatacgtgtaacgacggaaaataaagaagggaagggaataaatagtgcagggacagggagttggggggaggcttgctatttttaatagggttgtcagaaaagatctcactgataggtaaacttgagcaaagacctgaagaaggtgagggaatgaggatgaaaatacatatcgggaagagagttccaggtggaggaggttaaggtccagacaggagcttagtatattcaaggaaaagcaagaagactagtatggctgacaggatgagctaggagagtaataggaaatgaacttactgaggtttttctaatgacctgggcttttactttgaggtaaggagccagtgaaggtttctgagaataaatggtatgatctgccttatttaggattgctgtagttgctgcactgagataacatgtacatgagaggcaagagtagaagcagggagaccagagaggaaggtattgtagtattccaggtgcaaactcaccaggtagcttgaaccagaatggtggcggtagaattgggaagaatctggatatattctgaaggcaaaattgatggggtttactaatggtgtggatctaggataagagagaaaaagagttcaggatgattctaaagtcacttgatagactttcaaaccactcacaaaatgtgttttgttttcgtttgtgtcatgataaagttatttttaataaggtcaaataatcccctaccccaagagttaattaggatttaaaatgagttcagagggaattgggatccagccttaagggcttcaactctgttcaagtatttaaatggctttgatctctgattaaaggtggtggctcagctttaaactattattatctatcattttctgtgccctgtacattgtcatccttgcaatgagaggcatagagctatcaggagaggggactaaagcctaactttttaagtagactaatctttgtatcctcagctctattccgtcttttaccgacagctggtgcctgacctagaggcctactgcatcttttttgttaacaggatttttaaaagttgaggactttttaatgccaattatttcactcagaatatttatttatttatttatttttttgagacaaggtctcgctctatcgcccaggctggagtgcagtggcgagatctcggctcgctcaacaggaataattttaatagcaaaaatttaaaaccccttcattaagccaggcgtggtggttcacatctgtaatcccagcactttgggaggctgaggtgggaggaccgcttgaacccgggaggtcgaggctgcagtaagtcgtgatcgcgccactacactccaacgtgggcgacagttagaccccatctcaaaaacaaaagaaaattagaatggtaaaaatgaagtaaattcactttgcttcccacatctagctagacagggaaagatggagtagctttttcttttttacttcatagcttcagtgttgtccgggctttcattactctcatctcagtataaagtggtaacaggaaggtcaggtgagtgtgggctgcctacgagctgtacttactgccttctgtttcacaaaaggacgttttctccccataatgtcgttgttcttgctttgaattatgggtgctgggagaaactaaacgaagccgtcactgagcaatacacccacagcccgtcgaccgataggaaccttcgcgtggggggagttggttacttttaggttgcatgaagaggcggggcctcgcggggcggagctgggggtggtctgtgggtccgcgcgggcttcgggtagttcctgggtccggggagcagacgatccgctagccacattaggcgctcggtctctgcgtccgcccctcccgtgcctcagagacttgcgctccccaggcccgagcccctgtcggcccatcctcgagcccgtgtggctcgcgaacctctaactccagccgctgcagccccctcccaggcccggcgtccccgagccccgcgggcgccgcgcctgcccttctttggctacgctgcagccgcggtgtcggcgagtcctcccgggttgcccccgcgggcgtcagagggagggcgggcgcccgcgtggtgacggcgacgcctgcagcccaaggagcgctccactcgctgccgccggaggggccggtgacctcttggctaccccgcgtcggaggcttagatggctcaggcgaagatcaacgctaaagccaacgaggggcgcttctgccgctcctcctccatggctgaccgctccagccgcctgctggagagcctggaccagctggagctcaggtgagctccgggcgggcggtctcgggcgttctgctcgccgcgcgggcggttcgcgggcggttagcggacggaggccgcgtgtggcgggccggggcctggggcacagtgaggctgcggcaaccgaagttgcttgttgagatttgttgtggatggacgtggtgtagttttgtttgtttcttggattatctcccctagtccgagagaaaacgcattcgatttaagctaaacctgtgagggcgttatcggtggccacactttgattaatttacctaggtgttagggagcggaaaaaaatcagaggagataaaagttacagtgagattccatgcgattaaggactgtggcagcttgggtctgcagaacttctagaaccttctgtgtggccccaaacgttttaacttactcttctcgttatgcattttttaagggaggcagcagtttacagtggccctccacgtgaagttaagtttccttgcttcagaacaaaaatgaataaaacaaaaccaacccagcaatccattgagagcaaagattagacaggagtgaggggtaggcagtaagttaccgggtgcttcgtgcagcagagacgttgccgcttctgtttctcccctaacctcgcggacgggattcagcggttccgttcgtctctcggtatttattgggcacctccctacatagaagactaagtgctagttactggcctgaaagcatgaaaagatagttttccccttttcttgcttaagaatttatttggtaatacagtagtagacttgtatagaatttctaaacaatttaatgttaatagatttttggaaagactttaacggtgtattgaaaagttttatctacttcctgtgaacgtttgtctcaagttactgtgtaaattttgtgagcaggtgtagttaaaagaaaatcttgttaggcacctgcaattccgtgaaactgtacacaggagttggttacatagttttgtctaggttgtgcatgagcaaagaagcatgtgagccaaaaagtttaggaaacactgcatgtgtgtctttatcttcctacattaatacacccaaacatgaagtatctgtttgctgagaaaatacttcaataaccacggtatctcttaacaagtgaggcattattattgttactattgggagaaaagagccagagagtgagagattctccactcaaaataatttcttggattattaagccctacaccaggttctggggttccactcagaatgaggcaagtggaagagagaagtaatgcttcctcatggattttcacaatactggcaaacctgaccgttccactcccagaaaaagtagagcgaaagtagaaattggtggcctcagttacttgaagtccctctaactggtaatgtttctttttagggagccacataacaagtaacacacatctctccatgtcttcagaacgttgagggcatgttctcaaccacttcattctcctctcccttagccagaaagaaaagttttcctaaaggaatggggaggttgttactccactccgccttccttcaagctgagtcattgtcctccaacttgaattaatgcctcacatgtggtaggtacaaaagcactctgaagtgctcctctttaaaagaaagcctcaggttttgaatattattatattctactgtttgattaatgtaaaatgaattctgattgcacatcagtgattaaattacaacttgcttaattaacatttgagctgaggagaaaagtgattaatatgtggctgttcatttcaaggacttttttttagtaattctggacttttgtaggccttttttcttctttttaaaaaagtaatactagctgaaaaggaaggatttccgaaggtaagcaaaaatagagaaaaatgctaatgtagatcctattaaagttttttttgaaaccacatgggcaatggcactgaacactattaaaaactagaatcatgcgtagaagatcgatttttaaaagaaaacatgaaactcatatgtaattttgctctaatagtttgattttgttgactaataaagtagtgtaactgtgtagaataaaaccttatagtttgtacttagaagtgtgcacttaatgttccctaaccacactgatcctgtcaattgtggaagaaatttcatactttatgacctggagtatgaactgatctacatgatgtttaaaatgtttggcagcagttttacaaactgttaaaggatttccatttatctctaatggaatttatcaatacagtagcccttttttttggactgcattttgtcttctgtatttcttccttctacagaggtgattcccttttctccgttttgacgatcagttctaaatggactctgagttttgcattcttcagtggctcaaaccatcttgcttactattgttactttttaacaattattgtaatttgtaaaaaatactatgatattacgattctctctctctgtatatatacaacgttttcctggctcataactcccataacccttgttacagtcttatgttatagttcctggctcataactcccataacccttattacagtcttacgttataatgttggggtgctttaggcctcaggaaaaagaatctctctctctgaccttctttcacctgccttacctctagtctgattgtgggtcaaaagactctcgttccagagagggtcctgccctatgccctggaggagggcatttagcacccagaggccaagaagaatctgaatagactggccttgctgggtttccccattcagtctgttagagtgagggcatactctttttgtccaatcacttttctacatggttgtcattcatgcttatataaaagaagcaagcctccataagaacccaaaaaggacagggtttggagagcttctggatagctggacatgtggaggctcctggaaggtggtgtgccccttccccctgtacctcaccctacacatctctttatccatgtcctttgtaataccctttataataaatccgtaaatataagtaagtgtttccctgaattttgtgagctgctgcagcaagttaaacccaaagagggggacatgggaaccccaatttgaagccagttggtcagaagttctggaggcctagacttgcaacggtggagggtggggtcttggggactgagctttcaacttgtgggatctgataccgtctccaggtgtagggagtgttggaactgagttgggggatacttagctgcaaatcccccacatatttggtcacagccttctgtgttgttacagtgtgagagcagaggaaaaacacagtgtgagagttttttctaaaacacaggctaatgtttattcatttaatgtacacggactatgtgccaggccccatgtcgttgttactattatcaccattctacagatagggaaattgaggcttagaagcttaaatgacttgtccaaagtcacacaactagagagtagtaaactccaaatttgaacccaggaagactggctctccaggctctaatactttatgcctgaattttcttaaatatatcacatttcaaaatatagaaatgatatatggatgaatagatgagcttcctctaagagataaaaattcaatctaaattggcctttaattcagtggatattgaacacccactatgtgttaggtattgggtagctcctagaaagctcaagatggtaatgaagatgtttgggggatgggttttggagactggcagaggggaaaatgataggactgggagattggcttttcatatgtttcccaaaacttataacacagtggctccttctgccttcctgtcagcctttcactgtggcttaacctgcacccaggtagtgaagggatggggttgggggtgatagggatcattcgtctggcttaaagtttcatgttagggtgtgccagtgttctaggagtcacaaaacaagatggcatcatagttaatactgtgtgacagcctgtaatttaaaagaacacttcatatatgttatttgaaactttaagaacccttcgagttaggtggagggcacatactctctctcctagaaatgagggaagtgaggtccaattaggatgaagtggcttgcctgaggacatgctactgaaaagtggctcttcacactaaaaacactagtcccttcttttacaccaaaatgtcttgacagtaaatgtaatttaacattttggtgattaggaaaacacttcagaattttacattgcctaaaagtgatcattatagcattcttttgatataggagtatggaataagagacagaactatgagttttaagaacctgttttaggccaggcgtggtggctcactcctgtaatcccagcactttgggaggctgaggtgggcagatcacctgaggtcaggagtttgagaccagcctgtccaacatggtgaaaaccatctctaataaaaaattcaaaagttagccagacgtggtggcgcatgtctgtagtcctagccactcgggaggctgaggcaggagaatcacttgaaccctggaggtggaggttgcagtgagctgagatcacaccactgcactccggcctggacgacagagtgagactccatctcaaaaaaaacaaacctgttttagaaattatttctttcaaatcatggtatgagcatttgccattttccctcctttttatgaaagcacaaattttcatcattaataaataagcccacattcataatggtaagaatataatagctattaatactataaatatatgccagtgccaattctagacacattatacatattaacttgtgtgtgtgtgtaatttttttagtcagtgctatcagtcactgttaaactctacctgctttacttcatttagtcacaagcactgttcccttatcatccctgtttcataggcgactgacccatttgcacagctagtagtggcagtgctggcgcagttttcactgcatactctattagctgacatattaatagtagccacagtttgcgcaaaattgctgttgtactcctcctaagtctcccagcagtttgccgtttcgatactgagactgcagaggtttgtgaggtgcccaagacctgggtactagctgaggatgcatgcgctccggttttgtcttcctactgagtactctgactaaaatttctttttgtcaaagcctacttagttgtgatttcatgcagggagttttccaggagcacagcccaggccagccttgatgtgaggaaaagttctttcccaatttggacgtgtagctgcttccgggatctgttagtaaaaacagaactgcccttctccgccagaagtgttgccagatgagatattaagaaacatgaaggataaagtgagatggtccaacatttctctaaccagagttccagacgaaaataacagaaggggagacagggaatattcaaagatacaacagccaagaattttctagaactaatggaaaaattgtagacaaaagacgtgtatatgagtttaaggatagcaatagctgacaaacagtacaaacgttacttaaactaagtagagatctaggttcagctttttaaaagaaaaaatgtaaaatatgaggtagacatattttagactgtagagtaaatggatgtaccagggccaaaaggagcatgaattgccttaagggagaggaagggggaagctaaggaaacaattcctgctgaagcaattgggttttgaaaaaggtgatcccagtagacaagggtcagggagaaagaatgctacctgaagagggaataggacatgaaaagcccatgttgccaaataaaccctgagatctttacattttgaagaatgacattttacccttgcatgaaatgaaaaaggtatacataaaaatgtatataagaagttctataaatgatgaaatctggttttcacagggataatgccctggtaatttctattatgtattaaaaaaagccttgtgggatgggggtgggggagggtccctaaaacacaaactttagcagttccacctaactatttggtctcatttaatgataaaatattttcgtcatatgacaggcttattatattttttctagaatgtcttttttatctattttgttaagaacatgaacttactgctgtaactcataaatgaaaccttccttttcagaatagcattgttctctcttatcatcttacaattgaatacaaaccgaaaaggtgttgaaaaattaatctcttctttcagcatcttctcatttatcaatcacatgattcacctgtgtcatttgtctaaatattggagtcatggtttgtgcttttagcataaatatttagtgccaactccgtctctttcctatgttctgggccctagtttatctttctgagagattgctaatgtaaaatgtttaagtaaatactgaatggtcctggaatagggcctgatacttgcattactattagttagtagaatatttgtattttgattgtgttctctagccaaatttgtcacatgcgattcttcccagttctttgcttttactggctcttataaacacactttgacatatatttaatatcttgaagaataaagatatcctgtgattttacagcctgtcagtactattttggggtataacaggtgggtaaccgaaggggaaaaggcatgtgtgtgcttagggcagggagaggatccttttatggaattgaacgtgctaaaacattggtgaagttgttctttctgtgcacacttaagacagcagttaggattagatctttcatgaacttgtatttctaagaccatccaaatactgggaataggtctgtcactttcattttgcaaaagttggcatcttagttactgtaattcataataacaacgttccctggaagtatagaacatgttaaatatacaatatatatttctttattttgcccttattccacagcttagttttttagtgactgggtatattcatgtgtgtgtatagtgtgagtgcatgtgtgtgcaattgagtgaagtgggaaagtagtgcttctatagtttgatcagggctttacacaaaaaagccacagagattttcccttaaatttgggaaaagacaaagatacccccatgattgccactgtttaatacagtactgaaggaccttttcttaaaaaaaaaaaagtaataggattgggaaggaagaaataaaaactgcagatgatatggatatgattattaacctagaagaaccaacagaatcaacagactgaacactaaaatgaatacatgtaaatcaaggttgccagtgacaagataaacctacaaaaacagcacttctcaaaccagtaaaaatcaagtagaaaatacaaattcacaatagcagcaatatccacgaagactactatgaagaatacatgggaactctatagatctgaataaatgaagagacatatatcatgcctttaaacagagagatgttataaagatgtctaatttctcttgttttttgagaaacacaataaacttaccctagaatttatatggaaaagttggagaagtaaaagtccataaatagctaagttatctttaaagaagattgagggacctgctctatcaaatattaaagtgtagtacaaggctagtgctattaaaaaaaaaaacccaaaacttggcactggtataagaacagttaaatacactaatgcatggcatagagattttagagataaatagcgaatatacattcgctaggggaaagatggattgcttggtaaataatgttggggaaaatggctatttggaagaaaaaaacaaaacattcttacctaactgcatgcaggggttgatgctaggtggattaaagacataaatataaggaaggtagaactataaagttaataagagaaaatataggaaaataggaccaaagggtgggggaagaccttaggtcaaaacttcaaaagcatacgccataaggcaaaaaaaaaaaaaaaattgatcgcatcaaaataagagtctctctttagtgcaagacatcccagacgtggttcatatatgagaggatgagagatggttgcaatgtctgtaaccaacaagaatctcttgagtatacaaatcaacaagggaacagtaactcctgtttaaaaatagaaaagcaaaataggaaaagtctatgaataggctaacaaggatacaaagagatgtctgaaattattaggaaaacacaagttaacactgacatatcagtgtatttctgtcacactggcagcaaatagaaagttggaaaatgcagaatgttggtagggatatggggacccctgtgctttgctgtggagagtggataggtacaggtgttctgcagaatagtcataatactaagtcaaaagcagagtacacataccctttgtcttagcagttctgtcctggtatatgtcctaaggaaatcctcaccaaggtccaaaggggagatgtattcatagaagtgttatttgtagtaatgagaagctggtagacaacctaagtgtccatctctgggagagtggagagggaaaatcaggtaggtatacacatggagtattatacagcaattagcagcaactgattagaagtacacatagggggctgggtgtggtggctcacacctgtaatcccagcactttgggaggctgcggtgggcagatcacttgaggccagcagtttgagaccagcctggccaacatggtgaaaccccaggagtttgagaccagcctggccaacatggtgaaaccccgtctctactaaaactacagaaattagccgggcctggaggctgaggcacgagaatcacttgaaagcgggaggtggaggctgcggtgagattgtgccactgtgctccaacctgggtgacaaagcaagactgtctcaaaaacaaaaaacaaacaaaaatctagcaacctggatgctaagtgaaaaaataaaaacagaatgagatataaattcaaaatatacaaataatacagatcttgtaaaaaacaaatagtattaattagataaacacgaaagaatgattgccttatgagctgggaggaaaatgggagaaaggcaagtgtatagaaaaatgaaagaattttaaagcagaaatgaagaatttttgaaaagtttggtgatctttaaacttgatttgggttgaatgagagataaagaaaattaataggaagaacatcctgcatacaataaccgttttgttttcccaatttctatagggttgaagctttgagagaagcagcaactgctgttgagcaagagaaagaaatccttctggaaatgatccacagtatccaaaatagccaggacatgaggcagatcagtgacggtgagagccatctccacagaaggggctcatcttttacactcctttaaagagtttatgataagtgtgggtcaatttttgcttgacttttggtatgcgtacaccaggccacagcatttaatgtgagccacagagagcagctgcagctgtcagttcattacagcagccacttactcagagatttcttccagcatgctctctaccccaagcccctggctaggagagataggaaaaagcctgcaagctcagaaaagctggccccaagcagtaaggccatgtgttttatcccaggttcacagtcctaacttcagttcctcacaagttactggactgcaagagattaaaaaagcagaggaagagggtgagagagtggaagcagagaagtagagaccaaaaaaaaaaaaaaaaaaaagatgaattgaggtacaacataaagagaagggacaaaatgcagagaaaatgaggaaacttgtaggaccaataaaaggcatgaatgtaaaaatgtgctgtcattttcttttttctttttttgagatggagttttactcgtcacccaggctggagtgcaatggcgcgatcttggctcactgcaacctctgcctcctgggttgaagcgattctcctgcctcagcctcccgagtagctgggattacaggcacgtgccaccacgcctggctaatttttatatttttagtaaagacagggtttcaccatgttggccaagctggtctcaaactcctgacctcaggtgatccgcctgcctcagcctcccaaagtgctgggattacaggcatgtgacatctgcctaacctgtgctgtcattttcatgtgaagaacatgaaataggaataggtcacttctgattttcttttattggcactggacttcctacttgggctcctttggtgccacacaggccacatggtactgggccaagtggctggtgaggtaagtaagcaacctaaatccagatcaaaactgttacacatctataggtaggccatgatctagtctctacgctatcctgcccaaagatcaatgaattaggaagttacagaagcaggagcttgctgactttctcatataaataatgaaatgttgatagagctcctcgtgctggccaagactttagaccactgtcctgcttctatctggagaaggatgaagtcagtgcctagtattgacgacagaagacagcttatcttctatcgtggctacattttctcaaccaaaatttggggcattgtattctgataaatgcacatgtcgttctggagagatctgggacatctgatctctggagctctacccagcataaaccctatatgtgcttactgctcacagtgttaagacttgatctccatcccagttacaaatgcatacctacccaaacttttgcagacatgccaatttgagaagtcatctggtatcccatatatgcagattgtcaggaagtggtattctacaacctctttctgtaatctaatacatttcatcagttaatcttacatgctatagtttcagcttttatctctaaaaaaatttcatggcagaggtaaagaaaataataaatttagtcacaaacaaatgccttaatgtttttgacacagataagtttacatctcatattgatttttaggagaaagagaagaattaaatctgactgcaaaccgtttgatgggaagaactctcaccgttgaagtgtcagtagaaacaattagaaacccccagcagcaagaatccctaaagcatgccacaaggattattgatgaggtggtcaataagtttctggatgatttgggaaatgccaagagtcatttaatgtcgctctacagtgcatgttcatctgaggtgccacatgggccagttgatcagaagtttcaatccatagtaattggctgtgctcttgaagatcagaagaaaattaagagaagattagagactctgcttagaaatattgaaaactctgacaaggccatcaagctattagagcattctaaaggagctggttccaaaactctgcaacaaaatgctgaaagcagattcaattagtcttcaaacctaagagcatttacacaatacacaaggtgtaaaaatgataaaatactattttaattgataactagttctttgttaggtataaccacttagttgacactgatagttgtttcagatgaggaaaatattccatcaagtatcttcagttttgtgaataacaaaactagcaatattttaattatctatctagagattttttagattgaattcttgtcttgtactaggatctagcatatttcactattctgtggatgaatacatagtttgtggggaaaacaaacgttcagctaggggcaaaaagcatgactgctttttcctgtctggcatggaatcacgcagtcaccttgggcatttagtttactagaaattctttaccttaagcagcacacacatttactacacacacagtgttaacaaagcactgtgcttagagggtaaaaaggaatcacaaaacaagaatctttccaaagttgtctcattcagcaatgttaaggcatctgtatcaaattattttggatgtaaagattcctgtgtctcataatatgaatgtattttttgatatacaagaaactgacataaaatgtgagaaaaccacctataatttaccactgtgaacaattatatatctatctgcttcatcttttctcaaatgcatcaattctctaaaattcctatattgtaacttgcctttttttaaaaaagttagatgctgatataaagtctgcttaattgtcaacttaatgagctctattttgtgtagttatatctttatccattcctcttttatggacatttaggttgtttccaacttgttgctattactgcaacatatttttgtacacaggactttttccttctttcatttttgtttttctctgtataaaggcccagcagtgaattatattgggtcaaaggatatagacgttttcatggcctcacacatattaaactttttttgtataaaggttacagcaatttatacttttttcagtaattaaaatatagctatttcactgaaatatttccagcactgagcattaatacctagtttgcattttgtttactaaaaaggttgaccagtgtgttgattcttcttttatctgataaagtgtgaagcaactagagaacacttatttgttcaaagtaactagtcctattgatatacaaaaaccacaacaacttccctggatactattttgaaatgaacacatcaatttttatttgaatgtaggtattcttcacactgaaaaaccaaatcaagatccaaactgactttatgtatgtatatatctctcaatgcaagcaatatcaaacttcattttctctacaaaaatgccaagttagtctctttataaaaagcagttacaatctgaagacattcatgttacttcctttgccagctccaactctgccttatttaaatctttgcatttcatgggaaacattaattctatctatggcagagccacttggtttgttagcagactgatttgctgtcatcagactgtgagatgattttttgtgtgcatcatttttttcttgaccagctttttgaaaattaagaaatggatagtcatgttttcttcaggttctcaagtattgtcagcatccgtaaatcccttccactctgggaaatactactgctccctgcttcccatggcttccacatcagtccaggactttttctacacaaattattctggctctgcctccttgaccttggtattcttagcattatttttcccatttttttgcaatggagtttttaatggaggtcattgatttctgatcacagacttgaagagctatgatccacatttccaagctgcttggggtccctggtttacagtgtctccagcattctgtacctagagccacatctaaagggcagggaatctccagtgtggttttttgtttttttgttttttgttttggagtcttgctctgtcacccaggctgtctgacaagtagaagacatatccactgtagcaaggaacactatggagtatatgagttagggaaaagagactgtgaagggaagagaacaaacattttgtagacgtttggtgttgaatatatgctatggaggcagtttctatagtttcatttacttcatgaggtttcattttttcttttctgagatggagtcttgctctgttgcccaggctggagtgcagtggtgtgatctcagctcactgcaacctccacctcccgggttcaagcgattctcctgcctcagcctccctagtagttgggactacaggcgcccaccaccacgcccggctaaatttttgtatttttagtagacatggggtttcaccatattggccaggctggtctcaaactcctgaccttgtgatctgcctgccttggcctcccaaagtacagggattacaggcatgagccaccacgcttggccaatgggttggttcttaacatgtatttttatttataagaatgggagtataatttattttcaaatgatgatgaatctcctgagtcacatttttaccctcatttaaactattgtcttttatatagactataagtggatatagagtatgttttgctgtatctcaattctctaccattcctagcatataatacataattttagggtagccctcctgccattccttgttagcactactttcaataaaatgagagtattaaatattggcagagtatctgaaatatgaaataattttaggttgctttgatctttaaagaagttgcattatatattttactatttagatccacactgttgatacaatcatacatatcacacaaaattttagctttgaaatgcatttattttctgattattggaattcatccttcatgaaatttttagagtagtgttttaaattaagctccagagtgtaactgcaaccaaatagcaatacatacaagtggttttccattcaaatttacaaaagcattatttattagtaataaaaatat

SEQ ID NO: 17310 - DNA, 25976 bp, Human
gcaatatggcaagagctcatctctacaacaaaatacaaaaattagatggatgtagtggtgcatgcctttagtcccagttacttgggagcctgaggtgggaggatcacctgagctcagggaggtcgaggctgcagtgagcagtgattgcaccactgtactccagcctgggcaccagagtgagactctatctcaaaaaaaacaaaacaaaaaacgcctgtatctcaacttttaatatctagggaattagaactaggctgattacatttaagtaactaagatgtttcatatataataatcttatgtcttagaaaatattactatgatgtttttataatattttctctgagttatttttgagtcacagtgtcagtgtaaggtttactcttctggtgtaatgctttctgaagcagtttcttgctttcgttttagggtacatagcattgtgaaccctttatataatgaactggaaattggaatttgtatttgtatatatcgatggtaaggtttaatggaacaattttccctaactgcatttattttgtatccaggaagcgtcaggacaatcatgcccataagaactctaaactgttcaggtaatcatttcgtttttaaactgtcctagaaatatgctttgttttctatattaagaagactttataattgttttgtttagatgcacccttttatcttttccaaagttctgtgacatctaattcttatagccttgatgtcattttattaatcactgattttaagctgtaaaatatagttatactttatagtaatatataatactttatgaattatgtattttataaaacatgtatcatatatgtatgcttatatgtatactatgttatatttatattttatattaatatgtaactatatatatggtttttttttgagatggagtctcgctctgtcgccaggctgcagtgcagtgacatgatgtcagctcactgcaacctctgcctcccgggttcaagcaattcccctcccttagcctcccgagtagctgggactacaggtgcatgccaccacacccagctaatttttgtatttttagtagagacggggtttcaccattttggccaggatggtttcagtctcttgacctcgtgatccacctgcctcagcctccccaaatgctgggtttacaggcgtgagccaccatgcctggccacatattgtttgtattaagctataaaacatatctctatatagagatatgtaatacactttggcatacaagtcataaaacttggttaggaatagctctatttttttttaatggggctttctaaaaccttatacttttgtagataatatccatcaaggattttccttcaaatggttttctaaagttaaaaagtatttaaaagagtgaccaaaattcaaacatggaagagacttatgttcatgacttaatgctgagtttgaaattaatatattttaattgtggaattaatgtaatctcaataaaaataattccttggagtaaaaaacatttcaaatttatctaatttctggttggttagttaggtttttttttttttggtttcttatttgaaactgttatgacaatctctttgtattttctttttcttcagatcattttatcttagtgaaactggcaattgaactttgctctagttgatgggcaaaatttctcctagactattcatcatcccaatttcatcctagttgaaaattttcaaatgccataagaaatctttatagatttgcacttagcttttggatggacgtttctacaatggagagaactgtgttatagccctggtccaaggacattactagctaatgcccatcgactgtggtgtgcgtgtggaaggttccaaagagaaggagcaatcagcaagtttgcagacaccctggaacatggaagcaaccaagctttaagaagcacagctttggagacactccatgagtctgcactgctttcaggggaactagcacttaagaccttgtgtaacaaaatggacactggggacacagctctaggacaaaaagctacctcaaggtctggagaaactgataaagcatcaggtagatggagacaggaacaatcagctgttattaagatgagcacttttggcagtcatgaaggacagcggcaaccacaaatagagcctgagcaaatcggaaacacagcatcagcacaactgtttggttctgggaaactggcctcccctagtgaagtggtgcagcaagtcgcagagaagcaatatccaccgcatcgtccgagtccttactcatgccaacactcactctctttccctcagcactcattgccacagggggtcatgcacagcaccaagccacatcagagcctcgaaggtcctccgtggcttttccctggccctttgccatccgttgcctctgaggacttatttccttttcctatacatggccacagtggtggttatcctagaaaaaagatttcaagtctgaaccctgcttatagccaatactcccagaaaagtattgaacaggcagaagaggctcacaagaaagagcacaaacccaaaaagcctggcaagtacatttgcccttactgcagcagagcgtgtgccaaacctagtgtactgaaaaaacacatcaggtcccatactggggagcggccatatccatgtataccttgtggtttctctttcaagacaaagagcaatttgtacaagcacaggaagtcacatgcccatgcaattaaggcaggattagtacctttcacagagtcagctgtatctaaattggacctagaggctggttttattgatgtagaagcagaaatacattcagatggtgaacagagtacagacacagatgaggagagttctttatttgccgaggcttctgacaaaatgagtcctggtccacccatcccactggacattgccagcagaggcggctatcatgggtcattggaagaatcattgggaggtccaatgaaggtgccgattttgattatccctaaaagtgggattcctctccctaatgaaagctctcagtatattggccctgatatgctaccaaatccatctttaaatactaaggctgatgattcgcacacagtcaaacagaaacttgcactaagactgtcagagaaaaaaggacaagattctgagccatcgctcaaccttctgagcccgcacagtaaaggaagcactgattctggttacttttctcgctcagaaagtgctgagcagcaaataagccctcccaacacaaatgcaaagtcttatgaagaaatcatctttggaaaatactgtcggcttagtccgagaaatgcactcagtgttacaaccacaagtcaggagcgtgccgcaatgggtaggaagggcataatggaaccattacctcacgttaacaccaggttagatgtcaagatgtttgaagatcctgtttcacagctgatcccaagcaagggagatgtcgaccccagtcaaacgagcatgctgaaatccactaagttcaacagtgagtccagacaaccccagattattccatcatctatcaggaacgaaggaaaactttatccagcaaacttccaaggcagcaacccggttctcttagaagctcctgtagactcttcaccccttattagaagcaactcagtgccaacttcttcagcaactaatctaactattcctccttctttgagaggaagtcactcatttgatgaaaggatgactggttccgacgatgtattctatccagggaccgtgggcataccccctcagcgcatgctaagaagacaagcggcatttgagctgccttcggtacaggagggccacgtggaagtcgagcaccatggcaggatgttgaagggtatcagcagttcatccctgaaggaaaagaaattgtctcctggggacagggttgggtatgactatgatgtctgtcggaaaccctataagaagtgggaggactctgaaacaccaaagcaaaactacagggacatttcctgcttgagttctttaaagcatggtggagaatatttcatggatcccgtggtgccattgcagggagtaccaagcatgtttggaactacctgtgaaaacaggaaacgccggaaagagaagagcgtaggggatgaagaggacacgcccatgatctgcagcagcattgtaagcactcctgtgggcatcatggcttccgattatgaccccaaactgcagatgcaggaaggagtcaggagtggatttgccatggctggacacgaaaacctttctcatggtcacacggaacgctttgacccatgtcggccccaactgcagcctggaagtccatctcttgtgtcagaggagtcaccttcagccattgattcagacaagatgtcagacctagggggcaggaaacctcctggaaatgtgatttctgtgattcagcacaccaactcactgagccgacccaattcatttgaaaggtctgagtcagccgaacttgtggcttgcacacaggataaagccccttccccttcagagacttgtgacagtgagatttcagaagccccagtgagtcctgagtgggctccacctggggatggtgcagaaagtggggggaaaccctctccatctcagcaggtgcagcagcagtcctatcacacacagcccaggctagttcggcaacacaacatccaggttcctgagattcgagtgaccgaggagcctgataaacctgagaaggagaaggaagcccagagcaaagagccagagaagcctgtggaagaatttcagtggccccagagaagtgagaccctttcccagctccccgcggagaagttgccacccaaaaagaagcgtctgcgacttgcagatatggagcactcctcaggggagtccagctttgaatccacaggcacaggcctctcccgcagccccagccaagaaagcaacttgtcccacagctccagtttctccatgtcttttgaaagagaagaaaccagtaagctttctgcacttcctaagcaggatgagtttgggaagcattcagagtttctgactgtccctgctggttcatactcattgtctgtcccaggccatcaccaccagaaagagatgcgacgctgctcatcagagcagatgccttgtcctcacccagcggaagtcccagaagttcggagcaaatcatttgattatgggaatctgtcccatgctcctgtgtcgggagcagcagcctccacggtatcaccgtccagggagaggaagaaatgctttctggtgcggcaagcttccttcagtggctccccagaaatctcccagggcgaggttggcatggatcagagcgtgaagcaagagcagctggagcacctgcatgctggcctccggtccgggtggcaccatggcccgcctgctgtgctgcctcctcttcagcaagaggacccagggaagcaggtggcgggtccttgtcccccgctgagctcggggccactgcacctggcccagccacagatcatgcacatggacagtcaggaatctttgagaaatcccttgatccaaccaacatcctatatgacaagcaagcacttacctgaacagccacacttatttccacatcaagagacaattccattttctccaatccagaatgccttgtttcagtttcagtatcctacagtttgtatggttcatttaccagctcagcagcctccctggtggcaggcacatttcccacatccctttgctcagcaccctcagaagagctatggcaagccctcttttcagacagaaatccattcgagctatcccttagagcatgtggcagagcacactggaaagaaacctgctgagtatgcacacacgaaagagcagacctacccatgttattcaggagcatcagggctacacccaaagaaccttcttccaaagtttccatcagaccagagcagtaagtcaactgaaacgccctctgagcaggttcttcaagaagattttgcctcggcaaatgctgggtctttgcagtccctcccaggaacagtggttcctgttcggatccagacgcacgtaccatcctatggaagtgtcatgtacacaagcatttctcagatacttgggcagaatagccctgccattgtcatatgcaaagtcgatgagaatatgacccaaaggacactggtcaccaacgcagccatgcaagggataggattcaacattgcccaggtgctggggcagcatgcgggcttggagaagtaccccatttggaaagcacctcagactttgcccctcggcttagaatcctccatccccttgtgtttaccttccacctctgacagcgtggccaccctgggaggtagcaagcgaatgctttctccagccagtagcttggagctcttcatggaaaccaagcagcagaaaagggtcaaagaagaaaagatgtacggacagattgtggaggagcttagtgctgtggagctgaccaactcagacatcaaaaaggacctctcccgcccccagaaaccccagctggttcgacaaggatgtgcttctgagccaaaagatggcttgcagtcagggtcatcttccttctcctcgctgtcgccctcctcatctcaagactatccttctgttagcccgtcttccagggagccattcccgcccagcaaggagatgctttccggttcccgggcaccacttccggggcagaagtccagtgggccttctgaaagcaaagaatcttcagatgaattagatatcgatgagacggcatcggacatgagcatgagcccacagagttcttcattaccagcaggagatggtcagctggaagaggaagggaagggccacaagcggcctgttggcatgctggtccgcatggcctctgcccccagcgggaacgtggcagactcaactcttcttctcacggacatggcagatttccagcagattcttcagttccccagtctgcggacaacaactactgtgagttggtgcttcttgaattatacaaaacccaattatgtgcaacaggccaccttcaaatcctcggtttatgcttcatggtgcattagttcctgtaatccaaacccatcaggattgaacaccaagaccacgctggctcttctgaggtccaagcaaaaaatcactgcagaaatttatactctggctgctatgcataggcctggaaccggcaagcttacatcatcaagtgcttggaagcagtttactcaggtaacaaatactgttttaggaagaactttgtattgtggatttgattgctgagcagactacatagtgaaggatataaggcctaaaaaaaaaatacaagtaaaatgaaggtcagtgtgggggcgttttcagaaagtctggccttactcaggagtggaagaagccactgactgcacttggttctgaggtctcaggcatggtccattttcagaagaaaaagcctacatttatgcttttaaaatttaaaaatttgggtgccatgaaatcctaccactgggattaattcccatgggttattttccttctgacctttgtgagtgacctagcaggtctaattttctctggatgtgaggaattcagggaattgtgaagtgggccatagagcagggaatggaggctgaaaggaaagacgaagaaggaggaccgagctttgcaaatgctgcagggcttactctcattgacgagacatctgtctccttcaaaacttatttttccaagttgctggctggtttattcctacaagaaccatcaatgccttccatgtaaaattataaaaatattaaggggaattttgaaatttctgctaaattaataaggaggcaaatagaggatttaaaaatatgttttcacttttatcagttaccattttcccttcaataatttttgagactacttccttaattaatatagattgttttcattgctacttcaaaacatagaatgtgtcttttaagtattagcattgcacagagtgctgagtgtatatgtgtatctatatatttttatatataatatatgtacttattatatatagctgtaacagaatgttgaatttattcagtggaaactgtcattcttatctgattttatccctagtggtccttattttatataactagttcctggccttttagtacagaatttaggctcattttcagagatgatggaagagtgggacataggggctcctgtgtcttggagaaagcatgtgaaatgattctctcttcttgtcttacagatgaaacctgatgcgtcctttttatttggcagcaaactagaaaggaaactagtgggaaatatcttaaaggaaagagggaaaggagatattcatggagataaagatattggatccaaacaaactgagccaatccgaattaaaatatttgaaggagggtaaggaaacaaagtgcaaatgtaaaatgtgcagttataggtcagagtaaatggtccagaatgtctgcatggaaaaggtactgtctaatctggttgaaagctgaaagtaaattccttttctattcacagttctgaactctggctggtaatagatcataagttcatgcccttgcctttgggatttgctttgcaagaaaatgtccctaatggatatcattcaagcctcttccttaaattttcacccctctaatttattatgaaatctactaaattggtggacacttgatgtcatctaagtttgttcattctttgatcattttataggtatttgttttattgacggacatatttttattgtatgcttacaaaaatcagatcatgcacaatcatgtataatcttcagaactagttaatttgtttgtttgtttttcttattatctaaactagaggctttaatgggatttcaccagttccatcaatatccttttctgtcccaggatccaagtcagggtaccacattgcactcagttgtcttgccttttcagtcttctctggtgtatgacactttctctgtatttaggaatttcttttcaaatcttgagtcctgagtcatagaaactcaagtaataaggttcaaagactttgttatttgtatagttaagaaaaattacacatatgtaatgtcttgttttagattttgatagaaatgtatctttcatccagtcacatagaaggaaaagcctacacttatgcttctaaaatttaaaaattttgaagcgtgctaaccacattttggagattatgatgtaattagccttatctctacaacaaatctattatttacatatcttcatgggcatgactttattccaattatatttggaggaaataatgttacttgtttgactataaaatgtggaatgttcagtgagatgaaatatccatttctcacctagcattaccggtttggagatggattattctatttggttgtcccttaggttttgccctctttggatatctagcattttcaccactaaaaccacaattgtatgtagtcatgaagcttgtcttgatatttttttgacatcccccatcttttaacacaaacgagagaaatatagattttatctctcctcagagactgagaggtccctgtgactgaatcaaccctctcacattcagcagccttcatagcagtgtacttgcaccaatagattagcgagaactccacaattactgtatgctttggggagcccatctccactaacgaaggacacaagtgaaaaagcgtatgtgaacattttattgctgtgttttggtgatccaaaaggattgtgcccatatttcatttcctcctcctttaattgccccgttttatgggctgtgtcccattacttcttaatctgtggcccaatttctgcccagtggtgaccaagtgttttttccaaaccttgtgttacctcctcttattttggcaattgcaaagtgatagctaaaaaaataaaaagtattactgaccaaaattgtaagtgtatattgtctaactgataggtttaataataaattcaataatttagttaaacacagctttgaatgtttttcaaaatccatcaattaccttatcaagtagattcatgggcctgtagaactgttgtatgatatattatttataccagtttctctaatacatcattatattttatacagaattttactgtattttcattctggaagcaagttaatcagctaagacattgaaaataaaattatactgcttgatgataaaatgcatttcccatcactatgatggcaggctatagtaagcttgaagtatccttccttgaagaaaattagctttgtacaaaagtatttgttttagtctatatgtcttaagcaatttcatctagttaggggcagagaatagtgaaatttaaaggtgaaagacatttgcatctttagggttttttctactttattgcaaaagacaaagataaaattcaaaataattttgaagaacaagtggaagtcaaaattcctggtaaaaggggggaaatttaaaggaacggaagacatgcaaaattgattattcatagttttgaatagtttctacttaactctcatctggattggtactgaccaaaaagtagataacgttaagattagatgtgaatccgtaacagagttgctgtttaaatatgtggatggatttcctttcttaaaattatttcaatagattggatgactgaagttaaacttgcctttattcctgtttgtggattagctaggataaaatgaggaagtttgcaatgctcttagaatgtaaaaaaactgtaaatttagtgcctttaactaaatccacagtggattagggcattttgcatgtcagtttacctttggaagttatgaaaagaactccccaaatggagcgtctttccaaaaataacattagacccaaaattctagcctagctttgacttaagagataatgacagtcattgaattagtccgtataatactactatatcttatgacaaattatgttttattgtattctaaaatggaatggttgagcattgggtagatttcttcccttgattatcaaagaaaatacctaagactgtttttctagccgatttgattaagcaagatgacctcagatatcctttcaaacatctctatgaaacccttctggaaacaaatgcaaatttgattaaaaatagaatctctagttttcattatgtaactaccttgaagaagctagttgaaatttagactccacattattacagattcatggtctttgggaagagcagatcaaatctgtagacaacagttggtgagctgagctcaccctgtgtaaactagaaatttctgaggcactctcgtgccaggattgtaaaaatagagtaggaacttgcagtgaagaattctattatcagttatacttaatttagcaaatttagagggttgtatgtttgtacatgtacatcttagatgatgtaatgttaacaaaagatacatgatgaacatgttggtatgctttttgtatgtcccttgattggaggccatactagaatccagtccaaaggtctgcagctctttgaggtttacataagtcattttgaacatctacttcccaactctataaattcacatgtaatagtgaagccaattccattttgaattccatggagcattacattttgtttacagtgccaaatctattatctagttctttcagccatttactgcataaatttcacaggcttcgtagaagtaaagttgaataattgtctgcaaaagaccctcataaaactttgccgtgcaaataattagcttttgctttaatatatagcatgctaagaatatttgaaaacacactggattccctctttttaaaacaggtacaaatcgaatgaagattatgtatatgtcagaggacgtggccggggaaagtacatttgtgaagaatgtgggattcgctgtaagaagccaagcatgctcaaaaaacacatccgtacccatactgatgttcggccttatgtatgcaagttatgtaactttgccttcaaaacgaaaggtacaagtctgatttttttgagaggaaaaatacttctctatggctacttagatttctgagtgctattttataactaaccttcatcaacaataaagatagtttgtttgtgaaaatatgattccacgaaatatattttctccctcaagtaagtgatcaaaggatgtatgtgagactgtgaggctccttttatgacttaattaagagcagtagacataggtccaggccagttgtctccaaaggaagtggctacaaattgtctggatagctattacttcatgttggaaatgttatgtggtctagataatatttacaccagtattgaaatcctgcacatgcagtggtattagagaagcaaggcagcagctgggaagaaaacatgtgctcttggtcagtttcaagattataaataatgtagagacccacacactcccaggtgggtgccttcatccacagttgcattaattatgcatagaaatttgatagcttgtgttccctgtttttatcagcacagagacaatttctgattctcagtacataactgttagtcttataaaactaggacttgccttaaaatttttttttaaaatctgtttttaacaggtagatttatgtaaaaatattttactcaaggaagttgcttcggttatatttttattttttataatattatgaaaatgttcataagtctggtagtctcagaatacaaacagtagtgaattagaggttgttcgacttttgcagaagtgtgttttaccttaggtttagtggatactataggcaccccctcaacactttaaattttcatattgattaatctgctcattcaagaaaaagaaataccaagtaaaattatctttggtagagaaatgtatacctatattcttttatagctgaaaatcctaaattgctagaagtgtaaatgggtagcctctcaacatatctgtttctcttttattaaaaagatctatgtaatagaattgcctcatttgaagctgaaaaaagtatgtgttcatttgtgtctcaaaaaataatcatatggccttttaaataccactcacctctgcacaatcaagccttttatacagaactttactaagagattccctaggagataagaaaataaaaactttggtttcagggaatattgcaattcaatagtcattacgaatgatacatatcttcactgggcatatgagtttgctgcaggtatagttgtgtgaaaaactggatgaagaaatgacacatctctagatatttttaaaaatcaaattaagtctgcctctgaatcatcatctcctgaaggaaataatttattcttggtcattattggagtttccttgtcaccctttgggaatgtgcaaatgtctcagaatcttaaaatgagcaaaacatcctgggaaaccctgccagttttcacctccgactgaaatgcctgttgtccaaacccacattgtcgtctgagcacagatggaacgcccttgcatgaccaatcccttctccttgtctgtgccacttcttcaggggcctcccccgccactctccttccctctccttgtccttatacattacttctgcagctcatgactttaacaaactaaagccatggtagaattgtttcagatccagatttctagctacagacctattctgaagatgggagtctaaagcctgactatccttggaatggagagaaaaatgtaggagaaagaaacacatactaaaatctaaataaactatcccgatatgcttagcatctatacctatacacatccatagcgtacttgcactctggcacaagtgatgatttttattaatttgtagatacatttcattaattttctagatttaagcattcttgatatgtctataacatttttgggctctttaaaaaatggtagatataagttttgataaataggaggagtgggggcctggaaatatttctgtttggaatcattcaaaacagcatgtaaaatttataagtatataagcaataagtaaataataaagcaatatgagtaaaataataaacaacagtgtcccagttttaactgtggctcatatattacatgaacagcaagctgaacacccctaccagaggaataaactgtgctagcaggctgagtttccacggagatttcacagagccttctcttaaagtatttgttggtacattgctaaagcgttgtcaagggcacagataacattatggctattttcactgaagtgatgtaaaggcgccttacaactgaattagttcctgaatctcttttgataagttatatggcatataatttatatgtatgtgtgtgtgtgtgtgtgtgtgtgtgtgtgtgtgtgcattcttctgtagatcctgggtcaacgaggattggaacaatgttttcaaaatttctcacatttcataaagcagttatacaaattatatatataatttatatccacacatgcatatacacatataattgtatatgccattatcattataacatattcagcatgaaacctttcttttttgttagtgtgataggagcctgaagataagtaaagagggaatgttgctgctccagaattttaggaattgctgtcataacttttgctaacatatgccagacagatagatgctaaatactgggaataatgctccctatgagtagttagctaattatttgtatggatctttcagagcactgacaaggttggccctcacattagtttgtatgtatttttcttctgaatggtgaagatccttggaggttactctgtacctgatcagtcacagaaggtcaggggcccagtgggtgtgttgagaatatttcattctgaagtatctctgaggtgtgtggccagattgcgtttcctgtttatgtggagtcccaggaggctggtgtatttgggtagatatgaggtcccttctcaggcagaaaagcctgggatttctagtcttgctttgagcctactcttgaaaagatgtgagcctggacttccacatatcttctagaataaagaatatctgagattgggccaaagctctcagggattgatatcttcaaagaccagattattcttcttaaggttgaaacaaggggtagtgggtagaaacaaatctgtgttacatgatgaatttaataaaattagttcatttcacattgaatttggagcagctatcagcagttattaatttgataaccaattaatttctctcttttttttgctacattttcaaggaaacctaacgaagcatatgaaatctaaagcacacatgaaaaaatgcctggaattgggagtctcaatgacatcggtggatgatacagaaactgaggaagcaggtgtgtatgtcataaatgagttgacagacctcttcattatgcacagtggagctctgtggctgaggtagtaaaataagtttagatatttttaaaaagtgatcacttttcattttattaaatactaaatatagaaaataaaactgacacattgaattgcttgaaatctactgagaagaaatgcatttcagttttgactccgagggcaaaaaaggccttactttgaaaatacttatatttagagccttctatgaagggaatagaattgcacttgctttgtgatagcaaattagattttatgaggctttttgggaaatttgaaaagcattttaatgtattattattcaagttaagaagaaacccagtaggaaaacaaataaactagcaaacaaacatcattaaggttggccagacctcctgagatacatcacttagacatacgtttgtacctgagcttgcagagacaggttgttgcctttctttctcctctagcatcataattaacattatccatgctcatttgttgagggttttctgtgagtgggatgatgtctgagatataaagtcctactatggaatctttcttgtaagttggggatgaaaacaaatagatatacaagaagatagaatgaacgcagggtcacacaggtaagtgcctcattttataggagttctcagacataactatctgtgggcactagggattgggaaaagcgtttagaaagaaatgaggcttaaataagatcctaaccttgacatttggatcttgatctccattatctttgtttaattgtttcagaaaatttggaagatttgcacaaagcagcagagaagcatagcatgtccagcatttcaactgatcatcagttctccgatgctgaggaatcagatggtgaggatggagatgataatgatgatgatgatgaagatgaagatgactttgacgaccagggagatttaacaccaaaaacaagatcaagaagcaccagtcctcagcctcctagattctcctccttgcctgtgaatgttggcgccgtaccccacggggttccttcagatagttccctgggacattcttcgttgatcagctatttggttactttgccaagtattcgagttactcagcttatgacacccagtgattcatgtgaagatacccagatgacagaataccagaggctattccagagcaaaagtacggactcagaaccagacaaagacagattggacatacctagttgtatggatgaggagtgcatgctaccttcagagccaagctcctctcccagggacttctcaccctcaagccaccattcctctccaggatatgattcttcaccctgtcgagataattcaccaaagaggtatctgatacccaaaggagatttatctcccaggagacatttatcacctaggagagatctgtcacccatgagacatctttcaccaagaaaggaagctgcattgagaagagagatgtcccaaagagatgtttcaccaagaaggcatttgtctccaaggaggccagtgtctcctgggaaagatatcacagcaagaagagacctctctcctagaagagagagaagatacatgaccacaataagagcgccatctcccagaagggctttataccataacccaccattgtccatgggacagtatttgcaagcagagccaattgtattggggcctcctgtaagtataatccacttttctttctaatacataagtggaagcacattggtcctcctgataatgcactggtgtgaagtttagtagaacatgggtatctgtcatgggtggagtgaatctggctaatgaaaatagcggggagacatttttgtcatatgctattgtcagtaacatggctgtggcattacctaaagtgtagtattgcatcagagcagcagtgcattcccagtgggaacaggtgaggcctttctgaaggctttctaaacttaactaatgatagacgtaagctgaagcctttttgtaagtaaaaaagatgaacctttagaatgccatgactgcatggacatacactcacagggacatttaggcatcacttatataactcatcaccaggtaaggattctgattcagctgttaaccttgactttccaaaacttttatttttaaaatttttattttatttattttttttgagacagggtctcactctttcacccaggctggagtgcagtggcacgactttggcacactacaacctccgcctcccaggttgaagcgattctcccatctcagcctcccgagaagctgggactacaggcgtgtatcaccacacctggctaatttttgtatttattggtagaggcagggtttcaccatgttggccaggctggtctcgaactcctgaactcaagtgatctgcctgcctcggcctcccaaagtgctaggattacaggcatgagccactgcgcctggcctcaaaaactcctttttttaataaactctaccttgcccatcatgaggggacatgtgaaactggtcagggccagggagaggagagaatgacacactcggcatgtttataaatcaaagacatgagcctgtctgcttttcttgccattactactatcaagtgcacttgctcagtggaagcgtgggcccaaggagaacgggaaatcaggagagctaagtgagaatgtgcagagatttctatgatatgccttcattataagtgaagataacagtaaccaccatggattacatttaagcagtaggtttaatacaaattcatataaaagcacctgtcctgcctaattccacggctcagtagactgtgatgtctctttcagtttgtgtaggattttaaaaaatgaataaagcatgcacttagcatagacagaggcatgatacctttggaatctgtctgccttgaatgtgttttgatttcctggtttctactctttgttgtactcccttgctccggatctctgtgtcaagtgcatcagcaccatccttcacagccagaggagacactgccagctcccagctctgttttatcactgccctggcagccaattttctccctctcatcaccttccaccaccctgaatcctgagctcagcctgtcattttttcactttaggaaagctgctgcattcctgtccccatccccagcaccatcttttcacaagtctggtaccaacttcatcttgatgaagcaattcctgcagaaacatatatagcaattgggatgttgtttaccaagctaacaaattagcaagctaataagaaaaagagatacatttccacaggttttggtgccttagcaaaagtaggaaagagggatcttctgcagtttatgccattgcagcatgaatagagaactgtaaatctcctggatcatgggataccaagtctgggatgacacatgctttctctggtatacacgcagtgatgctggcagagtgtgttagatgagcctctccctgccatccctgcagcttgtgttctagcattggccaggtggattgagagtgtggcatttgtgaaacagtggtgcatgttcagtcaactgcaaacatgcgattcttcagtcagaaaaagtaagcctttatcgcaaacatgctgtggttgtaaaaatttatagcaacccacagtcaagttaggcaaaggaattggaagagtggactaagggagttcatctgatttttagatacatgcccagaaagttagagagagatgagttttagtagtcactgagtttgtacaagtttttttgatgtgtttttgttttgtttcatttttttttaaatatctgatcatgggtattattattattttgagatggagtctcgctctgtcgccaggctggagtgcagtggcacgaccttggcttactgcaacctccacctcctgggttcaagcaattctctgcttcagcctcccaagcagctgggcctataggcacgtgccactacacccagctaatttttgtatttttagtagaaacatggtttcaccatgttggccaggatggtctcgatttcttgacctcatgatccgcctgcctcggcctcccaaagtgctgggattacaggtgtgagccatcgcacctggctgatcatggttatatttcatagtgttattaaactttatcatttatgatgcttttggcctgttacccagtttaattctctttagaggatgtatagcctgctgcattgttcacatggtatgagggaacagatctgggaatcctccctgatgtagggacagttcgtcccaagcactgcccactttatgctttctcacaccacaggacactgactgtggtgtgaagggaccttacagcccagtcatattctgcctgcgtttggagtaatggtgatcatagccaacacaggtttggaagaaatgaatgaattcaaatgcagattgtgttaagtgtatgtgcatatatatgtgtgcacacatatacacatatgtacaaatgtacctacacagacatctatatatacatctatataccagttctattaccccactcatctcttcaacagtgtggcagtaaggagctctagacacaaatgatgagaaggaggtagaagtgctccagtgcccctgttagttttaattttaagacagatggatggacggatagatagatagatagatagatagatagatagatagatagatataggtatcttttatccatttattcagtatctactgaatttttgagggtctactacgcatggttcgaggttgaggatgaaataatattatggctgtggccttatctttttttttttgataaataaatttccttttccattttaaagcttttgtagataggtagcaggaagagaaacaaaggtgtgtccaggccctcagtatgtagtgtagatgaagattgtgtctagggaaacagtcaacattcattcctatcccttgttatctgtgtgatcttgggcgagtcacttaacctcttgaccacagttttttaatttgtttctggcagccagggaggtggcccatgcagatttttgttcctgaaagaacgtgccattcagctgtaaggaatgtagtgggcagacaagcctcctgctggcatgtcagcaccttcaggacaggactgttttgaagccaaagccatgctctccctgcagccccagccagtgactgagcacaaatgggtcacttctccttctctgctccctgctgcccccaaggaggctcttgctcttctacctccctctcatcatttgcatctagaggtccctactgccatactgttgaagagatgcgtagggtaatagatctggtacatggcgtatagatgtatatatagatatctgtgtatgtacatttgtacatatgtgtatatgtgtctatacatatatatgcacttaacataatctacatttgaattcactatttgtttttccacgacaaaattttcttactgagatttaagtaagatggaagtttgtccaccacatttataaggcccaaattacaaaacaataggattgcaaatggagtaaaaaccaaagtagagaaaacttattgggagtttctttggaggatgaagaaggggtgaatgagaggagagaggatgtgtagaaatgcctggtggggcttggagcagtggaagtggccacatggtagaaattctacttgtacacgtagctctgtggttaaaatcagtgaagggctgaatttgaaactttcattagtagcactaataagattttattggatttagaacatgctgagtattattgtagttttagaggacaattcatgactccatttgtcagcctggatttggggatctcaagtcagtttacgtaataggacatctctctctctctctgacttctgttccacttccttggtttccccacagatccacattctgactggttgtatgcaatggaggtcatggaatagcagccagaagtaaaacagaaaaataaccaagctcggttttattttaaactttgaatctgtgattgctgtgattaaaagaaaacgtacttgattatcttcaaagatcgttactgtaggcattacaggtcttcctcccaaactggtgtttgatgaaggagacgtgccttttccaaacctgattaaatacaagggggattttgtctatgtgcagaatttaaatgattctcataccgtaaaattcccacctttcccagcttatgaggtcgtggtaacgatagtgttaatgattgcaccgtttcactcacactttcaggagaatccatgtttccagcttgcatatgatatatcacagagaagggtaagggctaagcatcttagagagtagcagaaatcataatctagatagaactggatgaatctttaatgctacagagcataccttgagttttagaactgaaactcttgaaatagaacagtttctttggctctatcctggactactaccatactgtatgggtttatatctatctatctatctttggttctcaaaaaatagaaaaataaatgaagtcctttttagatgacaatccattaaagaatgaatcacattaattaaaatatgataatattaaaacctgataatctgacaatctaagttgtatttcactacagaaacagtatagaaaataaattctccattttcaggactaggactatgaaatctgaaattctggctgaacattttaagcatccttaattcattgattgccaagaagatattgaggtggaaatgataatatgaacaaaagaattaagatgcagtcatctttggttcacagtatagagttgaatataagttgttaactgtctgaaataatgttaactacttctatgatggatagtttcctttaaaaaattattattgatgtaagacttaaatggacttggtttgttattggatggagaagctggccttctgcattgagtatctcttagcaggaatgcattcctttagaccaatgtcttacacattggaggaaccagtttgtggatcctcaccaccgttttgtcatctgttctgtggaaaactttttaaaaaagccaattttcagacttgtcattccaattatatactcatcaacacttaagaaaaatattaaaaatctgtccagtatagcaacagatggtaatctttttatttccttttgaattaaaaaaaaatattattaatgtttattagtgttttttgctcagtaaacttttttttttttgccaattatccattaatttcttttcattatctcttgtgaaaaaaacagagctgaaatgtgtctctgtacccaatggaaaacaccctgactgctttatcaccttgctgtttaaaaacaaaagcaacttttcacaggccgacacctttattcaaggattataaaagacaacagagaaatcttttttgtcttgaaataggaaaacttgatcaaagaattaggtattgaagcctctctaggtagtgaatgtgtgaatgggtgagtgaatgaatccaacagcttgacctaagaatgaagcgtagcaggctctgaattttgtgctctctttgtttctctgcgcagaatttaagaagaggattacctcaggttccttacttcagtctctatggagaccaagaaggtgcttatgaacatccaggctccagccttttccctgagggtcctaatgactatgtcttcagtcatcttccactccactctcagcaacaagtgcgagcccctatccccatggtgcccgttggtgggatccagatggttcactccatgccgccagccctttccagtttacatccttcacccacattgcccctgccaatggagggctttgaggagaagaaaggcgcgtcaggggagtccttctccaaggacccctatgtgctttctaagcagcatgagaagcgaggtcctcacgctttgcagtcatctggtccgcctagcactccctcctctcctcggctgttgatgaaacagagcacttcggaagacagcctaaacgcaacagagcgggaacaggaggaaaatatacagacttgtacaaaagccattgcctctctccggattgccacggaagaggcagctctgctcgggccagatcagccagcgcgggtgcaggagccccaccagaaccccctgggaagtgcacatgttagcattagacactttagtagacctgagccaggtcagccctgtacctcagccacccaccctgacttgcatgatggtgaaaaggacaattttggtacatcacagactccattagctcactccacgttttacagcaagagttgtgtggatgacaagcagttggactttcacagcagcaaggaattatcttcaagcacagaggaaagcaaagatccttcatcagaaaagagtcagctacattgatctatgatgcatggagactttcatttccacattttcccatttttttgtttttgtttttctagaaatggaggtaatccagtttatagcatgcctgtcctaagttacagtagtttgctattatatatacttttgttatatcaaaagaattaggtaaattaacaagtcatcatgagcctgaccaaaacaaaatttgaaattaacctattgggtctggtacttttaaaattgtacagatgtttgtgccttttctttactttgcttatattcttataagcattttttagcagtaatttgtacatattttagaatttgtgtatctgctttgtaataaatgtaatttctttccttttttggacacttggatctaaatgatgtaaagcaaaacagcatcaatatatatgtgaggttgcactaaaacatatttttatatgattaaaactgaacagcttttatgtacagctctgattctgtaatactaatatttatttactttgtttcataaattgtacattttttcttaatgttgtggattgcttttctatgtgaagcatgggatttactgttgcgtaactagaacaaaaatgtacattgtaaacaagatatttaaactagagtatcttattctgcacttatgcattagttaaaaaaagataaaggatgtatcagtcagttcttaactcttgtatatttttttgtctcttgtttgctggattgactataacttaagtgctgattgtgattttaaaatgatagtaccgtaaagcattaaagtaaacaatgtgctattgtgagttttttcaaagctttataaatcagttataaataatattaaaagtatttggtcttatgtgaacatgttgatctatatactcatctaaaaatatgggaaaacattccaccccatgtaaatatgtacaagtgcatcactggtacaattttatgtaactcagttggacactaggttgccacagacctatgctaggtgtctttaaaaaattaaggtgacaaagcacatgggactgtgtagagcttggttatcggccggcccggtggcttggcaggcagtgctgtgcgctgctcatggagaagacctgggcttagcaatctccttagttcttgctacacaggatggtgactggaactaaggctacacagagggtcgcacttggactctgagggttgggtgtggaagggggaaaaggggatggagacctgctccccagctcttcctgtcagccggtttacatgggaacagggttaacatctgtgttaggggaggtcaccttaccctttttcataggggaagagtgtcacactcctggctatctcagggggaatggggaaaagaatctttcaagggcaaagaactcgtgggaggatgtctgttgtatgtaatactcacaatggcttttggttagtgttgaaggtgggaagagcatttgtaggtccagaagagtgaaagagagggaggggtgcagcaacatgtgcacaggcacgcacatgtgtgcacgcacacatacaatctgggttatctttgtgctatatagtggattataattctgtgaaaccaagtttgtatattgaattacattaaggagtgttctttaaaaagagaaataaatatacaattacatgcttgaggtgtctagttcttatgtgttgctttacattttaatttcccaattttgtttctaaagtaattttgatactagcaacataccatctgtgcttttaattgctaggctctgcccatcctgagtgtgaatgcttttaacaagtgagaagacagtcattggcttccatagattatctgattagaacagatagtggtcaccaaggtgtgggccctaggaatagacttatccaaacctcagcatgggcctgggcagcatacgttgcatctgaacagattcatgaataaagcaaattatcatttttcctctgcctctcttgcagtatgcatacttatctgaaattccactggggaaacctcttctttctttttgctaaggtggctgaagctaagaatcaactaaaatatatcagaagatacccacaaatcacagttcttttattagaatgagtagaatctttttaataataagagcagaagctcattaaaagtcaaaacctattagtattttcactataaaaatctcaaatttgtggatttacaatgtacctatttgcttttatgagccagactgtctttttaaactgtgttttacaaaggtgatttaaaggtcaacacagacactctaatatctgtctcttaccaagaagaatcttttgattatgtagggtgatttgtgtgtcatattcctcattgatgtgtgcgtgcgtgtgt

SEQ ID NO: 17311 - DNA, 28585 bp, Human
acttccctccatgaacaaacaaaaaattaaaatgaaagcagtgggggatgaagggaggcggggatcataacataggagtgttaaatattaaaattagaaaagaaaataatttctctatcaatgtttaaaatgctagaaattatgcatgcttatactataacaaagaatactttatttggggaataacttaattgatccatgatgtggcatttaccaaggtaatttttccctttttgttccagcagtaggaattagaggtggttcataaaacacacaatcaccatgtaaattgaaaccgcattaagatcatagtcatcttatgttgtttccctaaaatggttctcatttgccccacatattcaaatcagagtgcacaaagatgttgtgctgagtcagggaagatttagaatgctctgtgaacagttttatactgaacttcagagttcagttattgtacttattttttggtgtgtgtgtgtgcacagttgggttttttgtttgttttgctatttgaattactgtttggccattttaatgtatataactgataaatccaggaggataatctgtatgtctgctctctcagtttctttctataacacaagcctgaacatattgctctcctgattaacaactttcagtggttctgattagacaagacttttcgttgcagtcgacagaaacctaatgggaccattgaagaattccaaacaggcaagtgacaggaacatatttgcatgttagaagaatcagcctggcagcagcattgtgattagaatgaaggggaaccatccaaaaacagactggggaaccaatatggatctgcctctagcatgcggaaatatctctctacactgacctaactgactcactaagcttgtggtttgtttaaaggaagccacatgaaaattgagtttgggccaatagagtgaactcgttctccattctctagcatccctccccatgcaaccaccctatccctgccaagtttctgggcaccacagattggaaagtagcctcctgtaggtatttgcccatgttaagtggtggggtctctttctgtcttcccttcttggtctcacctgtctggtgtgacaagggaagcatgtgccaaccaaggctagacccttgtgagaccagagcagccccactttcggtaaagcaagcaacctctgcttacttgcccaacacaccctagcttccgtgttccttgccttgtgagttatcttcttgggtacaatttaacacagcgttcccacctccttataactaaaatagctagagggggctttgtgcctcaaaccccaaggagaccatcttggcaatctctgcctctgcaacagggcacttgctccctgggcaactcctttcccaggtcatcttctcccttgacatgcccatcagatttaatagtgtgcctatttggcagaaaaatggggtcccttggttgctgattcttaggaatgtgaggttctcccagccagagctctcagcactaaaagttctagtctctgcgtaatggccggcatatctttggcgtatctaaaatcctcttcagtttccagcagggtctttataagcttcttctgaaggtctcagacattcagccacggaactcaagtggaatttgtttggataacgtgactgatttcaaagcccggaccccttagacgtgcccatttggtgctgcaagtactgaccattactacaacatcttacagtcaacaaatttgacacattaaagatttatatcctttcttttgggttaggatcttctctcccctaaagcatctcagtttccagcatgcaatcatttccatcttatggaaatcagccatcccgctccgtgccagcatgctaccctgggaggcacatccaggcttgggaaacgggggtgtcctggatctcatgactccagcagcaccagctgctctctttcctcttccaagtagacttccgttccccccccacttgggtgtttttgtttgttttagcaattcagagctcaagataaagaccttaaagataactttgtgtgtctctccctttctaggtatttgcataggaatcagaggagttaatcttgtgagtatactctaacatctgcccttgtttccttccttccttctctatctgcctcaggggtttaaagcataagcctgctgccctccccgccaccccgcccctccaccctaggtcaccagagcgtatgcagagtccatggtcctctctctaacgaagcggtggccttttttgaaaactagattggctccagttccagcagttgtagctagtctatagcacagatgtgcactgttctaagattctgcactttattgaggtgccccacaagtctgcatttcacctcagagtgtcaactatgcaagaagcattactgttttcattccccataatgaaaacggactccagtccccattctgccaacctagaggaaaatttcatgtcagtaagatttaggtgcttccccttcccccatggagtgtgtcctaggacctggagattttcatggcctctggaagatgaggaacccacctctgaccttcagtttatcaaagtagtgatttattgaatccttgtagctgtctgccccagggccgccagtgagggctggaaacctcctgcctcaggtctggcctcccgaggcacactcttcacgtagctgtcttctcaaggattctactcattgccttagggaacagaggggtgccagggcctctattgctggggactgacatacctccttatcaggccctgggatggggggttggccatggggggatggaagggagagtgtcattttggcagcttctcctctgcttctccttctcgcctcccagaagtccagcagaatttcttctctgggtttagatattgttaacaaagacagacttcttcagaatgcttctgtcttcagctggatgaaaatacaagggattacaaagcctgccacctgttttaaatgagctagaaaggagaatcattgggaattcaaacaaagtaaaattctggagttgttgtgctatgctgatttggaggccctaataaaagcaaaacatcacccaaacagcaggtagctatgggaattaagagaaggaaatagatttgagagacaataaagttgtaaagcttaatctctgagaacaatctagactgcagagcttctaagtttggagaggctgggaagtgacatgggaagaggttgacttttgacacgcaccctggattctacagcaagcttaactgcttgctggctgtaggatcatgggcaaatcagcataacttctaagccttactttccccattaatcaaatagggttaatgctacctactcatgcggttgttgaaggtattaggtaaagttcttaaaacagtagccatcacctggtgaggatccgggagctctgatggctattgcatagcggtgccattagctagaacaggcagtgctggaggaggagcaagtctgtgggttaacgtttgaagcctcaccatgtgaccttgaaggggcactgcaaggtatcccgagagctgcgggagggaggtagatgtattagtctggaatttgaaagaaagttcaggattgaagatagagatttgggaggcttctgacttcaaggactaattgtaaccttgggttgtgcatggggtcccccagggagatcatgtattaatgtgagaaggtagaagaccagctgccaggcccacaaatctattccaacttccagcaaccccttcataccatgccccccagtgtcacctttaaaatgacatcattgcctggaggtgaatctgaatatcccactcaggcttcatttcaaagaaataatctcattgttcaccatgatccatcttgctgaaataagatttagttgtctgtaatctaccaaatcaggtgggctcctttccatctggaaaataaaataaaacatattcgagaggcttttcaaaaacaaaccttgtacatcttcagcctagaggattctttcactgaaaaccagggcagacttcccagtgtttgagggttgcccaattctttcccactcaaatcattagaaataaaaaagtcagtttggagaatttgcttaagtaaaaccaggagtcgctagaagtgaatgagctgaaactggaaggaaatccctttgttcaatgtgggtttcagtgaatgcccagcaggcggctaaaccagttcattaagagagaaaaagacgggttcttaaatgctgttctcagaagcaaatgcctagaaaaacatattgtgacagcaaaaacacatcctggaactcatacactctatgaaactttggtttttgtcatcaacgaataaacaaactttccaaaaaatatttcccccttcatttaaaacaattaactaatctgtttaccatctgccagtcttcactcccacaaaaatgtgattcttcttgttactctggaactcggaaacatttatctttaggattgtttaattttatagggtcatttttaaccacatacttaaaaaagaataattgacgtatgaaaacccttttttccctctgctttagaaatctaaattctgacctgaaaagcaatctgcaagtagcatcctgtcaaactgagatgtgttatttttcctgtctgttctctgctttattaaatcgtcatatactgcacatgattttccccccagaccaggcctgccttgggctctctgttgcattgttaactatttaagcattagactggcgcagagatggcaggtgggaaaagctgagggatttgatctcctccctgccagagttctcctctttcacgagtgctgcttacattgaacagcttaagaataagctcctgtgtgagcccttggaggccaaggagtattgttgaattcagaaaggaatcgctttctttttgtgataatttgaatattttgacaatgaagctaagctacttcactgcctggtttgcgtacctcacgttatgtgcaccctttcctgggaagcagaagaacccctgcctctttgaatacataaattggtattgtccgtttgtgagatgggtaggtgcaaaggaagaatcatccggaagaattttactcttttgctttaatgtctttttaaagctctttcaaaaaaaattttatacaagcctttggagaccacccaattaaaccagcacaataaatgttgagcattttgaggaaagagatggaccataaagatgatttgtaaagtgtttatacaagcaaaacaaggaatatgttggaaacaatttccctaaatgactcaggcaaataacctgctcacctccagtattttcctgtattgtgatgcattaacgttaaaaacagttgtcccaaaatggccttggtttttccatttttaacttaaaaggatgttctcatacaaaataaatggacatagcctttttgatcaaattcacagaagaaaataggcaagtgaataaatcacttaggcgagatataaattggctttgttccatagcagatttgcctttgtactagttaagaaaatcctgaaaagctttccctgtaagaggatcagttggttggaatagccttggtaggaagaagccaagtttgataattacttggtgaacggaaatgctggtttccaaatgctcatcagggttcagtggcacaaagctggctgtagacttggcttctgtagatttggtaaaaacgtaaattcctggggtcccagtgatgctgttttagtctgtactgatttgccctgtggccacccaggaatctgtatttttaaaagttttccatgctgattctaatgcatagccaggtttagtaaccatttaattcagtattcaacttagagacttcaaccttcttgcactgcaaatttgataaatctttgtttatatgaatctcctttgttgagtgccaactggttatttgctgactttctttcaattcagaatttgttttaggttctgttattgcatagatttgcatacctgttttatggtattttaatactgttggttttaaaaaataccatttcctctgagtgctgttctgaatatattatgtaagcaattttgtgtgttcttttttttccacttgcataaagcaggggaaaagttgagagtttttcttaatccagttgcaagtaggacaaaggatatgagtgtttaaagatcatctattaaaatgcatgaaaaaacactagaaaatctcctgtgcacatcgccagtcgtgtgtgtgctctagaagtgaagttcagggggtaacataatggaggaatgttttcctagcttcattccctgacgatgtacaaggtctcttctcacaggtttgaatcttcagacaaacttctgggaggactcggtccctgcctcgcagcagatgttccctgtcactcagtaggtgcgcatgttttaagattatttctagttgggcatgtttattaacgattgcttggaaacacatcataggcaagaacatgctggaggttcagggtacttcaaaaaggttctagtggaaaataaacacatttcctccacaaactgcagaatacccgagaacagggttcttttagccctttcattttttaaagctcagtgcacatgtgtttcagagaattggatgatgcagttagcaacttttcatgacctctgctgtcccacatccacagcctagtaatacacatagatctatggaattttctgctgacaaccctgtcagttcaaaagaagaaagctgcccctgccaacactcctaacttgtgtacataagatgtgtaagaggttgtcctgtctttgtggcagatgtcgactgaaagataagcctgggaaagatgctggtcgcatcccagccacatgaggcaatccagccatacttcctgaggctttatttgaaaacgctgttgtaaagcagttgctgaacttcactgctcatgtagacagtgtggctagaagggatggcaaagcgtaggttgaaagagcacttggcttagttcagaacacctgggagcaacctctgttcatcatcattatcatcatcaccagtaatgatattaatagaagctaatgcctttggggcactcactctgtgctaggcgttttgcttaggacagtgtattacttgcagtatgtcattagtccatgctgatgggcagtaaacttaaatcctctgagcctcagtttcctcatttgtgaaatggggacaatgatacccttctacctatctcttagggctatgagatggaaattattggaatagcatgagagagctttatgagctcaactgaaatagtttattaaatagtattccgactcctactgaaatacaatattgtcactaaatatttggatttattgaccaagaaattgaaattaatcccaacagggccaacatatctactaggacctagcagttctagttagggctgggagttggggtggggtgggggagcgtcttgcctgtatcttctgtttacagtgcgcctgacattagaagactaggagtgctagccaggaagatcctggaatgtgtctgccgaagtattcagtggcgagtccatgggctgcgaacaggtggggggtggctaacacagcaggccttgtctgtctcaggagctgaagggggccagccaaagcagggtggacagtatgattgcaaggcaagcaggggaggaagagccacttgagacattgctctcagctgctggggaggagctgcgagcaggcagcggtgggaaattgaggcttattgtgagcaaggtgccggcctccggggcgacggggagcgcagagcagcacatgaaagctgcctgcggatgagctgggggatggaccacacatgtggattgcaaggacagctactcagagagttcacattcctcccccattgaactgggtatgattgtaatggtttgttaaacaaacaaaggacctaaagctgtgaatgggagagaaaaaagacttaaggtgaaaaggagaagaggccctgcttgctagtgttccactctttttaagctttctcccccatttccttaacattcctttcccctttcagaaaagccagtgttgtcgcttggaaaacttgccttgtctcttcagtgccattttcttttaaaatggaaacctgatgaaatgttaatcagtttaaaaagaaaaaatcaagaatcaggataatcttaaaggaccagtgataaatatttttatttctcaaattaactattcctggatgaacaatttgctttgcatcctttgaatttattggacatgacatggaaaggcaaagagaaaattctcaagcttcttgaaataattgtgtctaataaagtacggcctgtgtcccgagaggcagacaggcatgcttctggaggaattggagtgagcttgggaacaggtgcagcagcttcacttttctcacataaccatgcatgtacacagtttactataagttctggatatttctacatcgagcttgaaaagttactgcacgttactttaaaactgcccatcaaatttgtgtctagggtaatccgatttggtcttgggttcatctcatgtaaaaagaaccagttagcatttcagaacagtacctttcaatctgctgttctctccaggtaactgagttacccatgggggagggataagtgattatatgtaactttttcctctctgcaattcatctgtagatgggacatcctcactttcactggctcccagttccctgtaggataaacccagtgtcccctgccaggtgcactatccctgttattggttttctgacacaggcccctctcctgcccatcccagccaggctgcaccacgtgttccacattgccctatgctgcttcatgactccgagctcttctctgttctcccctctgcctctgcaatatgcctcctccatttgtcaaccgggtatactcctagactcagcctaagtagtcattatcaaactttagaaagtgcagatattcaaaaaataaacaatgaggtcatctataaatccagtgtcaagataccctgctcccatgtagttatctgtacttcaaggcctttttctgtttatttagtgatatgttattttaggatcaaacagtccacccaagtcttgagcatcctttctagatctcagatccttcaaggtcattccggtgattttcactcacaaaccaggcatcccatggtcaatgtaactaatatgcttttcacatttctcttctcaatgtgagcctatatcctcacacacttcctgagaaagaaagaggcttttctttcccttgaatgttaaccttattggaaaaataataggtcctgctgctaattagagttctggttcctccatgtcctacacttaagagtcccaggaaaagagatcaccgccatcagctatagaagcagaccctaaaagggcctaaaggcgagactcaagggtttctagggagtgaggagggcgatgtattttcagctatcataaaggaatgatccccattcctgactgtaacaattagaaaatcttcccctaataccaaaggctcttgtctggattttgggagttgctctccacccctcaccccccaccagactcctgagagtcttcattcataaatagtcctcttcaaacaaggcagtcccatctcagcttgagaaccaggcctggacttaacccttgcctttctcaatgcacacatctattttacttgtagacatttgtctatttttttgtgactgtttctatttaaaaatacaatgcgtatggtggggagaggtgaggaggcctgtcaaagatccaagagtctgcaacaatatttcttttcctccgttccccctggtgggtactatactggatgacccatctggaagaaggcctttggccctttcgtggggatcctggctgtcccagccccttgcttccgtgctgtatggatgaggaaggccagtggtggaaggggccccagacctgtgagagatgaagcacttctggggtgacagatcccagctccctgctcatcagagtcatcccttcccccttggtagttcagcatctctcagtcctctgtggctctccaaggctcacattcattggcttttgccttttccatagcttctctggacttcttcctgtttcagttgagaacgttttattggcatcctctacctctaccacctcactccatctccatgtagatgcagtcaggggctaggcttgactcaataggttagatatcttcaatctgctaaatatagcaaagaaaagctcccatctataaaaagcctaccttcttctagtagaagagataaccaaaagatttttgttttgggtttgtttgtttgtttgtttattaggatcttgtttgtactatcaccatctagaagttatttaccaacatcaagtttttgaactcagacttaattctcattttgctcatttttatcaccataggcctgtcagtagaccatcttatccaagaggagctggggggattttgaggcagaaggctgcttctgtctttggagctctgagaattccatgcccccacaaggctgcttccatccgggctacagtgcagagtagatgacctaagggagtctcagtctagctgcagcctgccataaagaaaacaaattcctccttacccccagggctagcccacttgaccaaaccactctaggaggaaaacattggtgatcaaggttgaacacgtgagtcactgacaggatatgaggccacccatggaaagctcagagtaacttataaaatcgcctgtataagttaggttcagaaaggcatccgcttccctagactagaagagctcctgagccactccacgcttcacgtctccttgctggcccgaatgcccattaggcaccattaagcccagcatgtctaaaaatgaactcctaacgcttattttttgctgagtttttcttctgggatgcagaagaaaacctctctctgccaccaccattccctctttcccctaacctcagtcctaatccagttattctgtttacagagtgtcactggaacctgccctctctccttgtgcaggcctgtgttctctcttctgagatctggcagaagcctaaatgatctcattatccagcccaccaccctccagcatgtcttatacgtccctgccagagttaccatcaaaaagtgaaatctggtggcaagtccactgcttctgatcggtccccattgcccagctccctggtggtgagcgcctgggtcgtcctttccccttggtagtttggttttgtcagttttctgtggccctttgaggctcacaatcacaggctgaggctttccccactgcctcttcccattcctcacagcattttattggcattctctacctatttctacctcttctcttcccgccctcctcactgcatctccacataaattcaagagtttgtggctggacttgactaaatagatcaatctgctaaaaacaatttatgacaaaaaagcccaccttccccttgtagagtggacccttcacgattctccatctctctagcctgttttctcctttgcccacatctgcacctgtattccagtcttactgaaccacttattctccaggtggttggattcattcccttggcctgaaatagaccacctccctcttgaacacgttgtaaacttctacgctagcttcaacttttacttctctgtgacacctttcttgatctcccaagcaagagatggtcactgcctagacaaccaccacctcaagttttagtaatgattttcacttctatttatctgttttcatgcatatgtcattatagagcaatgtaattgtattctgtccattcattcctgaggaaacacatctttgaatatatcctgtccatgattccagtcttgcatattgtctctttccctttggctgggcactagttacctgtctttattttctggctaatatgatggtatttaaactatatttctgtttgtggatatttagaaatgcagctgtttgtgtagtttgatttttataatcaaacaccttgccaggctttctaatcttgtgtgtggattctttgggattttctatatcgacattcctctgcaaataaataattattccattccaattttatgcctttcattagtttattgtcttactgtatcgtattatccatgacttctaatacatgaatgtttcatgcaagcaatgataataggtaactttgtcatgtgatgaagatagtatactctgttttgttagtttaaaaatcatctcctctcctttcatgtttcttggtgaaatgatacatattttaaccatttagtcaatgaatgttagtctctggattatattagctgagttataagaggctgcctcatggtgttgactctcagatgctctctgggttctcaagtgttccccttgcaagtttgactcaaatgcctgtcccagcccctggggtcttgcactgccactgcctttttgttggtgttgtcctctttaaaaaataatatcctgctcttcttttaaggacctctgttctctctaggatattaatgattattatttttgaagtttccttccccccgtagtctttttttccccgttactttttgtgtcagttttccctattaagtgccttcctctgatttctggtgatccttggcctactaatttgtgagtcaagccagtaaagagctgatgggagctttgtatacttaggtggggcttgtcagctggggccttgtatagggtaaggtggcgacccctggaggaaaccccctttgtccttatggtttgctcttttctcttgggctggtcagcttcccagggaagactcctccatcctcctgccctgagagagaggacattcaccctgtgtcaggctactcccccactttcatacagtctccatagcgagcacttgtgctaggggaaggaagggcaggcaccccactgcaggcatcaggagaggtcaggagggctcagtgcttcactaacagactttcacctgctgctttcatacctgtttccatcctcacttccagaagtacctactgtaccaaattgcagagacatatggtagatgcttcagggtatagcaggttgttttgttgcctcttaatgctggcttaaactttagctttcttaggatggccaagtcgatcactgcttgtttacctgcttttcagcttccaaaatttgttgttttctcccttttatattaggctgtgttttagaaaaatcccactattactgttttagtagaattttcagagagactggagctacatgcttttattcagttggccatctttaaccaaatattacactatttgtaaacagaacacaccctgtcccttttcagatgttctggctaggatgtggatttgatgttccaaagctgtagcataatcatctggacagctttctcaattttttccctgaatattagagaaataattcactttgtctttcttgtttatcttaagcctcatttcttagaaagtaagagcttagtcactgggttaacaaaattcagtctttcaaggtgacagctgaaaagaatctataggcaacaaacctgatggctcagcaggtggctctctcagagcagaatagaagggcaggtagtgcttcctacaatgaggataaactagagtgaaagctcttcaaacatattaaggtggagatctctactgggccattgagtaaacacctcaccgtgtggaggaggaactcgtgcctctgcctggcagtgacagagaaaagtagaagtttgccaggtagacaagggttcccaggacattccaggagggagaaagccagaagcgtgagagaaagtagcactttaaggaaacagcaagtggagtgatccttggccttgccttccggccatgatgggagtgaggtctgcagccatggcagccatgactacctggaggttctggatatcatctttctcctgatgacatttctaaatagcttttttaaatttgatagagactgctaccaaagtccttcaaagaactgatattgagaaaaacacccttgttggaagaccaaaagtggaaattcactttcctctcagaaatgggccttgcattgattgtgtcactgaggacaatggaaatagatgccagaagtcacagtttattttaagaatgttgtaaagcagttgtgccccattagatgatgtgttatgtagcactggagaagtcctggaactacagttgtgttctgactcccccctccaccctcgtatacccctgtcccctgggaacacagtctttcctggctgttaccatatatatatgttcttcttcccgtctgatcctctctcatccccaaaataatcaacatgagcagaacgaagcagatggcacaagccttctttggcatactggcagatctgtatcactcactcagtatttttagaatcaaggggactgaaaattatgtcctgagatgttttggggtaagacttactatctttctagggtgacaggtgttgaaatagcaccgtatttaagactcaaatgcaatttctatgtcaagtcacagaacagaatgactcgcatcaggaccattgctctgtaagttctgttaggatcgttggtggcctgccagataatagaaagttgtcataaattgttttaaggatgtggccagaaagtgcattgggtttcaaccaaagattggactcatcagtaaacagcctttgaactgatcaagtgcgtggtgatgagagatgttgtatatacccacagttgttgttgttgttgttgtcgttttttaatagctaagctttgaccctcagccacaaagcgtttatagtctgttggggtagacagtcttgtttttacagaagtttattattatatcatgaaaacaaatatttgtattctaaggcccatatggaagaaatacatagttacggtgattaaaaattatgaatttgagttcattaaggactctctgaagaaattaaagaatgttcactattatataactaacttagttctgaggaccaactttgcaattagtattaggctaggtatattaaacacacagacctggaactcaaagccttgggaaaagatattcatgaaataagcataaaaacgagagactttgtgttttagtctttgagggaaacttgaagttggaggaaatgtgcctcacctttaaaccatggccatgtctaatgctcagattgtcccattcatctttgagggctcaggggaaatgtaggcatgggtgatgtccatgactgctggccttttgaatcttgggaagaagtggctggaaagagatctggaaaacctcattcagtgccaaagggcaagtttttcaattgaataagctttatttttttctttgtactcctagtgtgtttggtaagcaatgagtcaaggtttacatctgctgagaaagaatgcaggcgttttacttgccacctcttgtgtcctttctacacgtgtgttgtccacactgccacttctttccagtataattgatatggtgtagtatccatagggagagaatgtgtctctttcccgttacatccatagctaaatggttagaacatgagctgtacattgacacatggttctatagtacttttaattccagtgtttcataaatactgcctatttgtagggtgtttatttaggttacagtgtgctttcagatccattttgtctcagtcgattgtcccagcagcctgtttacatacatcaggtaactatcacaaatgaggaaactgaaactcaggacacagataacatgggtaagttggaatttgaactggggaatctttccactggattcacagaacaagtgcctggatttatagcttcagggtaaacacctgaggctcaatcagtagcacagttgtgtccaaggaaagcacagccttgccttcctctcctttgatgggaataccaagagtctgcctgtgccgtccaggacagcagccactggcactatgtggcaatttaaattaaagttaaataaagtaaaagtttcagtttctcagaggcacattttgagtgctcagtagccatcacatctgtaacatttccatcattgcagaaagttctgttggacatgccagtcatctcataaagcaagaattggggagaatcaacttactgagataagttgagaaaagtgtatatgcagggtgttaagtaggtgagagaaatgtaaaaccttccccaacaaagcagctccttctctgaaggggcgagtgggacgagtgctattttgagttcagctataaagggaatgagaaaaagatgcattttcaaacttcatactctgtgtgtgttagtcttttttaataaacctagaaagaacacagagcaattctaagtgaatgagtgtgttttatagctgggccggtattatggccaaacttaggctgggtgagaagtagaacagatcatgatacctagcagagcaaactcggcaggcggaatagaattcctagaaggagttattttgtttgtgaccagggctgttgaggattcctcaagatagggcctcaggcatgaactagaatactggaagggaaccaggggttgggggaaaggggtttgggcagagccgggacaggtaattagttaaagtcacacataattgcagaggttgtgtgtgctgctagaatcacagccgtcacaaagaaggtgtggtgccaaggtgctggccgaggactcctgtgtgtcccctggtttggattagcgctgaccaaaagtgcccgagtcagctttcacgtttccaagtgggtgaggcaggatggtgaggggtatttgcttggtaccgcgaactctgtccagacactgaaaacatctacaacagaagatgaggaactctacaagtttcctggaatttttgctggttagaaaaggaatatgtgtttggttatgtccgtgtgctacataatgctatatttaaacatgtttaaactgttattacaataaagtttcatctagttagactcatactttctgatctgaaagtaaccaaaaaggtaagtaaaaattaacttttaacaataaagagcaactctagagacatggcaataaatgactgcaaggagcagggagggctttaaagactcactgcaattggtcagtttaccatgaagtgccctgcttactggcaaagttcagcaaatgctggcctgtggacaaaagctactcaagtgtacttcacctaagcatacagtactcttaatttttttaagtattggcacttgaaaggtgagcatttgcccacctgaaaatctctctctagaatagcacagggtggtagtgatccagggctttaccctggcaggtagtggcaggtagaggccgatttgaaacctgctgtcagagtccagggatgaaatgtggggggttggtccaggtcctgagagtgaagctaggaggagacatctccaagtgtaaatttttggaacacagtttctcagcttgggtggaaagccaccctagtaagtggagtattgttcatgatgcaggctcagacacttcaggttcctccaatgatggccaattggtagaaaaagaagaacctggtttttggtgactctggctgagtcagaaggatgataatgatttgggtttgagacaagttgggtttgaggaggcagtaggcccatctcctggaggtggcctaccagcaggtagctggatgggctctccagggtagggccagggaatgaagaaaggtccataaacaaaaaaggaagagattagtagaacttactagaggatggtgcctacaaatctgaacgtggcctgggctggttcctgagctatcagctttgtgccaccacatcagtgcaactagactagactagcttcatgcacattctgtttatatcagcccttctgcagagtaatcttacaaacaaattgacttaggtgtatacaaattatttcttatcctctggaagtttaaacaggtgtgataagcaactaatgttatgccaacaatgagtgatgaggaagagcccgtggtttgagtaagtgtgggtgatttttgtttatggaccagtaaaaacacttgaacacactgagggagggaggtttttgtttgttgttgttgttgttgttgttgttgtttttctctttggtcaatggagcttcacactgacctgaaatagataatactggatccgtggaaagaactctccttaccagagggaaagtgtgctccactggccatcagtgcttgactcctcaccctctgagaagccaaaagtgtagacttgtatgcagatggccctctcacatggagaactgtgttccatgagcaccatttaaaggaacgtgttgattgtgggtagttgattctgaagcggtcagggaggaaaagcattgttttcaaatggctaatgcaagaaaactgttcctcttctctccacagccaatccgggggacccaggacatgccccagctatagtgatgcagattacctttctgctcctgaatcgcacctgtgcctcagactttctcccctcagcttgagactgcatgtaaactgggatgtgtgaaagcaggaagcaaagctagtgacagctgagaggtccatgtctgggtagaaccaggcccacgatgctgcctctcccgtggtctggagttcagctgcagggactctgctgatgtgcccagcaccatcgttctgtttgtgcttaaatggcacagcatttggtcagcacatctgaaaaggaaggtgtgagaagcaaagcccatggccacgttcccctgccagttatgtggcaagacgttcctcaccctggagaagttcacgattcacaattattcccactccagggagcggccgtacaagtgtgtgcagcctgactgtggcaaagcctttgtttccagatataaattgatgaggtgagaggctttggcaaaggtatgcacttttagaagtacgtttaaatggcttttctagccctcagaccacacgatgcaaggggaaagggacacaggatatggatgcattttagcctttgagggattcttgaaatctgcatccagtgattcctgtggttttatgtgacagtcttgttgtgcagtgtcagttcattctttcaacagagattttttatgcacctacaatataccaggcctctccccatggctggagaaataggaaaagacaattaaaatgcaacctcactgctttgacagagctatacaggtggtagaagttgttcttcactgcctgatgaaacctgggacggcttctcagatggggacaatctttaagctgtgacacaatgaaagaggaggaggcagagaggaggttctgggaaagccataagtcttggccttaaagcacccatgtgcagagggtactatccgaggaggagcagatgaggctaaaagtgcaggcaggaaggaagccacgtatagcaggccttacctctgtctgagagggtttgtctcattcaggtgtataagtagtgaagaaatatgattcgtttagtatcctagaaagaggactcagataataatttgaagaagtggcaggaaggctgatttgaaacctgctctcagagtccagggatgaaatgtgggggctgatccaggtcctgagagtaaagctaggaggagacatctccaagtttaaatgtttggaacacagtttctcaacttgggtggaaagccaccctagtaagtggagttcaggtgggtatgcagatgagcagcatgtgcatttgatcagttttaaaggcacccatgacacaccaaaggataaaaagcactgttttagcagatgagtctttttaaaaaattacatttagtctaagttatttattgagtgcctgttaggtacctacttccatgagggaaatgaatacattagatatcgtttctgccgccagtggatctttttaatatcacaggaaagactccaggtacatgcagtggctgtgctgcacggtactgggactggtaatgagcatggtgtgtgttgtgtctgtgcacactcagagccacacacatagtgcgtccactcacacgtgctgcttttgatacttgattaagggaaatgcaccatttgcccttaatttcatgaaataaactttgaagtttcaactttgactgttcacatacaaacgcctggagagagccaggctttagcaagtgagattttccatctgactggtattaccatagaccacattatgaaatcttggagtgaccctggaggaaggcacttgaaagaattgaaaagatggaaattatgctcctggcccttaagaataccactgttatacataatgtaatgtaataagttggttttaaaaattagcctgcaaatgcttacatattttaaaattcaaatgtcttctatacatgggcctccctctagctgtcacgagtagaagtattgaatgctgatcacgtgcatgagtttgttgcagaggctccctgttttgcatgaagcttcttgcgtgtgcggagggtaagcgtccttacccaaacatgagagcagcgctggctgcaactgagtcacagtgaggacactaaaactgcagataaagactgagacacatagaagagatcaatgtttagaaaagaagaattagtggagtagaactattgggattacagttgacccttgaacaacatgagtttgagctgcgcgggtccgcttatacacaaatatttttcaaccagatgcagattgaaagtacagtatttgcagggtgtgaaacctgtgtataccgaaggctgacttttcatacacatgtggtccacagggtggaccgcaggacctgagtatatgtgtatttgggtatgacaggggtagaatcagtaccctgcatgttccgagaaataatttactatggtaaactgcgctgaaaaagaagtcttaagtcatgtttagaaggtagttgttcttagcaaggaaaatggcttgttcagttaagggtgtaaagagaggcaaaaagggaagctgtcagtgtactttatgcaagaaccgccttccctgcctcagcccccagcatttcttgcctctcgcctctcttgcctgaagcagtgatatagtaaaggactggaagagtgtgagatggcaggatgctttcggttttgcttttaaaaaaaagatgatgcctgtaatcccagcactttgggaggccgaggtgggtggatcatgaggtcaacagatcgagataatcctggccaccatggtgaaaccccgtctctactaaaaatacaaaaaattagctgggcgtggtggtacacgcctgtaatcccagctactcgggaggctgaggtaggaggatcgcttgaacccgggaggcagaggttgcagtgagctgacatcgagccactgcacttcagcctggtgacagggtgggactgcatctcaaaaaaaggatgatgaggcaacagaggttgaaggaaaaaataactgacttgcttaaccagaaaacagaatgtgggtcccagtacagcatataatgaaaccagttagagacaacaacaggcaagaaaagatgatttggcaaggttggaggtcctaatgtgagcaatcaacctctaaataattctaaaatcactgacatgatccagatgatacccaaagatggtggcattgggtactgactctaggacatactaaagctgttttcatgggttataaggtaagatgaaaaactgagggaaagaaacaagtcgttgaagtaatttcagctataggatgagaatgttctagatcaggattgttgagtaagtaagggataaattaaaagggaaagaagtagatgccaggcaagggaaagagtcaagaaattcagaaatgtgggagctagtgaagtctggaaggcagtggtcttgctcaagtactactggggtgtcagactgtgccccacttacaggtagtacaggtgtaggacaggaaagagtgggtaggaaataaccaggtgcagtcgttaacctggtattgatctacccatgggtgataaatgaaatcaaatcagatgaaagtcctctataatgaaagaaaagagagaggcacaaactgacccaagagctatgggatcctgttcaccagtactgggccagaaaaaaaaaaaaaggtttaaatactgagtgtgtaagccagctccccccttcatatgtattcctgcgatatatatatatacatatggatatcctgcagaacaacatggctatttgccctctaacatgctctaaaaaccctttctccaacctgtgcatttatttagatagacctagaacgtggaaacaccagcacaatctggtttctcagatgcccatcgtattggttcctgtccctgccttacggtacccatcatgttatcatttatgtgcaaacaagctgtggtgtactggagggaagggaagggatgcacacagcaggccttttttgtttttgtttgtttgttttgtgacagaggaaggaggtatgaggttgtactttatttttaagaaaatgacagttcgattcagattagctttatattttttgaactggcttccagttggcctctaggtgggggcctccactcaacggctgctattgtagacccctccccaattctggctccacaaaaggggcaggaataaacagtatagggcagatgttggctgaaaggtgtaattaagtatacttttgacttaaacatactgtcttaaagagatcctatctcttttacggaatgagttgttagaaaatcttctgtatctaacgtgaaagctcacagggtacaactgcacttaaattgtcagttaggacaagctttaacctctcgtgacaaaacccctaaaggaggtatctgccctgagggatatgaagctacaagttgtaatgaaggattctgtttcataggacatgctaacatgtaatgctctgcattttagttattaaaatgaacctttttaaagcttaaggatgacaaactcagggtttccttataccactgagtttttaaaagccagtggtgagtttagatgttagcaattcagtggaactatgaaaaagatggaattgtgatggctttccataactaatttctgcttcacaaatataaaagagctattttgaaattccaaattgactagacagactacggcttgtccctgaagccattgttgaagacaaacttacaactcttattagaagtagcagcttcatatttaaagaagaaagtctttttgaattttgccaattaaattaccagtgacctttaagaagtaagtcaaaggtgtcttagagggaaaatttgaagtaacagagacaggcagcagcatcagagataagagctgatagtcaagcattgaatgaaggaaatcaagacagtggtgagatctcacggcaggcagaggctgaggctgaaagcaaggcagtgggctgatgttcagggtcctattagacacttttctgaggttaaggatggactttttaagaggctcctaagagttacatgtccatggcttgaactttttgtctcaaacaacagaaacataggaactaggaacaataacctaaaactggggctttatgtggttctgggtagcagacaaattgagtcacttgaatttccagagtacaaaagacccctttaaccccttcctgaaaaagatttttcatggtcaggtatttttaaatacttgcatactttgttcagaaatctgtatacattaaaaaaacatgttctctttaagaatattctggccaggcacggtgactcttgtctgtaatcccaacacttttggaggccaaggcgggaggatcacttgagcccaggagtttgagaccagcgtgggtatagtgagaccttgtctcaaaaaaaaaaaaaaaaaaaaaaaaaaaattagccaggcctggtggtgtgtgcctgtagttcagctatttgagaggctaaggtgggaagattgcttgagcccaggacgttgaggctgcagtgagccatgatcgtgccactgcactccagcctgggcaaaagagtcagatcctgtctcaaaaaacgttttataggtgtgaaaaatgtattatggctttagtattgcttgcttttcttaattataaaagtttatatatttggaaaatatatgaaagaattttgaaaattataccaagacccagagaaaactattaacattttgatataatattgttgctacacctttcttcagctcttaaaacaactctctattgtgaaatttctccttctgctcctaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgcaatttggcttgattaatttttcatacagctccacctgtgtcaacaacatgaactacatacactcagatcaagacagaaaacacttccggctccacctggctccctcatgccccctcctggtcattacttcccccacagaaaccactgttttgacctctactgagcatctattagaaacttcactttttttgagtaaaataattatgacttaagatggaagcttgtatgcgtccattaaattcacagcactaagagcttattatttctaaaaatgcaatatttaaatcattctataatgtgacataatttatttctaatgtatagatcagaatactatccaccagagtttagtctaacctgggctaccatgatccacttttacaacggtgtttaccattaatttctagccaaattagaaataaatgtacttatttcttattgggattttctcaaggtattatgccccttaaatctgacaggcctatttctgtttgttttactgctaaatagggtggggataggtagagaaagggaagacgagtttgtctgtctatccaagaagcccactggtcaaatgtgagaaaacctgacccactcacagtccttaacaatgatgctgattgatgaccacttaaggggcaaacagctacccaggattggaactgagaaggaaatttaatctatgagacccagctgccagacagacctgggtctttaaactacaatgaaacccgcggggaggaaatgagacaaagtgatgtaagttattccgttagtaggagtccactgcttggggacgtttaagtcagttcccatatcccctctttgttctcagagggaaagcaatctcccagagcaaaaggggaaagctaaaacctcctgatatccatttatagaagcttccacagatacttttacatggcttactactgtctcctgtgagttccacaacacatacttgattttcctgaacacagaacataacatttggagtttagtccccaaaatacagatcataagaatttcagatattccgcattacaagtcagggtaggctgggattctcctacttaaatttggacagaaagaaatggtttaattgttctaattaaaattttacgaggttaagaaaaagttcttggatttaaaattatgaattaagtataactgactctacaaaaagaggtctattgacccttaagattgcaaagaggctgggcacagtggctcatgccagtaatcccagcactttgggaggccaaggcaggcagatggcttgagctcaagagttcaagactagcctggccaacagtgaaaccccatctccacaaaaaatataaaaaattagccggttgtggtggcgcaagcctgtggtcccagctacccgggaggctgaggtgggaggtactgcttgagccaagatcgcaccactgcagcctgggtgacagagtgagatcttgtgtccaaaaaaaaaaaaaaaaaaagactgcaaagagaagagtcacttctcaacagagctctgtataaatcagtgctaaagaaatgattagatagcttctgatttggccatgataaataaatggcttgaggccactgagaacattcttcccacaggatggaagattttggtaatcttttctcttccacttcagtgtttcctcccagatacggtctgtgtgattggtatgtgtcagacacttctacacagtatatacataaacatttaaaacaaatataatagctataatttaatacttactagataccaatatcaaaactgagatttcacagctagtatataaaatgaagccagttaaagaaagattttcctagtaagtaaataatgttagtattccaattactagtctactaaaaaggttctaatatcaaagcaacattgtctttaaaaacccatcaaatgtccaattaaacttcaagtgaatttgaatcatgcattatacaggttgatgtgtttaatgcttttgttttgaaaacttcaaaggga

SEQ ID NO: 17312 - DNA, 12237 bp, Human
caaggagaggaagaccaggtgtggtaaagcaaccagcctgcccagcaagtctcctcgctcaggccgaacacccagggccaagcagccttgtgtcagtcagggctctgccctcctctcgccagccctgtttccctcaaggaggcaggtagttgcatcttcctccactccccagttctctccatttgggtctgaggcaaagctaacacccatgagggaaatgattcatgcaataaattttaggccgggcatggtggctcacagctataatcccagcactttgggaggctgaggctggaggatcccttaagcccgggagtttgagacctgcctgggcaacacagtgagatcccatctctacaaaagacatattaaaaaaataggtgggtgtggtggctagtgcctggaatcccagctgctcaggaggctaaggcaggagaataccttgagcccaggagttcaagctcttagtggtctttggatgactaaacttcaacacatcttagctcaaaatctccgatcacaccactgcattccagcccgggcaacagaatgacaccctgtctctaaataaataaataaataaatgttaattgtgtagctattatgtgccaggcacaatgtggaaggaaggggatacattagtgaataaaacagatccttcctgcatggtacttagtttctaaatggagacacaccatcaacaagcaaccataaatacgttcttgcaaactgagagaagtgctatgaggaaaatgtacaggatgcaggggtggaggatgaggaggtcggctaccttagatgccgtggtcacagaatggctctctgtaggagattttgagctaagatatgttaaaagtttagtcatccaaagatcactaagattagtctatagtctgacaacttagtaactattgacttatggcagggcagaatgggtgaggggagggaggagtcgttgggttaggttcctcttgaagggctctaataagaccctgatagaccgaccaggttacagtccgatggtcataatccagatgagagatatcaatctttaactggggtcccgagcatatggggtagaaataacaagggttgttgatggattagatgtgggatttgaagtttaggtctaccaaatccctgggacccttgcagtcagctctttcttggggaatgggaagtgggttccagcaacctgaattcaagtgcatgacgaaaccagaaaaagcaaacgccaaaatcaaaactcggagcctcagaatacctgccaatagatgcatatgccccagctttccgtggagggcagtttaccagagcccagtgcaattcctaatttccataaagaacccacatacaaataaagtctgtctagttcactatggttaaggtagtcaggaagtgtgccacattttacaaaattttccacccaaaatgtttttttttaatggtgcttaaaggaaaaattctcatttacctggaaaacttaactccccaaagggaagtttcgttcagatagctaaagcatgccaatcccagtccccaagggaactgcaacaacgtctcaccgggcgcactgccttcagcagtcactttcgagtttgttgccaggtgtccgagcgggtttgaacgtccgcgtcaatccacacagtacaaaccggaggaggggccgggaccacgcttcccctccaggactgccttttgtacgtgtgttttgtttctgttgctaaggtttagggagctgcccggctaccctcacggattcccatggaaactaccacctcccagaggacaggaggagaggcgaattcagggtccacccacgggccccgcccagggatggggtcactgagggtccgggcagcgaagggcggggcccgggagctgggcatgggcgaggcaggcgcgagaggagaggggcgtggcaggtccggggcggggcctgagtgcgcctgcgcagtccgcgccactcagggagccggaggggacgcgccggaggaaagatggaagactaccaggctgcggaggaggtaaccgccgggtcggcgacggaagggtggaggcctagagccctggccgcggaaggacacgcggtcctgcccggaaaggcctggctgcccacctccttcagctaggccagtctcggcagcccacggcctgagcttcccggtcgccggcgctccgcccggccccattctgcccggacattgccgccgtttccccggcgcggggggcgggaaggggattgagcttcttcccgcgcggggaggcaccgggcgtgactcggagagagcgccccggtgagcggtgccgagaaaccttcccgcagggcctcgcctccggcccgcagccaagctcgccgagaggatgacatcaccgccccttgctctgcggggctgaccccagccccagccccagcctggagcggggcgcggcggccgggctgggagcgccgaggcttggacgtctccccgcggaggtgcgggtgacgctcccgccgccagcccctccgccccgggctggcgtcccggccatcccgcgcctttgtctcgggcctcacctggttctgcaacgctgggaatgagtagcacatttcatttccgtttaatatgtctgtaagaaagctcattgttgtggggaaaaaatcatcttttatgcctccttgaggaagtaggataaagcccacgatgtcgccaagcagaagacacccatcggcaccgtgtgcgttaaatggctttccttcaagctcacggtcattcggggaatagagctgatgggcgcagctgagatacaacactcattttcttcttactgaataatccttgttgaaattcagatagagccctatggatttattatgcagcctgtcaaaaatataaactatagatacatttggtaaggttggatatcttaccatttatgaaatttagtggctgggcgcagtggctcacgcctgtaatcccagcactttgggaggcctaggcgggcggatcacctgaggtcaggagttcgagagcagcctgaccaacatggagaaaccccgtctcttttaaaaatacaaaattagccgggcgtggtggcgcatgcctgtaatcccagctattcgggaggccgaggcaggagaatcccttgaacctgggaggcagaggttgccgtgagccaagatcgcgccattgcactccagcctgggcaacaagagcgaaactccgtctcaaaaaccaaaaaaaaagaaaaaaatttcgtttaaggaggaatgttttcagggaaaataaaactaaaacttaaggactgattctagagtttcagttttgatctgatttcctaactagcacacacttcctgtgacagtggcataatcagtgtttgaatgctgatggcaaccaagtgaataatgacgagaagagctggttcaggagcagttggcaaagaaaaaagcctttccccttaaactgttactaatataatattggaaaatgtcttgtattacagtaatatcgagtaaaacttctaaaaaagaaatcgctttgtaaaggaaagcgcttaatactgcagtccgattctgactcccacaaataaggtggctaagtggcttcattattcgagatctcaatcgcatatgtgtaaaatgaaggggctggacagagtgatgagtgttctacctgggatggaggccctgggaggtggagaccatggctgtcttgtagtaggcatgtcttaggtatttactgaatggcccgttctggtcctcccaccagcctcttagcagccttttctgcatctcttctaacttcgtgtagatgcctgggcctttgtaactattctctcaactcaccattcatctttcttggagacgttaaaactatccactggattcaatacaactctgctttccactaaaaattctttaaaatgtccctcaacctttttcgtactgtaaccatatgggaggtgatacagtgcctttcctttgtgattaaggtcacggtagtcacttggaaggatcctttaagcttccagaaatgacttaatctctaagatattgcaaattgttcttcactcagtgagttggttttgtttccaagtccgacttctgagtacagcaagtgaggtggcttcgggcagtcagctcctgaccccccctaaaaagaaagggcagggcctgcagtggacagcagccagacagggaggaagactcactgccaagtcagggttctctgccttgattccctcaggatgcacgttgactgagggccccaggggttgccctctcgaaggcgtgtccagagctacgtacctttcctgggactcagcagtaactttaaacgcttgtgctcatgtgaagagcacattggcaggcaagtgcctgactaatgttattttcaggatgaccttttacccattcagatctaccatgtgtaaaaggaaaactatactcctggcactagattcctgcaggcagcccacctcctgagtcatccagacactgacagagaacagccatgctggcagctggtggttagtcctggagtcggagggcagcactgggaaagaaaaataattacctggagataatgtaatcatcgtacattttacaagtaatggtgctttaaaaaaatctcctcaaggtcaaactgatcctcctaatcagtttacatcatggaagagagaattacatcttaaatggattacttcagcagcttcagttaatttatacaaaaatcaaccaactcattaagcctctctattggttaatgattctagcagccagttgaaatggaagaagagaatgaattctagtttaaagtgaagtcttagattgtggcatgattaaaacaaaacagggccaggtgtggtggcttacgcctgtaatcccagcattttgggaggctgaggcgggaggatcacctgaggtcaggagttcgagaccagcctggccaacatgatgaaaccccatctctactaaaaatacgaaaattagccgggtgtggtggagggcacctgtaatcccagctacttgggaggctgaggcaggagaatcacttgaacctgggaggcagagattgcagtgagctgagattgcgccactgcattccagcctgggctacagagcgacactccgtctcaaaaataaataaataaaaataaaacaatacctttaaattatgtgcatgtattctagtcttctggtttctgaagactgtaatgccatccttggtaaagctgaacagtctagttagattatttctaaggtcttcatttctacattatgttcattacctacatttgcatttatcaatgtagtggaaatatcttttaaataaatcaaacttaactgaatgttcttccttacagactgcttttgttgttgatgaagtgagcaacattgtaaaagaggtaagaggagaaatgctcacttcttaaatgtttaatggcttatattagagaaaataatgtgttttaaatactatcttggaattgtttcgactgagtctgtgtgttttggtgtttcaaataacagtttttacttcagtaaatagctagataagagttgcttctatattatgtaaattacatattttaaatcagataaggagttttatgtacatagcattattactgcatatcaccaagatttgattctataatcttttaagcataaaagaatcctggtatacaaataaatgtctccagggttgaatgaagaaagagtgagtataagaaaattgaacaatcaatttccagttattctggacctagtgatccagtttggggcctatttgcttacttttcttacattcctaaatttcacactttattgtgttgttgatcatgaagaggaagagagacagaagggatgtttgttactcattcagaaagtacacactgagggagcgtgcagggcatagacccttctggagtttacagctgaggggcaggcagggcagacacatcaaacagtcctgctggaaggtgtcagcctgcatttgctgtgtggtaagtgccactagtggtggtgctgtgagagcactgaactgggaatgtgacccacccagggagttcagggaccatttcgagctgaaatctgcagaatgagaagtaggggtaatgcagtaaaaagaggggacaaggccccctgagactgggaagtgggggcagtgcatggtgtgtgagggagtgaaaggaggtgggtgtggctggagcggtgctgagagctaggggctcattcctacctagggtaggaatgaagccagaaagagttttcctcatcagcttccctgccttccctgggtaaaatggggcacagatactaaagccattggctaaaagaaaactattagatgatctgaatttaatgatactgtttggggtttcagatgtaatttagaatttaatgtaaattattgactagtgtttgataaaaaaccgcaacctatgtttgtgatcagtatccaaaggcaaaatgattttgtttgaccatttacattgttcagcatcaggagtgactttctggttgctttgcaggatctgtacgtttggttttcatggtttttctaaatacacagtttcacgtggaacacagcagggggcaggaaggtgggtggattacaccagaactgggaacagtggagggggcttgttgggaagtctagttctgccgcagttgttttctgccttatctttgacttggttaccagctttcaattagcaagtgcaattgaaagtacacatttccatgctgggcgcgatggctcacacctgtcatcccagcacattgggaggccgaggtgggcggatcatgaggtcaagagatcgagaccatcctgtccaacatggtgaaaccccgtctctactaaaaatacaaaaataagccaggcttggtggcgcatgcctgtagtcccagctccttgggaggctgaggcaggagaatcgcttgaacccgggagatggagggtgcagtaagccaagatcacgccactgcaatccagtctgggcgacagagcaagactctgtcttaaaaaaacaaaacaaaacaaacacatttccaatccacatggaaacatgaggtgacattgcagtgttacttgaacttgtgtcactggcctcaacagcttttttgccgccgcaataggtaattctgtactcaagtgaccctaaatattgggtagtagtcaatttgcgcaggtccaaaattggtggagggttccctcctccttgaaaaactgaatttcaaagtatgtgcggagggagagctggcggagggagaggtttaccttcaacaaagcctcccccaccctttgacgggagaggtttagcttgaacaaagccccccctaccctttgacaatgcccaggtctagtaatactgctgttctcttaaaccgggacttctggccccccagccctcttgtagcctctgagctgggagggagcacagtggccgaggacaagaagtaagccagccctatgtgtaacgtgactactcaagagtctcagggagatgatcagcaggtcagtgggtagaaatcagagtgacctagggaggttttaggtcctcaaaagcaaggtcgccagatctaagccccaggcatcagatcccagtccatcaccaccatgcacagctcagatccctggactgctggtttgctctgcctgtctgaggacagaccttggccctcactgaatgttgttattttcactttaggtcataactgtcatagaaactcaggttcctggtttccagcacagcaagttaggggtagagaataaagttgctgagatgcaagcacactggcatccatgtgaaaggggagctgacaatgaaaaactcagaaaatcatacaatggcaatatcataatgataagcttagcaagagcagcgacaatgagcttgcattgtcagataacccccaaagaatacagcatagataaagaagtaaacgtataataaagaaaaaaagttgggctgggtgctgtggcttatgcctgtaatcccagcactttaggaggctgaggcaggaggatcacttgagcccaggcatttgagagcagcctgggcaacagagcaagaccccatctctacaaaaaactagccaggcgtggtggcacatgcctgcagtcccagctactggacaagctgaggtgggaggattgcttgagcccaggagggaagctgaggtgggaggattgcttgagcccaggaggtcaaggctgcagtgagccaagattccatcactgctctccagcctgggcaacatgacaccctgcctcagaaaagtaaaaataaaaaaatctcatcataaacctaaaataagttttggaatataaagggcttttagttatctgaaaaatgcacttaatgtggtaacatgttctcagacaatgctggataaaagtattttttaatatatgattatttggatagctttgtatattgtcagttgtacaaatacaattcatctaatatatagtattagtgtatgttaggtagtagtagataaaagtaatatacttttaagaaatgaataggcaaaatactttctagcctcaacaggaaaaaaaatgtattaatagtagtgaacatgaaatgtgattattaggtcaaaatgtgtaaataatttgacagactatgaatttttgaagcaaatttcaaacttatttaaatgaaatataatgctattaaaagtatatttgcaaaggcaccctcatgattaaaaataaacttttcataaatcacttcttggggtgccgtcagttcctgattgaaaggtggtgtgggtgcatttggttaaccgggacgcgctttgtgctttgttttctaggctatagaaagcgcaattggtggtaacgcttatcaacacagcaaagtgaaccagtggaccacaaatgtagtagaacaaactttaagccaactcaccaagctgggaaaaccatttaaatacatcggtaatggagtcttgtttcttttatatttgcgggatggttttttaacactgatcagaggggcatccagtaccagaaacaacagctaacgtggctcaactcaaggaaggctcctggtgggagtcggtcgtgtgtgtagtatacgttagcgtacgcttgaccatttggctgctggtacaattgcagatcgtatgtgaagcgggatcttacaggaggtcccatcagatgcttttagaacaagtgaagcatagaggaagtgtggacagcccccagctgacagtggctcaacttagaatttttcaactttgatggatttaccagggtattaagtgcatttgcaacttacattttcatatattgttgatttatgatgggtttatgggatgttgtaagtcaaggagcacctataatttgtcaatatagtgagacaaggcaatctgtccctataatttttatcgagaacatcaaccacgtggagctacatacattgtacgtttgctaaaagtggacagaatgacatttgtgttacccagtagacttctctaacaaaaatttgttttaacttaagtgacctgtgtaattatgcagaagaatggagctggattacacacagcaagttcctgcttctgggacagctctactgacggtatgattttcattcatgtttgtgaagttttgttgtgtgaaatatatgactggaagtttcctatctttgaatgcaatgcatgtttatcaccttttaaaacatttaataatagacttgccaaggttctttgtgtagcatagagatgggtacttgaatgttggccttattgtgagtaaaacgtcgtcccccagctttccctgccgtaaatgctgctctcttccctcccgcagggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttgtggcactttcacaatgtagaggaaaaaaccaaatgaccgcactgtgatgtgaatggcaccgaagtcagatgagtatccctgtaggtcacctgcagcctgcgttgccacttgtcttaactctgaatatttcatttcaaaggtgctaaaatctgaaatctgctagtgtgaaacttgctctactctctgaaatgattcaaatacactaattttccatactttatacttttgttagaataaattattcaaatctaaagtctgttgtgttcttcatagtctgcatagtatcataaacgatttcttcatagtgagtggctacagaatctatacaaccagaccaggcgcagtggctcacacctgtaatcccaccactttgggaggctgaggcaggcggatcatgaggtcaggagatcaagaccatcctgtctaacacggtgaaaccccgtctctactaaaaataccaaaaattagccaggtgtggtggcgggcgcctgtagtcccagctactcgggaggctgaggcaggagagtggcatgaacccaggaggcagaggttgtagtgagccaagatcgtgagccaagttcccgccactgcactccagcctgggtgacaagagcaagagtccgcctcaaaaaaaaaaaaaaaaaaaaaaaaaaaattttttatatatatatatacaaccaaaaaaaaaaaagttctgctgtggtcctctccatgatgtactcattttacccgtgggaccaggatcctgacggctctgctgggttctggttagattcctacccctcggcatcacacctcccattcttaagccctcctcttctagaggtgaaggggtgggaggtgggcaaaccaatttctattctcttagccagagagctctaactcacacttggcccaaagctgtaacaccttaactgttaatcctgtgttctctgtagggctcacaaattgtcttagtacttcagagcttacaaaatggttttcacaatcattcattctgtgtcttcaacaatttgcagtcatttaaaaatctcagaaaatgtgtttggaggttatctgattggtttaaagtcacacatccaagttgggagctgggcccaaacccacgccttgtctccatcttgagtgctcttccccaggccacattagacatggcaataaagatacctccgtgcctgcctgctgaaatggaaaagccctgccgttgtctccaaagccgctttattaaagcatttatgtctgcaaggccaaattaactccacacacaaagagcaaacaaatcaagacacatagaagtgaatattaaaaatttattaacatttcccagaaaggtagtgtcagaattaagccattcgcaaaagacgaatttgccataaacaaacattcacttttgcctgatgacagcaacactgtgatggggtggcactgtgccccacggacaggtccacaactgaacacatggctctatctctccttttgggcttaaagtttagtgttattttattttacaaatatttacagtcattttgtaaaaaggcagtttttagtagcagaaaattcttctgttttatagtatggtatcacagttactagcgtatctccaatgtcaaaccaagataaacagcatcacaagatgtcacagactaatacaacttccctttggccaggggaaaagatctgtatctttttttttttttcttcaaaagtctaacctctaaggcaaccggtttctaaaaccctcaaaatacacaaatacactttcatgttttaagtctcatcttcactaaatgttcagacacatccgttttaattatcccttttatgagggtctgtgtttttcctgtgataaaggattcaggaaataatttaccacattataatctatttaacataactaccctcagtaaatagttcataaaatacttgaggctggtgacatttgtcttgtaacctgctcatttagtgggttgggtttacaaaatgtatctaagcttttattgcaatctgcaattatgtacattaacaaccttacaaaccttgaacatagtatatatatccccttctctagcctttcaaatggggcttaagagagagaaaatggcaccacttcactgctataatgatttaataataaatcaagcagacttatcatccacatggataacgaagctctccctagggaaactgaaatacctctggtcatcttccaggttctcctagactggaccagtatttaaaaaatcccaaagatgat

SEQ ID NO: 17313 - DNA, 119762 bp, Human
cagttggacatagagaagggtttatcagtctgccttttattcaaagtcttagatccccaggctcctggctgacttgcactgttggaactaagcaaaagagattccaagaagatcccacaaggatctcgtgttagtccattttgtgctgctagtacagaatacctaaggggggtaatttacattgaagagaaatttattgtatcatggttctagagtctgcaaattccaagatgagatgttggcatctggcaaaggccttcccaatatgtcatcccatggcagaagggcaatgagggttagaaggagcaagaggtcaaatttgctgtctcaggccctttttatagtggcattaatccattcatgaggatggagcccttggaacctaaacatgccccaacattgttgcattgaggattgaatttccaacacgtgaactttgggggacacattcaaaccgtagcagatcctctccattcatcctacctcacctggcacgtaattcacttgcaggctaggtggggagacaagagtatccacagccaagaagcccacagcttcagggacctgtgaacagaagtggaccagataggggatggcaaggaggaggtcagcacaaactgtctgcagggtgaggtagcttcattctctgcagtggggacatgaggtagggatcggggttcaggcacagggtctgactgttttataccaaagcaggacagatggaagtcagaggtggacaaagacttttcctgtcacctgtgactcagtcacagaagtgcccaaattgtcttctggtctgaggacagcagaagctcaggatacctttctagcaggtagatacagggaatggtgtgggatgaggcagaggtttgcttcaggttctcatcaaattccccagatctgaagccagcccctctcaggcctgaacagaagcacttcacctgtttatttcttgaaaagccactctatgttgctgcttcccacttttagttctcagaggtggctttcctactgtccagaagacataaacttctgttttccctggagtcaccttagcttaaactcctataatcttgttgaatcatccctgtgtttggctaaaccaggctcctcatacccacgttccagggtcacacaggtaacttggcttgctgcttctgggggctctgaatcccacaatgccgatccaccacctcttccctgctgccactagtctcctggggtctagcctcaacagcttccaccaaggacacactgcattgcttaagagtgtatttaaggtgcggcatttgtgatgctagggaggagccttcctgacttaatcacgtagggggagtggggaaagaagtgggtatttggaaggagggtgaggtgggctgggaatgccaagaaatggtagtactgtgtggtgaatcaaagtgggtcttggaatcttcctagcttttcttttcttttcttttctttttttttctttctgactttttatcttatgttgtcactcaccatgttttgttttcctcatctgcaaaatggattgttgtaagcttgaacaggaatcatgcataaagtactgagcacagtgcctggtaccttgaaatcactcaatggaagtttcttattatttgccctacacccaaggagtaattggggccctgaaggaagacaccccaatttgccgtcctcccagccgccaagcctgatagtgcactagggaggctgatgggaaaataccgtgcagaaggctgaggagtggggattctggggcgggactctttgaagtcctaggtgacctctccgcccaggcacccgccctccccgggcctgggctgcagagctgcgggcgggggcggtggccctgcgctgcacccggcctgcctgcgcgtaggcgggcgggcggggctgcgcgtccgggctcccggggctggtaatatagcggctcgccgaggcgctggtgcacgggggcagcgcgcagcaggccggcgggcaggcgggcgggctggctggcaggcaggactgggatcgaggcccagaaaacggagcagcgggcaccagggaggcctggaacggggcgagcgccatgagcaacaaatgcgacgtggtcgtggtggggggcggcatctcaggttagtcgcggctgtgcgccctccttcctcttcacgcgctcggacaggtggctgcctgggggagacgcggggggcggccgtggggcaggggctgaccctggagtccccagactgtccacgcacgggcagggctctagtgggtccagagcgccgtgcactgaaccctcctttgggggcaattttgggtgcgttcccggacgcagaggccagaggctggaagcctgttgcagctctggggccagactttgaacttctcccccagaaggctgctaggccttcgcttgctggaattttcgaagccagggaaaaggggtggggaggtggcacaaaggtcagtcatttgctccaacttgacctggacactccgcaccctcgcttagagcaagcatgcaccacatcgtattgttgtcctggcgtcaggaaaacgaccttgaacagaagaggttggagcctggccaatcgattgccaaagactttccaggccctcctgattctttgaggttctgtgattgtcacggatctaacttgaggctgcagtgtctttttggcaaatgcctgttttcctcttatgcctctcgcacccccactccaccccaccccactcctagcgcagggtggccaagctgcagctttgctctctggcctagcccatatttggcaaggatggggacagacactaccccctcagccacacggggctgtgtacataccaagggcaccgaaaaatagaagccagaagaagggatgggggtagtggtggaacttaccctctgtggaggatcaggcagatcctatgggatagggtcaatgggaatcaatgatgctctcagcacagcctgtttaatggccccctgggcatgctttggcccacctcctaacgctgcctagtacttgagcagtaattaggacacctccagacccgtggatgcattgtctaagacttgccttaaggagttctcaagtggcctttgggaagtagaggttggccttgctccctgccaggagggcaggacagagttgttctgactctcctgtggctggagaaaaaaccaaggcattggatgtttggtgctgaccatggtccagtcctcctgcctctgctccagcctttctcccctttgggtgggatctcaggctaccacatctgtctagcaggctctggtgagctcgcccatgccaggccctgtgcctggtgttgcaggtacatagatgcgtaatcacaacatgctgaggttggccaaggctgtgtataaattcagttttctttcagtatttttgacatcttctctcctagaggaagttggacttaaaagcatacctacttaggtgttttagaaaatattactaagtgcctcttgatgctgccttgcatagcaccccatcttacagaagctgaagtttctcttttcaggcccccgaagtcattttctcactaaagtatgcccaatggattcagatttttctattttcccttcatgatttgtccctttctgattcatactccacaccttcaggttcaatcacattactcatgttagactcatctggaaaaggtagataagggtttaactatttttgcaagcagtggtgaaacctctgcattcatcctcccgaactctgatcaaaacaaggtactgatgagtagatctgacttttctcaagaacattccacggaataggcattgttctaagaaccaagaaagcagccttccaaggcccagtcttactcaattgcttcatctgctacatggggataacaccagttagtcactgctggattacagggcaagtgaaacaatgtgagtaaaatagctttgcagagtctgaaatatggcacaagcccctcaagagttttacccatttattcagacaataggaattgagggaggctgtgtaggggattcaaaaatggatcatgttgttcttgccccggaagacttgtcaattcaagaagggtgatgggatactcagacaatacaaggtagaaggtggtgcgtgccatgggaggggtccattcattgattcattattcattcattcaatgaacatttacttcctgttccacattttgtcccaaaagaaataaaagatgatttatacagggccattgttcctggggccctcacaagctgatgtggaagacagtcaagaataattactactctttggcatatgataggtgctttaatagtgcatataaaaaattctagggaaggtgattggagagaacatcaaactctgtctgagaaaatctaagaactcacagagttggtgacatctgaactatgtcttcaggaatgaatatgaattcaccaggggactagatgaagaaagcatttttaaactaaagagcagcttgtataaaaccacaaatatgtgaaagaacatgctaacgtgtaggataacttaagaacttcattgcggagagttgccagaggggtctggtgggagagaaagctagaaaagtcagttgggatgaattatggggaggcttgtatatcagaaaggtttagctctttctgtgatcaatgaatagcactgatgattttttattcagagtgccatgcatcaaatggcgtgtgtcacatctgatggtgatattagcaaaaagagggatatgaagaagagggagagaaggttttgggaaaagataggacgtctagagttggaggttctgggaggacacccagggagagaaatctagcagttggaatgaaattggggttacaaatgtgtacgatagaggttttagtagatgaaatggccaaaatcaagagtgtagtgtgtagaattttcgaattagtaggtgaccaacacaatgatttatgtttaaaagtctctggatttgactctgcgttctaagctttgttaattattaaacttgggacattctggcaattccctgataatttttaaagctgtcagcaaattttaatcactccctttgggataaacagagacatactgggaggatagctggttaatacataactttcttttttgatgttttaaaagttccaagatagttgtagactaactttttagaaatgtgtatggtgtataaatgagtatgcactgaaatctcttttacccaaggggcagatcatctccagagacttggcagagcaatgacatctcccacatggaactggacagcagcacgttgcatctgtcccgcgtctctcagttttagtgtttgggtgggtggaaccatggaaactatcttttgcaattctggaatagttcttgttcaatccccaaaataaaaactaaaaaaggcaacttgaagcagaaacaagaaagttttggccagacttaggagaggagatttggtcatttgagggtggcaggcacttgtttgagatccctggaagtgttggaaccagacttccaaattgtaaccaacacctggcaggtgatctttgtggcagggagagcaagcctggctgcaggctagtggtactggctttggcagggaatgtcagagatggctcacaaggggttatgagttgaggtgtgtggtgggcagatgtggcccatatgttaatggcaaagcctctttctcacctttggtgaagaaaaatggagaacttccctgggctcctgtaacccacttgaatgtcctaaaaaataataattatatagatatgcctgaaaatttgtatatcctagtcaaggaaagaatacacagaggtaatacagcaatattaaaagaacatacgatttatcttggaaggttgagacgggaggattgcttgagcccaggagtttgagaccagccctggcaacgtaatgagacatggtctccacacacacacacacacacacacacacacacacacaaaggctgggtatagaggagtgcacctgtagtcccagctactctggaggctgaagtgggaggatcacttgagtccaggagctcgaggctgcagtgagctatgatcatgccattatactccagcgtgggccacagacaaagactgcctataaaaaaagactgggagggggagaataggcttagtgtcaaacacactagttatgaatctcatttcttatgcttacctatgtggaaccttaaaaggtacataacctccctgtatttcagctgcctcatctttaaaatgagactcataatgccttcctggccggcttgtttcaaggattggaaagaatgcacatgtaggaccataaacagtgatcacttcggctttggcttataggtgccttactctacctttttggaaatatatccttgtttgtcctgtagagtttttcaatctaagggagcaaaaacaggcatttctatgtaatcacttcttttcaccaaccaataatttttctggatgtgcagcatagataaggtggcaacaggacgccatgtatacatgtgggcatcaggagagactcgcctgacttcagcctcatcctggctcagccaattcctttatccccccgcaaggggcctgaggaactcaggctcactttgggctctgagacccactgggttccgcttcaggagaaattctggaagtcttagatctgtacttcagcctcacctcaacctggctattattccaattctgatctggtcttcatttcagccatttgattcctgtcttaactacaatagaagataaatgcattaataacaaatgatattatttatttaataatattatttaataataaatgataaaaaggtagcatatcaagcgttatctacatgctgtacaaggtgttaggagcttgattagaatgacaaaagctctgtgaaggttaagaatgacaaagccttgttctttctgcttgattctaacacccctgggacacagtgttggggccggttggtgggctgtgtgagtagagccagttgccactagagtcacaatttctaggcccccatgtgtcctcagaagtcaccagggcaggtttaaggcttggcttggcattgacaatggtcacaattttcttctcctctgactgggtattgaggtctaggctccctgccatacattcaggggcagtggtggagcataggggttaagagcatggtgtctaccctggttccaccactaactagctgtgccaccttgggcaaaatagttagttaaccttcccatgccttacttttctcatttggaaatggggataataatggtatctatttcacaaagtggctgagagaattaaaggagaaaatacatgtagagtgcttggaatgtggcttggcatttggcaggcacacaatagatattgatgattattgttcatcaggctgacaaaatgtccactagcaactagtggtctgaagtgccagtgtgccagcttcctcactgtcaaactttgggctgaggaagtggtttgtggctgtgcatttgaatgcactgacacacacacacacgcgtgcatgcacactcggagaacattagcctgtaacagagattctgcttccaagccctgttttcttggcttgtatatgatttactaacacagatgatgtgagaaagtcagcagcttaatttaaacaaaaggctttaactctaattattttaatatgtattttaagagataaatatgtcagaaactataaatgcaaaacatttgtatacgaagaggaaggaagataacacagctgttaaacacaaagggcattggaggcctgggacttgggctcaaatcccatctgttcccctaaatgtggagcttgggcaataggggtggcaatagtaacaggttagtttttttgtggagttcaattacagatgattttcatttttttccattttctgtaatttacagattttcacaacaaatatgtattatttctgcaactcacgtttccagaaacaccatactcttccctctccaaaaaaattcctcaaagtataaatcaccatgatggaatgtgactgcatctttcatttatatcagtggcttttcttcttaaaaatatttgagggaatttttgttattaataagtgtggttattggccaggcatggtggctcacacctgtaatcccagcactttgggaggccaaggtgggtggattgcttgaggtcaggagttcaagaccagcctgaacaacatggtgaaactccgtctctactaaaaatacaaaaattagccaggcgtggtggcgcatgcctccagtccgaagctacttgggtggctgaggcaggagaatcacctgaacctgggaggcagaggttacagtgagccgagattgtgccactgccctccagcctgggagacagagtgagactctgtctcaataaataaataaataattaataaataaatgtggttattaattcttcaatttatccttctgcaaaagatgccctgctagatatcaaaagctctttcaaagagcttgtctcttcaatttgtcttggtacttcttcagccaagtttcttcaatttttcttggtacttgaaaagcgggtgagtgttcctgggctaactcctagaattctcaataaatgttaactttgttatttgtacaagtcactgggcagtactcaattgagggcaccctggaatcatgcaagatcgaatacccttgaagggtgcaaaagtgagccaaattgaggggccacgttcaggtgtaatatgtgtctgaagaacgagtgttttcagccccacaagagaatgctttggaaatttgctcaggttaaatgtgtaccattgtgcttttgcaagaatctcattcgctgggcttaacttattagtagtgtgtctgcataaaagttgttatttcccctaagaggaggccataatggtataaaattccttcctgattttgaatattcaaggaacaaacttagaagaccaagctaaaaaatactttggtttaatagaatcattggtgactgaagacggaagcatctttagagttttacctactagttaagatcgcctggttttgcatccaagaaaaagcacatttagagagtgcaaagggctggctccagacctcacagccccttcttttgaataaaattattgtcctggaggatgagccctcagccttaggagaaaatgcaaacagaaggacaacctgatcaaatggtgctgggtgagaggttagaatcactaatactttgaatgcactatttctactttctgttttcatgctcacaaaatggatccatctttggcctcctctgttaactcagtaaataaagatacagaaagccaagtccctgttagcaatgtttcctaagtcagcatgcatttatttactgaaggaaggtatagaaaaagagtaagactaagttcccagcctcaggaaacttaaaatgcagatggagacacaagactagcacatacatgcaataaggaacaattaaactaatgtataattgaattctgaactgtgggacccaaggactaagttagaagaatcattaaagaccccaggagttggagaaggtctcattaagggagtagaatttaacagattctgaagaacagtccaggtttgggagggtagagaagagagaggctttaaagatgagaagaatcatttaaatcatagggccagagacttcagttagcaggtgatctttatatttacaggacagtagaaagtccagcttgtctagaataaaaggaaggggagacatgggaaggaaagttagtaggaggggggcaggatccaaaaacgagcaattgaaaaacaaagtgaaaagttaggttttcctgtggtaagaaatagggagccattgacagtttatactataaagataaggtggatggtcgtgtgcctgataaccagggaagccaaaacatggatagaaattcaggaaaggattgagaggtgatcagctgattataatgtattgggttattctgaatgcccaagggaggtttcaagagaaatggggatagaaagaagggaagaatgagtagaaggaggtgtccaaagttgcacttggctttcttcactgtcttgctggcagcctatccagaaaagaagtatcacaaacaataattagttgtaatttaatgaagttgtaggcactccataaaacatttaccactgttactattgccacctatattttatttttgcaaacttccctccaaagttttatcattgggattgaaggacttgactgtatttacattttttcttctttaaaaaactaaaaacagagattttcttcccaagggctgtgacccagtttactaaatgataaaacgtgtatctctggcaatctcaaacacaaaatgaatagttcatcttatttgttatataaaaactgtcggccgggtgcagtggctcacacctgtaatcccagcactttgggaagccgaggcgggcggatcgcgaggtcaggagaccgagcccatcctggccaacatgaagaaaccctgtctctactaaaaatacaaaaattagccgggcgtggtggtgggcgcctgtagtcccagctactcgggaggctgaggcaggagaatcgcttgaaccagggaggcggaggttgcagtgagccgagatggcactactgcactccagcctggcgacagagacagactccatctcaaaaacaaacaagcaaacaaaaacgaacaaaaatgtcatttaaaccttttgttttgtgagagaggggcaccatcagaaaacatcttcaggtaggtctgacctttcaaatgttagtcatcttaccatagtctccatttaatggcatcttaaatgtcatatactatctaatttccacttcatatctgaaatttgagctcttgatcttatgttatgcatctcttagctaggccatttttaattctactctcctcctcaataacatttatcagaattacacaatgatgaaaatgtcctactagatacttagttttatttgctctccttctagcctaaataatcgtcccttttgcttaacctctccaacatttttaatgattcttttaattgaatttggaatccttacttcatattttgaagttgggctactttttattgctgtgatcccagtggtgtgtgtgtattaaattgtgtattgataattatgtctttagttatatctcatttctttgggttattttccagttttctacattaaagaaacaagctcattggaagagcttttgttatccagcaaagcatcttttttcagaaggataaagttaagaattaataaccaatttagttaataaccaaaattacttcaaacatttggtaagaagaaaggccactgatagaaatgaaagatgcaatcacattccatcttgatgatctacagtttgaggacattttttagagaggtgtgagtatcttttttaatagcatgaatgcagaaataataaacatttgttgtgaaaatctgtaaattatagaaaatggcaaaaagaaaatgaaaatcatccataattgaactccataaaatatttaccactgttactattgccacctatattttctttatgcaaactttatgttgtatttactgtacttatttgtatcccctttaaaaataaataccaacatgttatgaatgtttacctatgtcttaaatgttttttcatgattttataacattagttcatatgattgtatcacaacttgttgaatcaatctcctattgctgaacatttgtgtttttttcaaactttctgctattttcaacaaagctgttatgaacctaaattgttgtacataattctgattgtttctttaggaaatttccagagataaatgttagaaattcttttaaggcatttaataattatagcaaaattgtcgcccaagaaagttttaccaatttaccttatgatggaattgtaataatggacttcttagccatttcaataggaaaccaacatttcctccccacccaacgatcccccagacagtacagagataatcaagattcttcaccagtttgtagtcgtaatttaatgaagttgtaggcactagaaattaaaaatatcttcagttttgtaacattttagtggtggcaagtaagttttgctctctgtaacatgcaggaaagctgttttttgcaattactacgttatgcctaccattatctactgggaacatatacttttatagtacttttaaatttattgggtaccatctagcctgtgcttccagaagtttgccatcattaattagataactgttgtgtttctatgcagaaaagaaaagaaaatagtcctgtaacaaaccattttctatgattaattatttttacccatctagataaaacatgagtatagcctttgttcacagcctattgtaacagctgatcaaacagctgtttcatgttttacattttaatttcctctgtattttgcattcaaatcctgtgatagagtttaatttatttaggaaacccataagatatagtcgactgtttcagaatagcccttttatgctgtgccagttagtggaaatcaaacagcccttgttaagcaccgatgataaatacacataagggtgtgcactaaaagagttgtcctcgtttcatcaaatgtatttccctatgtcattgtttctgcagggagaaaaagaaatttgttcattcgttgattcagtcattcaataaacccttatcgagtgccctatttaccaaacattgggctaggtgtgggaatacacagatgggtaatacatgtgcccatctttcaggggtacaccaagcagaaggaggcagacatgtacaggtgaatgttctgaggggtggtgggtgctgagaaagacatgcttatctggatcagatgagacagagaagaggaggacagcagcttcacctcaagggcctcagaggccctgaaggaggatttggcaatggaatttactggagaggtaaccagcaaattcaaatgttcttccttgaaatatagctttaagtagttggaacttaaatctatattctaatgtacatagagtgttgaaatttcactttcactctttgtatagtggatgttatagtaggctgtcccactaccttcaggacctgctgagagtgttggctgctgctggctcacagccaagtccctctctgaaagtcacccttgactgaagggagctgactaacccaggccttcgtaccctcttgcttcaatccaggataactctgaaaggccacattagcctgagagttcactgtaggactgattgatttctctgttgtgcttgcatctctcagttcaactccttcctttgcccaatcctgcttcctttcttcatacatgttgaaccccgataaagcttctatatgcaaacccatctcagaggctgcttaccaggggaccctaagctagacagaggatgactgaacagcatttttgctcagcgtgtcacaagatgttctaatcatgaagtttcagacagttggaggaagaagcaattaaagggcatgacctttcccatgttcttttcttttctttttctttctctttttttttttttttttttttttttgaggtggagtctcactcagttgcccaggttggagtgcagcggtgagatcttggctcactgcaagctccgcctcccgggttcatgccattctcctgcctcagcctcccaagtagctgggactacaggtgcccaccaccatgcctggctaattttttgtatttttagtagagacgcagtttcaccatgttagccgggatggtctcgatctcctgacctcatgatccgcccgcctcagcctcccaaagagccgggattacaggcgtgagccaccgcccatgttctttaatggcctccaccaaggatgcaagaggccggtagggcctggagacggtgcttagtctcatcagttctggataagcactctttggtgccctgagagcccccaagtaagggtgaaaggtagaggttgatcactatgctggcccaaacactctctggggaatcccaatctcttaccactctgtgtgctgattcagagctgaaatttagagcctccgatctggaagtgctcaaaatatggattccttcttttactggaggaatccgtggcagtacagccaagagagaaattatgaaacagccctaatctgtgaagactggatacagaagtttggacgctgtccatctattccaagccaccattttggatccagctcagattctgggttcttggaaaaatagtgctgttggcacacacctctattctttcccttatcctgtgaccattttatgcagcttcctgtaggatttctcacagggtgttgaaaatgctgaaagtgattataaaaaaaatggacaatggagttcttgatggataagggagaaagggaagttgtgagggagcaagctggttcatagattcaaatggagatgttaatagattggaggtctttgtgtcattaaagaacatttatattagagcaatttgagcaggtgaactagaaagataggaaatcatgattgtgagggggtgttctgtagggttttgacgatgaaccttttgatatgtgctacttggaaataaccattttttaaatgagttgcaacattttgaatcagcatgtccagagatttaattttctatgtgattcaaaaaatgatgtaagagtcagaaaaatgattttctttcattttattttctatttactaatctgctattggttttacaacagggcagaagagacaactatccatttaatctaagtttagagattggcagaaaagtccctctgttttattgagaaaggcaggaatcatacactttggggtcctaaagattctaagcaggtctctgttaaaattgcatgcaggtcactggggagctaacccctcaactgctgatttgctatgtgagtgatgtacagcaggctggggaggggaaccaaagcaaggtgctcaaactacagcaatgcaaagcagttgggagacataggcagcctttatctcccagctgtttttcttgaagatgattagaaaagcatagaaaaaagtcagagggtgtacaaaatttagcgttatttaaagtccagtgggaacagcactttgttctattccaaaacaaattataatagagagagagagatcttgtccttcccacaccccatcaaactacactttatgcagctagaccattagtgttatgataccattagcactttgagaattctgttctctgactgaaaaagaaaaagcacattgtttatggaagggtctgtaaaaggaaattgcgggctagttttcaaccctgtgattcagcctcatatatttactatctacccgaaatctttgccggcaacatgccattctatccccgtctgtctgctacgaggctatcatttagaaaacattaactgaatgcctcctgtgtgctaagtgctaggaatgaataatcaggttccagttcaacacattcacacacacacacacacacacacacacaagaattgatgtgaaattacgttttctgtgcttatttatttttggtgcatgcacaaaaatgtactttttaaatgaaagaagcctctcggtgccgtgaaagagctttacctttggacaaagttagaatggatgctaagatcactttggctttgctttccaagtctctgtcctctgctagcttttttagttttattcatgggtggtatgatattcctggccttataaggggtataagtaaaatatcatacttgccttttatgttatcagaaattgggctgcacacaggaaccgtcagtgtctgaaaggaaatcacatggtcctagttgataaaaggcagaacatccaaaatataccacccgtgtcctgcttctctccccttgttcctttctctctgatttcatagagaatgtgtccaagggggaaatgagttttctgtagataaatcagttggccagtccacagtattgagcttccagtggacaggtctgagaaatggggaaaaatacaaagaggttgagatgacagtaagtaggaaaggtaaaagcattttgcatgtagaagaaaaatcatttggggtgtgcacttgctttatttctgggttttagtttgtgatcagaaaactagcagaagctgatgaaaataggaaagcatttcttttctcctattgtgttctttaaaaaatatatttcgccaaacagatattttataaaatctggcttccttccccatagataaattcctttgaaaggagtctgtaggtttaaaggttgcttcagaatacatttaaaattaatctttaaaattaaaggcattagtgaattttaaaattccattgaatatatgtttatgtgtaaagatgtttgaatactttttcttagggaaaaaagggattttaaaaaagaaatattagcacttagaatttaaaccagcttttaaatgatacatcctatatataaattttagcatcatttttcaatatttttaaaatgcaatgaagatctcaatggcaggtgaaaaatgatatctgcaagtgattttttaaatgggagcttattcaattttgtaattatagctgtatgtgaagaacaaacaaaatacatgtgcaaaatataataacagcaatatctgcctggtatttctaaaggactttggttacatataattcttgtacgcatgataagaaaaggaatgttaatttttaactcaacaaatacagcgttcctataaggtggtctgtacagtatattggtttgtataattcacacattaagtgaaaggaaagaaagagatgaggagtggaaacacttatctcatactcttgtctagttgaatattgttttttccatctttgacatttgaattttgtagtacagtgcagtatgaggtgtttaaagcctataaactgttatttaactaatactgttttctaaaatactttccatgatctaagaaaataatttctagtttcttgggctatgtattaactgggcattctaaaacgtcacttctcatcactcccatgatagtacaatttcctgcttccctcctaaatcgctagtgctccaccagtctcctttgccagctcccttcctttgcctgctccttcttctttggccaccaatgtttccggtttcaggaagtggaaccatattctggccaggtttccagccaagagtcttgacatttgtagcagacattgcagggatcctaccaaatctccttggcacttattttcatacacatgaacttaaggcctctgtctgatgcaagtttttgcctgcaggctttctctggccactggagctcctcttggctcaaacccaggcaggtgagcagtgcgggtggggctaatgccccccgaaaagcagccatgagtctgtgactaacatgatttgatggataagtaacccatcttcctcatctcttaggatagctaaagtgtgttccacactgtctcccagatttccccacagttgcccacagtggtaaccacttaactgtctccatgccccttctggatctggtgttcctcacgtggaccactgtagttcccagagtctgctcatttgtgtcccatcattcggtctagcccttctccagtccattctgtttttctattatggtaaaatatacctaatgtacaatttactgtattaactgttttaggtgtacagtttagtggcattaagtacattcacattgttgcacaactatcaccaccatccatctccagaaccgttgcatcttctcaaacagaaactctgtacgcattaagcaataactccccattcccttcttccccagcccctggcaaccatcattctactttctgtctctatgcatttgactgctctcagttcttatatgagtggaatcatacagaatgtgtccttttgtgtccggcttatttcacttagcataatatcctcaaggttcatccttctagttcattcttacaataaaggaagtacaacttgtgaattgggaaaaagcagattggatattttttagtcacaaaacatatttattgtcagaagtgaagcaaacaaagttgttcaaagacaaagctaaatatttgtcgaacttcacctcattcctgccctcctgaggtgacctgtgttaacagcctggtgtatttcctttcacacgtttctcctggaagggcaatttttctaaaatgtaaatctcatgagatttactcttctgcttcagatctttccatggccctccattacccccaggataaagtctgaaatgatggttatggcccagaaacactgcagacctgaacttggcctacttcggatgccttgtttcccgtggctcttcctagggcctgtagctacactgatccactttgaagttctcgaataatctgcaacctctggcctttgtacctgcttctgtcacgtgtagtcttcctagttctcctccctcccacccctgacctaggtaacttttgatcattcttccaaatatattttaaaattcacttttaggggtccttcctcttgtctgacagacctgtgtgaactaccttagcgcctgcagccagaaaaaaaaaaaaaaaagcttttgggcaaagagtcagtcactgtagttcaaataaacaatggttgttcgtagaagtgaatgaggagggaatatgggtataacatcgacaatacctgctacaacatttttcatgaaaacctctgaatcacttgaaaaagtaatgacaataatcaatcttattgagttctaaaattttatcttcataagatttttaaataatagctttgttgagatattattcacatacaattcacccatttcaaatgtacaattcagtggattttcatagattcacagggtcttatgatcatcaccccaatgtaatttttgaacatttttgtttccctaaaagaaaactccacatcccttagcagtcattcctcattccccatcaccaccgtcagtccctcagctccttacaaccattaatctactttctgtctctagatgtttgccaattatgaacattttatacaaatagaatcaaacactgtgtgaccttctgtgtctggcttctttcatttagcatcatgtcttcaagattcatccatgtggtagcatgtatcaatatttcattcctttttaaggccaaataatattctataatatgggtgtgccataatttgtttatcttttaattagttgatggacatttgggttgtttccactttttggttattatgaatagtgctgctatgaacattcttgtacaagtttttgtgtggagatatttttatttctcttcggtatatacccgggagcgaaactgctagatcataaggtaactctttgtttaaccttttgaggatcaccctcttaagattttaaagtacgatctgcagtgatttactgaatgtcacatagtgcaggtacacctacaaagccatcattttgtgctgcctcctggatagagggtagagatgcctggattactgggttgcctgtgtctctcatatgcttttctgagatggttggtgctgggagagatcctttgggaaaaactcttagcctgttcagcttctttaggtaagatgctgtcctgaggctgacccagttctgtctagttctgacccagttccaaacattaagtagagcatccatgtaccatgccaagccatacccttcccgtcctttaaaagctgactctgggccatcttgagtgttgaaatcaaacctaaacctcctctatgtagttaatcccaaagcccaaataagatatcatattggcaggaataaatccactcatcaaagtttatccatccattgtttgaggtgattgtttcctggattgtaggtattcctggaaaataatgtgaaacaaggtaagcttccaggaatgaaatgcaaactaaatggaaattaagacacattcataaatgtgtctcacaagaccaatgaagctaaaacatttatcactaagaaaatgattatccaaaacaattatcctaaacagtaagcatttggtaagtaatatcatatatacgtatacagataatgtatgtatgtattgtatatatatttatatgtttataaaataaacaaaatgcttcacatgaaaactccaactagagaaaatacgtatatatttaatgtgtgcatatatgaaatgcgtttacttacatgaatatatttatatatacatatattttgacattatgtttaacatgtagtaagtattctccttagcctagagttacagatagtgatgccaagttcagtcccttaattgatgaacaataattatgttgtattcatcagtttaaaaagcataatataaacaatgttattaaattccaagatttacactgtaatctaatagagatgtattggtggtgttaaaacagcaattaaaagaaatagctccctagccttgaaaaaataatatgcatctttctctccatctcccaatctgatcattagcttgtaattgaagtaaatttcataaaataccaagtagttgactttgggatggcatttctatcaatttacttgtatccattatttttctgaaatagagaaggttagtagcaatatcaaggaaggtggactgtgatttatagagaagtttgcaattatgtgactaagtgcttaatttagggatctcaaaagtataaatttacaaagaaagttgatcagttgtgaagataattcaggaaatagtccagtaaatgaaattgcccatgtagtatcatgactaaataggggttttttgactaattctgggtgaattataattatttttataagttcattttaaagacctaccatttaaagacaaccactcttaactttgggtatatattttttccagcctcttgaaaatatattcatttattttggctatgtgtgtgtgcgcacacgtgtaccacacatttatatttgctgtcatagtatagacacgattttttatcttttcacctgattttctattataagcattttccatattattacagtctttatgaacataatttaagtaacgtcaaataaggcataccaaaacctacttaactaataccagactattggacgttatgtattatgtgtgtgtgttgttattataaatgacagtgcactaaagatattcagaaataattactttttcccatatttggtattcttccttaggattgactcataaggtaataattcctgattttaaaatatggacagtttaatgtttttgacagatactgccaaattgtttttctcaagtactttaccaattactcttccagccagctttgttttatcacactgttgggatcacttaatagcatcctttgctttatcaatctttttcaaattgagagtgaatgtggtattctaacttgggaggtgaaaaatggttatttttcatttttaattgctggcaaagtcaaatatttttcttgtgtctcttattcaattatattttctggggaggttatttttatttcatttttttgacttgtggttagaatatggggtggaatccattcttctttctgaatgaaccagtatttgtttatgtttctgaactgggtaggtaactcataaaagaaatgttttagccaagctgttgagttgcattctctgcctttaagagcctttatgcccttccggtgcatgtattcagtgagtgtcccaactacttccagtgtacagatttcacacccaggtgtatggccaatagccacagggtgagtcctgatactgcaattaaagtggcctaatccaataagtagacttccttgaacatattttctgtgtggtattagtgtatgtaaaatttgtgatgtaattctactgctttcacaagcctttagtgaaactcagtggattcaaaactcacttttcctaagatgactcccaaatctctatattttcagctgagttaacaaatgtgaaaataaataaatgtttattggctttgaatttgggtcagttaagagagacaaggaattggggaagcatgagataacagagggacatagtaagacatagcactaagaatttacatggagaaccccacaaaaatacaatacagggtaaaggaaataaagactcatagaatcaaacacaaatccagagggacaaagaagcacagaagaacataatatcattgcataattttctgggtttagaattttgtcactaaagacatataaaatgttgtaattttgcaactgtgggtgtaaggggtgacattgccattttgagttggcaaaggatttacttctttgttcaggaggaatttgaaaagtagcacgggtttctcaggtctggattatacctctcttcaacatgacggaattggccgttcctgttacaggaggctttacctttcaacttgggttgctgactcatttgacaattttggaccatgcccacagcttgagagtacagagagtttgttcaaagtacttaaaaatagacacacacacacacacacacacacacacacgtttcagctggagcataatgctaaaatacatttaaaatgtaagaaatttctgtaagtagctagtacagcattgaataggtatctttcttttcaataatctaacagtgcaggcctagaatttaaataccccagaggaattaataattaacaaagcccttaaaataactctttaaaatttcaggtgcttacatgacattcagcaggggaagcattttagttttctgacaagtgcccaaaatggtgttactgatgaaaggagactgtagattttagacatgaggcagataagctatggagctaacattatgctattgatatttgggggtctgttttgaatccttgtccaggtggaaaactacccttctgcactggtactttaaattttttccttgacaaaattttgtattaaatttgtagttaaagaaacatttggaacagaaaatttgggactaaaaattttggaggataactgtgatcaaacggtcaccttgacattaaaatacgtttttgatacatcaggttttgaggaggaatgcattctgatggccgcactagcgttagttctttgcaaaatgagttgctcttcatccttctgaggtgaattaattgactcgtctgaattctttcctgccagcaacaaatatttgttgaggatggctacatgccagatattctcccgggtgctagggataaagcaggaaataacacacgcaagatctctgctttcacagagcttattgtctagttggtggaggggcagtcacataataaattaccaaatggaccaacaaaataaatacttagctacctacaaagtactgctagtgataagttaatcgatgaaaagtaaaataggatgcagtaatgaagcagagtcaggaaatacctcttccttagagagaacattcaaactgagatctgcgatcctgaacatgtaactatcagggaggtgagcattacagaatgtgggaacagttactgtaaatcccctatggtgggaacaacccttgcattttcaaggaacagaaagaaaaacaatgtggctgtagtagaatgagcaaggggtggtaggaaagacaactaagcaagagtgaggtcatatggggccctgtaaggtaagttacagggtgggactcctgtttgcaatggaagtcattagaagatttgaaatacagaagtgtaatgagttggattttgttttgaaagataccctgagatgtgtaatttgatatcttagaaaggcaagaattgaaggagttgcaggcttttgcagtagtccccaaaaaagacgatattgtcttagaccaagatggtattagtaagaatgctgagaaatggttgtattcaggtgacactgacttgctgatgtattgactggaggccagagtggtcaggaagaaaaagaatcaaggacaattcctggattttggcctgaaaaactgggtgaattgtggtaacattattgagatggaaatgactagagaggaactgatttgggaaaggaaacttaaaagctctgtttgggacatgttatatttgacatgattattacatagaggaaggcacaattaagtaggcagtttacatatcaagtctgaagtttcaaggctatggaactggttgagatcacctgtgaataattgaaaaaagaagaggctcaaaagtggagtcctgggactctccaatgtttagaggttgggaagagaagaatccagcaaaggtatttaagaagcagcaatgagttagagaagaaacccatgaaagcctgtggttcagaaacaagtgaagacagtgagtcaagagggaaggcatgaccaaatactgctaagagaacaagtcatttaaggacaaaggtgtgcccaccagatttggcaatatgaaaatcactgacatctttgacaagagcagtctcagtgaaatagtagagatgaaagtctgactggagtgagttggggaaatagagatggggaaatagatgcaatgtgtatagattattatttgaagaagtgctatgaagggattcaaagggaaagggaggtatttgaccacatattttttgaagatggaagataccagaacatgctcatgtgctcatggtaatgatccaggacagaagaagaaattgatgatgtaggagagaaaatatatgattagaggatcgaagccctgatagggatggaatctaaaaactgcatggaggattggcttccttaaagaaataacacttcatttaagtcataggaggtaaaacttcacatacaggcaaaggtgaaggtgtgtgtataggcgggttgattatggaaagatgaacaagttcttttactttctccataaaaatgaggcatgatcatcagctgaagagggatggaggtcggatggtgtcatgtaggaagtttaagaagaaaagctataaagcagccattttgtacaatggaaaattaaaaactattgctcaaaaatatgattcatttaattgtaggaaggcatctgtcaaatacggtggccttaatttcagaaaagagatgttaaagtattctttctgatgatgattaagcaaaagatactgctcagattgctccaggtttatgataaaaatgttatcgacagaaaaaaaacacctggatttgtttttgatttggggcgactgagcagatatcctaaagtgaatggggaaactagatctcagccacaggcacccctgtaataatttgcccaaccagcaataggtattttgtttttctctaaatctttgcactagtggtaatttttgtatgccaggtcttcttctgatacttgaccctgacaactgcattcagggcgtctcactgagatctatctagaatgattctttttttaagtgtaaattatctcaaagggattgaacctaatgaaggtataagtaatttcatctgagttccatttgaggccttgtcttcacaaacattgccagcttgttttggcttttgttaaatcgttttatcaaaccacgagctgcgttttggccagacatggaaaggtttcaacctatctccaatctgttggtatgaaataacaggaaaagcctctttccaaaaataatctgagtgaaaagttaaaaattatggagctccccaaagattcttgcgcatttagatgcaaactctgcctcagtctgccttctcctagcctgccatggtatcctccttcttatgggtgatctagtaagggataaagtatttactgctgtggaaaatccacactagggagtcctaacacaccctggggcctggttagggcaaattctctcgaggaggtgacacttgaactgattttgggggatgaggtggaattacatgaaatctcagcagaacgaaggcatggaaacactaaacagcgcagagtgtgagaagaaccacaatgaggggaaaggagttcagtgttgccagagtataggatgtggagcagaaggaaagaaggctagagaggttggcagagggcaggtcttgctaggtattgcagggtattatgggtaagatgggatatggaacctgaaagactgaagcatgaagcccaggatttaggtttgagctcctagcccaatgactgggcccaagtgataaggcagaaggaaacctgggaaaatgagtaggatttgatcatgtattggttcaggtttgtcaatgagccctacattgtaaatatgcttcacatacaggagggaggaatttcctcagtgggttgacagaaagccctgttggggaataggaagagcctccatctttggagccatgcaggcagctgacttgaatctgcgagggctcaggaaaatggtgtctgtctttgctgaagccacattcctattaatggaatgaggcctagatggtagcttagatcagaggttctaaattggtagcccatggaccaaatctctcacaagttggggctggctcgccagtgttttaaaatttgattttagtgtttttattcagctctccaaagcccttgctgttggctattgttttacacttgcccatctcacactttacctactattctattcagctccctgggacttttgggtttccaagtcctaacttagaatgaaaaatgaagacgaaatcttgccagaacctcaatatctctgactccgagacaagtccaggcaacgtaacttccagaagctagcactcgggaggtgggaggtggaagttgttttcagagcagcaagaaattggggaggaaattctttgcagccatattggcagggtctttcctttctcaggaaggcagaggccagggtgggatggaccgcaggactccaggaaagtgctttggggatgttagccttgctgcaagatttaattttatgtggagatgatcacagaataggtagtttgtggccaggagcagtggctcatgcctgtcatcccagcactttgggaggttgaggtgggcagatcatctgaggccgggagtttaagaccagcctgaccaacatgaagaaaccccatctctactaaaaatacaaaattagccaggcgtggtggtgcatgccggtaattccagctacttgggaggctgagacaggagaatggcttgaacccgggaggtagaggttgcggtgagctgagattgcgccattgcactccagcctgggcaacaagagcgaaactccatctctctctctctctctctctctctctctctcttcttctctctctctctctctctctctctctctctctctctctctctctctctatatatatatatatatatatatatatatatatttaaagaataggtagtttgtgttgaggggctggaggaggatttctagtcaatggtgtttgtgatgggatgctagcggtgtagaaaggccctggatccaatgcttttaccttaaatgaaaaaaaaaaaaattaaattgtagttaaatggaacaagagaaaataatgtgaaagtacagttgacccttgaacaatacaggcttgaactgctcgggtccacttacatgtggattttctctgtctctgtcacccttggggcagcaaggccagctcctcctcttcttcctcctcctcaacctactcaacatgaagacaacaatgatgaagcctttttgatgatccacttccacttaatgaatagtaaatatattttcgcttccctgtgatttccttagtaacattttcttttctctagcttactttattgtaagaatgcagtatataatacatatatcatacaaagtatgtgttaatggactgtctatgttatcagtaagactaacggtaggctaacagtaattgagttttgggagagccaaaagttatacatggatttttgactgtacaggtggttggtgtccctaacccttgtgttgttcaagcgtcaactatagatataagcagaaggtaaaatctactataattgaatttttaaaacactaggatttcagcaggttcttttatcagaattaaaatagttgaggggccaggtgtggtggctcatgcctgtaatcccagcactttgggaggccaaggcaggcggatcgccagaggtcaggagttcgagatcagcctggccaacgtggcaaaaccctgtctctactaaaaatacaaaaattagccggtcatggtggcgtgtacctgtaatcccagctactcaggaggctgaggcaggagaattgcttgaacccaggagacggagattgcagtgagctgagatggtgtcactgcactccagcctgggagacagagcaagactccatctccaaagaaaaaaaaagttgaacgctgcttaaaaaatcatgtagagttttggggttttttttgttttatatttattttttatttttgctttttcaagggcaaattcctgaatgctggggggagatgctgtttctccatggtgatggaagacatgttttgtctcttcagatttaggctgctgccagagacaccgactgtagactaaagcagggagaattagctccaaagcactgggacagaggccatctgcttgtgaaagcagcttctaagaaaacatacctgttcccctatcccttcctgctccttcccacaggtcacttgccttaatggtgtttgccaagagagccatacctttgccttttctcattgcatttgtttatctgtttcaaattctgtatgcaaggcccattctaattgagtcaataaaataaaattctctaggagtctggttgttgtgttatgacttccaagagtccttgtttttgttctctaactacagttatgtattgtaatacctttatgttgtctctctattttagcaggaagggtgccactcaatccccagtgacagatgaagaagcagttgtagcttctgcattgctgtttcaatgatacctttagctctggataatgcccctggttatgtatgttgctcacagcttcagtgcacatacacacatacacacacacacacacacacacacgtatatgctagacactgagcatgagtctgtgccctcctatgtgggtcaaagtctatacactgttaggatgggactgtacagttttaatatgagtctttcgggttaggctttaagaaaagaagaagaatctgcttggcttgtgattattgaagccaatgtttttaatgccagaactgattcttctaccacttgtgacttctgtttgaaagttgctattaaggtcttaaggaaaggattttcccacacacatgtttctgaataacctattctggtcaagttcacagtcttgacctgccaccatgtttcatcctacctggtctgggtgcccagagacctggagcatctgagctggcaggatggaacttcttgtgcctgggcgtgccaaaacttttccttgacactgagaaagacaatgaggctctgaagccagaaaatgtctcggtgagttgaatagttacataaatgtcattgacaatcattgaattttaaagtagagttgtacacttcaaaaatgctacagaatttgtatgaagcataggacttgtataatcttggcaatggctgattttttgatgcgaagttcaggaagctttatttctcacttaagttctagattattcacatcccctcattattatttactgctctgtgttgaatggagaaaggcctctcctttattgtgttgcttacagctccaaagctggaacttagatttcattttattttactttaagttctgggatgcatgtgcagaacatgcaggtttgttacataggtatacatatgccatggtggcttgctgcacctatcaacctgtcatctaggttttaagccctgcatgcgttagatatttgtcctgaagctctccctcccatttcccccacccccttacaggccccggtgtgtgatgtttccctccctgtgtccatgtgttctcattgttcaactcccacttatgaataagaacatgtggtgtttgtttttctgttcctgtgttagtttgctgagaatgatggcttccagcttcatccacgttcctgcaaaggacattaactcattgtttttatggctgcacagtattccatggtgtatatgtgccacatgttctttatccaatctatcagtgatgggcatttgggttagaactgagattattaagctttgtcactatgaggctcacccaactgcttacttaacatctgtttgggctaatgccccatttcccagttccaacaggtcactcgaaatagtgcttctgctaggaactccctctctgctctcttaccctctcccaacttctcagcactactgacaacataagaaaaaccattctggagtggctacccagggttttcatcaccatgttatccccaaataagcccaaataagtttaattaacaatgaagttagttagtacagaagataacatttcccatgtatattagttggctagggctgctgtgacaaaattccacaccctgggtggcttatgacaacagaaatgtattgtcatatggttctggaggctggaagcccaagatcaaagtgtttgcagagttggttccttctagggatgtgagggagaatctgtgccatgcctctcccttagtgtctggtggtttgctggcgatctttagtgcctcttggcttatagaggcatcactctatctctgccttcattttttcatggagttctccctatgtgcatgtctctgtttccaaatttcctccttttacaaggacaccagtgaggttggtctagggcccacaatactgacctcattttaacttgattacctctgtaaagactatctccatataaggtcacattctgaggtcctagggggttggaacttcaacatatgaattttgaggcatactcaattcatttcacaacaccatgctacccaaatttactcatctggccatcttccagctcctcagaggtggcagcacactttcccttcctccttgctctagctgagggcattgcccccgggcctatctttggtgtaccttttcctgggtgatcctgccagactgcatggccagaaaaaaaacaggggaactttccctgtccttttccttctcatttcatcgttttcttttcttttttttttttttttttttttgagacggactctcgctctgtcgcccaggctggagtgcagtggtgcgatctcggctcattgcaacctccgcctcccgggttcacgccattctcctgcctcagcctcccgagcagctgggaccacaggcacttgccaccacgcctggctaattttttgtatttttagtagagatggggtttcacatcgtgatccgcccgcctcggcctcctaaagtgctggggttacaggcgtgagccaccgcgcctggcccatcattttctacttttctgtaacttggctgtaccaaatgcacttctgacctccccaggaagctccctttccaaatatctgtagttaacctcttccttgccttcatggtgcctcttctgttaggctttgttcttttctagaggcacatcatgttttggatatcactctaaggaacccaccaccagttttagccacattgaccaaattgaccagttgctttaggtatgtttttgaaaaaatataaggagaactttccgccctcaagagaatcacttttgtcccctgttgcccaataagttattaaagactaagaaattatataaatggtatatagtatctttatggaattatgtgatacattaacttggggctctgaacaagtccagcggaatagaaaccagtttaacttttttccagaattctcttactatgaaatttttcaaagaattatacagtcaacactcatataccaaccaactagactccacaattaatgtttttgctatatttgctttattccagtatatccaactatttatccctctctccatctatcaatctctcttgatttttgatgcatttcaaagtaagttacagacatcatgacatttcatccctaattatcttagcacatctattcctaaacagctttgtttaaatcagcatttccttatcgtatatgaacacaaataaaacacatatttttattcacatctattggtgacacccaaattttaagctccacagggcagactttgggctagatgctttggggtcataaagatactacctctgtaatgaaatctcagtttatgtgacattgccaccctgtctcatttgggttgatcacagactgaaaggggcctaatttaatcaccttattttatagatggggaaagtgagtcccagaaaggtggggactcttgtctgaggttatgcagccaggaggtggccttttgggcataaagctttttctactgaagggcaaagacctggcttcttcttgaccaggtggtgttttcatttggttctggtccttgcacactgctgactaccttagtctttgtttcacaggttcttgttggggcagactcactaggctcctagaagatggaagcagggccaggctttggcatcactgaatgactcctttgtaattttatttcttccaatcactgattacatcacactcagacttcttttccttggcacctcccacatgttgtcctctttttctagatttcctaatctgtcttctcctttctggtgaaaggggatgttttcctggagacgtagtcagcatactctatagcagacttctaaccctcttcataacatttgtaacacccatcacaaaatgggatctggggagggggtcacccaaagcagaaatggtagctcttcagttttatattcttccttaaagatgcttgtgattctaaaaattgtgttggtaatccgtaggagggctactatcatagtagtgaaatatttcatcctcagatccccatcaaagaaatgatcatggtattttagaataactgagggagtacaattgcttaaggaaatggataccccatttacctcaatgtgattattacacattgtatgcctgtgtcagaatatttcatgtgccccataagtacatccacctactatgtacccataaaaattaaaaataaaaaaggaaatgatcatggcatcatataattatcttctatacttaaaaaaaaatttcttgagagtatgtttatgcatacacacttcctctaattcccagaaggatttgaggcaggtaaattaaaagtttaattttatttaacagtttttataatgaataatatagcacacaaacccgagaaagacaaagctataatttctgggtttgattcctttattcatgggagactatgttgagataaagcaaaaacaaattttgtcttccacgattacaatacataaaagatagtcaactcctttcaaacaacaaagggtagagacaaaagcttggttattaaacaagactcattatgattgctgacattttagaaaatgcaatcatttgcatataaactgtgatgaagagacaatttttatggttttagacatattctgaaagaccttggaaggcaatctcattctagtatctcaaagcggctgcatctggagaaaggtttctatggcaacttatgaaagcttgatgttttttatctttttcaagagcataaatcatcccacagcctgaggcttcagtaaaggtctccattattttacaagctattgccatttgttttcatgttatatattttgattgtcttagaggaaagagagcaaaggttatcatgtttccgagaaggcttggagtctattttctctttttttcattttgtgggacaagacatgaataacatcattctaaacattgcttctcaatgatcaaaatgatggtacacattgcaatatttggtttatgtcacgtgttgtttagattttccccaaaattgtgactggtgcattctcaggaagacaagccagtttgaacttaaggaggaggaactatttggccaaaacacctcctaatatgtagttcagtagagatgccctggagaatgctgcactgttccacatgcctgcaaatattcctctaatgatacagtcccaaggctttggacattgatagactccaggtgatttttatcaacatattctttccaagaaagttaatttaaaaattctgattttaaaactctgcatgtttcaagaattttgttttagcaacatggatctctgtatgttataggaggtaataaggctgaggcaacacccattaagacaaagaaacagaaccaggtttcagacctagctctgccattgctaggtgtataactgtgagcaaacccttgaatctcttcgaacctccttttactaatccgaaaaataggagtaacggtgccagattcatggcattattgttaaggattgaatgcgtgtgagtgctgggaactgtgcaatgctgtacaaatgtaaggtggttattactgttggctgactgtctttctttccctttgaaaaagtcaaaagtttatgttaccatttctggatgaccagaggaaatcagtttcagtatgtcttaagtattttagtttcttatactgtatttaaaatacttatacagacactgatcactacagccatttatttatttatttactcagtaatcaaatgtcacccctgtagaagggtattaaataaattcattcaacaaacatttaagtgccaactgtgtactagcattgaggagacaaagaatagacaattaaattcttattgttcaggaaataaaagttttctgagcttcaaggccacagcataagctgttcaggtggtgccctgcccaagggcattcggctgatgaagtagaagggggatgtaatgcagtcccccactctgccagccaagccgtttgcatgcaccttgtgagctgcattcgcctgaatgaaggacatgttttggaaatttactagccaggagtgtgtgccttcttgcaatttacacgaaggcatgcatgaatgtgctagcagtggccctgatgcttgtatgatccgtgatgttaaagggaagatttgcaatgtttcactgtgaaatatgatgaaggctgctggcgtgcttgttatctggagtcagattgcctgaatttgaatactggctctgctacttgctagctgtgtgacctttgtgcacattacttggcctctctatgcttcattttctacatctgcctgcctcatagttattgggaggataaataagttcttaaaacacatagaatagcagctggcacacggtcaatgctcaaaatgttagctgttttcagtgatggctttactgttcagggtctccttgctactctgtgttgaaaagttcaacaattaacatctaaattctacctacaaaaaccacttttcttttatgaatttgatgtcaaattggtgatatttatctccttacctcagatctttttggtgtgtgtttgtgttaaataactagaaagtattctcttcagagaaatcagagaattccagttatttgatgagaagatgacttggtagtttttagaattttctcataaaaccactgctttgtcagagtgatagaggtgatgagggatgtttgcatattattggcttttataatcccagcactttgggaggccgaggcaggcagatcacctgaggtcaggtgttcgagaccaggctggccaacatggtgaaaccccatctctacaaaaagtacaaaacttagccgggcgtagtggtgcttgcgtgtaatcccagctacttggggaggctgaggcaggagaatcacttgaactcaggaggcagaggttgcagtgagccaagattgcgccactgcactccagcctgggtgacagagtgagacttcgtctcaacaaaacaaaacaaaactaaaacaaacaaacaaaaatgacaacaacaacataaaaaaaaaaacagtcccaagggaatgcctatatagtttaccaggattacaatagggattctttgaggtatagtgaatttcattgtcaattttggttaacatgattccctctctctcttttcataactttaaactgggaaagagtccttatgtagtattttcaagactattaactttgcattttaattttttaaaaaagttttgttaaatatcaaattttgatatgaagagtgtgaaacagattgacaaagccaagcatgaggcaggtggtgattttgattttacccctccctttgtattctggctcctctaactgcccttaagacactgtaaagagggcacttctgtgttactgccactgtgtatttcccagtctcccacagcatctaacttgggccattttcttggcaaaaaactaaaagtgcagaatgctaatcatgttgtacatcactgatttctaagtatttaaaaaatttgggtgtctactcgtaattgagattgtcatcacttttatgaaaccttttccaagtaaacttctcagaagagagatgcaatatttttataatttcataacatcaaatattagtctaccattatttgtgtgtgctgtgctatgattattcatccaagggcctgtcatggggacatagggactgcttctgaaagtgccaaattaccatttggttgtgagattataattgatactgcatgttaaattcaagtgtcattagctttttaaaaagatgaagtgatgataagcttgctcctaaattgtttgcaaaggttaaatatctaagagaaaagctggtatttaagattcttatatttagtcagatagtagaatgttttaagacactttatatcaatcagtgtatatgtagagttactgtgtttttaattttttgttttttgtccaagggtagtggctaagagttcaggttttgggttgaactctgactctgccacttactaattgcgtaacctacagttaagtcactgaatgtctctaagctgccattttttctttttaaaatgaggataataatattcctcagcattgtggtaaggatcagttgagctttttgtgtaaagcgcttcacccagaccaaagtgcttcatgagttatgatggtggctgttattactctgggcattttattttattttatttttttaagacagagtctcactctgtcacccaggctggagtgcagtggcatggtcttggctcactgcaacctccgcctcccagattcaagtaattctccctgcctcagcctaccgagtagttgggattacaggtgcccgccaccacacccgggtaattttcgtatttttagtagagacggggtttccccatgttggccaggctggtcttgaactcctgacctcaggtgatctgcctgcctcggcttcccaaagtgctgggattacaggcgtaagccaccgtgcctggccagtattttcatttttaacaaacaaattgttaattgcattatatcaggagattattgcataagtgtttaaacagtggcgattacattgtctaatgttttaaggcaaatgtatttctgctactgtatgatttttttttgcaatagtattgcactcaaaaattttcatacttcccagaggatataccatctctcatatttttgtttctatggcaaaatgtattaaaagttccaaacaaccaacatagaaaagaactcttgggaaataactgtctttaggtgagggatgctctgtagagttcattgtttgcttagtccttgagcagtcaaactattagtccttttatcagtcatcattgagggaggtttttgagctacctcttctagacaatcttaatcacctcttgaccagactccaactcagtttcctatgtaccctaaaattccctccttctaaattgcagtgacttccctaagccactgatatttggaccaatttttttttcagatcaatttctgtcaattgatttccaacaagcctcttgactaccccctatgaacattagtgagctaaattgtaagttacttccagcaacatatttttgtgttgccctttttaaagatatttttgtaattttctgtttataattgtttaaggtacatgagcatagagaactccgttcaatgatttgataagtcttttgtttgttttaataactgtttatatttaacatcagatattattgggtaaatgcatttactaaaagacggtaccttttgtggaatataaaatgctagtgtatacaagtaacgatgtatttccttctgaactcttttgtttaagcctcagcatgctcaagcggtttatctaaattcagtgataatagctgttactatggctgcatgttatttcatttgttgaattgatgcttggtaagaaaaatgtcattgaattgtttgcaattttgaatttaaatagaagtggttctttttccttatggaggtaaaattaggaaactggggttataaatcctgtgccctgtattcctaaatcagggttgtgcaatgcttgtgtgcactgcatggggttcatggactttggaactgttatcccatcagcaactggaagcattggctctgcccccggtgacagggatgggaagatggattaactcaaataatgaaatgtcaaatcagcctctctataaaatgggaattcctcctttaagatcactgatagacggtgactaaagccttggcttttcattatggtttttaatgtgggctcatattttatgttatatggattcttataaaccacaacatataagtgtgtcttaaaaacaagctgatccaaaaaagtgagaaatatcttttgaagtgtaatttctctttgtagcaaaaattggaagatgcaatcaatgaagaggatggccatgggggtccggggaagacagtgttgtataatggctgtgaatacagatgctgcagttaaactggctttgtcacctactccttatgcgaccttggtcatctctttgggcttcgattttctcggccataaaatgggaatgtcaacagtacttatctcatggggtcgtagaagttcattgaattaatttattaaaacacttagaacccagtataataagagtattagctattttataggaatctttttaattttgcagtagtggtgtctaaaagtcacagaactattatttttgaaagacaagatagaagcggttttatttacgttgtaaggcatgagagcatcttggcatggccttaatatttggtctcataaagcaaatgaggaaggtaattggaactgagcacattcagcccactcatcatgggaagagcaccagatttctgttctctgagaaagcttgctaaattctgtaagagtgcttttaaaaaaaaatacagtattttaagagctttgaggtcaaaaactacatccaggatggattagtaccccaaactttatacatgtactccacactatgctttgtcctttgtcaaaatgtattgaactctgcattaatggatgtatcagtcagggttctccagaaagacagaaccagtaggatacatagaagaatacatttactgggggaattggctcccaccatcacacagatagaggagccccatgataggctgactgtgagctggagcatcagagaagctggcttagtctggaagcctcagaaccagggaagctaatggtgcagctcccagtccgaggccaaaagcccgagagcccaccggaggtcactggtgcaagtcccagagtccaaaacctggagtctgatgtccaaaggcaggaggagaacaagcatcccgctccagaagagagagtgagggcagagacagagagagtcccctcttctttcacctgtttgcccctgcagggccccagccgattggattggatggtgcccactacattgagagccggttttcctctcccagtctgccaactcccatgccagtttcttctggaaacaccctcacagggacacccagaaacaatgcttcacctgccatctaggtatcccaccatccagtcaagttgacacctaaaattaaccatcacaatgggtaaagtttattgcatgtacatttacctcagtaaagctgtgggtttttttaagagctaaattcatggtggtgagaatgtaataggcattcactaagtatttttgactaaattaataattaaattagtcatgaatggaattatttcattcttcagtgatgggtcatatcaggaaatccagatgcataaggggtcgaattttacctccttgattttgaaactttacgtcaacttctaaaagtccaactttaatagtaaatcccagttcctggcacacactttgaaggcccactgtccctcagtttaccagtttttcatatttaccctgagaatgaagtcagtgactggacttagtcctgtgtctgcaactcatatatttctcttgagcatggccttgtgttctcatttatgttatcagacatgcaatttagtcattaaaatagacattttgatatagtggcagaggatgtgtttaagatttgagaaatttactaaaaaatgaaatcccttttgtcgtttccagaaacatcagactctgggcctctattgacaaaccgtatccacttgtaagttgaatgtaacaataggcggtgcacgtgagccagcatggacttttctcattggctgttagcatgaggagcttgtctggcatccttgtatttgatcctgatgtcttactgtcttttctcccaggtatggcagcagccaaacttctgcatgactctggactgaatgtggttgttctggaagcccgggaccgtgtgggaggcaggacttacactcttagggtaaggcattaagaatccggaggacaaatgtgggactgaagctgagtttggggtttcatttttgtctttttccccaaaagtcttcaatttcatttgactctaagagggtgaaaataactctgaaacattcttcacagcctctctcccagtttgccttcctttcaattcttctgttcctttttgtcttttcatctcatgatatttggcctcatagagttaggattgagtaagagggaaatggacagatatgtgtgtgcctctgtgtgtgtgtgtgtgtgtgtgtgtgtgtgtgtgtgtgtgtgtgtgtgtgtgagacagagagagaaataggaagaaaaataacataattatatgtactttccactcctaacttcgatgcttccttcacaccaacacaatcattctaatcatacaaactaaacttttttggagagactttctcccatttttaaatttattttttaaattttattttaacaaatcataattgtattacatttatggagtataatgtgatgttttcaccatatgtatacaatgtggagtgattaaatcaagctaaattaacatattcagcacctcactttcttgacattttttgtggtgatacatttgaaatttactctgttattttgaaatgcacaatacattattattactacagttactgtgcaatggatttcaaaacttattcttcctgtctagctaaaattttgtacccttcctgtctagctaaaattttgtactcctcattccctcagttctcaccccccagcccctgataatattcattttgctctctacttctatgaattcaacgtgttttagattccacttataagtctttctgtgcctggcttatttcacttagcataatgtcctccaaattcatctatgttgtcccaaatgacatttctttatttttaaaggctgaatagtatttcattgtgtgtatataccaagtcttcctcatccatttatccactgatggacacttagggtgatttcatatcatggctactgtagataatgctgcaatgaacatgggtgtgcagatatctctttgacatattgacttcaattcttttggatatattcccaaaaatgggattgctgaattatgcggtagttctatttttagttttccatttttagttttctgaggaacctccatactgttttctgtaatagctgtactgatttacattcccaccaatagtgtacaagggttcccttttctcttcatccttgacaacactgattatttttcctctttttgataaaagccattttaacaggtgtgaggtgatatctcattttggttttaatttggatttccctaatgattagtggtgctgaactttttccatgaacctgttggccatttgcatgtcttcttttgagaagtgtctgttcagttcctttgcccattctttaaaaatctggttatttgtctcttgctattgagttgtttgagtttcttatataatttggatattaacctcttatcagatgtacggcttgcaaatatgtaaagaaaactatcattttattaattgttcttttgctgtgcaggagctttgtagtttgatgcaattccatttgtctgtttttgctttttttcctgatctttcagggccatatccaaaaaatcatttccctgactagtgtcatggagctttccccttgttttcttcaagtaattttgccgtttcaggtctcgtgtttaagtctttaatctatttagagttgattatttgtatatggtgtttgcatatggtataagataagggactacttttattcttctgcatgtggatagtccgtttttcctgcaccatttattgaatagactgtcctttccccattgtgtgttcttggaatcttcatcaaaactcaattgattgtaaatgtgtgggtttatttttgagctttctatcctgttctattggttggtgagtctgtttttatgtcagtaccatactgttttgattaaaattgcttcataatatattttgaagttgggtagtataacgccttcacctttgttctttttgtacaagattgttttggctagttgtagtcttctgtagttccatatgaatttaaggattgttttttctgtttctgtgaaaaataacattggcattttgatggggattgcactgaatctatggatcactttgggtagtatggacattttacattattaattctcccaatccatgaacatggatgtgtttttatttattcacataaactaaacttttacctgcctaattttccttcttgtttttgcttcagcttttatttttttaaaagaattatttaccaatttataaatacccttattttaattgctggttaattgtttcaattctgacactgttgcctaaaattaatgattttctatttaaacacagagtcaagcaaagcaagtttctctgcaaggaaatgccctacttccatacattcaagatctgaataatagatatagaagctacagagtattttcatttccagagagataagacatataaaattctgactcacagctcttcttttggaaggattcatcaatgatatatatctgacattttgtactcattcttttttttaaattatactttaagttctgggatacatgtgcaggggtgggatctgctgagctagatcacttggctccctggcttcagccccctttccaggggagtgaacggttctgtcccactggtgttccaggcaccacttggatatgaaaaaaaaaaaaaaaaaactcctgcagctagctcggtgtctgcccaaatggccgcccagttttgtgcttgaaacccagggccctggtggcataggaccgagggaatctcctggtctgcgggttgtgaagaccatgagaaaagcaaagtatctgggccagaatgcactgttcctcatggcacagtccctcacagcttcccttggctagggaagggagttccctaaccccttgcacttcccaggtaaggcgacaccccaccctgcttaggctcatcctctatgggctgcactcacagtctaaccagtcccagtgagatgaactgggtacctcagttggaaacgcagaaatcacctgccttctgtgttgatctcactgggaactgcagactggagctgttcctattcgaccatcttgccagccctctgtactcattctttactttgagtcatctcctttataattgaatttgtcctcagcaaatatctactgagtacctactatgaatcaggcacagtaatccccccaaaatggccttgctccacagactttacagtctctcagggggacaatgactgttgtaattgcctaattatagcttatcaaggaaaatgctacagtgagggtgggtgacagcttggagtggtgccataggaggcataagagggtaccttaccagtcttgagagccagagactcagagaagcctgaaagccttatctgttattgactgtgacatacaccgcctgacctagttatttgtgatttcacacaagccttcaaacttgatctaacccttgttgtctactggccattgtttttgccattatgtgttcctcaaatatctctttttacctttgtcgtatggcaaaatcttcacatacttccaggatctcatcccttcctactccaatcaaaagctacttgcctttcttctgtgttaataccacttacctgttccacacaaggacaattattatatgttgctttacaaggttttgcctgtgtacatcttatctctcccagttcttgaaatcttcatattccttgaaaaatacagcatataagagtgccttttacgtaaagaagctggtttagtacaattaggtgctgaatttttaaaaacatccttctttcatttatttgagaaaatttattggacaactgctataggagtttggaatactttagtgagtaaaacaaagatgccttgtgaaaattgcatttttgaagggtaagtgagtggaaagctagacaaaaaatacgcaaataaacaaaaacagaagagaaggaccatttctagtgtttctaactggtaggaacctggtttttcttagacatactcagaaataggaaacttttctactaattttttgttcaaagttcgcccctcagtcattggaaatgaaaccaattcaaaactacgtaaatatactattaaacataaaagcaatttcaaagtccaaattatgaccaaatattccctagtgctattttcaaatgtctggattaacaaatcacataagaagtgatcgttttctttcttgctttttctctagcattaggctcctcaacattcacctgaagtactgagtaaagagattcgtcaataattcacagctcacaaattcaaagcactaaaaaccaagccatgttatggtatattgtaaatgatgaggtttagaagctcttgcctattcagagttcaatcaattttgctttaaagattgatttaataactaagtcatgtgaatgaagtagagttgataacaaaatctagtttttcgtggatatacccttaagctgtatctataacttgtgaaatgtcgatttgcttatttcaggactgtcttttgttattttatacattttttacaaattttttttaattttttcctatgggaaaacagaaccaaaaggttaaatatgtggaccttggaggatcctatgttggaccaacccagaatcgtatcttgagattagccaaggagctaggattggagacctacaaagtgaatgaggttgagcgtctgatccaccatgtaaaggtaagatcaggccagactttgaaggatttgaaaacttctctatgatgtttccttacacaaattccagatcattctctcagagaatcttctatatctctggatgatgcaaatgtattttataatggtatttcagccactctgagattcattcactgttatcaaaggtgaattaggtgggaattctacctatttaggaaggttattgatgaagtggtatcttccatgtggtaaaatgtttaacaaaacccataaagaaaaaacatttgtgctttatttattaaatatctatttaaataccgggaagtcttttatgttatataaaaacctgtgcaaagtttttaaaatgctgccctagactgcacattgtaaagagtatttgcaatatgcctaatggaatattcttacattttatcattgtggcctatatatcagctaaagttattcttctttggagattgacatcaaagtggttcaagtcccagatcccgtcttttgcaaggaagcttcattgttctccccaagatttctgtgaatttactgagtttctcattcctgtgatcatttgtggctcatagttctggcttccatgatacctatgttcattcacatctcacggcctgtgactcttttcttctctttgcttatgccaacctgggttcacactcacctctttgtcctgatttttctcagaccgccacaagcatatgtgaaaagcaaacgtcactgaagtttgcttgggtttggtgggcgggggaaggctcttaaatttgcagaaatacaaacagattagaactgaatgttggacattcattctaataacctcttagatcaaagcatcccctgaggatttctcactggtcacatttctctgcagattccagtctcccaccatgctgctggtcctcagactctcttcacatctccctgctcctctgtttttccagcatcctcatcttggtccacaaagtcactcatgttctctgacaatcagacagtcacctaatctgggccccatccaggagtcccatggaagaactggcggaggttttcaatttcagtctttcctctctcatcttcacttgctcctgtgggtggaagtaagcagcacaggaacttattcctcactggtagaaaacatccccttagaagacagaagaaactagcaacggtcaattttgatttatataacaattttgacatcctcatattatttgtgagtgataatatcgaaacaaataactgaccataaatcatgaaacatttaataaaatgggaactaagcagttacttaatttggtataatgtgggtaaaagttttccttaatttataaataaatgttttggttgaccttcaaattttattttatattggccgggcacagtggctcacgcctgtaatccctgcactttgggaggctgaggcgggcggatcacctgaggtcaggagttccagaccagcctggccatcatggcgaaaccccgtctctactaaaaataccaaattttattttataagcctttccaccttccttccctatgtgtctaggagaaaaagagacacatgaattagaaatgaaaatctaccatggtgataatgtgatttgttgaacatcaatcaacagttcttaacaccctttgttgggttctttgtttttttaaatgtagattttcttgaccgatttcttatgtcttattctacctgtaaggcttgcagagattgacttttcagaacactaggatctttaaatttctccagacaaaggaaatgaccagagattatattcacttgcctgtctttgtgtgtgcagagattattgtcagctcagagctatgtccaggatgctttgttttttcctgacattaagtcccttgtctgagagaaattgctgagtcatcaattacaggaatgatgttacacttaaatgatatttcacagtgatggccaaatgtgctgctttttcactatttccattactctatgtgcagttaggaaaatacaagtagttaagcagtagtccttacttaatacagggtaaatacatatgccaataatgctctttatatttaaaataagtcttactgctttttaattatgacaaaagtaaagcatgtttattgtaaaaatatgattagaaaatatagataaactagaacaattaacaaaccctttataatactatcttgagaagatcactctaaaatactctcttggttcgtagattttcgtattcctgtattgctattttctgacctctgctggaggaaatgggaaataacagtgcattttaagaaattgtatgcacatgcatatgtgtatatgttttacgtagtaacttactctcaaattaattatcactaatgagacaaattgaaaaaatactgatgctgtaaaaaaaaggtttctgcagtcttgacaaaggtgccaatttggcctcctcgtgatcagtcacatgcagtgaagagctacatgataatacataatgacgaagaccttatagctaagaagtccttctcaaactaagtacttgttctctaccatctccacttccatgtctttgtatacgtcatttttctcatttttgacctgtaaaaagcatcttggatggctacattcatttccggaattattaacaagaacttcgacattctttctcctaccacatactagagaatgtagttgagaaatttgcctcctgtgtcatggaaagcagtactttgggaatttgaacactgccctctattacctattttaataactactgtccccaagggcaaactacagttcatgtaaatagatagtatatttgggccttgtttcttttttatcagggaacatgcatgtatttcttaatctgaatcttgagagtatcaagtatgctacttgccatattgtcagatcctgctatcaaagaatctgcttttaaaattttttatgtggctgataatgggaaatagagttttatgtgcaaccttagtaacattaagctaaggaacttggatatactggttgatattgaaatgaatgaagtggagctacccagaaaaggggaagggcacagtagctcatggtggactaactacccacatgaaagagtgtgtttcctcaagagaggatgactcccaatatcaccagttctgtggtagttgtcatagaaatgttcttctgatagaggaagtgtgttcatgccagctccataataggcatctttaaacacctagtgtgctgtgatgaacaggcctctgtcttgatctgatctgtcagacatgtttgtatctactgagtggcgttcatttttaatgctctgtagatctgttatatgttgttaaagtagggttttccaaagacaacttcataaataaaagatgtgataccaaactatattgggatttaattatcagtgagaaagggatcgcttcagctcaaatctatataatttagaaggtgttttccttacttctggagtcagtgatgcagctgttagtactttacaattattgttaaacatctactgagatttttgatccgttttacaaataggcatgctaatttccactggtatagtttagaaggcagctgtttagatgtcttggaagtaacttgaaaaaattgttttcttttaaggaatatttcataattaaaaagaaaaagataaaaacaaaaacttcttaaggaatcctgctatattttgacttatgtttctttctctttcattgtgtgtttacatgtgcatgcgtgtatggttgtctttgttcttttgggctctttgaagaagttggagaaaattctaaggtttggtacaatgtaggcaaataaaatttttctgtttcagaagctttcatcagtctgaaatttgaaagtaaagtctggtaaaacacccatgaaactgctctaggtctgaaggttgaactgttaagagttttgccactataaagatgtagtgtgacttaaaattaagagtccaacttcatactgatgttcatttccaaacttcagctatctggagaagctgagcaaaaggactttttggtcttaacctacttcccagtgggcagaaacaaagcttattgtcaaagtcctttttgcattgcatatggtcaaccttcaatgctaaagatgcatgcgaatgaggattcatctctcaaatatattgtctgcttgttgctgccatagctgctattgctcaaacagcctcacagaggaggaggcatttggcacaacccctcagtcttgctgacaactctgaaatccagttgaaaatatgatacacaaaatgcacacaaaggcagagaggggaaaccatagctatctatctgcgatgccatttcagttaatctctctgtctaaatggcctctcagtactaagaaacagcaacaggattagagtagaaatattgagacataaaaaatgcaaatgataattgcatttagcaaatggaaatcgtcctgttgtgtaaggtcttggcatctcctggaaatcaacaggccagaagtatccagtcttctctaggtcctcaatattcccttcttcacacccctgtccccgatcctattaatccaggggaggctggatcaaagtccagaatacacttgcttctctcataaagacagaagtctccaggaacaggttagaccaactcttgtttttattcaggaacagttgcccattttacatgaacttcacacttaccatgttgagtttactggctctgtgagtttgccctttctgaagtgggcttaatgaaccttttctaccacttccacccacactgcatttcatttcttatttgtttgaaacaaatatgtcttattatggaagattttttcaaggaaaaatgtggagaatagtaattttctctctagtaagtgaaacacatttgtctagtgatcattctaaagcttatgctgttattctggaaaccaaagtgctcatttgtgttctttagagaatacaggcagatctttggcatgtaataatttgctgaaaattatgcctttgatggctgaatttggaacaacatttaggatatgagatgaattcattttccgcctccaaggtttccatttggaacttaaaatatggtacaatcagtaaacatattttctatgcatacacacacatatctggataaacttaacagtgactatggttgtgggtaacagttagttttaaattttgctgggagtggagggtagacaatgtatggaattaagttatgatagtgaaattcactaagggaaacagcgatatagattaaatcttgtgcaaaattttacagcttctatactatgtgatcatgtgttatggccaagtagtccaaaggagctgcaaagacagggggcccagctcaccaaaagatggtgactaataagggaaccatgtaacagattaaagagagctttggcaacttgcagtaccaagagattgacagaaagtgcaagatggcctgaaatgtgttagcctgccttaccatgtcctctgcagagcagcagcctgcagaaaggcttaggcgtggattcccaggctgcgtatcacatgtcctgggcatttctcttggcctctgcaaccaccaagaagtaataacaatggtaacattactcttatatggacatctagaaactaccaagtgttttcaatctcaaataactataagttatttagttgtgaattagaagtattatccccatttaacaggtgaggacctaaaggttaaagagattaattgcaaatgacaagatgcaatggggtcagagcatgagttgaggcttttgggtgtcaagaacacactgcaaagagctcactctctgctggttggggactactttttgtcatttctttctaagcctcagcacccacctggcccgcctttcttcttgccaaacttatactctcacatattggaaaaatcgagttcaagatcctcctttccttaagattttccacagttgagtacagttattccactagctccctccaaagccctgtatcctcctcaccttcctgattattctttataaaagtctgtttttaagtaggataaacagttttctgttacttgtacatcgagacttcataaacagttgactcttggacaatgtggaggtcaggagtgctgaccccctgtgcagtcagaaattcttatataacttgactccccgaaaactactaatagcttgctgttaattatgttggtaaacacatattttgtgttaaatgtattatatgctgtattcttacaataaagtaagctagagaaaagaaaatgttattaagaaaatcataaggaagagacaatgtttttactattcgttaagaggaggtggatcatcataaaggtcttcatcctcatcatcttcacattgagtaggcagaagtagaggaggaagaggaaaagtcggtcttcctgtcttaggggtggcagaggcagaaaaaaatccatttggaagtgaacctatgcagttcaaacctgtgttgttcaggggtcaacgttttgtgtatgtgtgcaaaaaagcaaatgtattacaagtaaatgctaacaaccactgacattctaacagtttctcttagagctttaaggttggtaagtacttggttggccttccagattatccagatgattgtacttgatgaacaagtaaagctggcgacagttttacgaatgctttatcattttttctacctgtcagtcttgtggcacctgtttgctggctacatgcagcctgtccactaagacaaaggcacacacaattggaaattttgtcatagcagcattctagttcagaatatcaccaagtgataaatcaagaattcaggaatggatcagctttagtgaaactggtgttgaacataaaatatatctaaataaagatttaaacaattggaagaattacaatcatagtaatttatgtacatgttattaaaaatgtttatatggtaaaaattatataatcaacaaaatcagaatgtagagaaggtgagaaaggaagacacataagagaggtaacagctgcttaaatctttcatagcaatgaatcaatctataccaaaattaatagttaataaatagttaataaattaattagttccctcaggaactaatatctcttagggtgtgtgaaacatctatttgaagtttagcacttccttcagttcatttcagtttatgtttcttccatcaaattgaagtatatttccatcatttaaaataacagatataatatgattcaattctcatattttttattttctctttgttcttttctccctccttcctttcttccttccttgttttttgtttccttcctccctctctcagtcatccatttgttcatttatccatccatagcaaccatccatccattcgtctattcatttttctatcttgtagatgcttatataagaggtctggaatgtcatacaccaaatgttacggctttttttttgtttaacttgatggtacaacatggagtaattcgttgctttcttctttgtactttttagtactgccaaaacattttataaagagctcctctcatttttatttttaaaaatgtaattagacacagactttactttggaaagctcatgatctatgagaagaggttaggcccagtgtttctagcagatctctgtgcctctcacctgcctaggcagcagtctcctgggttacatatccattaacaatcaccaaactgcttccagccaggcttagtgactgagcttagatcctttgagttcagacagtctagatcccaaagcagctgttctaatgcagaacctcaaaggcccttatcctggtattattgtgctgcagaattttctgagtgtctgacacatacacacacacacacacacacacacacacacacacacttaatcattgaccttttgtgtgtccttggccacgttatttatgcttttgtgttttgatatctctgttgaaaagaaggatgtttgtacctgtcccacttagtattctgaggtttaaagaaacaagatgttaacaagacactgattaacatcattgtcacgaggctgctgtgatacactgaagatcctaagaacattttgataggaaggatagagtttctttactttccttttggaaacaaacttttctaataggttctggggattcttagtagcaagtaagaatgtaaatgatgagacaccaggtaagatgaagctttacaaattcttttcaaaagaggaccaggccaataaacttacctgaaaatattttcatgggcttcttatacactgaactgtgaactttcccccttaaaatccagtattatttttcttctgtgttattggtaggctaggagagaagcatttggctgcaactaaactcacatgcccaaacaggctaaatcgatcataaatagataaataaagtgatcttttctggctgtattaccttctaagtttccttcagttccagtcagacttttaataccctagaataggggacaatggctattactgggcttagctgagatcctttcctctgggtccctaactggccatgctggcactcttgtagagtcaggaatgtctcctcctgtcaggagacaggaggcatctcaggatttactagtctctaagaaaacctaagtttagagaagtaaaatacattactttaaaaatctcttttgatatatgcgtgaaatctaaaagtattaaaatagcttacaacagcactgtccaatcaaaatttaatatgtacattgataattttacatttttctagtagccatattaaaaagtgaaaaagatgaaactaatttttataatacattttatttaacccagtatatccaaaatattatttaaacttgtaatcaatataaaacattattaatgagagattttacattcttcttttgtactaagcttttaaaatctgatgtgtggtttccactcacagcatatctcaattcggaccaggcacacagtgctcaatagcctggtgagtggctactgtattggatagcacagggataaaaggttagtagattctgtgtatttttgcaaacattgctaatccatcttaaatttgttaaaaaataaaacccgtacaaaacatatgtctaaatctcacaacagagaccctacagtacatcgcaaattaacttcctttattctgttaacttcaaacatctgtcatcacaaagaatccagaagtaaacaatgagtgaagttccttatgtgcctgctacttcctaagggcagggaaactttgaatcactttgagaaaactatcctaggtacacagggagatgctatgtcctgtgattttaatgcattagaaagtgagcaagctggaagtaattgaggttgacgtggtcagagagactaccctaagagaatgctttgaacacttacaaaaaccttaaaagacactgcgcaataaattcaagggaataaatttatggagagcataaagacttttcatatagtgtcattattttaatacatttgctcatttgtccctgtctatgactaattcaggagaaacaatagaactgtcccaaagtgccataaatggtgattatcttaacatacagtcagagaaaagtccaacaagtaaagagttgtagagaagataagcctgtagttcaatggaagtttatttactcttttcatcttttagcacacatgcttcatgcaaaattctgagcaaaagaactgcagagcgacctggagcattttactgctgacatttactatttccccttttttaaagttggcaaatgttaagggcagttgctacagacagcttctactcatgtgcaaaccatgagaaaaatcacaattcatagttacctataatttaggctctcaagggaaaccaaattcatatgtacatggtggctcctggaaattctgttccaaactcaatttaataataacaataagcaacatcttttgagattttgatagatacaaagcaccattctaagcagtttatatgcattatctcacttaatactcagaaaagcctgatgatttttattatttctccttcacaaaggagagcattgaagtaagtacaaggcatttacacaacttgctcaagatgccccagttggtaagtgatggagtgggggctttaaccctgatccatctcactccaccatccaggtatttggcagctcagcttaggtgcaggccaacatagagattatacttaagagcagatgaagtctcaaaaaagacaaggaaaaggataagggtgctgaggactgaattgcggggcaggccctcaacccttctcccctttccgttcaggttcttgcttcctaatgctgatttttttttttgtcttatgcctcatcactgatttttctttttatctccatttgaccacctgtgacctacttgaccttccagtggaggacactgacatgaatcatctatttggttaaatcaaggactattgagagacattgaaatctctcatttcattcttaatccaggaatttaaaaaaaagtattaaagctgctcatttgagtgagaatgctggaactctgtgtcacacaagataaacgtaagaatagagagccatacatgtttcttgggtttatttcatgtttccattgcaaagtataaacataatagggttagaagaagcattgctttctgtataacttcatacttaggcagaaaggaaaatataaaattacatgtttaagggtgacctatgtggagtagatgttttggcaattgaaaggatgtcattatgatatctaataacattgatcctttggattagaaaggatgagagtccatctaaaaacaacaggttgtttttaagctgctacttttcttgatgaggccaggatagttgtgctgctgctattttagggacctcatatttcttcctgattggttccaggcatttctcccagatatctgttgacatcttgtctatgtatccaggctggagctaaggtttcttgactgtagaatcctgggagaaaaagcagtaaaaataaataagttagaaagatagtgaataaaattaaattttcatcatgacctccaagtacctaaatgatatgccccaccaatctcctggcccagctcaccctggtccagccactctggcttctagtgtgccaagtttattcctgcccctgggctattgtgcttcgaagcagattaaagatgggtggctacacattctttgatagtcttcccatggaaagggagagttggggtccatgcctcctctctatgaatctgggaggactctgtcacggctttgaccaggagaatatgactgaagttatgctactccagtttgacagcctaggccttaagaaactggtgggttccacttttgaaaccttgagttacaccatgtaagaagtccaaataccctgagactgccatactggagaagccacatgtaggcactctggtcccctgtgccagccaaatccaaccttccaaccctccttacaaaggtactagacttggaagtgaagctgtgtcagacatccaacccagttgagcctttgaatgactccagccccaaccgccatctgacacagccacataagtaaactccagcaagaaactgcccagctgagttcagtcaatccacacaactgtgagagaaaataatagagtgatgccttaagccattaaattgtggggttatgtttttatgcagccattggtaaccaaaacacacttgctattccctccacttgaaatgccctttcttgggcctcaactcaaatatcacctcctcagagatgccagagtagcctctcccacccccactggtattctctattcttaatttaggctttctctgctttattattttttatagcacttataaattatatcatgtatatcatattatacatgtatttgtttttgactactttctcctggtagaaggcaagttccatgacggcagatactttggttggaatatgtccccaaaatttatgtgttggcaacttaatccccagtgcaacagttttgagttgtgggacttttaagaggtgattaggtaataagggctctgctctcattaattgttgctgttattgcaggagtgggttagttaattgtgggagtgggtctgtcatcggagaagtggactcctcataaaaggatgagtttggcccctttccttctgctcatacttgtgatttctcaccatgtgatgccttccaccacgttatgatgccacaggaattccctcaccagatgccagcaccttgttcttggacttcccagcctccagaactatgagaaataaatttcttttctttataaattattcagtctgtggtattctaatacagcaatacaaaatggactaaggcaacaaaattatttctttttccattttgtccactgctgcatctccagcacttggctcaggatgtggcagttggtaggctttaggtaaatgttccttgtgtaaatgattgaaagaatgggtctttacccgtatgtgagcctgtcccttttagagcacaattgggcagaccctgatttggcatcactcttaggagaaaacggaaatattttagccacaagcactctagtcctacaggaaaagaagtgccacctagtatggtgtcaggaaaccaggagggtcccccacctcaacacttaacatcaccggctcccacccaaattccacaaataaagactattttctttgtccacagttgagttacagataaactggagatacagaagcaaacaaaacatacaaaaatccctgctcttgtggagcttatgtgttatctggggaggatataaacaaacaaataaaatatatagaaaaatattggtatgcctaaaataaaattagtcatgtttgattttataattgcttttcacttgcagtaacaggcacaatcaagaaatatggctaagtgcagaataaaaaaggctataaaacatggaccttcttaaatgaagttaattcagacgtaacaaaaattcatatattatgttccttgaaacttaaaaaaatgcgactttaaatttaacactctcaattctaatggggatatgagttaattttcaagtatattttagagctcaagtttagttaaccaataacttgctgaattatgcaaaaagctttggctttcaaaatcttattgcttttcccctgtcaagatttaataatttttagtaagggtttgaactttttaaccagatatgccaaatctcccaaatgcatgtataagatgttattatgttaatagcaatgtataatacaatatctgcacacattggaaaatatatatgtgtgttgtattagaaagtgatgagtgctatggagaacgggagtgtggggttatgtgagagggtgggatccaatttcaagtagggtagtcagggagggcctcactgaggaggtaacatttcaacagaaaacctaaagcaggtgagagagcaaaaaacttaaagtataataataataaataaataaattaaaaatgggtctttgggtaagagtgttccagccagaggaatgtgaggttcagaagccctgaagctgttttgtaaagcttacgtttacagcactgcaaggaaccccctgtggctggagtgaagtagacaaaagaaagctgggggagggaaacagtggttctcaaaaaacaaacaaacaaaaaacaaaactctcacctgtagattttgcacggtgtaaatacttaatgtccgatgtcaagctaccaacttaccgtccctgaaggcagagttggaaagaagtgaacacagatggttctcatgacacagtacgcacagactccaacacaatatgaggaggtcagagagagaacagggctaaatggcatagggcctagagggcaattctaagaacattgacatttactctgggtgatgtgggaagccactggaaggtttgaagtagagaagtaacatgatgtgactttcctttgtaaagtactattctgcagaacctccttcatgagcaaatagatgtgtgtgtgcatgtgtgcgtgtgtgtgcacatgtgtgcatgcgtgtgcatgtgtgtgtgcacgtgcacatggccacacatatgtctgtgtctatttcttcttcatggacggcaattcaccccagctgttactctgctttctttgggggcagatacaaaagaagaatacaaatcttttctttttttttttgagacagagtctcactctgttgcccaggctggagtgcaatggagtgatctcggctcactgcaacctctacctcccaggttcaagcaattctcctgcctcagcctcctgagtagctaggactacaggtgtctgccaccatgccaagctaatttttctatttttagtagagacgggttttgccatgttggccagactggtctcgaactcctgacctcaggtgatccacccgcctcggtttcccaaagtgctagaattacaggtgtgagccactgcacctggccacaaatcttttcctatgaagggccaaacctctttcttcatttaggcatttaacccagaacccactgaaataaaaatgacaatattaatcatgatttttagactatgtggctcactcaaccatagagcttctcatacaagtgaaatgcagcacatgtgtgaagccttaatatatcatcacaatctgttctattacttcatctcatcaattggtaattgaagtattcttaggatcctgctgtgttctctagctttgaaactcacagcatcctattcaaactcatgtacatatgtgtgagaaatgggagggctgtcagcagtcattcaataattttgaagaggagcacttcgaaactacacttagaccaacccgcagttgtcattatgacggtcattgctgaaacccactttaggtcagcatgagttagctagcaccttgtggcctgctttggaatttaaagccatcatatgagacaatatctctgaacagaattttaaaattgaagctatacataagaatggtatgggaagtagggaccttctgaattaaaagtttaattttgggtgggtccaaatggtacagatcaaagaaagagaaaatactagcacagtgaccgacttcctgagcacaaatacacaggcttgaagatggaaaaggtgaaataactgaacacaatgtcaagaaaaagaaagaggcagatgcttataaatgtaacagaagccatgaattattatataatgtatcctaaagaatttctctcctagctatgaaagaaacagcctttgcctcaggggtcttttgctaatatcttctagcagccccaagatatgtagacattgtcatatcaaagttcctcagagccttgaacaacatatgtgactgtgtattttcttgggaaagttgaaagctctaacaataaatgcatctgtaggcctggcgtggtggctcacacctgtaatcccagcactttgggaggcccaggcgggaggatcacctgaggtcaggagtttgagatcagcctggccaacatggtgaaaccccgtttctactaaaaatacaaaaattagccgggtgtggtggcacacacctgtaatcccaattacttgggaggctgaggcaggagaatcactggaacccgggaggtggatgttgcagtgagccaagatcatgccactgcactccagcctgggtgacagagtgagactccatctcaaaaaaaaaaaaaaaaaaaaaaaaagaccatctgttttagatactgagagcataggcttagaacccagaggggcctgggtttgaattctgaactcgctatttactagctgtgtgatttgaggcaagtttcttaacctctctgtgcctctgtttcttaatctaaaaaatgaaaataataataccttgcttatagggttgttgagggagataaataaaaataaacgtataaagtcttattaaaaggattttagtatgcagcaaatgtgaaaaaagtgttaaccatgatgatgatgatgatggtgatggtggtaatgatcatgatgatactggtggtggtggtggtgatgatggtgatggtgatgatggtaattatgatacttgcctatcacaatccttatttctcatacccactttctttgtgctcatgacttctcctttgaaatggcttttcaaaaagcatatgggtgtcaattcaaagtacccattaagtgaatttctttgaaaactttttcctcctgaaaataattgtttcaaataaacagatgcctctttgatattctttttatctcagtccagttggtaaagtttgaatgccctttaagtatctccagggtgtcttccatgtaaaattcacaagtagctttttggccaaacttgcctcttccttcatctgaatctcactccaggtttctcctgctgtgtcatctctcgactagtcttcagaatattcttctaatcagaatcttcccagcatccttcttattccctcaacaagtgaatctcctttaaatcaacacaatttctacactagggattaatgttcatagcaacagagctccttttgggaccaagaaaacctttctatttgtgcataaagtctcctttgatttattttaaagtggagttcttatttcaaagcattgactttctttggagaagtattctgactcatctaagtgaatcatcattttggcttgtatcactaaagaaagtgaacacttctcccaaacaatttatggagtgaaaatttggtacctgcaccagcattaatcagaggctgactttggtactggatgagttattcaatggagaagagaaaacatgttgtgcttggataaattcgaggatatgaatttctgtctcataaggctctctctgtagagaaagacaagctaattctggagacacagacttctgttacactcctggggcttcaataactttaccatggaccttgggcatgtaatttaatgcttcgtagaagcttcaattcctagtttgtaaagtgggattattaatttctaacctccaagtgttcccttgaaaattaaatatgataatatatgaaatgactttataaatatcaggtaccttcatcatttttaaaatcttatgtggtagagaacctctttagaaaggagttttttgacaatttgttttttagaaacaattttttctcaactgagataatcacatgtcctcagatttcaaaaggataatctaataatctgaggataataattgacatttaaggaagaacttgttttgagaaaaatcttttattttagaagtcaatttctccctccctctctatccccatccatccttgtatattgtactaaggcacgtacccaggttaccaagaacttttccatcttctcattactttatacatttcagaggcatcaaaagcattcggataatatttttgaaagacaaggggcgcgcctgtcatccggcacctgtgagcccagtgaggctgcagccgggataggagagtggtgcagttgttttggattagctgatctgctctctggggctggagttcagggtccagtcctggaggttcagagagggcttgctagaaaatgcaattaaacgagtaccttccatgacaaggaggtgctagggtaagcatttggggatggatttttgtgctggtaaatcccagcatgctcagtgatgctgtaaaggcgagaagctctgagctttcttctacaaagtcatctgctagttcatacggtagaattatcccagagggaggcaattgccctatgggaggctcaaggtgtgtgtagaaaggggctttgtggtatttattaaaatcataataacaacaacaactaatatccttctaagaactttgcatatatgatctcatttaatctttgccacagccctggaggtaggtattagtacctacattttacagatgatgaaagtgtcagagatgtaacttacctgaggtcatagaattagaatagtcatttcttgagccaatgctttcatcatctacatgaaagttggcaatactttttgtggaaagaaaagtgtagggatagtaaggatgatattagtcaatatctatgcatttactatgtgcaagtcactatgttgagatgtgtatgcattatatcactgatgacccataatactatcatggcattggttctattctatttacattcacattatatacagaggcccagtttgttgcatgcctgagttcatggttacctgctgggatgttgaacatcacaagctgtgctctcacctctggtatctaatatcatgtatctgtacgcaaaaacggactttttgcaagtggtttctggtgtttgaatgttataaaataagagtttgcgatgattatggtgaagctgagtgttcccttttttgtaaatgctattgtatttggttttatttctttgctgctgtacaatgaaatcaccataaaaatcactttatgtctgtagtgaaattttccaaaccataacatatctttatgaacctgaaattttacaattctttaataacagctatttaaacaagcacttttttaaatatttttgtctgtgaaaaaccacaatagatttattaattaaattagaatattagagctgggaaaccaccttctatgtaaattattggtgggagtttatgaaattcttgtagtaagactaaaagtagagtgatcttttctctaagaattgtacttaagctaatacagctgatagaacatgttaaaaatgcatggaagacaagatttcaatatttagacttgtttaagatttattggaatttggagatcaagtggactttaactccaaggtcctttcctaaataactcaaaatgtataataggagttgttgtttaggttggagacctttctaaaacaggaaattcacttttgttcatggcacaaacctttataaggacattaatggtgttttaaaattatgatctatgatgtaaaaataagctttgtcttgagggccttagttagatttgactacagactttcttctctcagtttggtctgttcacctatttgagtatgtttgtagcagctattgctctatgtctcatttcctttagcaaggttctgataagaataatagaaacaattgggaccttgccaccaatctccgccccaaaagaaaacacctcaattctcaaatgaggtcccattaagcctgtgtcagaagtttctcatgaggtctgggccaccccagagccctgggattgagattttttagacattgctacaggctgctgtgcccatttcaatggatggctgttgcagttgggttcctcaagacacagacttggaggtggcgaatagcatgttggtggtttgttagtgggtactgtggggatcaacagccattgattgttggaaggcaagaaggcaggggtggccagaggaataagtgtgatgtagttgcagtggaagcctcagctgacctgacaagggattctgaagatgagatggcccttgggagctgtcctgagtggggcaagagggccaggcctttctatcctcatgtagatagtcattggaagtgaggtgcccagagaaggtgacatgaccttaggcaaagtggattttctgcagctgggataatctctgaagggggctgaaaatcaagggctgcctgccaatagcactccgagtaactgaagtaataagttcctaatttctgaagggcaatctgtgcaagctcatcacagcatctgccacattgaccacttgggaactccactcttctctttagtagttccacgccaaactttgtttattggggcttttgcggaccttgccacctggatgacccaaaggctctggacagagaagcgtaagagtgtctggtgagatcaatagagtcatgaatcctgctgactacactttccatgaaacaacttcctttatccaaagactagggttgccatcaaggggctgttccatacacagccacatagccaggcgaagctatgaagccagccatatgccatgttataattatgatgccgtaaatctctgttttcatggacctgcctctccaggactttggagcttctggagcctggaactatgtcttatttaatttccgcttcttcagtgtatttcttaatgcctgtttcatagcttgcgctttttccattttgtttaagtgttagtagcacttaaaagtatgatgcctagatttctcctgggtctgtccgagcctgtcagtagttttgattgtcttcatcagttacccaaatacagtgttagttctaatttggtagttatcctttgcgttgtcgctctgcctaatactcttaaagtcacaattatattgaagtagagtagaatggtgatgaggtgggcaatgttggtgcctgctgttgcctgtgtgcaaggatccatccaggacttggatcttctgctgcatgagaggaagcaggagctgggaaactagcttgatgttaagcacacctgaatttgaactctgcttatcagctgtgtaatcctggcgaagatgtttatcctaagactcattctcctcatctgtaatatgagttactacacaaatattcaaaaagcaacattattcataatagccaaaaagtggaaacaacccaactgtgtatcaacagatgaatggataaacaaaatatagtatatccatatataggagtattattcagccctaaaaaggaatgaaattctgacacatgctacaacatgggtgaacgttgaagatatgctaagtgaaataaatcagacacaaaaagacagatattgtatgactttgtttatatgagcattattactatgtgctctgaatctcttctggccactaaacatggtttcaaatgaacacactatcagatatttatttattcttcaaagatttattgaatgagtactcctccaggtactgggaatacaccagtgaaaaagacaagatttctaccttcgtggggattacattccagcgtggagaggcactcaatatatgtatatatatatgaacaaatgtaccacatagtctcagttgctatgaagaataataaaggttgacgggaaaagcatctctgaggaagtgacatttaaatagtgccttgtgaatatctggcagataaatattgttgaaagagggagtgacaggtgcaaaggccctcaggcagggataagtttatgtgtctaaagaacagcagggaggcaagtgaacaaagggagagagtggtagatggggaaagagaagtacaaaagccgtgttgcccatggaaaggactttggagtttgtgtaagcacgataaaaagtcatcagaaggattttctcaagggagtgacatgttctgaattatatcttacaagactcactctgactgctaggagattctgggggccaaaggtggaagcagagagagaattaacaaagttaatgcagtaataaaggttagaactgacagtggcttggagcagggaggtaacagtcaaggagatgagaagtgattggattctagatatattttgaatttagaactggtcgttttgatggctgattatgtatgggataggagaaaaaaagaagtcaagcaactgatttcgggcaatctgctttacagatgaatggattattattgtctagcagtaaaagtaatgggggatgaggcatacagaaaacaatagaatgagtcagtgaaattcaccagactccccaaagaatcgttttggtcagtagttaaaacagagagctatagcagagagagagagagagaaaagaagaagaagaagaagatgaagatgaagaagaagaaaagagaaaagaagaagaagagagagagagagaaaaggaggaggaggaggagaggaagaaataacttctgggaggaagaaatcctacactagaagacctcaggctcttgttggtagtcattggagatggccttggaagcttctgaagctcatctactaaagaaaaatgtgtcttttgctgggaggcatcaaacatagaaatgtggatctctttcctcagggtagcctagcaaccaccagcctggcacagcacatcagcaatgcctatgtcacctattacggtgaccactccaaatccaatgccactggaatccaaaaaggaacttgatttttaaaccccttcctcttatttctctctcagaggaagtcagtcactacagcaagtatggacattgaacatccctttccagggaaattaccttgtctagtgatatggatgtctttacagtgcatcaggttggttaggaagcttttctccataacaatagagcaatgctggctgtagaaagttgaaagttgaagtctctttctactcaagtagtcaatgaatctactgtatatttctgtatattacaacattccagggctcctttgctggctgctaaccctcctcaccctgaactcagaagttacatcaaccattcatttacttacagtttcattgagatctaattcacataccatgcagttcaccactttaagtgtacaattcaatggatttttagtctattctgagtatgtaaatttttgttgatgtatagcatacatacagaaaacaggacaaaacataaatgaacagctgatgaattttcaaaatgaacatattcataaagccagctttcatcccgctacagcccccacaggcctcctcatgttcccttactggcattacacatccccaaggagagccagtatcctgacttctatcaccatagattaattttccctgttttaaaactttctaaaaatgaaatcttatagtatgtagtctttgtgtccagctgcttttctaaatttttgctgtgaaattcaatcatgctattaggagtatttgtaggatgatttattccccttgatgtatggtataccattaaggaactaaagttctttttttgtccatattgctactgatggatagctgtatggtgcacgattaaggaactgtaatttattttttgtccatattgctattgatggatatttaacattttcgtgtatgtgtttggagaacattttctggggcgtatacctagaagtgggtcatagtaatgtgtacatgcagctttagtaggtactgccagttttccaaaggggaatatactatattacactaccattagcaagatatgagagttctggtggcttctttacttcaccaacacttggtgttgtcatcaagctttctcaacctcatcttcctggactctggccagaaggcccctgagtaagcttcaagtaccttctcctggtgttatattatctatatgtatgcactctgctggagagacttcatggtttgcaacaaattttcagaggagcccttgtcccagagaagggcaaaaactacggcttccagttttcagctttcttataatctctaatattgtggtgaaacagccttttatttgagccaagatttctcctggaaaagctgacactggtagatagtcgtctctatttttgaaaagcacattattcaaggccagaacactctggagttttgctagtgctggtgtgcatgttgagcaatatgttggggatatccaaaaattacatgtcctaaataaagggatgatatttattgagatactttagatgcctgtgctatttgatcaaataaacacttatgtgtttacaaattgaaagagtgagaaagttggcacagcaaaaccaattttagtcgtgggcattattctgctttggaaacaacctcttggcatgatggcatgtcctgatggttagaaatgtgatacagttggaaatggctgatacagctgaaaatggctgatacaagcagcaaagaattagggtcataaaaccctgcatccttctgaacacacccttattctttgaggtcaatgcatggactaattttggagacttctgtggaactcaaacctgtctccactgacagatgcatttacaccagattatgagggtaaataggagaaagacaggtctttgagggaggaattacaattttcagcttcttaaacactttacttttttcagaataaattaattttgattgtgtttagaaagcagtcaaacttctgactcagactctgaagaattcttcttattttagtactgtttatccagtcatctatctatccattcattcatccatccatttccatccttacatctgtccatccaaacatccattcatccatccaaccatcccatgcatgtcaaacaccaattgaatatataacattcttaagcattatgggatgatacagatgattggttcatttcctgatatagctggagagggaagacatacccacatggaatacctagagaatacagtactatcaagataacatgggcaagtacaagttaagatggtagggactcaaatggagtgaactttatgtgcagagcactgatgggtagtgagatgaagcttggaaggcttcttgaaggagtcagtcttgagctttgcaaagaaagttgtttatactttgcgctgatggatattagaaaataaaaagcctttgaggaaagatgcagtgatgatacactggtgaggagaggatagcctgctgacatcagggaaactgcttgaccagagcacagaggcagccaccttcttcttggaaggcatcttcttcctggcagccaccttcttttggcagctttgagaaccaggcacaggagcttgaatttgttccagtgaacaaggggacagtccagttggaaaagagataagacaaggctgcccccttctggtttcttgtgcagtccattcatgctcccatctgaagacactagggcctctgcctgcctggagcattctcccctccagatattcacatgatttcccccctcacctctttcatctcttcattcaactgtcaccttctccttgaggccttccttgacatcactttaattaaaattgcaaccaacctcaaaccaccaacacttcctctttgccttccctgctactttgtcttcacagcacttttcaccttctaatctactacatgattttcttatctattttgtgtagtgtctgttttgtcagtttttccttgtttatacctactagaatataagctcccaggagagcagacttttatctgttgttcctccagtgcccagaacagtgccaggcagacaggaggcactcaagaaatatttgttgaatgaatgaatgaatgaatgaactgatgtgacagccattagaggatggactggactaggccttgcatgggaacaggagggacagccacaaaaatgatctggctggtcattgagtccgtcattagcttctaactagtttgtaagaatctcaagtggttacttgattaaatgccttccagagactatctttggaccacatgagaagtggctcatagagcagagacctgacaagagcttgaactctattactcatgtgcaatttattgtatgtcacttatgctgcaataaagctgtttaagaagaaagaacgtgagctctacctacacaaatctgaggttaaattcagtttctgcagtatgcaaactgtgtgaccttggacaagttactcaaccctatgtgctatgaaactcaactgcaagatgaaactatcagcagcttactcactggatctttgtgaggattaaatgaattaacttaaacctattagcccagtgtctgacaaatagtgttcaatcattataattaaaaggaaaggctgggaagcttcatgatcgagagcattggtctttgaatgtctgaatttaaatcctgctgccacatactagttgtgagatcttaggcaaaatataattatttatctctatatgcctcagtttcttcatctgaaaaggacaacatgatgcctatctcatagggtcactgtgaagattgagtcaatacatatgaagtgcacagaacagggcctgaagagagtaagcactcaatactacttgttgtcattattgcttcttattattattcttgcagggcttcacctggtttctcagccactatgactcccatcttccccatttctttctatgtggacaatcccaggcctttcacatgctgtggtgctgctggaagattccaaaaatgcagcattgccattgtctgcacctcactccagtttcacccatgtgatggtgcaatcagaagacagtgtcagtgccaattctgtgtgcttagaaatgttagcaagcaattctataagaaaaaaatctaataattatctgatcaaaaaatggacaaaacattttaatagacatttctcaaaagaagacgtccaaatggcaaatagacatatgaaaagctgctcaacctcattgcaaatccaaactacagtaagatagcatctcaccccagttaaaatggcttatattcaaaagacaggtagtagcaaattatggcaaggatgtagaaaaaagggaatatttgcacattgttggtgggaatgtaaagtagtacaaccactatggagaaccatttggaagttcctcaaaaaactaaaaatggagctaccatatgatccagcaatcccactgctgggtatacaccccaaagaaaggaaatcagcatatcaaagaggtatctgcactcccatgtttgttgcagctctgttcacaatagccaacatttggaagcaacctaagtgtccaccaacagattaatggataaacgaaatgcggtacatatacactatgaagtactatacagccataaaaagaatgagatcctgtcatttgcaataacatggatggaactggagatcattttgttaagtgaagtacaccaggcacagaaagacaaacatcacatgttctcacttatttgtgggatctaaaaatcaaaacaattgaactcatggacatagagagtagaggatgcttaccagaggctgggaaggatagtagaatgttggtgggaggaagataaggatggttaatggataaaaaaaaatagttaaagaatgaataagacctactgtttgatggcacaacagggtgactctagtcaataataatttaattgtacatttaaaaacaactaagagggtataattggattgtttgtgacacaaaggataaatgcttgagggaatggataccccattctccatgatgtgattattacacattgcatgcctgtatcatcaaaacatctcatgtaccccataagtatatacacctactatgtacccagaaaactttttaaaaatttaaaaaattggaaatgtgaacaagggtcatgaaataggcacacgaacagaagaagacaaccatttgcccaactacaatttgcaggacttctcccctcctccctgatgggaaagactaattttattttctctcaaactgcaagtataggtcaaaaggaaagcttggtccttcaaattagtttatggcccaagaacaacccttgttcataactgtaaaaatgattgagttatagaggggaaggtggcttaccctggctcccaacagttagaagggcaaggttcccatgaacatcagaggagacattctgagagaaaaaggtcactcctcaggaactgaatctgagaaggaccaggccacctgtttctactgacagggactgggtccagcatcaagaatatgatggcaaaagggcttcccaaatgtgacagaaattggggtgttgggtctttacctccagaacagaggtaagaaggggagaaggacatgtagaacattgatgttgataatagtaatggatgtgtgacccagccagcctgtttctgagagccactcactcactcactaggtgacaattctaggaagtggagttcaaatgttttaactgaacatacaggctccaaaatgaggccgtgtgagaatcagtttgcttactgtttttcagaaagtctgctttaaaaagtcaaagacaaattttcatggcaggaattcttatgctaggaattcatccagaggagattcatcaaaagtgtggtcatggatttatgggtaagaagtggttgtataaatgatggtacactcataatgatcacaaaaccatcagcaatatccatttagtgcatgcatcctgtgtaccttgtataatctccattattcctacagtacatccaagataggtatcatgattccaattttaatgataagagaactgaagcttacaaatgttgagcaatttgcctgtattcatacagctattactttgaagagctggttcaagtcagttctgttggtctcttaaaaatcatcgtgtaatccttctaatgagattctagtccagagcctctaacttttttacattcttttttttattattattatactttaagttttagggtcttaaaaattattaagaattccaagtagcttttgtttttgtggctctatctctctatacttgccatcttataaattgaaattgagaatcttaacaatatttattgacatgatttaattacttaaaataacaataataaccctactataagtaaacataataaatttttattaaaaactgttttctaaaacaaacaaaatgagtgagtgacattaatttacattttgcggatcttgttcacatctggcttgaagaagacagtgaccatggcagctactgtaaatcaaattgaacttccaatagctttctttttttttttttttttttttttttgagacagagtctcgctctgtcgcccaggctggagtgcagtggcgcgatctcggctcactgcaagctccgcctcctgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccttccaatagctttcactcatgagctatgagatcccaatctagtcatttaaacttatctgagctatatttcctttacctgtaaaaggaagaaataacttctgctggacctacttaacagggctgctgtaatgatcaaagaaaaatgctatatgtaattagaccttttaacttaggtacatcctaggacaaggacttattctaatgtcttctcatgatttcttcagaagaacaagcctccctggacaatgttcaaaacagtaataatcactggaatgtttccatcatggccaaatgtgaggcacaaaactcttgcctcagattgtgtaatcttataaacttagacatttcctccttaccccacttactccctgaagcttgaagatttgcaaatttttatgagtctaacaatagctctttcctgtgtttatcagaagttttccctaatcttacaaaagaagatttgtttttatgaatttacctaaactaagctgttgcctgcttagacataagacaccaaggaggttaaagggtaaagtgttttattctgcttcatgatagtttcctttacatattgtttggttcccatttactcacacatttactctgtttttggttttagagtcttgagcaaacctcctttctaggagcattcctgagttaggagggctttaacagctggtctttgacaccattgcattgctgggattattgctatttgggcaaccctcaatatttttgggactccattgaatgagaatccgtataattcagctgaggtgacatttcaactgggttattcagatgggatctgtcaaatagagtcttggaaggggccccttcccaccctcatcacagcatttccatatgacatgtactgtacaaataatttatctctggggaaaggaaggagggatggtggagaggtgcccatcttatgtgttctggtgggaggttaatatagaaggatatggctgggtgcggtgactcacacctgtaattccagcactttgggaggattacttgaggtcgggagttcaagaccagcttggccaacatggtgaaaccacgtctctactaaaaatacaaaaattagccaggcgtggtggtgtgcacctgtaatcccagctactcaggaggctgaggcaggagaatcgcttgaaccaaggaggcagacgttgcagtgagccaagattgtgcaactgcactccagcctgggcagcagagcaagactctgtgtgtgtgtgtgtgtgtgtgtgtgtgtctatgtgtagatatagatatagatatagatatagatatagatatagatatagatatagatatagatgtgcaggatgcttttgttgggcagggctccacatgcaggtcatggttagttagttaactctgccttgttccaaaagctgtccttcactttttcccaggccaagtcccatgtgtcagactgagctctcactttctgaatcaattgtctttatgtttccaggagctgccatggttgctggtgcaggccctggcagtgacagacagacattaattaaccacatctgctgggctcacattcttcttcaagtcatctggtggtgatttctggctgaaccaatgcatttgtgaaaacaagcaaacaaaaaaacctaaataatttaattgtttggctgaatactgatttcttcctatctttttattaatggattttcaagcaaaaatatgctgttcttcccacttatggtgtggctatttagctgcttatggttttatctctttgtgattccctttactcgtgggcacaatgccacactgatagtgcagaaggatgactttgtacaccagtcatagatgcacattgctctcaatgtgcatcttgatttggttctttgctatttaagttccatcccacacccactttgtacaagtgcattgtgttgagggggcagggttgggcactactctgctggtagggatctgcagagaccatagtgggtctgggttcaaggggagacttaaaacaagtaggatagatagttataacataaggaaccaaagtacaaaagatcagtttataaatcggggcattgtgtgtcaaataaatgacaagttcaaggtcacacagctgagattatatcaagcatatattgtgaacctactgtgtgccagcagtctctgccagcacgtcctaggcatacaaagattataattataatagtagcagctgcggtaataatattgattgagaacttacaacatgccagccactgttcaaagtgatttacatgtatcaacacacttcatctttctaacatgcctccaagacagttactatgatcacatttcactactgagttaactgaagcacagagaagttaagcaacttaacacagctagtgagtggcagaccatgactcaacccagggagactggctccagagcccatgctcttgcagcgtagggcccagtgaatgagatagaatagtaaatgcatgaaactggtgcagtggagttagcggcagatgaaagagaaacagagagctctgggacactgagaagaccacctaacccaactgtttatgctaatctgggcatacttcctggaagaagacgatggagtcaatagatgttgaattacaaagactgatatctggggcctggacgattaagtaactgtcttactctgtgtcagtcatcttaggagaggcagagctagaatggggattgacttcttcttcgtggagaatggtccctggatcaatccacaggtttctgctgagcaagttttatgtattgaactctgatgaaggagggataagtggaggttttcaggtcagcatgcaagttgtatggaacatgaattatttctcaataaagctgattataaaacaaaatcagcatgcactcagcagccagaacttgcttctaaataccactctcttgataaaaggaaagccttcttggacaaatgacagatcctagggcttgggcagagaaaatagaagatgagtctggagaatcttctagtgccaaaaatgaaaaaaatgctcaacagacaaaaggatggggacatgtcaaagggactcaggagccgacctgaaggagtgctcagaagtagaataatttgagcaacaaataaatcatattgtattagattataacacaaggtataaaacacatatatatgtccactgttataaataaatgaatgaataagcaagtaaaaggggaaaagaggaaaatcttccttagaaaagaattcaaaaaatttgtggggattctccatctccagaaagtggaagttagctcccaccatcccctcttgaggatgatctgaacttaatgactctcttccaaagaacagagcatggaagaggggtgagtagcaactctacagtggagagacctgacagacaccaccctaagcaaggaatcaaggttaacatcatccgtgataagtcatattgatatcaagtgccctctgaggtgacatgatgacaagagcacttggtctttgtggtagtcttccccaaaattcatagtcctaatctaaaaatgaaaaaagtaacttcagacagatccaaattaagggatattctaccagataactgacccgtattcttcaaactttgaaggttatgaaaaataagggactactgagaaactatcacacaccataggagactaagaagacaggacaactaaatgaaatgtggtatcctggatgggatcctgcaacagaaaaaggatggttagtggataaatgggtgaaatccaaataaaatctgaagtttagtacatagtgatctaccagtgtcgatatcctggtcttggcaatgtaccatgtaatgtaagatgctaacattagagaaaactaggtgaaaggtatatgggaactttctgtactatctttgcaacttttttataaaacaaatattactttgtaaaacaaagttactttgtaaaaatttgtaaaacaaattactttgtaaaaatgtgtaaaacaaatagaaactatatttaaagcataaagcataaaagaaaagtcagcaagtgtcagtattctgatcaactagaactttcatgcattgctgttggtaatgtaaagcagtgcaacaactttggaacactattaaacttaaaaagttaaacatacacccactgtgtgactcagccattccactactaggcattgacccaagagaagaaaaaaacatatgtacacaaaaagacctgtacaagaatgtttatagcagttttgttcacagcagatcaaaactagaaatagttatcaacaggtgaaacaaaccgtgatgcatccatacaatggacactacttagcaataaaaaggaacaaacggaaacttggacaaacctcagaaatgtcatgctgagcaaaagacgccagatacaaaggtgtacatcttgtatgagtccattaaaaaatgtgaaaacaggcaaaaacaatctataagtgacagaaaactgaacagtggttgcccagggccagaaaggggacagggattgtctaggaaggggaaagagggaactttctggaatgatgggaatgttttatatcttgattggagtggtagttacataggtgtacacatgtgtcataactccccaaattgcatgttaaattatttaatgtgggtacatttgtgaggagatattggtcaaaggatacaaaatttagttagataggagaaataagttcaagggatgtattgtacaacatggtaactatagttaaaaacaatgtattgtagtcttgaaaattgctaagagaatagattttatgtgttctcacctcccaaaatgataggtatgtaaggtaatgcgtatgttaattagctcaatttagccattccacagggtatacatatttcaaaatattatgttgtgtattgtaaatatatacagttttaatggcaggttaaaatttttaaaattacttctaactataaaaaacaaaatacggaaactaaactaaaataaaatgagtacattgtagctaaagtacacctcaatagtgttaagaagggtgacagttaattttatacgtcaacttgtgtagatatttggacaaacattattctaatgtttctgtcaagctatttttaagataaggttaacatttaaatcagtagactttgagcaaagcagattaacttccataatgtgaatggactttatccaatcagttgaagtccttaagagaaaaagattgatgactctcaggaaaagagggaattctgccagcagactgcctttgaagtcaaactgcaactcttccttgggtccgtgacctaccctacagattttggacctgccgtccctctcaatcaacatgagctaattccttaaaataaatctgaatccttctctctttctctgtttctctctctgtctctgtctctctctccatctatatctatatcaatatcatctatctatatctatgtatctatgtatctatatatctatgtatgtatctctctctctctctctctctctttctcctgttggttctgtttctctaaggaatcctggctgagaagaaacataaagctgtatctcaacccttccctgagaatcttatggccttgttggagagagaagaccaacatggccacagaattaatacaagaacaaatacgaaatctcttattccacaattctagtttctctgcctgtacaacatcaacagaaggtgcatctttattgaatgactcagagttttggggaagtttctgttgactgagaaccttaagttattctgattccgttgaaagatgctatcagaatgcacgacctggcttctgactcgggttttcagattgacccaaagtgggtttttttgcgtgtctcttaagtgccatcaacaggttaattctcccagatattatttattttaaatccttggaacaatgtgttccctttatttctgtgtcgaggtatccctgtgggaagaaccaggtggtataacatgtctagaagagaagtttgaagttgtctaatctttctgctttgactttgctgatctctgggaactcctgtgtttacctagcacatctgagtccttgggaaagctttctgggccctgttttgtggttcttctaacagatggttgcattcttgtgattgatttttgatccccttctaagttgtataatgcttatagttataattttctgactctccaggcacacagaggctcctgactctgagatatttgcaagtaccattgacaaataagatttccttaggttaactccacttatgtacttgtatttacattttgtatggtaaaggctccagtttcagagagaaacctctttaccgtgcttggtgtggcagtgaacttaattaacagagaattttgctggcaatctctatgctaaaaagttaagtggggttctgaggacacaaggagctaaaaagttgagtgtatatcacatattgataactcacataattttgcttgcagacatttaccaatttggcagattacctacttttacattgtagtaaatatttccttttaaaaatatcttgtatctcacagggcaaatcataccccttcagggggccattcccacctgtatggaatccaattacctacttagatcataacaacttttggaggacaatggatgacatggggcgagaggtaaagcttctttgactatatttgtattcttttttgtaataagtttcatccttcaaagaaagaaagtaaaatatatctccaacacctagcacattgtgaacacatggtaactaaagatttgtgaaatgaatgaatgaacttgtttctaacctctgcaataataagatgtcaaacagattgatatttgtatactactgatgagtgggcaggagattgggtgtcactcagccttcttggaatgatgtttcaaattttggaaatcttcagtacatagcaaaattagacttctgggtctttgattcaccaccatgcccaaacaagtcataagtaatcacacataaagcattttttttcttttactttaagctccgggatacatgtgcagaacgtgcaggttcattacataggtatacatgtgccatggtggttttctgcatctatcaacccatcgtctaggttttaagccccacatgcattaggtatttgtcctaatgctctccctccccttgccccccaacccccgacaggccctagtgtgtgatgttcccctccctgtgtccatatgttttcattgttcaactcccacttatgagtgagaacatgtggtgtttggttttctgtttctgaacacacataaagcttaactgaaaactccatagacatgatttgctgcagctctgtgatccttgttaaatagttaaatttatgagtgttctctagaagttagtaacttaggaatccatatctagaaatagcccagttacaacatgcctctatttattgtgcaggaagttttatcacaaattaaatatggcttgggtggtacagatttataataggaaagctacatagacagcattgattatgcagtaaaagcaatattggatgaatttggaaaacttaacatttttcctctttaaggtagagtttttaatactatttgaatagttatttaaagtggaaaattacaaaaatgaataaaataaaagagaaaattacatttgtctttctccttcgaatcctcatctgaatgtagattccgagtgatgccccatggaaggctccccttgcagaagagtgggacaacatgacaatgaaggagctactggacaagctctgctggactgagtaagtcttgccattaggcacaggcatttactgtgaccaccttttaggtttatttagcaataccgttcaacaagtatgggacaagtagctgctttgtgtctaaaaccacaccaccagccagtggcatgctgaaaaccattggaattggctcctaccctgaagatatctgtacatacaacttacttctttggagtagttttgtatcacaaaggtggtattaccctgtgaagtcctcagaacagaccagaaggtaccactttctttatctgaaacagcttaaagaccatcagcttaaagctctcatttattaagttgttgatataggacaatttttgtattcttcactggtggtcaaatgtggagatggttagcatgtgcatttgccacaccttgtgtgaagtagtgcaattcttcaaggacttaaagaggaacctctaaagcctttgtgtagataggtcacaactacaggggaaacatgtgtgactggactggctgttcccctttagtgaaaaaacaagtacctatgagttaagcattaaattcttgttggcagaactgggaactgtagagaaattgtgaaggcttgtatagacagaccacatggagaggccacactgctcttggacagcagggaaaatggaaaggattatgagggttcccattcaagcacgtggtaaatttgtggtaaacaaaataagagaaatggaagccaaattcaaggagactgccctgtcttgctaaagagcattagttgagaatatgtttggctcgggggttaatgtcttcatttttaggcattcattcactgccaactaaaagtaaaaacaagcttttagaatatctgaatcttaaaaatggaaataatcaaaagacataaaattcatatatttttcatataaaaattcagcttctaataatttagctttaagaaagtgaggcaaaagaagagagaggcaccagcatggcacatgtatacatatgtaactaacctgcacaatgtgcacatgtaccctaaaacttaaagtataataataaaaaaaaaaaagaagagagaggcatacagggagagaaggagagagggagagggagaaacagtgaaagaggcagattcaaagcattatttttaaaagggaggatctgaaagcccaatagtagaagatcggcagaatcaagtatggaacatctaaaaaattgagtacttgagggttttaaaaaatcgtgttgtagaggaatatttaatgactggaaaaaatagtaatattaaacacatagaaaagcaggctattgtggtatggtatatgatctcatttctaaaaacaactatttatatatgcactgcaaaagcaatggacatccattgaagtatttttaacgtttaatattaccatgcaaacatttatttttaaaatgtttaaaaactttacatcattaaaaattattctttaaacatcatatttcatggtaccagaatattccatgggaaatgaatacgtaatgtatttgtccattatcatcctgttgaacacattggttactttctgttttttgttattatcattatacaatactctataataaacatctttatgcctctcctgtgttttcaacctttgaaagcaaccagttctggaatagtaaaatccttttatgtcatgaaatcaatgcgtgttattaattatattcttttaaacatttacctaatgctatctaacacctctatgagaatgtagtttgcaatataatttattttaatagtaataaaattgtagtatttagttttaaattatatactttagattttcaaaatataataagtatgtaattatctgcatttgttttataactcctgttatgaaaagcttttaataaattcagttaggtcttctctcctcagagaacttttaagtttcttggtgataaaatcaatcatatgtttttgggatcacagggacccgacattttctatcgtagcccttggcctagtcctccacttagtgaatattctaagttgtcatttgacaaaataaagcattctgagatactaggagtataagaacacaagacaattttccaactcttcccaagcaagatacacacagtattatttcctggatttaaatgaagtaatccccagaatatccaacctattgttgttcaaactaaagcacaatcatacattccaagactaatgttgattattctttcagttattatcatttacaaagtgcacttcacaaacatgaattgtattttcaatgtgatcacagctatgtaaaaacattttttaaaagacctatacttagaaaaaaatgcatcaaaatgagactagtaattatcttctggaggggcagaaatatggaagacactcgttctctcatccttttatcttataaattttccaaattttatataatgtgtatgtatttttcatgtagaaaaatattataacatttatcttttaaaaagtcaacagggcaaaaaatacggaaatattgcactaacttccttgaccttccatccttcaaatattgttcttatttcttttcttactgaagctcctagagtaaattcaaataaaggattaggaatggactggcccttcagaattacttttagatctccctttatttcaaaccagaattatttctttcccaccaaattgccaacaataacaactagaattccagcaatatttttgttaaatattggctctccagctgggccaatgttaggtttcagttatttattactccctttactgtatgcccctcaatccacctaaaaaataaggaagaaaagaaataggattttaggaagcaacaaataaaatactacttttattttaaattgacgtctggatatgtgttttagttagatattacaaattgcctctgcaaggaaggcatgagctagcaatttccatcccttcaattatcctgagaaatcttacaaaactaactgtaagtcgctttaatgtatatatgacaccatttcacaggctgtaatgatggggactgtcatagacgggctgtcaggttgttacagctgcaaataatgtcaataattggtatgtgtgttaggcatgattctacaaacttctagggtcaagatacagtaaagtagagagatgccccttggtgagtagctgcacttccaaggctgtcagctgactaattagaaaacattttgaggtatcaaaagcacgagttttgcgtcaagtacgatctgacttgaagttgtgtcgttatatattcctaaactgtccgagactccgttttctagcatgtgaactgtggaaaaataatagatatttgatacggttgttgcaacaatttaacaagataatgattttaaagacaatggagtgtggaaagagttcaataaatggaagacaatatcatttatcccaaccattgtcagcattaccaggtggaaaatgctgcctcagatataacaagattaacaatatgcaaacttcatgtcaaagtcaaaaggggaattggaccttattaaagaaatcccagagtgcacactactactgatgaattttatgctgtgctagatataatggagtcctcgaaattgcatgagatagtttgctttctggtgtgcttcctgataggtgataacctctcaccatttacctgccaatgtcaagcaaaagcttacccatttatgctctattaattgtttgtcccctcatccattatttgagcttgtcttctgttaggcagtaaaataactgaatagataactgtgactaattttgtgtttggtacagcacctagcatatcctttgcatgttatggatgtttaaaaaattttgtttaactgatatttctcatcaatcattcattcgttcaatcatgcaacaagtaattattgagtgcttacaatgttccaagcactattttgttaaaggggacactatggtgagtgagaaacagaagatccttgttctcataggttgatattctagtggggggagacagcaattaaaaagaattaaccaataatcaagacaatttcagacagtgaaaagagttataaagatactatacagtagcaaaatgatagagaatgtcaggatgctgggaatatggaagccagtggtcgttttcatagacaaatgtgaatatgtctttctaaggaaacattagagtaaaaagaagagggtacaagatgagacagaaaaggtaggcatgggctggatcacatagggctctggaagccatggtgtaagatctgaatcttattctggttttaataggataccactggagactttttaagcaagaaaatgacatgatttgatttatacttcagagagagcatcatggtagggagggagggaaaagcctctggctttgagtgtggtgaacagataccaggtgaggatgaatggaggcagagaggccagtctgaaggaagtaattgcagtactcctggaaagagatggattctaaatttgtggtgaaggtggagtgatgtggtgagagataatgggacttcccaatgaattggatgggggaagattgatggaaagagagaaataatgtttgatttctagagtgttggtttttaccactgagtaaatgatggtgctttttactgagatggggatcactggaagagcagcaggaatgtaaggagaaatcatgaaagcacagaatctggaatagaagctgattctgagtaaggtgttttgtttacagggaaaataatctgatatttcaaaaacctccgatgtcacgttttgtaatattagattctagtgacaattttttgaccttaccacattgttttaaacttaaccaagaaaatgtgttacttaaataatttttagagaattaagaagctgctctcctgcgtttgccaagtttgctcttgtttcttcctgtgcagatctgcaaagcagcttgccactctctttgtgaacctgtgtgtcactgcagagacccatgaggtctctgctctctggttcctgtggtatgtgaagcagtgtggaggcacaacaagaatcatctcgacaacaaatggaggacaggtacccatccattcttccacagtcccaatggaaaaacactgctactgaaatgaaagatcatcatccttcaatcatgaactgctgaagtgggaagcaggcttgtggcttttagagcattaccatggcagctcaaagtgtttcttgtaaggcagtctgttgtcaggtacccactgtgagaacccagtgtccaatgtaattttaaagctaggcttgtctctctttatgcactgtggccattttccatacgctcaattattatttggtaagtttgtaggagaccatctgaattaagcttagcttgagcacttcttggaaagcttataaaggaaattcagtaatgcattttcaatttaaaacacacactattcatggaattcatttatctattcattcattcaatgcccatttcttgagccccggcactgtataaggcactgtgctagacacagtaggaacatattggagttcttaaataatctgcttggttgtcatgttccattcttctctctccccctcctcctcttctttctttctcttctcctcctccccctcctctttctcctcctccttttctctttctccctctccttctccttctctgaccttaactgaaaattgaggaggaggcagccaggtcaactgtgtgcatagccaggtagaacatttggaagttttagcaaggctgagggcaggtgggtacagtgaggtgaaatgagttcggtggctacagaagcagcaggcatctgacccaggataagatgggcagcctgcaacagggagtaggctggcctgggggaaggggacatggtgggaggcagggaagttctgcgcttgagccacaaagcaaggggaagcaggcttaggtctgctcaggcaagctagggaagagctttaggtacagcttcaccagttccagctctaagcaaaagactgcagataggacagagagcagggatggtgaccagaaaggtgggatacaggggtcattctgaagatgtccagctaaggttggagtctgggaatctacaagagcatagcttgtaaagtaacttagaaatcctgtaactttgtccaaagacagcaattcctacttagaaaaccatggtgaaagccactattcactgcagcaaaatgaaatgttagacatctcagagtagacatatgtgaggacaactaagaatttagcaatttatgcccattcctgcgtttctctttcacctccttttctctttccaggagaggaaatttgtgggcggatctggtcaagtgagtgagcggataatggacctccttggagaccgagtgaagctggagaggcctgtgatctacattgaccagacaagagaaaatgtccttgtggagaccctaaaccatgagatgtatgaggtaactgtgatattgtgaaatatatatttgatcttcatcccagtttcctggcatacaactttaaaaattcttagaatctccagagtgatgtcctttgatgccaatgattgatggctggcagcccctaggtagcttcaggatggggctggtcacaggaaagaccatggaaagactagagggttgggactttcagccccacccccagcctccagggaggggatggggcaaggggctgaaggttgaattgatcaccagaggccaatgatttaatcaattgtgcctacataaggaagcctccataaaaacccaaaacgaccgagttctgggagcttctggatatctgcacaactggaggttccttgagaatggcatgcctggggagggcatgaaagctccatgccctttctcacaactcttgcccaatgcacctcttcctctgtaccctttgtaatatcctttataataaaacagtaaacatgtttccctgagttctgtgagccactgtagcaaatcaatcaaacttgaaggggttgtaggaacatcaactggaagcagattggtcagaaattctggaagctggacttgtgactgacatctgaaggtgggggacagtcttggagactgagccctcaacctgtaggatcagaagttatctccaggtagatactgtcagaattgagttgaattcagaggacacatggctgatgtctgctatagaattgcttgcttgcttaatatgtggggaaaaaccactccacatttggtcacagaagtcttctgtggtgatcgttgttgagtgagagaatggaaaaaagcacttttttccattctctcactcaacatttgctttgaactcaactttgctttgaaatttttccactcagagttaccaagacacttaaacaagtgggaagaggccacagtctcatagataatcaaagccgaagtcaacaatgtcacacactttatagacagtctttttgccaatagtgaaaaagctatctctaactgaaaaaaaggaaaagagaaccagaatatttggggtgggggaggatttataaaaacttataaaggtattatcaaccctctgtattttgcttttatgtaattagaaaaacacagaaaatatttatttgataaatatcaagcacctcctatgtgcctgacatgattctaggagttaagaacacagtcgtgaacaaaacagatacaattctctgcccacatacaattctccttctagtgaaggagaaagacagtaatgaaacatatagttataatataaagtatgtcagatagtgataattagtgcggaaaaaatcaagcaggaaggtggggagagggcataccagaaagtgagatgggagaattggttatgcaagtttaaataaggtgatcagggaaggcctcactgagaaggtgatatctgatagagaattggaggagacgagggattgagccatgtggttccctgagagaagaagatggaacagccagtgccaaggcactgaggtgggagcaagcctggtgtgaccaaggaacagcaaggtgatcaaaatggcagggccaggcttggtggctaacgcctgtaatcccagcactttgggaggccaaggtgggcagatcacaaggtcgaaagatcgagacaaccctggccaacatggtgaaaccctgtctttactaaaaatacaaaaattagctgggtgtggtggtgcacacctgtagtcccagctactctggaggctgaggcaggagaatcgcttgaacctgggcacgtggaggttgcagtgagccaagatcgcaccactgcactccagcctggcgacagagtgagactgggtctcaaaaagaaaacaaaaatagcagaagtaagagtgtcagggcaaatgtaacaggaggtgagatcagtgatgtaacgggcccatttcatgtgtggccttggcgatgatggtgagaaatctggctttgactttaagtgcaatgggaagtcattggaggttttgaactaaggaacaataagggctactttaggtttcgacaaaatccttgtcacttctttaagagactgaaaagaatataacgatagaatgagagagaatcattgggaaaaaaacaaaagcaacacggcaacaatgtttaaccatgttgcttttctttcaggctaaatatgtgattagtgctattcctcctactctgggcatgaagattcacttcaatccccctctgccaatgatgagaaaccagatgatcactcgtgtgcctttgggttcagtcatcaagtgtatagtttattataaagagcctttctggaggaaaaagggtgagtactttccttatataaaaacctttagaagaaggtccaagaaacttgttgctaaggcatgcattttttaaaaatgtcaacttttattttagattcaggggtacatgtgcagatttgttacatggatatgttgcatgatgctgaggtttgtggtatgaatgattctgtcacccaggtagtgaacatagtaccaataggtaggttttcaactcttgctgtactccttacctccccctttagtagtcctcagtgtctattattttcatctttatatccatatgtaccccatgcttagctctcacttataagtgggaacatgtggtatttggttttctgtttctacattgattcacttaggataatagtctccagctgcatccatgttgctgcaaagaacatgatttaattctctttttatggctgcatagtattccatgctatatacataccacattttctttatctaatccacctttgatgggcacctacgttgattccatatgtttgctattgtgagtagtgctgcgatgaacatgtgagtgcatgtgcctttttggtagaacaatttatattcctttgggtatatacctaataatgagattgctgggtcgcatgatagttccatttttacttctttgagaaaactccaaatttcttttcacagtggcttaactaatttacattcccaccaacagtgcataagtgctcctttttctccaacatctcttattttttgactttttaataatagccattctgactggtgtgagatggtatctcatcgtggttttgattggcatttatctgatgattagtaatgcagagctctttttcgtatgctttttggccacttgtatgtcttcttttgagaagtgtctgttcatgcattttgcctactttttaatggggttatttggtttttgcttgttgaattaagttccttgtagattctggatattagacctttgtcagaggcatagtttgcaaatattttctcccattttgtaggctgtgtgtttactttcttgatagtttcttttgctgtgtagaagctctttagtttaattaggtcctacctggcaatttttgtttttgtttcaattgcttttgaaaacttaaagacatgtgtttgcatgtaactgttttgttagaatgctggacataaaatgttaatccaggttctaagcacagttctttcaaataaaatatattggcacaaactcatggaattaactttctttagaatataaccaactctttgtaaatcaataaaaggtttatttaatcctcccccaaaatcttgtgaaaagagatgagtaatcttttctaattcagtgttttaaagtatgggtttataaagccaatcaccaaggttgagattctgaaaatgtcttggctctctctcactagtgtcgattctaccatattaaattaaattcatttattcacttgcacatattcaacaagtgtactactcaattgggcagaacattgcagggttgctcactaaagtgctggattctacaatgatgggaatgttctagagctgctttaatacactagtcactagccacatgtgggtactgaacacttgaaatatagctaatgagacttgggaatcagattttaaaattctatttaattaatttttttttttttgagacggagtctcgctctgtcgcccaggctggagtgcagtggtgcgatcttggctcactgcaacccctgccttccgggtttaagcgattcacctgcctcagtctcccaagtagctgggattacaggtgcgtgccaccttgcctggctaattttttgcatttttagtagagatggggtttcaccgtgttagccaggatggtctcgatctcctgacctcatgatccacctgcctcggcctcccaaagtgctgggattacaggcataagaattctatttaattttaattgctttaaatataaatgcaagtagccacatgcagacagcacaacgctagaatcttgtcatatttgctcttatagaacccacttttcttccaagtggaggccatgtaagaagagtcagtatctagaacggagggtgaagggcgggatgtactccaaggaggagcaagactgcagaaagaaggttggaggcaaatggggaaagtgccacaattttggcttagggtgcttcttcctgtgtaactactctttttccgctgcatcacaggctcctcattctccacattgcagataatcacgtttaggactgctattggattggtgcatcagttgggcaagtaatctactgtttgcaaagtcagtgcagtgacccaccacaaagagccctgtcattttagtctttgaatctaatggctgtaacacactggtgctgaatctcttcctcttgtgacccaggccacccattttaaatgactggctggtggcaagtagataaggtttaggaccaggaatacagtcttctctgaatgagcatgggtgcctttatttatggagagaaactgtaactttccattcatgcctgcaaatctttatcttaggcctgctatgtgccaggcaagttgttaggcactagtatcagaaagaaaacccaagacctccacccctcagaatctgacttggtccttgttggtaatgagccttgcataagacttttaaaaaatgattgtgggcaaggcatagtggtgcacacctgtggtaccagcttctcgggaggctgagactggaggattgcttgagcccaggaggtggaggatacagtgaatgagctataattgaacttcagcctgggcaacagagtgagactccatctctatctcaaaaaaaaaaaagtttgttgacatgagatagcctcaccaaagcatttgagatttcttttgagttacaactttaatgtatttcttcaactgggcgcctattgtatgccagacacagtgctaggcactgagaattcaaaggcacttttccttgcccagaaaatccaggctcaggaggaagacagtcatgcaaactggtaattgcacaatgtattgagttctaggctattatagaaacaccaagtagggctccagactcacatccaatatgattcctgttacattgataagtgtattcaatgacacttatttgaaagtttctgtaatgaaatctgaagaagttcactcttataacaagatctttgctttgcactagactatcaacatcactgccaaagacactgtaattaactagtaacatacaagctcagtcaatatgaggtaacaagatagaagggtatgaattaagcagccccaacaatccagcacagtgattagcacatatcaggcacacagtcagtaatcaccagagttttggttttatgttgctttgttttgtttcacaagttcagtgtggcttgggttattaaagagaaggtaacattttgtattttgatacagacagtggtagccaactcttgattgcttctcccctccacaccccccacccaatcccagcatcatgctaaacactgcttttattttatttttaattgtagatatttaaggtgtacctcataatgttttgatacacatgtacatagtgaaatgatcttgtggtcaagcaaattaacatacccatttcctcacatggtcatctcctgtgtgtggtaagagcacctgattgcttctagattgattatcccaggaaatgcttcccagtctcttagtgtgtaacatctttgtgaatttgcaaggacaggcttcctatattttgctggccttccactgaggcattctaagtctagccgccctcaccgtcagcaccccatcctacacgggatgcatcagcccttcattctagcccacttctgtggaaaggataggctgttagcaatgcattgaattcttgtggtctccttgcttttgttcatctatgaaccatttctactttcccttgaatatttacatctaatttatctcaatttatgttttcaatggcagaagctgtacttgtttttctaaattacagaaataaatataatgaccataaaactttcaaaaactgaaagtatgtgaaaaatgtttctcttctattgttcctccccctagagggccactgttaaaaatttagattgtttatccttaaagatttactgtatgcataggtaatacaagttgaacatccctaatctgaaaactcaaaattcaaaatgctccaaattctgaaacttttgaagcatcgacatgatgtctgaagtagaaaattccatatctgacctcatgtgatgggtcacagtcaaaactttgtttcatgtacaaaattattaaaatatgtataaaattaccttcagactatgtgtataagatgtatttgaaacataaatgaatctggtatttgggcttgggtctcacactcaaatctcattatgtatatgcaagaattccaaaatctgaaaagagccaaaatttgaaacacttcttgtctcaaacatttcatataagggataaggatactcaacctgtactttaaatatatgtgtgtgagcatccctatatatatgtagagagaactatatatactggaaatacatgttaaataatataataaatattttatacaaatataactttaattttaaataaatatgttaatatatttttccaaaaacatgttttttaaaaaacatacatcatacatatcacactgaaatttgctttttcctgttaacaatatgccatggacatctctccatagcagtacatttaaatctaacccctttcgacaactgaataaacagtatctcattgtgtgccttatcagaatttacccaagacatcagctgttgatagtcatttttcttgtttccatgtttttgctattatacaccatgctgcaataaacagcatcctccatatagctctacatatttgtataggagcatttctttttgataaatgctgtaggatggaattatcaagtcaattgatttgggtagacctgtgaaatttttgttagggtctgtcctctcacatccttgtcagttgatataagttccatatctgtcttctccaaatctcatgttgaaatttgatccccagtgttggaggtggggcctaaaagcaaatgtttgggtcatgtggacagatccctcctgaacatcttggtgccgtcctcctccctgaggtaataaatgagttcttgctctgtcagttcccatgagagctggttgttaaaaagagcctggcacttccctcccctctctcttgcctcccgtctcaccaagtgatctgcacacgccagctcctcttcaccttcagccatgagtggaagcttcctgaggccctcatgagaagcagatgctggcaccatgtttcttgtacagcctgtagaaccatgagccaagtaaatatcttctttccttcatatattacccagcctcaggtatccctttatagcaacaccagcagtctaagacaccagctaataatatttaaaatttttttgtcaatcaggtaggagaaattgcctcatttatctataatttgtaatttttatcattaacaaagtatcattttgtaaattacctttgctcattaaagtttttttctgtttatattgcaaatattttctcccagtgaatcagtttttaacgatttgttgtatgatggtttccccctactaaattctcagatacacattgattctttctgttccactgacctttttcactgcgttctaaacatttttgcagctctacttattaaaaaatgtacacataaactatcactataggtattcctaaattgtacacaagtacctctgaaaaattatatcgttgtaactataaaacatttgaaaagtagactttttaaaaagcttaaattgaaaaaccagaatctctagtattttcttccactatctagatgtgcaatctaggtgtacacccccactttggaaagcacaagtttatattatctaatcctatggcagcattgtactgttttaatatctgtagctttatgatatgtttataatatgttatatattatgtcaggtaggacattcccttattattatttttcctttaattttgtccttggtaaacttcttcagttattcatccagatgaatgttattatcatctcatcaaagctcctgcctccacacccctacattacaaaagcttctattgacttattttattctgaacatgcctctttgttacctcccagagctacaatggcttcttttctctctgagaaagttagcactttgggggaaatttcttctactacctgaattattgggtccctccccctacccacccccccatagtttttctgtttcatttgttagttgtgaatttgtttcttctttgtctttgcatttattctttaagaacttctttaagtgtttggatgtccttgaatatcatctctttttctaagagtaaagccctacaaagctgatgagatgttttgtgtgcatgggtggggctcttgagctttctatctgcaagtggcagaaatctcttccatgctgcatagcttgtcctggcatgaacatgacttttctctctgctccttgttccttcacctccattaagtgcactcacttgactcagaggccagattcactctgagaaggaagtgtccaaggagcccctacatcgagaaagcagtacttccaccttggccagcctggcatcctatgctggtcctgtccaaccgatccccacatgatcagtatgcacacgttctttgatcagatcttgtcctatttgtctgctctctctcttgccttcttatattaggggattcctaagatggttctcttgtatttttaaaccttgagctcttagactttaaacatttcttcttcacatacttcagactttctcaacatcttttcctgccccagcatgcctgaaggacattcaaacacccctcaagccagtggcagattgggacattgattctaacaggtgcacagtggggaggggtgcaggagacgagaaagagacaagttccctttaaaaggcttcctggtttgtctgcttacacacacgtatgcacacatgttggggaggtcctttctctgttctttcttccttattttgaaatcttcttgttgggttttctatacaacatttgccgctgagtcttccacaataattttgttcaaacaacctcaattttgcaagtaaatgatggagcagaaggagttggacactgcagtaatatattgttataacatttcagactctgccctgatattttcaccagtgccctgtcacagtcttttgaaattgcatatacaggcacacctctttttattgaacttcactttattgcactttacagataattgcactttttacaaattgaaggtttgtggcaaccctgcactgagcaggtttatcggcatcatttttccaacagcgtgtactcactttatgtctctgtgtcatattttggtaattctaacaatatttcaaactttcattattattatgtttgtcatggtgatctgtgatcagtggcccttgatgttactattgtaattgtttaggagttccataaacagcacccatataagatggcaaacttaatcgataaatgctgtatgtattctgactgctcagtcaaccaactgttcccccagatctccccatcttcttgggtatctctgttccctgggacacaacagtaatgaaataaggccaatgaatgaccctacagtggtctccccagtgttcaagtgaaagaaagtgctgcacatctcttgctttaaatcaaaaactagaaatgattaagcttagtgaggaaggcatattgaaagctgagataggctgaaagctaggcctcttgtgccaaatacccaagttgtaaatgcaaaataaaaattcttgaaggaaattaaaagtgcactccagtgaacatatgaatgataagaaagtgaaacagccttattgctgatacagagaactgaatgatctgaatagaagatcaaaccagccacaatattcctttaagccaaagcctagatccagagcaaggcccccaactctcttcaattgaagttgaagctgcagaagaaaagtgtgaagctagcagaggttggttcatgaagtttaaggaaagaagcctcctccccataacataaaagtgcaaggtgaagcagcaagggctgatgaagaagctgcagcaagttatccagaagttctacgtaagaacattgacaaaggtggctacattaaacaacagattgtcttgttttgttttgttttgagatggagtctcactctttcacccaggctggagcgcagtggcgcgatctcggctcacggcaacttccggctccctggttcaagtgattctcctgcctcagcctcccgtgtagctggggttacagtcacacaccaccatgcccatctaatatttgtatttttagtagagacggggtttcaccatgttggccaggctggtcttgaactcctgacctcaagtgatccgcccatcttggcctcccaaagggctaggattacaggcaagagccaccacacccgaccggaaacaacaggtttttaatatagaccaaacagcattatattggaagaaaatgccatctaggactttcatagctacagaaaggaagtcagcacctggcttcaaagcttcaaaggacaggctgtctctattgttaggagttaatgcagctggtgactttaagttgaagtcaatgtccatttaccattcaggaaatcctaagacccttaggaattatgctaagactactctgcctgtgctctataaatgctatcaaacagcaacaaagtctgaatgacagcctatttatttatagcatggtttactgaatattttaagcccactcttgagacctactgctgagaagaaaaaagatttctcaaaatgttactgttcatggacaatgcacctggtcacccaagggctctgatggagatgtgcaaggagattattgttgttttcatgcctgctaacacaatgtccattctgcagcccatggatcaaggagtaatttcaactttcaagtcttattatttaagaaatacattttgtaaagctatacctgccttacagtcctcctgcctatctgatggatctaggcaaagtaaattgaaaaccttctggaaagagttcactattgtcaatgccatgaaaaacattcgtgattcatggaaggatgtcaatacatcaacattaacaggagtttggaagaagttgattccaatcctcatgagtgactttgagggattcagtggaggaagtaactgcagatatggtggaaatagcaagagaattagaatcataagtggaacctgaagatgtgagtgaattgctgccaactcatgataaaacttaaatagatggggagttgcttcttatggatgtgcaaagaacgtgatttcttgagatggaaactcctcctggtgaagatgctgtgaacattgttgaaatgacaagaagggatttagaatattacataaacttagttgataaagcagtgacagggttggagaggattgactccaattttgaaagaagttctaccatgggtaaaatgctatcaaacagcatcgcagccttcagagaaatttttcataaaaaaaggagtcaattgatgtggcaaacttcgttgttgtcttcttttttaaaattgccacagccacaccaaccttcagcagccaccaccctgatcagtcagcagccatcaacattgaagcaagcccctccaccagcaacaagattacaactcactaaaggctcagatgattgttagcttttttagtaataaagtatgcttaaattatgtacatattttagatataattctattgcacatttaatagactacagtgtagtgtagatataacttttatatgcactgggaaaccaagcaatttacgtgacacaatttgctttattacaatattcactttatttccattatctgaaatgaaacccacattatctttgaggtgtgcctgtattttgttcaggagggaactgaggaagacactcttatccaggatgagctgaaattgtttctcaagttgttcttgacaggggaaagagtctttggaggtcatgtttgaaatgagggtttgggactctatgaatttcaattatacatgtcctctctgctctgcctccagataataaatatacaatcatgtcatctgcaaacagagacaatttgacttcctctcttcctatttgaatatcctttatttctttctcttgcctgattgccctgtccagaacttccaatactatgttgaataggagtggtgagagagggcatccttgtcttgtgctggttttcaaagagaatgcttccggcttttgcccattcagtatgatattggctgtgggtttgtcctaaatagctcttattattttgagatacgttccatcaatacctagtttatggagagtttttagtatgaagggctgttgagttttatcgaaggccttttctgcatctattgaggtaatcatgtggttttggtcattggttctgtttacgtgacggattacgtttattgatttgcatatgttgaaccagccttccatcccagggaggaagccgacttgatcatagtggataagctttttgaggtgctgctagattcagtttgctagtattttattgaggatttttgcatcgatgttcatcagggatattggtctaaaattgtctttttttgttgcgtctctgccaggctttggtatcaggattatgctggcctcataaaatgagttagggaggagtccctctttttctattgcttggaatagtttcagaatgaatggtaccagctcctctttgtacctctggtagaatttggctgtgaatccgtctggtcttgggctttttttggttggtagactattaattactgcctcaatttcaaaacttgttcttgttctattcaggggttcgatttcttcctagtttagtcttgggagggtgtatgtgtccaggaatttatccatttcttctagattttctagtttatttgcctagaggtgtttatagtatagtactctctgttggtagtttgtatttctgtgggattagtggtaatatcccctttatcattttttattgcatctatttgattcttctttcttttcttctttattagtctggctagcggtctatttttttgatcttttcaaaaaaccggctcctggattcattgatttttttgaagggatttttgtgtctctgtctccttcagttctgctctgatcttagttatttcttgtcttctgctagcttttgaatttgtttgctcttgcttctctagttcatttaattgtgatgttagggtgttgattttagatcttccctgctttctcttatgggcatttagtgctataaatttccctctaaacactgcctccagataataaagaactacttagaataagtgacttttcataaagtgtcagtgttcagtctcttcttttttacagtaatgaactggtatttcctttacacatctttggatttattctgatttcttatgaaagagaaaacagggagcccaagtattaactgcaaggagaaccagatttcattaaacggtgacctggatgaattcctaatatcatatgctttattctttgcagagaagggcttatggtttgattttttcaaaaaatgctggctacttatccctcctttgacatcagtttggtttgccttcatatgtttggagtataacatgctttatttggcctttgggcttctcaagtttaaaaacatgcacttcattatatctgtaatggatattttgatagagtgatgaatatgctcttccattttgctgttctctaagattactgtggaaccatgattattgatggagaagaagctccagttgcctacacgttggatgataccaaacctgaaggcaactatgctgccataatggggtaaggcacaattatggtgttgtggctgctattcagtgttgacaagataatcacatactattaacaaatgtgccccaaactttgttaagtgattttttttttacccagtggtattatttttcaaattcagcggtacaaaaattattactggttcttttctaaataatgtcttccaatgaataaatatctaggtaggaagcagaataccaataacattttaaaatttttatgttagttttctattagtatttagtgttgggggtagacatatttaggtgacccatcttttgttgaaagcatgataaaaagacctgacttggggtgttttactaagagacttcttgtggaggctgtgtgggcatccatgttacttaaatgagatgctgagatttctgagtcccagtagagaagagccaagaccagcccagtcttcagctttccagggacgaccagcacgtgggaagggaagaccaggatatcctggcccagagaggtggtgacctggagtatccaaaattaagatgggcctcaggacatgtatgagtttatctcagagagagccaacagtcagaacagagagatcaaagctaattgttagttgaaagcaatcatggggctagaaatggagatggaatctagaaggttgggtgctagggagacaccatggtggagacaaaaccaaagagcaaggactggatgaaattggaagagctcagacatagccttaagtgggcatctgaggcccaagggttattcttattgaccaccagctgggtgaggggaagtgggtcagccatagtgttatccaaggcaaaaattatggccagtcatctacttttagtcgcttgattccttgaagttagaaagtgctcttcagtgtcagaaatttgatatgtaaatcataaaactttgaacgtaagaaaagctagtgtatagtttgtttcttttggttgacttaactgtgtaaactgggcacatgtgtagctacgaaaatgaggctaggatgaaaccaaccattaatttctcccctttttcttgtttatattctttagatttatcctggcccacaaagccagaaaactggcacgtcttaccaaagaggaaaggtaacaaaagaaatgctgcttctttcgtttcttccttcctttcccccccactccatccctccctcccttttctctttctttccttcttttctacctacttgcctgcctttcatttttacttaactttttaacttacggactgcctaattatatgtgtattgccagtgctacgtgtttgctatgttaattataagggtcttgttgtaaaagacatagtgctgataacttaagaaccaaagtattcaaattaatatttattgagtttattgtacataagacaccatgctaggggctacggagaatatgaaaatggatataacccaggggctgaaaatttgcttgtgaaggagataaaccagggagaaaaattactgtgttgtggggaagtctgctgtacacatactacatgaatgatgcataacaattacagattataggtacagtgggactaattcctctggaggtggcaatttcttcttgcaattagtgttcaccagtgccaattatttattcccacaccactgctaataacctatttaccaggaaagagctcctgaattatattatgatgcatgctttccgattccatcagggttctcctcaatgaccaatgttacctctgcacatagccagggccgtagcggtctgcctcggcctcttccctaaaaatgtccccactagaatataagatcatgaaggtaggatgttttgtctgattggctcactgctgggtttccagtgtctggaacaaatcttttcccactttgccttttgatcctgtttatggcttattcattttatactataataaaattttatctttttatgtaatcaaatttatccattttaaaaccatggtttctgagtatctatcatacatagaaaagactttctcattccaagataattttttagaaatcacccattcttccactcgttttatggtctgacctattatatgtaaatctttgatccttctgaaacatattttggtgtaagaaaataacgtaagcatcctactttatttctttcacgagcagctatttgtcccagtgccattttattgaaaactgtcttttccctgtgggttcaaaatgtccacctttatgaattctaaatttccttatatatttggttctacttctgtacttatttctttgctctttctatccattcctctgcttgtggcaagttacatcatttgtataaaaacaaagaaaaagacagaaagagagagaaagaagagagggagggagaagaacttaggcattttcataaacatttgtttcagaaacattttgttcataaacaaaagggctcctggatttaaaataataaaataataccatgattcaggcaacatgtcactttactttcttaaagacttaccagcaatcctgtgtgattaatatttgtgacctcaaagatttaagacatctgaaatggaacaaaatgccttgttttaaaaaattaaaatgaaatgctggagtggaatcaatggctcatggaatcttttttatgaggggataaatgcctctttcccactttttttttccctcccttctttcctttattttctcttttgtctcttttcattcacaggttgaagaaactttgtgaactctatgccaaggttctgggttccctagaagctctggaggtaaggctgcttcccaaccctatactaagggtgagaggcctttctttgtccccaagtgactagcagggataggttaatgcaagttgggtcctgaagttcatgtttttcccaatatatttgcagaggcatctacacaggactggtcagtttacaagtggttccagagagtgtgggccctggctgtgctggtggcaggtcagggaacttgcaatatgctgtggtttaggtgatgctacattgtccctgaattcagagtttcttcctgggagagggcattgggtcactctgcttccagttctgttaggggggtaaaagaggggagcttctactacccataggaagatcctagatcctggtagccaggatggggatgaaaagggctttttcccctctctggtgatcttgtaagaaggacagagtctcactcaggtacataaacctatacctaccccatcccccactgtctcacagtaaaaaaataagattacctgtccccactcctgcatgccctcttttctgccttgttttacccttgaacatgagagatgtaaagaagacaggctgtctgtctgtatgccagttgagttttctagacacctttggaagtagcctgagaaaacggtgatcttcaaatgaatcaagtagaactctaaggtggttaaaggtgggataggggcagggtagggggcatttggtgacagtcagagggcccaaagtactcataacaagtacccataatcacctccctcatcaatatttaaaatgatgaattggtgttctcatgacattcatcagactgctaagtttttaatgttttgacatagactatgtcaccttttgaaagtgattattaaatccaattatctgtgaagcatttgaagacaatggagaccaatgtacaaatgagcagttaatgcgtgagaaaagtctaatgaggaggctgagaatgtttaacttgttaagcctcttaaatccaagtctctgtagtatataccacaatctagttgagcagctacatgacttagtcctattactctaacacttactttgctcagctttggagtgacttgcttcctcctggttaagttgttgtgtctttcaaatttgtcatttttgttcactattttaaagcaaaattctctccctccctcctcgccccaccattgcagatcttctgtacttgatacaggtgaaacacatgctcttgatgtttcttggaattctttctcagcaaataaactagaacaattagagaaacaatattaatgaggaatatgttttgctttttttttttgctttcatataccaattagcaagtttaaatataggcatagcctccaggctcaaggatattgagtaaagtatcaagacaaaaaatacagtatatactcactaaaaacagaacttaacatctgttaaaaattattagtttttctgtttaaaaatgccattcagcatgatttataatcctttgggtatatacccagtaatgggattgctgggtcaaatgatatttctagttctagatccctgaggaatcgccacactgacttccacagtggttgaactagtttacagtcccaccaacagtgtaaaagacatatgcacacgtatgtttattgcggcactattcacaatagcaaagacttgaaaccaacccaaatgtccaacaatgatagactggattaagaaaatgtggcacatatacaccatggaatactatgcagccataaaaatgatgagttcatgtcctttgtagggacatggatgaagctggaaaccgtcattctcagcaaactatcgcagggacaaaaaaccaaacactgcatgttctcactcataggtgggaattgaacaatgagaacacatggacacaggaaggggaacatcacacactgggacctgttgtggggtggggggaggggggagggatagcatttggagatatacctaatgttaaatgacgagttactgggtgcagcacaccaacatggcacatgtatacatatgtaactaacctgcacgttgtgcacatgtaccctaaaacttaaagtataataaaaaaaaatgccattcagtgctagaggtctggagaataaagagtgtggagttgatttaaaaaaaaaagccattcaagatatttcaccctggtagatattcaagctttgtgaagttacattctgaggcactcccaggctaaagcagtttgttaattgaagttcctgcaacaactcgtgagatggttgtttggggaacttcagttgaaggggaaagcatttgtcctcatattttgaaaaaggctgatcatttttcatttgagaaagtctcttttcctaagaagggtgtgcatgattaattcctgatgataaaaataagttggtcctgtccttgtttgctcttggcatagagaaggccacttgttttctttttgctttggtgtctattttgtggaaggaagaaattcctgggaacaagatacattgaaagataaagtccaacttttcttctgattggctggagacagccagagaagcttgcttaggaggtggatgtagccgtcaggtgctggggcgtgtagcgtggtgataccacagaagacctggagccacttaacccatcaggcagaacctcataatcatactttgtaaataggatgccttacaaatgactgtccaaagtcagctgtgtgattgcaattcttttaaacaaaatgtttttcaaaatctccctttaaaacaaacattgttttcttaaaacttgctacgttgattttatcttttcgaagtaatgcttaatgataaagcttctgtttggttactttaaaaaagcatttgagctttacaaaatctctgccaatttttcctgttcgtgtcaaaaacatatttttcagaccaatagttgtttacaaataccaccatcaacagaagtgcttgcctgccacaaaaacatgtttgttcagcctccctcaagaaagctcacctccaccaaaacatgaacctgataatcctttttcttcaacagacatatttttctgtctttttttcctatccagtcactccagtaaacataaatccttttaaaaacttttcttgaaaccatcaggcactaaaactttttaataggtaaaaccaaggtaaaaatggaattagattatcgcaatttatgaacagtacttaagatacaaagaaaccaaatgaaaaaaacattctaagatctgaatttcttagaagcttattaccaaggacatttacctgcccaaagacatatctttaaaaacatcaggataatgcaactctatttccgaaatacattggtttgacaatacaaagcctactaaactgttcgatttattctaggctaaatagctttctctgagtctccttcaagtttttgttgctctatcttgcagccagtgcattatgaagaaaagaactggtgtgaggagcagtactctgggggctgctacacaacttatttcccccctgggatcctgactcaatatggaaggtagagtaaaagcatgctaagctgttacagaaatcccctgcacctgaatccaaaacctaaataggttcaggtagctcttctcccttgtttcttataaatacaaaaaaaaaaaaaaaaaacaacccaatttcctttgtatcttatgaatgaaatcgtgtatcttatgaatgaaatcattataattatacatacatcatggtgctgcttttccctggaagagcaattccaatcaatataaccatagaaggtttcagcataagaatagcattttaccccattcttcatgatatgattattacgcattgcatgcctgtatcaaaacacatcatgtacccatagatatatacacctactctgtacccataaaaattaaaaatcaaaaaagagtagcattttaggtagtccaagggttcacccaatgtcagaagaagtgtccttatactgagttaggactcagtaaaacttcctcaaatgccactgtacaactgccaacacggggacaaaattataaaaacaaaatgagttctagactgggcatgaagagacttgggtcccagctctgattctaccaataacaaactttgtcatgccaaacaggtcacttctcctttctgaacctcactttcttagcaagtggatgggaaagcacaaaatgatgaaaagtgagcaataatcagtatgctcaagaaagtatgagttttttttattttttgatcctaatccttagatgctgggaagtatgagttattttttaacatccttattgagacgtaattcacataccatacaattcacctattcaaaacggtgcacagttcaatggcttttagcattcacagcattatacatccaagtgtgttgttgtttagttaatttatttgatgacaataaatgaactaataatatagcagtgatttttatgactattatactattactaaaccaagcaataatttaatgccaaaagcttaatctaaacaggatgagaaatgtagactagtgagtcaaagactgttgaaagtatgcagcaaacagagggggtaagtggaaatggctaatcaatctgtccatgaaaactggtcgaataaggagtaaaacctgcttatcagaagatacgtaataactttggttagcactttctttacctgcttaaagatggcaaaatattatccaagagaacattctggggccaaggggcagcacctgataagctgctgggtcattaagttaatttttagatatgctgactgtgttactctattttcacactgctgataaagacatacctgagaccgggcaatttacaaaagtaagaggtttattggacttacagttctacatggctggggaggcttcacaatcatggcaaaaggcaaggaggagcaagtcacatcttacgtcgatggcagcaggcaaagagagagcttgtgcaaagaaactcccgtttttaaaaccatcagatcttgtgagatccattcattatcaccagaacagcacaggaaagacccccgcccataattcactcatctcccactgggtccctcccacaacacatgagaattatgggagctacaatatgagatttgagtggggacacagagccaaatcgtatcactgagtgtagaatatgtcaatggtatttgtttcattctgcatttattggctaagtgccaaccatttgcgaagcactgtgctgagaacttcaataccaaggacagcctccctgctgagaaggagctgacagtgttgagggctagggtggggatggggagaggacatgatatcaaaaattgactctaaagtactgacatatgtccctggaagggaataaggataaaggagggcactactgtatcaccactcagaatgttaccactgaggtaaatgctctaatacaggggcatagagataccactggaacacacagaggcacaggctagctttacttagagaaatctgggaaggcttcataatgcacataccacctgagggttgtaggaggcagagaaaggctattggggatgcagtctatgcagatggaatggcatgaggaaaacgctaggatcccacaggtttctggaaagtctggggaagaactttgcatggatggtgtattaggccattcttgcattgcttaaaataaatacctgagtctggggaacttataaagaaaaaaggtttaattggctcatagttctgcaggctatacaagcatggtgctggcatctgctcagtttctggtgaagcctcagggagctcacaatcatggcagaaggcaaagtgagaacaggcaagtcacatggcgaaagcaggaacaagcaagtgtggtggggagaggtaccatacactcttaacgtgaccagatcttgctagaactcactatcatgaagaaggcaccaagccatgagggatccgtccccatgatccaaacacctcccaccaggccccacctcaagcattggaaattacaattctacatgagatttgggcagggacaaatatcaaaatattatatcagatgggctatgggtgatattaaggacagaatggagaatcagatcaaagggggaggaagaacagtttgccctatatgacacattcaggaatacaaaacttgatatttcaacagagaacagctatcactgcattacttttgtttttggctttgttttaaatcagaagtgtgatatgattagatttctgaccacagagtggtgggttttatgctcaatttcataaataccttttggtttggggaacaaagaggacactaacctgaactggcctgatcctgaccacgtgagagaagcaagataaatcccattgtatctggcattggtggtgatacagtaatgccttcttttatctttattccttcccagggatatatgtcaggcttcctataactaccttcaatttttagggtagaaactaaggcacagcatagcttaacataattcccagcttgaacagagactacctgcccagaagacttcccttgacccttcagggccatggtatttaagatattgcaataagttttatattcagagccctgaaagttcacagtacatgttctgaaggaaaagagaagacagaattaccagtacaacttggtaaagaactaaatatacatttcttaagaaatgtttcttctggatagggtgaaaaaaatgattgtcgtgattatgcagtaaaactcataagccacaagaaatatatgtggagttcccctttatgatgtcctatatcttttgtaaatatatactgtctgttcacgcacctgcaaaagaaggggcaggtatttttcttacctggttgttggactctttttttcccttaaaggaacataatttccaaatgacaagtggcgggaaactatctctttgtttaaaattaattcttggttttcacatattctgatttatagtatgattagttctctaagcctttgttctgtcttctaatatttcattcttagggtctagccaggcctcctagaggtctccagctggggttagttttctccattgaaaaaaaagtaaacatgtagtgaaaaacggcattgtttaatcaacacggggaaagtcaatccaccttctcttgtaggaagggttccttcctgagtacccttaggctctctatatatttcatgtgttgtcatcaatatactaatacaggtgttcctcaaaatatgatggggttatatcccaataaacccaccataaattgaaaatattataagtggaaaatgcgcttaatacacctaatgtactgaatatcatagtttagcttagctaccttaaacgtgctcagaacacttatattagccgacagttgggcataatcatctaacagaaagcgtattttataatagagggttgaatatttcatgtcaagttttaaatacggtattgaaagtgaaagacagaatggttgtatgggtacttgaagtatggtttctactgaatgtgtattgttttaacaccatcataaagttaacaattatacgttggagaccatctgtattctatataatatctctccttgtattttcttctcctttttgtgatgactacaatcagagcaggtgaaagaaaacccaccaatgcaagccagctcatttggttttctaataaaaggcccagtggtgtacagtgttgactaagatggaacatggatgttagttcttgacatcgcttatcagatataagagaaccatgagacaggatgaataatggcatgttgacggtgctttccttatggtatttttgtcagagcaacaatgaactgcccctcttacaggccaagtgctatgacatttcagtcccttgtatagcatgtgggcagtctactaactattaaatattatagggtgatgatacaccaggcaaagaatataagataaaaatagagactttgacatctgttagacatggttcaaatcctggctttgctattttctaggagtgtggctcttggcatatcactgaacatttctccaagcctcagtcttctcatatgtaaaaatgagataatgataatagtagctacatcacagagttctttaatagattgaagaaataatgcagtagagagaggaagtataactaagtggttaagactgtaggttccagagtcagattgcctgtgttcaaataccaactctgctacttactagctgtgaccgagagcaaattactttgtctttgttgctggttaggttccaggaagcagaccctgaaacaacgattagcagacaggatatatattaaggcatgcccttaggattggcagctgtggaagggagaaggaagcaggagtgggcatagggagaacttgggctgcagtgcagttccagtgaaggcctcagctgaccccagaggaagttccagaactagaatggcccttcagagtgggaggtctcaagttggagcttgggaatcaggtatttacagcccgtggtgatcagtcactggatgcaactgctattggaaggaggcatgacctagtaggtaacatagttttttttagcagaggcaatctccaaagagggctgacatcagtaggccctcttctggcagcactcccagcagctgggaataagtctttcattcttgaagggggcctgcgtggttcatcacaatgtccaccacagtctacctccatattcttatctgcaaaatggtgataataatagtaccgacctcaccagtacaggcaagtgttcaaggaataggagttatggagccatagtcagactctcagatttgttaaatgttactgattgaaagggtcttagaaatcagtggaccattccctttaagaggcaaggaagccagagcacagtgagagtaagtgatttgccaagttcactagtggaatagccagtggggaattgggggcatgtatcaccttgccacagagccagtgagccataaagggagccatgtgactgggcttacacagtccctcacttcatgttgatgaagcaaatacataatttacgtccattaatgtcagctccttcacctgcaactcttggtgcaggagtgaactttggcttttattctattttgtttgtgacaaggatcatgtaagagctggaggaaccacataaacattattccaaaattgccaatgtccttcttgattgtttagaatctgtggaagctgaccagcattggtctttatgggaaaacttttctctgactctctgagactgaccacttttgcctctttggttttgttccaagggttctacgccagccagtggacaggatttactttgcaggcaccgagactgccacacactggagcggctacatggagggggctgtagaggccggggagagagcagcccgagaggtagggtctggggtcatagattatggggaaggaggcaactcatggtcctgacatgtaggtcaaagatatctgagagcctggagaccaactctccagtaacccccatcttaagacccataaaatactattttaactattgtctcaggtgaagtgaacaccttagcccgaagtaataatgaaaatacctaacatgtcacccgaagtaaaaagagcccatggggcaaacgatcaacctgactatacttgaaaggtaacctaggtctgatattctagaaccaaacatgcttctattaggactcaaaattcaattcatttcacaggaaagattttctgacagttcctctgatgtcatccctatttgaggtgtgttcataactattaaaatttatggtaagcctaatgattggaacctcttataccacaggagaaagaccttttggcgcctcttaaaggttgtatggagtgttctggcctttaccttggtgtttttgatggatatctcaagagacagttacttagtcctttagggagcagattagaagaaagatggtgtcacttttgctatttgccagtgtgttctttcatttcagatcctgcatgccatggggaagattccagaggatgaaatctggcagtcagaaccagagtctgtggtaggctatgttttatttcatgaaattagatatcttttctctaaacccattattttcaagaagagcacacttgtatatattcacataccttttcctaagtgattcaactaagtgatttaaacatgaatgtttaaataagtatcatgggttagggtagaggtgagagatttagatgaactttgataaatttgtagctgtcacattcattacagattattaggaaaaaatattttttgatgaggagggagacatttctcggagacttctaaaaataataactcaataaatgcctgtcaaataaatatctagcctggtgattctccacatgaggtaggaaaagaaaggaaagtgtgttagcatctcctgtccagggacaaacaaatggaatgaaatggagaatatttagattaaaattttatttttaatatactcatcatttttgtaataaaatcctaggaagttttcctggctggaaggagggatgcatagaggttagagtgcaaacgcactttagaggacaaagtcacaaaggtcagaattattgctctatccttttaagtgtgaagtcaaagagaataggcctgccactccacagtcattctcttagtgcttctgccagggatgggattgtgggctgtagggaccattgattcatttactaacaagtatttatggcacacgtgttctgtatcagccattgtggcaaaggcacagcagcatttttgtggagctcaacatctggtggagaatgcagatgataaccaaaaagtacagaacagtgaagaagacatgctgagaaaaaatgcaaaaggagaatgtcatcctaggctggggtctcaggaaagaaagcctccctgaggaagtgaagggtccagtgaggaagacagggtaaacagtataagcagagggaacatcgtgtttactggtctagacgttggcaagaatgggtcatgttcagagagctggagaaagtacagactttctggaataaagtgcacaagccctgtactaatacccaatgttttctgaacctaggatgtccctgcacagcccatcaccaccacctttttggagagacatttgccctccgtgccaggcctgctcaggctgattggattgaccaccatcttttcagcaacggctcttggcttcctggcccacaaaagggggctacttgtgagagtctaaagagagagggtgtctgtaatcacactctcttcttactgtatttgggatatgagtttggggaaagagttgcagtaaagttccatgaagacaaatagtgtggagtgaggcggggagcatgaagataaatccaactctgactgtaaaatacatggtatctctttctccgttgtggcccctgcttagtgtcccttacctggcttagcgttctgtttcaccagtttccaagtttattgccctcaaaatctttagaatagttaaattggcttgtttaaggttcttgctgccccacaacacaccttgcccatgcacaaggaatgaattttttcctaccattatggctttgtgcttgttcttcctcttacctgtaatagcctcaccttccctagttctttgcattcgtccttagaatactgtattgttacagctgaaagacagtaaagaccatttagtcctcaccttctgttttagagttgagcaaactgaagcccacagaggtggaacttaattacctaagagccacaataagccactggtatctgggggactagaacacaaatccaacgcttttcccacctctttggatgttttccccaattatcctccttcactccctgtcatagttaccgatggtgtcccgttgtgtgggtttactctgtgctaagttgtcttacacttctcaaatgctactcagtatatagccttaagtcttactgttttgtgcggtgtgtctccagctgattttaacttttttgatggtagaaattttatctcttcttccttttgtatcctccattgtatcttcatacaaaggacagtacacacttgggtaattaaaaataaaagttgattgaccatatctgctgtcctttctttttgggtaatgactttcaagctttggacacatcaaatcaagatccagtattaagtatataattgtgacttgaaagcatttagtcaaaatttccttgaagcctggatgatgcatgcatttgattgcatgatccatcatgggtggcatatgtgtgagcatgctgaaaatgatttataaagatatggtaagaatactaaaagatgcagttccttgccttcactaccccaaaaaatacctgccaaaataaatgacatattaataagcaagatgcttaaactattaagctaattataatatttcagttgacatttcatattccttcttggtgcaaagctttttactaggtacactcattaatttgaaactgcagtttcacagtccattaaattctatttggactattttttaaatggtatcatcatttcaaagcactcatacctctcgactcccaccgtcagttttcattggtatgttttttaaatccataaatggccattcttatacttttgtttaaaaaatgaagcttattcttagcataagtgaaattgaagaaatctcccaagattaattaataatagtatagagtttctgattttacagtggcattaacatgtatgagtttatggaaaatttagggactgtcttactctattttgtgttgtttgttataacaaaatatcacagacagagtaatttatagtgaacagaaatttattgactcatgattgtggaggctgggaagtccaagatcaaggaactggcatcttgtgagggcctttttgctgtgtggcagaaggcatcacatgggtgagagagtgcaagagagggctaaactcatccttttataaggaatccactcctgtgataacaaatccactgccatgataatagtattaacccatttatgaaagcagtgccttcatgacccaaacatctttcattattagatgtcaccttccaacaccactgcactggggatcaaagttccaacacatgaactttgggggatacattcaatccatagcagatactaaatgggaaacccaccaagattttctttgtaaccatttttttttattctctctaaaaatgtacatggcatggggtgccttcttgagcatcttctccaaaaaagtctccctaaaagttgatctcattgctaactctaatgcatctgctaagaaagagtcaagggctggccacagtggctcacacctgtaatcccagcactttgggaggttgaggcaggcagatcgcttgagctcaggagaccagcctaggcaacatggtgaaatcccatctctataaaaaatgcaaaaactagcgggcatggtggtgcgtgcctgtagtcccagctactggggaggctgaggcaggaaattgattgaacctgggaggcggggattgcagtgaaccgagatcacactccagcctgggtgacagagtgagactctgtctcaaaaaaaaaaaaaaaaagaaaaggaatcaccttctccaaaaatgtcctggatcactcattctccagctgagtgaggtgccccttttctttgttttcccaatgtcacatacattgacctcttgttctgtgctgaccacatgatactgcaattgtgtcgtgttaatttacatgatttgactgaggtgccaagttacattaaatatcagctaccaaggtgagtcctgagatagacaaaaatagagaacttcaaaggaaagatataaaaaacgtgtttttgttttctgttgtaacccctcaccagttttgagaatataaaaggagtagagagggttttcaaaggggcagatttgtacagatctctttagagagagagctgccattctctgggtccaacacagcacaaaagggagggatgggggggctgccttctcattccaagtctagtgagagaagcatcaagaaaacccctttgagagcttcacgtacctctgaagaatcaaagacctcgattctgctcgaggtagta

SEQ ID NO: 17314 - DNA, 86936 bp, Human
  misc_feature (1)...(86936): n = A,T,C or G
agtcccacttaatacatgataggtgagttatttttcttgcctacttgcttcgatttgggttaagcgcctcagcttgaaaaaccccacagagaaccaacaattgcctggtctcccccaagtgacggttctcgccccgccccgtcccgtctcgcctcgccccgcccctccccgctcctccccgcccctccccgctcctccccgcccctccccgctcctccccgcccctccccgcccctccccgccccgccctcaacctagtgagggctggaggctgcgcagacctcgacgggccctacatgacgtcacaaaggggccagaccaagtggggcagcaccctgcgaccctgcgatcctgcctggctcagccgccttcatatatctgcttccttaagtccactcttgcccagatagctttcagttaaaactaaagaatgaaagcactaggttgagagcccacgcggctacacccacatctactcccccactctcgccaggcaaccgcgccccccgcctgcagtggcatcgtccggccacgcccagtggcagggtttccagcgcgagcctgcaggcaggccgggaaggcggagccaggccggcctagagtcacttctccccgcccctgactgggccgggagcccggggctggtctctaagagtgggtaccgagaacagcctgaccgtggagaagggctgcgggaagcagaacaccgcccccagcgcccagcgtgctccagaaacatgagcacaaacgcctcagcctccttccccggcggcaccggcaccggcaccagtacccgcaccagtaccggcaccggcaccagtacccgcaccagtaccggcaccggcaccagtacccgcaccagtaccggcaccggcaccgagcgcaaggcggagggcccgcccgaagccgggggcacaactgcccaggtcccgaacccggactccagcttggacgacacctcctacagcctgtccgaatggagcgtccgttctgagtggcggtccgtctcggatccgctagccagttcccagtggagcacgtcctcaactgccgaggccgcctcctggagctccagcatacactccccaatcagcactaccggtcttagcgagagtactgactccgactccaagagtggcctccggggtttcagcgcttacaacccgagcagtcggatccccaagtctaccaccagctcgaactcctccgatggggccgtcacagcctccaatcaggacaccggcattccctgggtattagtaacaggacctaccccgcccgtaaactcccccgtagagtcattgcaagggtctgccttctcctcagggttcagcaccccacggggtttggtaaaaggaccgaccctgcccccggattccaacctgacctcagtgtccgactacacttggatatttgtacggggacctcctatacccaatgacctttcgcaagtgtcaatacaagcacctcctacacccagtaacacccccgagtgtcagtacaagggtctgccgcatcctcagtgtccagcttcccctggggtttggtaccaggaccacctctacccaataacatttccccagtgtcgccacaagcacctcctgcaccccataacatccccccagtgtcaaggcaggcgtctacccccacctcagtgcctgacactccgcggggttcaatacaagaacctcctgcacccagtaatcctttccagctgccgacacaaggacattctaaacctaataactctcgccgagtgtcagtacaagggtccgccccgctctcagtgcccagctccccccgggtatcagctgaaacatcagctccgcccctgggcgctcccggagtatcagcaaaagggttcgccccgcccacagtgcccggctccccccgggtatcaaaagaaggatcggctccgcccccgggctccccgggggagttgatagaagggtccttcccaccctttgccgtccccactcctgtgcctacgacccaggagcgtgtcagccaaagcatggagaatcaagagaaggcgagtatcgcgggccacatgttcgacgtagtcgtgatcggaggtggcatttcaggtcagtgtggaccgtagcggtggcctgggggaccctggccagtgaggggtaggggaacctacagtagctcttgtggtgtttgggggtctctcatgcatgcgagagtgtagtgtagccatggcttggccccatatcctgcgaggtaggagtgggggttgtgccagttttgctggtggtgtgactgggggaggcagacacaataattttactactactactattaaatactaatatttaattagctcttgctgtgcagttgtatttagcactttacgtggattttctcagtcctcaacagtcctgtgaggtgggaactaaattcatccccgttttgcaaaaccaagaaactgaggtctggggagtttcaataactctcttgaggtcgaatcacctagcttgtaagtggctgaacgattttctcccatttaagacctgcagtactaattcctgaggtggctgctttgcctcactgatttcatatcctttgccctaaacagaacatcaggatacagatttctgtagtattgagggagcagtagtgttattccagtcctgctcttctctattttccgtagaaaatttagtaggtgaagaggaaggaggtagactcctttaagaaaaggttaaaaaaaaaaagaggagaagagggggtgagctcttaaactattcctgtgtgtgtgtgtgtgtgtgtgtgtgtgtgtgtgtatgaactgtgtttatatatatatatgaactgtgtttatatatatatatgaactgtgtttatatatatatatgaactgtgtttatatatatatatgaactgtgtttatatatatatatatgaactgtgtttatatatatatatatatgaactgtgtgtgtgtatatatatatatgaacttgcaggaaggtgtaggacatttattgtccaaagagaatccctttatgaagcaggggctgagtgccctgttgtatcctccttcctcctttcactaagagctcccaccacctgaatcttgtcttctgatgagccagttggtgggccagggtgcccctggtcctggcttggatttgtggctaaccaagtgagtggtgcatgaggctttccaatatcttcctggaagcctcatcatgattgatatattgtcgcctatgttgccatcattggtaaaatgtttgaaaattaggaattttgttgcctttcatccctggctagaataccacactgacctatcctccccctactaggtgttaataatttctgagttatccctgcaggatctgattcagaaagagaaagctgatgggagggagtaagtagagtggccccacagtagccatttttatatataaatctttcgaggagactctgaacatgctacaaattaatgttgggtagagatagctttatctgaacccaacattgtttatcctgaacaggccaagagaagagattggcatgaactgttgctttgccagttccagccagtaccagcaaaaacatacatgtatgttggagcatcagaggaaagcagctcctggtggagagtaagaaaaaggagtatttcagcttgtttctctttatttatttatgtatttatttattcattcaaaaaacacttgttgagtacctgcaatgaagtggactgctgtttcccaaaatctggtcccactaggcaagcctcctaaaagcaatatggttgtagatcactggaaaataaatatgatgacaatgtgttatatacattgactaggggttctgggtcctctcccatctccataccatctgtattctgcaattcagagttctttctgggattttattcttagtctttttcttgttcagtctccagaattccttaaggagcgcggtttttttatttttcctctgcctgattacctgctcttcctccctttctatactttatgctccatacttggtcattagcagaggtgaaattaccatgtagctgataaactttatgctttatggccttataactgtaggttgcttctggttctcattctaaataaataaccagtttcatactcagtcctgtatttgcaattttgctttcttatttcttagagaggatacccaagttatatataagttgtaggtcccacaaaacctgaatctgtccatagtcactcttaattattaatttatttccatttgggggaagtagagggcatttcttgcacagtagttcacacctctattccagaggccagcttcagtgacactggaaaaagcacttgacttcctctaatgccatctccatcagtcagatctgagtgattttaatactcaaactgaccagaaacattgctttctatctgtggtaccttcccagatggttcacagctaaaatgaaagtagttgcaagtgtggctcgtgttagatcctggacataaactgagtgtttcatgagcgggtgagaagcatcacttcccaagcattcttgtgaattcagaaacataccatttttgtgtgtgcttggcagtatcccatgaattacttaatagtccctgtggcagttttatatgcctttggatgttctttataacttttattaggacttgtacactttgataggttacccacacattcataatacatcaccaatccatagcatcagcagtgttatttctattatatagcacccagaagagtacatattctaagtgacattactcaaaattgatccatattagcaacattttttaaataactctctacacagagaatagcagcatctggatgtatctccttttttgtcattataaaacataaaatagactatgtcttacaaccacaaactctttttatctgcctaaccaccaattaaataattatatatagtatgttaatagttgagaggggaaataaccctgctgatttgttggtctagtggtatctttaaaatgctctggtccttaaccatcattcatcatctatcacccattcctttttgaaactcctttcatgttttcagcgatgctattggatcctgaatttttatcccatactgattgctgcttttccatccctttcattgtgctcatattcttgcaaacatctggttttgaaaggtttcactgttcatcactttggggctcttggtactctctccctctctttctcattctaggacttcagctgtcccttatctatagaaaactctcaagtctctgatttgaatcctcttccttccctgaactcctgtcccatagcttatctgctcctgggtatttcacgattgaacacttcaggttcaacatgtaccatagctactgtgctagccaatccagcttcttttcctcagttccttgactctgttcttagcaccaccatcccttctataatttttgacataatcttttcttttatcttctgcacccttttagcagatccttctcactcttctttggggctatctctcttctcctttctctatgatgacctccctccccccatcaccaggacagactcttttttaaaaatattttgtataaatgtaagggatacgactgcaattttgttacatggatagattgcatagtggtgaagtctgggcttttagtgtattcataacgtgaataatgtacgttgtacccattaggtaatttctcatcatcctccttcctcctgccccacacccttccagtcaccaatgtctattattccatacctctatgtctgtgtgtgtacattatttagctcccacttataagtgagaacatatggtattggactttctatttctgagttgtttcacttaagataatggtctccagttccatcaatgttgttgcaaaagctcttgacccctgaagctacctggttatgacccccttcccagtggccaccctttacaataatggctctccctttatgtccatcctgcattcagtgttctcccaaacttgatttttcttaaacacttctttcatcaccttgcccctctgctcagggccttcaatggtctcctattagcagcctcccaaacacctccctatcccgccccccatcatgacaagtagcatttcctactattttccaacatggatctgagctttagtctcaccgcctcgtgtcctcaggctacactacgtttatttagtcccttcatgccttttctgtttttatctttcttaacatggaagtgcttttctcttacatttatattctatctatccttcaatgcttggctgaagatcctttccttgatcactctggctcccattgatttttctctcctcttgtagagcttgtaatctgtacttaacaaacaatttacacttattttctatctcttatttcatgatttgattttaaggataatggctcagtcactgaattcagttgttagttcttactcatgagctgccacagatacaataaatgacagaaaactagcggtggaagatttttaaatctgccctcaactgagaatttctgaaatggttctctttagtagagaaaaaaaggaaacaagaaaaaagcccacctccaggggacaatgtatacttccttcatgagtctgtttggaatttgagtctttgggtcaaaggggttttaaaaggcaatctagtccaatcacctaagattttaatcttcttaacagcacctcgctagtgattagagccagatggctgtagctttgaacgcatttaaggataggaaatgctcggtctctcaaagcaactcattacaagtagaggtagctctggctccttgtcttgtttaagcatttcaagaacctctacctatatactaagcagtgactggggatcatggggaaagaaagagatatataatgatgagtaagtagcatccctgtacataaggtacttctatcttctggaagaagtaatcaagtgggtgaataattgacatgaatacagtgagataataattgatatgaatatagtgagataaatatcaatgtggtgagataaatattaatgttttgaatatgaacaaagtgcagggatcttgagagataagtagaattttaacaggtagagataagaggatggaaaaaaagacataccatacaggagagactagaggaacacagatacagtcatgagggtataagccagatatgagcagtgcttaatttcccaatggtgagagttccagggaatgaaaatagttgtttcctatgcctctaggtatgtgatcctggtagctattgagatgagcccagtgtgccacatctacccatgatttttgttcctgtgtgagctgtgaatggttagcgagcgcacagtgaaaatgccttagtcataacactggattgtcctgggtgaataaagtgtttcttcatttttttttattttgcaattaaattccaagtgtcacgtagaaagacctcttcatgtccaaatagtgtttaagcaatagaactcctctctatttttgtccatcagctgagctctgctgaaagaattgagaacactagctgcccagaattcagtgctgtataaaaccagcaggaatgaatttttcttatcttctgagagacagaaaagccattttgcaagagaaataactaatgttcagcattccgatgattgagtccacaacataccacaatttccctttttgctgaaatatatcacctgtaaaaattattctgctaggaccattttaggcattttaacccagaacttggcagcatgtactgtgtggttttgcagtgattaagaaaagcttccatttaagaaatgccacttatttttggtgtcttagttatttaaatactctgaggttcaatgtgggctgagcattaattttttgctgtttaggacacttctctgcccctaatttatattttatttttctaaaaaataaactagggtgtttttacttcataaactttttaaatactaaacaaagaatacaagaattacatttatttgtgttctgattttttttttttgaaatcttcatggttgaaggagcttttggatttatctggcattaaatgggaaattttagcatttagtcaatactaattgatttgaattgttacataatcctcagctattgtgaaaaatgtatttaacaatagatctaggtatagcataattgcatacattacagagaccaataatggagaaaaagaaacatggaacaccattattggtgaatattgggtcacaatctttgtgcagttatggcatagaaatattttaacctatgaaaaatcttgcagtatttgcattcaagtgtactcagaaagactaaggttgtattctagttttatattacatatagggtgcccagccctgtgatttagaaagtgtagacacccgataaatagttgttaaggaatatacttgtatgtaggagatgtatagatttcataatgatagggttttttttttcattgtaattagaacttcaaaaattgaatcaaaacattttctaaatgttgtgagcatttgagacaaattgattgttgggactgtttctcctcctttatcatgacaaatattttatatttttaccagcaatttgtattttccttcaaacaatctatttcttgttatgttgccatctgtcattgtgtattagggaaatttaaagtctttgaactatggttttgtcatccaagaagttggattaagttatatgtgatatatcttctggtatggatttttagtaattagtcaatttcatgaagatccgtctctttagctttctttcttggaccctcctcaacgtttttttcttctatgctttattctgggaagagtttgcattatctgtcatactgacattcttcacaaacttgaatcagggcctgggtctctccacaggtgctcattcacactttccccatggcttctctgagactttgtttaaaacccttttctagttgttgctaggcaaaagtaaacaaagcacactcaataacaatatttaattgattgactaagagtgttaagaacataaaaaacagatgataagatttaagagttgaagtaattatatattaaccatgtccaagggttatagaatggtggcctgtaagagcccaaagggactgaaacagaggctcagaggggtccagggaattaccaaatgccacaaaattcttagctgtttaacttgtccttggatgcgtaaaatactgacttccaggacagtgctctttctgtacctcacctcactggacctgctttgtcagctcatccatagatctgcagtaaaccttattattgctttactttgaacgttgatgctctaaagcatagtgactactgcttaacagtaatttatatattataagatatcacaaggaatgttattgctttctgaacatttaaatttaaaaatatgggacaccctattaaataaaatgactttcatatgacaaatctatttccttgttggaaaggccattcctggtgcatttaggatatgtagagattgttgggatagtttagatcagtgattcttgaccttttggaccaaatgtctcttggaaaatctgatgaaagctattggacgtttcaccaaaaaatgcgtatttttacgcatagatgtttttctcctctgcaccaggccaatgttctggaaacctcttctgcgtcactgtcctaatagtgtaattatttttagctgatactgagacttcacgaaagtggtgaaaaatatttcagaggattcattatatcattagacagttactagtaatgaatttttaaatagaccatgatgaagagtcaaaacattcaggctggacacgaaggcacctacatttgctatattagctctatgataactagagaagtgaaattgacatgttttgaaaagaaagaatttgggagaaaacattggtgaaggaaatggaaggctgtggtggttgagatttcttttagtagttttcaaagattgtttatttaaagtatcattagcccatcgtctattcagtgacttgtgtgaggcatagaatctgtgtaacctctgtgtcacaggggttacagagatgagcctgaaatgctcttcaaagttggttcagaggtccaatgtcagcacagaggagggaggagttaattccacctggaggaagtgacaaggaaaggatttcatggaggaagtcatactcgacagaagtgtcatagattttggataaattctgaaatgtaatgaagatgacctttaaggtgaccgtttccagattaaatgagttagcttggagctgtggcctaagttgaagaccattttcttgcttgtatgtatctgttcattcattcagtaaatatttgtcaattgtgcatcactgtatgccttgagtaaaatttgtggggtttgctctcgcttctctgctttgggcatattgcctcaaaaataaaatgcctcttcgaaaatctgatgaaatctgattgcctcaaaaatgaggcaatatgagttgatatttgactatactttttattgcccttggagtgttcagtccaagagtccaaatgtgcagttatgtaagaattcttttggccagagaccacttcactgaataatagagaattaacaatgtatcatgcagtgtactctgtgcaattcctaggtgatgatgcatatcaaagttgaagaaagatgtcactttcgggaataaagagaaagaactaggcaggtatacaccatagctacactaaaaccttgctccaacatgctcagcttgtgctctgggcattgttcacctaggaccttgcctttgggagtttattatgctatttgaacaatcaatcttatgagagattaaacaagctttcctaaagtgtgttttcaggtatacatttttttaaaaagcagagggtggataaatgctgagttaaatgggtctttttgctgcaggacttctcaggaccatatgccagtgtgcaccaggcatttcccagaaggagaaacagtatatggtgtctcaacttccatgaacattgatacttctccccagagcatctttcttgaggactcatgttccgtaaaacatttagggaactacagcccatcctagtgtgcagagtccaaggacagcaatatggagtgtccctggtgcattttaagtttcaatgaaagaatggggcgaataatgaattaaggggtaattgcattccctaacttgggtgagatccttttatctaaagtgaagatgaatgcggaacaataatcaaataaattaggactgtctagacaaccagtctgttgaattcagggcaaattgaagttaattgttagctttcatctgtttattacttgagacagccctatcttttttagcctatcaaggggattagaagatttggcctttcctaaagcagagaattatgtatctgaaaggaagtacaaaatacagataggcataggtatagattagatagatagatagatagatagatagatagatagatagatagataggaatggttttatatatcaagggcaagtttgtgtgtatattgatattctctgttgtcttctgccaaaaagcacaatgctggttcaaagatcagagaatgtgctagcagtatttagaatctgctgacttacttaggcgtaaaggttaaaatgacatgccaccgtatccttgtcaatgtttcttagttgcttgagataaatatattctaggtagcattagaaacttccctgttgccctcatccacataagcatgattttgttttcttagtatgtggttcttctattcattgcaacaagcatttgggcactgcaacgtgcaggctccatcctagggatgcaaagatttgtaacacatttctgttttttcataacacacatatagctcatttatgcatctcaagattaatgcatctaaaacaagacacttgatatttccccataactcttcttcccctggctgtttccaacttaataaatggtacctctatttaaccagttgctcaggttaaaaaccttgaatccattcttggttcctctctttttgtcatacaccacatccattccagcagcaaatcctattggctgtagcctcaaaatatgttctgtatctcacggcttcccacaacaactgcaaccacagttatccccacccaagccgttgtggtcttttgcctttgtccaagccaccatgatctcttggccagagatctgcctctttactagtctctgtacttccttcctcttttgccccactacagtctgctttcctcacagaaaccaggatgatctttaaaaaagttaaaataaggtgaatcactcccctactcataagcctccagtagcccccatcatacttagaccaaaacctagagttttgatgtggtctacaagacactctgtcacttagtctcttcttacttttctagtctcatattctcctcactaatttccttttggctgtgctagccttactggtctttgagcacatcggcctttttcctatcttccccatatacttgcatggctcacttccttacttcattaagatctctgcttttgttctcactcataggtgggaattgatcaatgagaacacttggacacaggaaggggaacatcacataccagggtctgtcatggggtgggggaaggggggagggatagcattaggagatatacctaatgtaaatgacgagtcaatgggtgcagcacaccaacctggtgcatgtatacatatgtaacaaacctgcacgttgtgcacatgtaccctagaacttaaagtatatatataaaaaaagatctctgctttaatgtcacctctcagatgcattcactgatgatcctgtgtaaaagcactccccacttccatggctcactctccccttactctgctttatttatcttcatagcacttaatatttccttaatagttcctaatcacttaatcgtaatatttattcctttatttgtctctctttcccataaaagtgtaagcttcatgaggacttagttatattcacctgtatcacagcacctaggatgatgcccgggactcagtaagagtgcaatattatttgatgggtgaatagatgaaggaatgactttagctaggtttatgatacttgtgaaggggtaagtatatgtacttgcagaaagattccattgttatccatgccttagatgcttctcatgaagacagcccacatttcatatatctgtaggctgtatttgaaacattttaaggggaaaaataatttggggtagcaaaaaattcttaatgtttgtgtgtactagttttctctttgcaaacacagtgatgttctacaggaaacatatatatgccgtacattcaagtgagtgtatattgaaagatgactcttcattccacttcagccccaagcactataacccaaaaataactgctatgatagtttattgtgtatcctttcagatatttactgtgcaagtatgaagtatatacattttttgctattctacaatgggcctatactatatacagggaatctcaactttgcttattttaccttatttatttcaaagaactttcatactttttaatagttgtatagtatttcaaagaatgcctctaccacatccttgtatgtagctcttggagcacataggtaagtttatatgtaagagagcttgctaggattgtaattgctggatcaaagggaggtccatttacagttttgatagctaatgacaacaaggttgaatcactttactttgccaccaacagtgtaagacagaatctgtttttctgcatccatgtcaatactatgttttaactattttcattcttcaacccaataagccaaaatggtaccttatttttatatttctccagttatgagtgagattgaacaatttttcattgaaaggcatttacatttcttctgtaaaagtttatgttcacatttttttaacctattttaaaagcatgtctggtcatttttccttattgacttgtgagaactttttatattttgaagaaatgaactctttgttgaatgttgcaaatattttctttttatggcttctgggttttgtgtcttgcacagaaagcattctttattccaagaatattactttagaaaaatctgccttactttattctagttttttaaggtttttatgttatgcatttaaatcttctgagtttattctgagtaaagagttagagagagattctgctttactttttagatttccccaaatcagatgtctcaacacaatttattgactaaaccaggatttacctactgatttgtataatttaggctatttctagaccatatgctcttatttctctgtctctctaatcttgtaccagcacaactctttctactgtagctttgtcatacattttaatgaaaagttgagctagttataatgctttttcaggaatttcctggcaagctggccatgctatttttccatgtgaactttagaatcaggctttctaatataaagaaaaagttactaatattttaattgagatttcattacatttgtagatttatttggaggaattaaggtctttataatactatttccttttatcaaaaaataaaaactatttttctgttcaaatcttctattgtgtcttttggtgattttgaggatatttttcaggtttatttttcagagctcttgttgagttgatgttgctctaagaagtgagcttatttttttccatcatattccaattcattgtacatagggtagatatttatcttttaatattaattttggctgggcatggttctcacagctgtaatcccagcactttgggagactgaggcgggcggatcatgagatcaggagttcgagaccaacctggccaacatggtaaaaccccgtctctactaaaaatacaaaaaaaaaaaaaaatagcctggcgtggtggtgtgcacctgtaatcccagctacttgggaggctgaggcaagagaattacttaaacccagggggcagagattgcagtgagctgagaccgtaccactgcactccagcctgggcaaaagagcaagactccatctcgaaaaaaataataataatttttaaactagacaccttattccttgaattttctttttgtttttctttcattcatttattcattccttctcatcaattttccaggctaagtttccactatccatccactatgataattttctctcttctctaatttttatgcctcgtttcacccttatctaatggcattgattagtacttgcccaataatgttaaataaaattggtaatggtggaatttctaccttgtttctgattttaatgctactgttgtttcaccattaagcatagtgttcaagccaatcactccaaaagctctggaagctctcctaaatcactccaggcaagctggcttaaggacctccatagcaccttttttttacctttattgtaatctggaacacaatgaacttgagaatgtgtttatcttactgaacaatgttgacaaattctgtgtacatcctcaaagaagtacttttccacagatcgccctctgggaaacacagatttagagaaatacatgatcaacaataccaaccatagcataaaggagtttaaggattgagacaaaaccatgaggcttagaaaaaaggaggtcatcagtgaccttaaggataatggtgatgatgatagctcatactaatggtatatttaccaggcatcagtcacttggctgagtaattatacatgttaccttgtttaatcttcacattacccaccaaggcagaacaattattatctctgttttatagctgtggcaataggctgaagaaactttcttaagattatcacacagtaaataataaaatgtgatttcaaattgcactagctctatagcaggagctcttccacataatactaggagaataaatccagagcctgccccaggaatgttttgtttggccaattcattatgggatttttgttttgttttgtttgtttttaaactgtgaatgccttcagtaggcatacataccattgaatttgtgagtgtttttcaattgcagtctctgaagttttatgtatttaatttttattttattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgttgttccccttcctgtgtccatgtgttctcattgttcaattcacacctatgagtgagaacatgcggtgtttggttttttgtccttgcgatagtttactgagaatgatgatttccaatttcatccatgtccctacaaagaactcatcattttttatggctgcatagtattccatggtgtatatgtgccacattttcttaatccagtctatcattgttggacatttaggttggttccaagtctttgctattgtgaatagtgccacaataaacatatgtgtgcatgtgtctttatagcagcatgatttatagtcctttgggtatatacccagtaatgggatggctgggtcaaatggtatttctagttctagatccctgaggaattgccacactgacttccacaagggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggacattagccctttgtcagatgagtaggttgcaaaaattttctcccattctgtaggttgcctgttcactctgacggtagtttcttttgctgtgcagaagctctttagtttaattagatcccatttgtcaattttggcttttgttgccactgcttttggtgttttagacatgaagtccttgtccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcaggctcttttttggttccatatgaagtttaaagtagttttttccaattatgtgaagaaagtcattggtagcttgatggggatgccattgaatctataaattaccttgggcagtatggccggtttcacaatattgattcttcctacccatgagcatgggatgttcttccatttctttgtatcctcttttatttcattgagcagtggtttgtagtactccttgaagaggtccttcacatcccttgtaagttggattcataggtattttattctctttgaagcaattgtgaatgggagttcactcgtgatttggctctctgtttgtctgttattggtatataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgactaattgccctggccagaaattccaacactatgttgaataggagtggtgagagagggcatccctgtcttgtgccagttttcaaagggaatgcttccagtttttgcccattcagtatgatattggctgtggatttgtcatagatagctcttattatttcgagatacgtcccatcaatacctaatttattgagagtttttagcatgaagtgttcttgaattttgtcaaaggccttttctgcatctattgagataatcatgtggtttttgtctttggttctgtttatatgctggattacatttattgatttgagtatattgaaccagccttgcatcccagggatgaagcccacttgatcatggtggataagctttttgatgtgctgctggattcggtttgccagtattgaggatttttgcatcaatgttcatcaaggatattggtctaaaattctcttttttggttgtgtctctgcccggctttgatatcaggatgatacgggcctcataaaatgagttagggaggattctctctttttctattgattggaatagtttcagaaggaatggtaccagttcctccttgtacctctggtagaatttggctgtgaatccatctggtcctggactctttttggttggtaagctattgattattgccacaatttcagatcctgttattggtctattcagagattcaacttcttcctggtttagtcttgggagggtgtatgtgtcaaggaatttatccatttcttctagattttctaatttatttgcatagaggtgtttgtagtattctctgatggtagtttgtatttctgtgggatcagtggtgatatcccctttatcatcttttattgcatctatttgattcttctctctttttttctttattagccttgctagcggtctgtcaattttgttgatcctttcaaaaaaccagctcctggattcgttaattttttgaagggtttttttttttgttgtctctatttccttccgttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttcttgttggtttcaaagaacatctttatttctgccttcattttgttatgtacccagtagtcattcaggagcaggttgttcagtttccatgtacttgagtggttttgagtgaatttcttaatcctgagttctagtttgaatgcactgtggtctcagagacagtttgttataatttctattcttttacatttgctgaggagagctttacttccaactatgtggtcaattttggaataggtgtggtgtggtgctgaaaagaatgtatattctgttgatttggggtggagagttctgtagatgtctattaggtccacttggtgcagagctgagttcaattcctggatatccttgttaactttctgtcttgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagatagctcttcttgttgaattgatccctttaccattatgtaatggccttctttgtctcttttgatctttgttggtttaaagtctgttttatcagagactaggattgcaacccctgcctttttttgttttctatttgcttggtagatcttcctccatccttttattttgagcctatgtgtgtctctgcacgtgagatgggtttactgaatacagcacactgatgggtcttgactctttatccaatttgccagtctgtgtctttgaattggagcatttagtccatttacatttaaagttaatattgttatgtgtgaatttgatcctgtcattatgatgttagctggttattttgctcgttagttgatgcagtttcttcctagtctcaatggtctttacattttggcatgattttgcagcagctggtaccggttgttcctttccatgtttagtgcttccttcaggagctcttttagggcaggcctggtggtgacaaaatctctcagcatttgattgtttgtaaagtattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttcttgaggagtatctttgtggtgttctctgtatttcctgaatctgaatgttggcctgccttgctagattggggaagttctcctggataatatcctgcagagtgttttccaacttggttccattctccccgtcactttcaggtacaccaatcagatttggtctcttcacatagtcccatatttcttggaggctttgttcgtttctttttatgcttttttctctaaacttcccttctcgcttcatttcattcatttcatcttccatcactgataccctttcttccagctgatcgcatcggctcctgaggcttctgcattcttcacgtagttctcgagccttggctttcagctccatcagctcctttaagcacttctctgtattggttattctagttatacatttgtctaaatttttttcaaagtttttaacttctttgcctttggtttgaatttcctcctgtagctcggagtagtttgatcgtccgaagccttcttcgctcaactcgtcaaagtcattctctgtccagctttgttccgttgctggtgaggaactgcgttcctttggaggaggagaggcactctgctttttagagtttccagtttttctgttctgttatttccccatctttgtggttttatctacttttggtctttgatgatggtgatgtacatatgggtttttggtgtggatgtcctttctgtttgttagtttcccttctaacagacaggaccctcagctgcaggtctgttggagtttgctagaggtccactccagaccctgtttgcctgggtatcagcagcagtggctgcagaacagcggattttcgtgaaccacgaatgctgctgtctgatcgttcctctggaagttttgtctcagaggagtacccggccttgtgaggtgtcagtctgcctctactggggggtgcctcccagttaggctgctcgggggtcaggggtcagggacccactttaggaggcagtctgcccattctcagatctccagctgtgtgctgggagaacccctactctcttcaaaactgtcagacagggacatttaagtctgcagaggttactgctgtctttttgtttgtctgtgccctgcccccagagttggagcctacagaggcaggcaggcctccttgagctgtggtgggctccacccagttcaagcttcccggctgctttgtttacctaagcaagcctgggcaatggcgggtgcccctcccccaacctcactgccaccttgcagtttgatctcagactgctgtgctagcaatcagcaagacaccatgggcgtaggaccctctgagccaggtgcgggatttaatctcctggtgtgccgttttttaagcccgtcagaaaagcgcagtattagggtgggagtgacccgattttccaggtgccgtctgtcacccctttctttgactaggaaagggaactccctgaccccttgcacttcccgagtaaggcaatgcttcaccctactttggctcgcgcacggtgcaccacacccactgtcctgcgcccactgtctggcactccctagtgagatgaacccagtacatcagatggaaatgcagaaatcacccgtcttctgcatcgctcatgctgggagctgtagaccagagctgttcctattcggccatcttggctgccctccagtctctgaagttttataaactctattcattcattaataaattatttcaacaaatatttcctgagtgtccactgcatgccaggtactatgctaggctctggagatacagcaataagcaaaaatgagcaaagaccctattttcgtgtaggcttaattaaataacatacaaaaaatgtgtgtgtgtgtgtgtgtgtgtgtgtgtagtgccaggtagtaatgtgtactaagaagaaaaataaattcagggtagcagggacagagtgtgacagatgactatattgattgtctgcattgatggtggggtcactgggcattttttatgaggagtacactacatttccaggtttattcaagttaggaaatggagacatctgatcatgtgttgtagaaagaaaatcagaaatcacataggagctgaaaagggtggcatgagtctaattgaggaatttcttacttttctgtgatagaataatgtgaatattcttgaagaaataaggtaaagcaaatggccctgggagaggtggagaaggcagggctaagtgtggaagctaggttccaaagtgacagtatgcctgagatttatgccctgggaagcaaagggattatttcctcaaaagcttcattgcacaaattaactcccaaggtatgctatgtggataaaatcatctcctataccagttctctggggacagcaaccattttgggttgttggaagcattgcagaattggtggtaacacagtttctatgggcagttgctttaagaacctgaagcttgttttgaggttgccatggtaacaccactgctggctgcatacaacatctcacccaggctctcttgatctaataaccaggacccacattgccttgaactcccttaaacaaagtgtgcttttagcagactagctttttttttttaacctctctgataaatccatcaacctattttattttggtttctgtaaattgcaaattactgaggagagagaaattaggagaggaattgtattgttttaaactcatcatcccgatttagaatacttaatgcaaactaattaaagatctgcttgtgctatgatctgctattttcctgttttcaagtttttgcattttgaaatctatcatatctccttgttcacacaataaggccttaacaaactctttgtgaatgtagtttctctgacctctctactctcatagaaaaccacaggatactcaggagtcttgggctcttttcttcctaatgagctctgtttgccatggtttaggagaggaagaactctgagtataggggatgatagattttgctagtgttcacttagacctcttctctcaaaaacatgggtgagagaatcacaaatttttgacactaggatacttgacagtttggcccagtggtcttttaccaagatggctccacatctcctacatcccaatgatgatcataaacacttgctgatttaatagacaataatgttagtagcctgaaatcacactagtagtttgaaacccatgatgagggtacagatacaccatggaaatctaaatgctgtgaaacagtccccgcttcccactgctgggctggttgttaatcatttactggcatacctgtatcaaacccttcccttatcatgcgggtggggagtggtgagaaacaggcttcttatcactagattctatgtggccattaaatgatggaaaataaaagaaagggagagctgtaatgcataatgctcttcatttttgtttagtaatttatattactttggaacaagatgaaataaaagatttaagatgagatttttctctttgcataataaaatgtgaaaaaatatttgattacaaaagctatctttatagtagccacattttatttggtgacttgccttcagacttaagaatcttttctaacaattttatcccatttacaaaaaaatgctcaataaatatttcgaaagattaggtcaaaagcccttaaactaatctgtagggttgacaattaagatatcattttttttctataactgatcattgaattttgtagtgatgagggaagggtagaatgcatagtgagtgacacacaagtacaaaaaagagttggttataatccaagacttacatcttaaagtaggaataatttttaggttttgccattcaaatcagcagatagccacggttattacattacaaaagatttctgagctccaagtgtttgcctgtactttgacttactaagcattcaaaaatattttcctaacagcatcatacttttattttcatgttgtatatattttaacctttaagttatcgtggaaattccttaacagggtcttcttcccagtaaacatgcaaactgaaacattagcgcccatttattcagcatcttagaagaaatatgcttaatatagtagattttcctaaataacttaaaccttaacccttcaaattctaagaccttttagaaaccatttatctgaaatcctttttaaatattttaaacatatttcttatttcttaaactaagaatttaaactctccttgctgtgatagggcaatcgtttttctgcaatgtagaaacaactactttcaccagcttttaaattttatttagttatatccttaaatgccaaactgcaaaatgacctttgtcactggtgtggtcattgtattggctcagaagccctgctcccccctccccttttagtttcctgagtagtgtttatttattattggcactgaaatccattcataaaacttgtttagagttacatactagattcgattttattaagactctaagtgagggtgtgagaaggaaaatccttcgcttttcagaagactttgttgtggtcatatcaggcacttggaatatggagataatgaaatctactccaagggatggttgtgagaggcaacaaggaaaggcatatgaaatgaatctataggatgctactgagaggtccctttatgcacacaactgctacaggccccaccactgttgttcaaagttccccaccgctccatccccttaggcagtgtggggagagccagtttcccctccttacaagaggagctgccagagcaattccagtagacccttgggtatatttatctacctaactggtttttagttaggttgatgaaagggaatgagaagagataaaacttttgcatctgagtttctctgtttttaaatatggagtattactttgagcctaaaaatgctcatcactttcgacttagtaatctcccttctagaacttaaccctaaagaaataatcagacataaggagaaagatttatgcataaacatatttttcatctcactttcatcccatttttacattagtcagcacaaactttggctgtgttccagaaaacatattgcgccaagactggcagacattggtttgagtttatttaactgtcaggggatggcttttctttgtgagctgattccacaaattcattacatacttaaatcttttatgggcatcagcaatgtaagagtagtgtacttgaagggctcaaaattgcacacaaacattagcagatagcagtgctggatattatggtttagacttaatatcttttaagatattttagatcttgtagacccaaactcatccttgatttggctatgtgtattctatgacattctgtatatgagtaaaatactgggttctgtgagagcaggcatcaagatagaactagctgtttaaaagatttattgtgggaaaagcccgtgaaggataaaggggaaggagagcatgagtagggaataaaaaaacaaaaaatagggtagtcctgtataatttcttacaatttggattttgttcatttcatcccagtagtattatttaacatgttcctctgtcccctaagtatcagatacagagggctgatcacattagaatttaatttgttccttccttccttctcccctctcctcccctccatcccctcccattccctctcctttcttcattcttggaaaactacttcataggtgatggtgtgtgcttccatcaagagtcagataacatttgtctcatctgtttttctgtgtgtgttagcagcttgattatcattatgctagatccattaattcattaggggttgcaaaatgctgacatttgaattatttctgtcttcacttactaactagcatacttttatacagagaaacttcccctcattagctatttggttgttttgaggttcagcgcaaataggaaacataggatgaatactagattttttcttttgcttaccatttttcaaaatggtaagttgattccttagcattttccaaaggtggaaaatgagagtttttgtgtttgtttagtattattatgaactcatggatttaagccattgtagttgttatctttatttgacactcaaattatttcatctttggccagtaggagtttatataggtaggctcctaagtctttttgacagaatcctagtagtctctgacagccttcttgctttctggtatgatttagtgttcaggctcatcttgtacatttcctgcctcaggtctcactaggtcacaagccatagttcattgtagtgagaattgattttttagaaacaacactgtaagtgttgggagtgttcattgctactgggtaggttattttttctagaccttttcattgtacaaaactaagaaatatttttttttaaagttagagtatatccagagatcatacttataattccaatttatatctaggactacagggttactacttcatctcatcattttttacatctgaatttctttatctccatgctaaaaaacctgcttctcagcaactcaagcctgattactcacttgttttatcacatactacaaatgtaacagccttgggataacaatgctaatactaggactagctaaattgttattgaaaaaaaatgtgaagttcttttttatctttaggatatataccattagaaatgaactatcaaatccgtgtgttttaaaatcagttagaatagttctcctcctcaaccacttgtatacatatttaggtataatttgtatcactttactaatcttgtctctggtgccattcttatttccctctaccctaatataactagcattttctccctgtattatgtttatctctgtaataatgagaagtctatgagaagtataatgagaagtataaagttaactaggaactaagacagaatttgaagtacaaaaatgaatgtggatttaaaaataaatgtatgcacaatagcactatatatatatatattttttttttttttttttctttgagacggagtcttgctctgttgcccaggctggagtgcagtggcacgatctcggctcactgcaagctccgcctcctgggttcaagcaattctcctgcctcagcctcccgagtagctgggactacaggtgcccaccaccatgcccagctaattttttgtatttttagtagagatggggtttcaccattttagccaggatggtctcgatctcttgacctcgtgatccacctgccttggcctcccaaagtgctgggattacaggcgtgagccaccgtgcctggcctatatttctttgtgagctgagaggtcttagaagcaatgacaccccagtagcaatgagcacacctagaacccagatcttggtttctaatactgttctccagtaaaagggaccaaagctcaatgaagaaatgcctgattctaaggctgtggcagagaaagataagatgagtcgggagcattgtgtagtactagaaaggaaggaagtgtttaaacacacacacaaaatgataggggcatgtcaaaggggcataggagccaactaacagaactcctaataaccatagctggaagaatttgagcaacgaaataaatgacatagtgttggattataatccaaagtataaaacaaatatctgcgagtccatattgatatattaataagtaaatgattgaaaaagtcagtaagtgaggagaagagacacatctccagtgcagaattccaaataatttatatggatactctaccctcaaaaagctggaacatacttcccactccttaagtgtaggctatgcatagccttttacagtatgttaagatgggaaaaagaataactatagtggaaaaacttgacaaacaccacctcagccaggtgatcagatcaaggtcaacatcagtgataaatcatgcttgtagcatgcacccttgatataatgttaatctgcaatacttccttaatttttctggtattactatgttgggtttaaaaaatattttatctatcctgaaggcttttaattacaggtggaaacctgttctcagctttgtttgagctagtgaaaaaagtatgaagcatggtttctaccttatggtaacttagaaactagtgaaggaaacaagatctagcaagcatgtaatcaaaatataaatcataggacatgattatacaggatttttaagttgagaaaagcaaagcatagctatactgagacctggtgtagctagaggaagttttaaagaaaatagtctcttctgttaatactatcaggatttctgtatgagggaaatgatagggattgatttagaggctcaaaaattctctaaatatatgattatcaccagaaaacaagatatatatattttaagaccattacattttgtttctgttgaccaactgaaatgcaagatgactaaattagttatttttgaatcccttatgacagataataaaaattggtggctcacttaatcacagtgtggtcagaatttattagaaagacagcaaaatcattggattgtatatgataccctgcatttatttgatgtgtagacctggttaaatcttggattttaagcatttgaatgttacgttgctcttttttgtttttcctttaggactatctgctgccaaactcttgactgaatatggcgttagtgttttggttttagaagctcgggacagggttggaggaagaacatatactataagggtaagtgattttaatacttacatgtaatgtaatatctcactcaaactacaagtggcaccactggaaatcacagggctagaggaggtcttaagagttcatgcagttaagccgtttgtcctccatagccctaaagtactcccatcaaataagcgtccattctctttaacatgtacgcactgaagactgacagcttctgaatttcagtggagtgaattcaaaaaacatgagcaaataacttcaatacagtgtcataatttccatactagagacgtaaatgaagtgtgtagtgtctcagatggggtgatagtttggctgtactggaagtgactatacacccgcaatacacacagacacacacacacacacacacacttagattccctatttatccaatgacacacaacttaatagaaatgtggtggcaaaaacccaaaaaaccaaaaacagacaaaaaaagaaatgtggtggctgcagtaagcaggaacaaatgtagcatatttttgcataacttttcccttggcccttgttccctaagaagtatgcttctgccagagatactcctcaggtcgcgtctggctacatgtaagaaggaagcccagttcttgctacatcgctgctttttttatacttcggcttacatcaccattctggaaaaaatgcatgctattatttactactattaagggaatggttgcaggtggttgactctgtgggtactgatgaaagtaggcagggagataatgaagagtgggaaggaaataggggcaaagatggaagtttttgcacataaaagtgggggagaaagggagaagagtcagagagaagtagtagaggcagaagaggaggaccagactagaccagcaatgggtaagtcagtggacgaaagaggaaggggtgctcaacagtcaactgacacaatatgaaggcaaacaaaacaaaacaaaacaaaacaaaacaaaacaaaacaaaaaccctcgcatttgacagaagttcattaattaatgagcccctttgctagagtacacaaatagagtgttaaagactagggattgagagtaaagacaaaactagactgttgaagtgactggaaagaaaggaagcatctatctaactagaagatgcttcagttagactaataacagaatggcgtaagcaatgcaaacatttgattatttcacagaagtctggtggcagatagtccaggctggtgctcttgctttttgctcttctttctgctctgatattctttcttttcttttcttttcttttctttttttttttttttttttgagacggtgttttgctcttgtcgcccaggctagagtgcaatggtgcgatcttggctcactgcaacctctgtctcccaggttcaagtgattctcctgtctcagtctccagagtagctaggattacaggcaccccccccaccacgccagccaattttgtatttttagtagagacagggttccaccatgttggccaggcttgttgcgaactcctgacctcaggtgatccactggccttgaagcctcccaaagtgctgggataacaggcatgagccaccgcacccagccctgctctgatattctttgcatgtaggtttattgtcttgtggtaacaagatggatgctgagattctaagcatcaagttctcattcaaggctgaaaggagagtgaaagggtggcactagccttgtctgcaactaagcttttccttcgccaaaagaccccagcagacatttgctttagtctcattggctagagttgagtcacatggctaccctcagctgtcagggatcctgggaaagtaagtatttcacaatactaggctacataatggaagcaggcatgggagaggaaatatcaatggatactagaataacctacagacaacatttgaattaggatttcatagcagcgatttcagccacattgtaccatgctacccttctgtcatttgcttcctacctttttagatacagggatgtatctaggcctatttctgctttgctcagctctaagggtgctgtacagccttgctatgcaaagtgtcatctgtgggtcagtagccccagaatcaactgggattttgatagaaatgcagaatatcaggccctatctcagaactgctgaatctggatctgcattttgacaacatctccaggggacactatagaagtgctactctgtggcatttgtttgcttgcttgccttaaactaatgccaatccggattaaattttctgagtgctcccttagatgtagtccactgggaagctattggtctgggagtgaggagactgggattctagcctctgtactgacttgacatgatgtcttggataagtcctattagcactttacatctcagttttctcatctgagtaataagatactatctaaatgtcctcgaagaaactcccttccatcttcaaattctaattgaaggcagcgtgttatagtgcaaatgaagagctgcatcttctgcctgtatgcctttattagatatgattcttctgtcattttctgaaaaatattcctccactttggagatagttattaagttgtcccttagctctatttttcttatctctaaaaccttttggttattaaacaggagcattagtcatgttgcggattttcagttaagaacaagtttctttgtataagggaaatgagaattccaacatacttgtccccatctgtgttattggccccaattactttgccatgctgtgtcatttatatatgtcagcaccacacaggaactgttattgtctattcagcatgacattacaccccccttaggaatgtgagaaaggaatctctgaaatgcttggaaattaggacttagcatttatactccaaatgatgagaaggagagaaagagggctttaagaaacaggcatggaggccgggcatggtggctcacgcctgtaatcccagcactttgggaggccaaggcaggtggatcacttgagcttgggagtttgagaacagcctgggcaacatggtgaaaccccatctctactaaaaatacaaaaagtagccaggtgcagtggtgtacacctgtagtcacagctacttgggaggctgaggtaggagaatcacttgagcctgaaaggcaggggttgcagtgagccgagattgcaccattgcactccagtctgggtgacaggagtgaaaccctgactcaaaaaattaaaaattttaaaaaaagaaacaggcatgaaaattgtatttaataagaaactgaagcaaatattttttaaattgcttctaataacataatcaattaggataattttgggaggagatgccataaaagctactatggatctctgagtaccagaatgtcaaatttggtattacctggcaagctgttcagatgcgtcttccattagttcagaacttgcccgtttttcctaatgtgattcatccatgattcttcagagtcaaattaataaagttgaaatgcctgcagggctgccacagggttggtgtatgtttccaatattgttgcatgtttgtggcctcttcaaaggctgagtagtgagatctaaatcaagaccccaaagactgaggtgcaacacagtagaatacagtgttaccgcttctagtgtcttcatgctgaatttgaggcacttcatttagaacgttcttactttgtaaaggaacattctgcaaaatgcctcactctttttactgcttcatttaggattatttgctttaaagatagtgtcagcattctaaagacatcatgtttggaaactcccaggagtccccttgctgtctttgttaaagcccagaaatttattggagtactaattccagttttgttcattatatcttaaaatagttgttgtagattagaaaaggtttgaaggacagcactgatggttactaaaagagagaataaacattatatgagggcacattaaagaagtcacagaagcacttcatttctggtattatggcagaatggaaaccctaactcctcattgaaataagtaaaatgctgaatacaatatgctgtgctcatctgacatggaagttagaaatttgtagatctcctggatgttgcatagacatctcaaacgtaacacatccaacactagacttctgatcttccttaaggccgctgttccagctgcccatgttagaagatggcaacttcgaaaaaactcagagtcatgctcaacactaccagaccctcatttgttttgtcaggaaattccgttggccctgccttcaaaacatatccagaattcaacgcttcccaccacttccactgctatcccctggtgggagccaccattatatctctaggccagattactagagtaggctcctgattttcctgcttttactcctgccccctacattctgttctttcttagtgcatcagtgagagtgagcctttcaaatgtaactcagattttagcatttccctgctcgagaccttccaacggctccccttctcactgacagccaaggcctatgtccttacaatgtcctgtgaggctttacgtgacctgctctgccaataacctctgtaacctcatcttcaatttttttccttgctcacattgttccggccactttggcctccttgctatttcttgaatataccagcagacttctgtattacagtctttagatccatgttgctaggagtttttgctttttttttcgagacggagtctcactctgttgcccaggctggagtgcagtgggacgatctcacctcactgcagccactgtctcctgggttccagcaattctcccgcctcagcctcctgagtagctgggattacaggctcacgccaccatgcccggctcatttttgtattttcagtagagataggttttcaccacattggccaggctggtgtgttttaatttctacacctggaatgtttttcagttatttttcgtcatcactgcattgtggtcagagaatattgtttcatggtaacaatccttgaggctcgctttataacctagcaagcacatggttaatatccaaagatcttctaatttctgcttgaaaagaacatgtagtctctaaaagctatatgcagtgttttatatatgtccactagaataagcttaactgtgctccttcttttttgtttgcttaatctattaatcacttttaaaagtatgttaaaaattctctgttctactgggcacttatctttggttcctgtcaaatgttgcttacattttgaagctatattactcagtttatgcaagtttaaacttggttagccttctggatcttttagcattatgtagtgacacttatttcactgagatttattttgtttaaggttttctttgatattaatatagttataacagcttacattagtatttgtatatctctttatctttcagttagagttttctttattctgactttttttcctttttttaaattttagattcagggggtacaggatttttatttatttatttatttattttgagacagagtctcactgtgttgcccaggctggagtgcagtggcgcaatctcagctcgctgcaacctccacctcctgggttcaagctgttctcctgcctcagcctccccagtagctgggatcacaggcgctgccaccacacccaactaatttttgcatttttagtggagttaattgacaaacttggtccatctatatttgttatgatttcttttttaaatgttttaactttattatattatggctttccatttgtcccactttaacagttttcctcttggtttctttctttccttcttttgggttaatggttttcttctttttgttttctttttaagttttttcttctacttgttcagaagttatatagtcagaccaatgtttttcagacaattttcctaactatattaacactcatacttaatgtagtctaaagtttatcaacatactatctttctactaaaaaatacaaaagctttcatgcttcagttgtgagcacccttcttccaatctgtaaactataaaagtatttcaagtttgtatgtttctcagacattattaattttattttattctattgttgatgttgcttaattttctttaaagttttgccagtatctttgttcactgtccattcttgaatctcagaccttttatttgtaaccattttcattctacttgaaacacaccctttcctccaatctgggtcctaaactctgtacacttgtcagcttgacaaaaacatagttctaacaggtaacaaattctacttagaatttctcttcctctttttttttctctcagaacagcaaagatattattcccctatcttctggcttgtatttttattgttgaagagtcactcgtaagtctaattgttgatttttttcagagtatgtatgatttgcctcttttgttttctgaaaaagaattgcttttaggagctcttttctttggtatactgcagtttctctgtgtctgggtgagaatttcttttttatttatcattctttggacctgttgggtttcttatcttccaacaatgctggtaaatcctcagccactattttttaatactacttaatattttgacaccatcttccatgtcttaactacctcctcaacatattttccaattctttatctttgaactgcattctagataatttattcagatctagcagtttactcactctttaactatgtcaaatatatggtttaatccattcacggagttttaaaaattttaattagtacatttttattgctagcagttattttttaatctacttgataatattttcagtttcttttcccctgctcctagttttaatgacttattttatttaaaatatattgcatagtacttttagattctgtgtataattcaactattatgaaatctttctggattattttttctgcttattttcttttggtgccttgtttgcatgtatgttttgtaacttttggctgtgggttgctaattttccatggaactttatctgtgtgtaaattatttgaggcataggggaaaaggacttaagtctacttctaccaccgtccttgacactttaaattttctgcccaagttttttcatatcatatggatagcttaaattcagatggaaaacataaataaagataagcttttttttttccttttctttgtgacaatacttagagctgcaaaataatggaaaatataaagtcgtggatgcagctaaagcaatacttagaagatgtatagtctaaattcttccattagaaaagaaaaaggctatatatgaataagctaatcatgcaaagagttagaaaattaagagcaaaataaatccaaagaaggggtaaaaagggaataaatcaatgatgtagaaaatagacacccaacaaagaggatcaataaaataaaagttgattctttgaagagacctattaaagatacacaagaagtgtctgataagatttttccagaaaaagaaacaccccaaataaatacgagatcagagccagatgtggggctcacgcctgtaatcccaacactttgggaggctaaggcaggtgtatcgcttgagcttaggagcttgagatcagcctgagcaaccctaaccctacaaaaaatacaaaaattagctgagtgtggtggcacatgcctgtgatcccagctactcaggaagctgaggtggaagaattcatagagcccaggaaagtcgaggctgcagtgagccatgatcatgccattgtactccagcctgactgatagagtaagaccctgtctcaaaaaaaaaaaataaaaataaaaaagatgaaaatgaagatataattactgatgcaataaagaataattaaatgaaaagaagatgccatgaacattaaaccaacagttttgaaacatatatgaaatgtacatattgtgagaaaaatataattcatcaaagttaacagtgatttagtctggaaatagaaaagatgggtagtgctttaacctaaaaataaattaaatgtctagtttaagattttccctaaaaaaatcaccaagcctagctagttctacaggcatgttctatgtaatgttcaaagaatggatcactttatttacatacaaacctttctagagaatagaaaaaagtatgatcactaaggagattagcagtactgtaatgcaaaaaacagacaaggcagtagaagaaaggagaatcataggccagtctcaatattgcttataaacatagatataaaaattctaaacaaaatgttagcaaagcatatcctccaacagaaagataatatcacgttgggtagctccaggaaggaaatgttgaataatactagacaattttctggaaatagcagattaggtaaattataacaaaatacaaagagactagacaagttgcactgtatagacacacacacacacacacacacacacacacacacacacgcacgcacacatctttaaagcattaaagagccagcgagctaacaagatagtgaagaatcactgggccaacatctggaaaggattaacctacttttccctgggtggcagggggagttgctgaccactgaagaagctcccgaaggctgagcagtgctttggacctagtgcaaagctagggtgacaggtcaagtccagagccccatgaagtgtgtactgatttctgggggagtgtttgtcaactccttgtgctgtgggttgggctgcatctaaggaccaagggtaaatggcaagaaaactaggccaaatgtgcatttcggcccagcttcaaatcctctcaggtactgaaaatggtataaagttatctggtactgtgagagtcccaggctgtgggcagaagcaaacataaatcctctctgagaaagatatcatcttcctaggattcaaatgatttctacatgttttcaagtgcaatgagtggcattcaacaaaaaataatcaggcaaacaaggaaaaaatgcatgacaacatgcttgagaattggtatacacaacaaaatagacacagaccctttatttattaaaaaaaaaaaaaccacggaagggttgcagctcaccaatattcaattattgattaaatcattggaactttccaattaataaaaacagctgaaaagcatggagaactgtatttatgagggaggaagtaaacaattttagtttatgatagagggtttgcatatttgtaaataatttagtgatatgtgaatctttttataccttcttgtattcttttcctatgacgcattctttcctggaagtgttttaaaatagcatctagagccatcaatgtggactgatttaagatttcacctggtggaaattagggaattaggctttgggtggctcctccagcaataacaccagacagaagctcacataataatttaaatgtttcataaaggatctaaactggcagaacatactacagtgttctttatcttttatgcattgtattgctgaattggccttaccaataactttaccaaatgatggtgcttagtgatgagtgttagacaggattgtgccccagttcttgagtggatgaggaaagattgccattttcagttgctctttataggggagatgtaaggcacaattaacttttaaaaaaataaatggggttatttttttacaagacaccttttttccaagttttaactaaagtcctctgaccaatttttctctttttgcagaatgagcatgttgattacgtagatgttggtggagcttatgtgggaccaacccaaaacagaatcttacgcttgtctaaggagctgggcatagagacttacaaagtgaatgtcagtgagcgtctcgttcaatatgtcaaggtaaggctgacttttcacccaagtgactgatagggaagcattttatttgagaaaacatttggtttgtttttagttatttttctttcaaagcaattgtaaaagtaggctcttgactttgaagtagtatttgcctttcttttcttgttttcttttttctttttcttttgaaaaaaatctctaaagtctcctggaatcactgcaggatattatgactcagcttgaccttcctccctgtcaccctcagtggccctcacaagctatcctcactcccagaatgggaggctctgggttccctcctaatgcatttgaaggccacaggggtgggggtggcaggtgcctgcaacagacatgtacacacacacacacacacacacacgcacactcccctcccccagctacaggcaatccctgagcaacctagggagcaaccctagagctccaaggaacacaagagtttgaggccacttctttagcctttgaactggttattcatcctcattcttacctggcattatttggaatgctttatttcctctgtacctggccttcactcttgggaagtctagcttgtttgtgcagtttcctactgtttaaacaagagattgtttaaactctagccactgatttccacagctgttgccagtgtttttctttctcactgaagccaaacatggagtggctggagtctggaaacatgccttgagaaatcaaagttcccatctgacattgcagcctacttcctagagctagtgtcactgaggaaggggtcatttactcattctaatgtcaggattcccacaccaataaccacatcatttctcaacaaatacatcccttcccctactccacctcgggcaataactgtgggtccggaggctacagggctttgggtgtgtcctgggagttgaggatacttgtgacatatgtacactgataaccaatcaggagagaccagaaacctttgtaaactctgatagccacatggtttgagatgcttgggatagtctggtggtgacagatgtgaaaaagcaaatcagtagtctttttattcttttctttttacctttaagctctgttggacttgaaaatcagtagtctttagaaaaactgtgggttcagaggtcaagggaggaatgaagaaagtataaaaaatttcacaaagtatttaggaactctggctacaacaggctgtgatcaaaaaggaaaaacccctttgcttcctcattttctcttttctgcactgcacagtgtttccatggactagtaagtaataacaacagtgagaataatagctgctaacatttattaagcatttttacctgtattctcacatttaatatagggagagagaccaaaccctttgcgctcaactactaattaaacagtcatgtaaattcactctccactccaactgggaagcaaatgagtgtgatgattatcttggaatctgtgcagattcatgctgataagattcagaggctgagaggtttttagtttacctggaggctaacaataaacaacaactaaaagctttttatgcatgaactcattaaatccttacatccaccctgctaggcaggcattatcatccccattttacgtttgagaaaccagaagttcaaagaggttaaagtgacttgacaaggctataaaactcctaaaagtctacctaacccctgagtgcatgctcttcattatcccgatatatggcctagaaaatgaaactgaggactctgaatggagatgtgctggacctccaatgtttgtttgtcctcacacacatctacagtaaggtatctcactgtcaatatcactgaagtctgggtcatatgatgaggagattcagtcattgaaagaccactttttttcctactttcttactcttcttccagtttcatgttccttttatgtacattttaaaaactgggaaaaactggaaaaaactggaaatttacaagtatgtcctcaagctaggtacctgctagtctcccagccatgcccagtctaaaacttgatattgggctgggtgtggtggctcacatctgtaatcccagccctttgggaggccaaggcgggaggatcatctaagaccaggagttctagaccagcctgggcaacatagtgagacctcttctctatgaaaaattaaaaaattagctgggcatggtggtgcacatcctgtagtcccagctatttgggaggctgaggcaagaggatggcttgagcccaggaggtcgaggttacagtgagccatgatcatgccactgcacttcagcttgggcaacagagcaatatcctatctcaaaaataaaaataaaaaataataaaagtaaaacatgatgctaaggtgatagtttgaaagtggcacccataggcagcttttgtaagtaatttagctcctcattgttcttgatggaggcaaggtggagttaaaatgataaagttctgtttgagaattttgactttgcctgaaagtgatcaacagatcgtgacatgctatccaaacttcctaacaggaccttacaaattacatatcttaagtgttagactttctgatgtctctgaaattttctgggctttactgggaaccctgctttctagaaatccagatgtaattgttctgtactttaagaaggtggtcctgctgcaagctttaatagaggatgaactaatggaaagacttaaggagatgatgcacgttacattaggtgcctaagtaaggaaatgttaagagtagcatccagggtcccttttttgattttgttgctgctgctgagtcccgctgtaaggttaggtccacactaccctgaaagtcctgttcctaaagaaaaaacaacttcagctttctggaggggagaactgctcaactctaccatatttttatttcacaaaaatacaaatatggctgtgctattgcataacctactggacaaaggcatcttgccatggcattggacttggtagcccgaggctgctttcaggaatgtaaggcagaaaataaaataaaaacaaaaaaagaggctaggcgcggtggctcatgcctgtaatcccagcactttgggaggccgaggcgggcagatcatgaggtcaggagatcgagaccatcctggctaacacggtgaaacttcatctccactaaaaatacaaaaaattagccgggcgtgctggcaggtgcctgtagtcccagataccagttactcagaaggctgaggcaggacaatggcgtgaacctgggaggcggagtttgcagcgagccacgattgcgccactgcactccagcctgggtgacagagcgagactccgtctcaaaaaaaaaaaaaaaagaaaaagaataaaaaacaaccaaacaaacaagaatgcaaggcattgttaacctctggatctttgccattgcatggccatgcacatcaacacaatggtaatattagaccataattattgcatatgcagcacgtggcaggtgtgtgctaaaacacataccgtgcctacactttggacaacaaatggcacctttaaatcacagccgctgtggttgatccctcaaggtcagtaccgctcccatagtaataataatgactacctcccctactgagctcccagtatgttccaggccctgtgccagggccttcacctccattatcttacttaaccctcacatggatcctaagttaggggttattgcgccatttcacagaaagagtctgaagttcagaggcccagtaacctgcctaagagagtaagggaattcagattaaggtcttttgactttatgctgtctcttgctagtccagattctactgtcagggactgtggactccaggaagctgccttacagtttgtgcttgtcctggctctttctggcagctctcttctgatggtcatcctgtgtccatcattgtgtccccatatgcagtgctggtgaccattttgctcaatcttttgacccggaagcctgaaagagcagtgttaactacctgctatgatacaagcactgtgccttggttattgtttgatggatgcagtaactggaaaacagccatttaactgtcagaaaataaagattgaagctctattttgaattttagtacttattttcaaatagctacacatttaagatggtaagcatcattcttttcattgaatacttaatctcatcgaatgaaaagatgaaaaatagaaatatatatcattaaaccatcctctcacatactttaacctttcagagaatacatattttcaaccaaggtagacaacaatgttaaggcaaaaaagtagtgggttggttaaagtttagtttatttgatctgaatgagtgcctttttgctagtgttttccaatacatcatatcatttctggaatgagaagtactcattgtagtagatgtttttatgattatcaggaaactgtattagggaaaagcaggaagatatttagttcaatattccagataagatgattaataaattgtatactaaaagtaactctacttattttaaaatatcttaactctcactgtttttctccacttctaggggaaaagtgggtgtttccccaatgtgatagtgtattgggttaataatacaaattgtatttgtgacattttctgcattgctttttgacaacttcagctttcataatctaatacagtcaatattcgtttttgtaaataacactgaagtgaaaaggaagattgccattttctagataaaccaatcaataatctttgtggcccagattgcttcagctcttaaattttcccaatgcgaaaccttaaagaatgtttaaattgtttaaacactgtcaacagtctgtggcacatctagtcccagcttactctaggatggtttttactattcaccaaggaactactcgttacctttgttagattgtgtttacagtgcaagttttagcaagacagtgtatagttccaagcctgagcctctcagatggatactgaggatacaccttagtggtgtttcctctacctgatcccttccttttctgagactatgcctatctactacgttcatagaggattcacatcgatatgctaaattcactcattgcttaatatttatatttatgtatttgataaatatataagtatttacagagcaaaatctactctgtaccagatattgttccaagctgcagatagagtggtgaacaaatgatcaaaatttctgccctcatggtccttctaatctaaagagagaagacaagtaaacaagaacagtaaataaatattagctaacatttttgcctgtatccttcatggatcttgtgaatagaatccctcttctaattctggtttagaagatcctgattcttatataataggttcctgactggtttctacagtgagcagcttttatgaattttgtgaatttgacatgcttttattggggagattatatctgatctgtgaaattaacataaattaatcatatcattgtgaaccttaaaggtagattcttaaatggcatcagctagatatttttacacttgatcttagccaaaaagccaagaagcagtagctagatatgtttaaaacattctctttatcggttgcacatggtggctcatgcctgtaatcccagcactttgagaggctgaggcaggaggattgcttgagcccaggagtttgaaactagcccgggcaacatagtgaggcccccattgctacacaaaaatttaaaatataattttaaaaataaataaaataaaacattctctttatcagttcttctcttctgcatggcataaaggaagcagctggacctgaatgccaagtggattgattcattacttgcattagtaaataagatgctccatcattatgagtgtgtttcattgagttgtggagatcttttgttaaattttgcaatgctgtgtcttgcagaaaaaatgaaaatgttggattccatttttttttttttttgctttccatgagtttcctgcacatcataatgcaggtagggtgaggggtatggagagggagaacccagccagaaatggagcaaggcattttgcagaggctacttcaaaggagaaattgacaattacatgcattctcacgttcttcctgcttttcacgtcctctctaaataaaagtagagactataaatatataccacccatttgtttttagagagtggtgtgataaagatttatttaaaacaacataggctttgctgacagtaacagctcagcaagaatttttttttttctttttgtattggttctattcttcccacagccctttactccaggtttctatgccaacgactgaaatcaaaggcttttcacaatgtgtatgttctggaatactaagtaaattttgttgttgctaagagggaaacttggttttagccagcaggccatgtagaaagcagagtttgtcttaatgcttaccagatataacccctcacttctaatagaatttgacccatggcttataatagaatttcttttggatatgcgacatttcattttaagtttcttttagtaccttgtccatactaactcacagaagatatttcttttatcttcaaagaaagatacattttcactttcaacctctctcagaaggaaactcaagaagcggaaagtgtgaagtctttgtagggatgttgcttgttgtatatttgcctcctttcttttaaacacctaaattcatccctcctgatgccatgctattaatattgccttccacctgtaatgtacctatacatgttttacctcacttgagcttcccaatggtcctcagagtaaaaagcattatttttcccaactcagagagcgtaggagccaaagtgtggctttccagctctaagcccagtgttctgtgggttacatcaccttgttttttattccaaagttaacttgtgaacccttctaataaactgctccaagatatgacaaaatcactttatcccaacaggctctgaagttgtaagatgcccctttggaaacagggactcctgtggatatgggggtggtcgttcatgggagctgtatgtgacacagtttatatttcacagttcacagttcatagttcacagtggttgtacatgggagctgtatgtggcacggtggcttctcttctcttgcaccctgagctgtagtctgagaggtcctctggccttcagtgagcacctggcagctaaacagcccccagtgtgtcccagttaggctcagcaggctgaagaccacagatgtattctattattttgttaaaatactaaatctggaggtctaaggcatggtttgaaattgctggctatatattatttttgttgaatgatccatgtaaacttattattcaaagtatggcccaagtattggccagtattttatgttataccattatatcctgcctgattttaaaaataacaaaaaaggaaaggatttaaagtggttcttgataagtattacaaatttggataagtcagggtagaagatagaaaaacaaaacaaaacaaaaacaccagttaggtaaggataggcaagtagttacaggcctgtgctcatgataagaaattctgttttgatgatagaaatgaggtaatacagaagggattgctttcttctctcaatcacaattctgagtaggttttaaaagcagagaggctaaaaatgtttacatattttcagtttgatctatccagtatccagtataaggatatatgaagatagctggtaaaaaatagtttttagtaactttcattcttttttccccctcactttggaaagacttcatttgctgcttgtgagttcccagagagcttaatggcagaattcctcttaaagctttgcactgtttagagagctaggtcagcattagccatctcctctcagaggctccttcttcctataaactctcaggattacatctcagatttggtttcaaaaatataaagttcctactcagtgacaacccaatatatagcaaaataagttaattattagatttttttcttaaaaaatggtaaagtacactaacataaaatttatcatcttcaccaattttaggtgtacagttaattcagtagcattaagtacatccacattgttgtgccactgtcgccaccatccatccaacagaacccctctcatcttccttccattcatttctaatagggactaattcactacaggaattgtttctaaccattcattgagaagtaacctagcatcaccctcccactggcagcacagaaagggggttaagtcagacacaaaggatttctctcacactcaggctgagggactttgtgatcacacataatcatgtagtgcctcagtatttgggttaatggccaaaagaactttgtgaatggaattaaacattatatgagcagcttcctcaagagaaattgctctagtctccataataactgaactcctggaggttctgacctttcaggttaaaatgtagttgcctctcagaggttaaaatctcctccttcttccttgctttctacttccttcctatttcttctcagcaacccctgtcctcacctcagtggcatgcacattactccaatcaaaagactcaatcattgatctttaattttcaaacttttgcaaagtagccttctaacagttgaaatcttaaacagcctctaacgtccaatgaatcccatatctagtccattctgggcacttcctgaagaagggaaattcagttgtctcatgatcacatgttgagccagctagaaaaccttttctgtcattgcctcatcctgctgcctaataggatcgatgctgccatgtaaccctctgtatcacgtgcagactcaaacctttttcatttctatgtcaaattcaatgaacagataccttttgaaaacctgctgggccacagagttttagtaagtgacagttattcctactttagagataagagaaagttataataatgagagtggttcaaggtcctacagaagtgagagagaaagagggacaggcataaaagcctagttaattactaacctttgcaaacacagagcttcaaactgaaaagagacaaataatgataataatgtcaatacctgatatttgacagtccagtactattttcataacacttcattttagtttttgctttgtgtttgggttttatgtaaccagaagaagaaaattcttgatggaatcacagaaaacttgagagttaattatagttcagtgtagtgaatgctttgatcctgaaggctgtgaaactgaatcgttttcattcagaaaatttctcatgtcaggtttttcaaacaaaaagaatgattagtaaactattctattacctttcattcccatagctctcctgtaatttgtaagactcaaatgatacacactgaaccttgggctgagatttaattttgtatatttgccaaagtacacagtagcctagtttccatagccatatctagcagataaatgtctctgaaaaaaaaaatcaggcttcagagacaatgggaggaaatcactgtggctcacacttgcggaccagcagtgggtgacaaaagtggaccctgggacacagacatgggtgcagtcactaattgacataattatttgagcatccaccagtcgagtagtcctgagtatctgtgacttttcctaatctgtagattaaaaaaaaaatactattctgatgtttaaatgctgggaagatggtgctaagagtataatggctcttagttcatccaccctttcattccatgccatcaccctatctctgccatcatggttataaagccatcactgaagtaacttcatctagtagtagggggcagggccacatcctcccagacactgtgatacacaaggtggatgcactcacttaacagcttagctgacaagaagttctgctttgccctttgcccctctctacctgctcttatgtactttctcactgcactgtcttgttacgaggaggacgggctaagggcagaaactcagcatgaagcccatgatgcacttgcaattttagctagatatacaagcaatttccttcctttctcctcgttgttgtggaatgatgtgcccttttgtccagaagggatacaaatgacattgtattcccatgtgtaacatttggaaaataaacattctggttgtcacagcttctatttcatcgcatattttcctgtgttatgtcatacttctgccagtgcaagccagaatgtgaagaatgcctaggggaatatttctcaagtgttttctaagcaacattaatcttaaaaatactttgcaaaaacagggcatttggtggtcagataaactttggaagtgctccatatcctatccctgtctttgatagtcaagatgcccattaacaaattaggagtcctaggaagcctggcaataaaaaaagactattgaacacaaaccaggatttcccagacttatgaccatggaaactattttcatataacacctataaagatcagagtaagagatgctatcacaggaagtgtttttagagatttaggttcacaaattaccaaaactactcgggaataaatagaaaattgaatagacctataataaggaaagagattgaattagtaatttaaaatctcccacagaaacaaacccagacacaaatggctttactggtaaattttaccaaaagtttaaagaagaattaataccaattctttataaactcttccaaaaaaatacaagaggaggaaagatttctcaattcatcctatgaggccagtattatcccgaataacaaaaccaaagacatcacaagaaaactacaaaccaatatccctatatagagatgcaaaaatcttcaagaaaatactagcaaactgaatctagcaatatattaaaaggtttatacaccatgactaagtaggatttattccaggaatgaaaggttagtttaatatacaaaaatccaataatgtaatgcaccaccatattaataggatgaaggaccaatagcacgtgatcatctcaatagacggagcagaaacatttgacaaaattcaacatccttttatgataaaaccactagaaaaactaagaatagaggagaacttcctcaacctaataaaggccatctacaaaaaacccacagctaccataatactcaatggtaaaagattgaaagctttccttctaaaatcaggagcaagacaaagatatttactctggccacttgtatttaacattgtactagggattttagccagggcacttaggcaagaaataaaaaaaaaaagaaaaattgtatttgcagatgatgtgatcttgtatatagaaaatcctgatactgactaaaacaattcatagaactgttaaacaagttcatcgaggttgcaggatacaagatcaatattcaaaaataaattttatttctaatacagtagcaatgaacaatctgaaatgaaattaagaaaacaacttcacttaaaatagcatcaaaaaacaataaaatacttagcaataaatttaaccaaagaagtgcaagacttatatacctaaagctacaaaataacattgaaataaattaaagatgtaaataaatggaggcatcctgtgttcatggacttaatattgttagggtgacaatacttcccaaattgaactacgtttttaacacaatccctttcaagatcctagctgacagtttttgcagaaattgggagattgatcctaaaatgtatatgtaaatgtgagagacccataatagccaaagcagttttaaaagagaagaacaaatttgaaggacccacacttcctgatttcaaaaattactatgaagctagtgtgctaaaacaatgtgtacttgtataaaaacaatgtgtacttctataaggataaacatataggtaaatggagtagaactgtgatttcagaaataaacccttaaatttatgcccaattgatttttgtcaagggtagcaagacaactcagtgcaaaaagtaaaataagttatttcaacaaatgttgttggaacgactggatatccacatgcaaaagaatgaagctggacttcttctcacactatacacaaacattaactcattttagacctaactataagagctaaaaatataaaactcctggaagaaaaaataataaatctctgtgagttaggcagtgatttatttgatgatactgaaagcacaagcaacagaagaaaaaatagataaattggtcttcatcaaaaaaagtttttgaagtgttgtcatttgtataccatcaagaaactgaaaagacaatccatagaatgggagaaaatatttgcaaatcatatatctgataaaggacttgtattccgaacatataaagaactctaacaactcaataataaaaagacaaacaacccaattcaaaaatggacaaaggacttgaatagatactttgccaaaaaaaagatatgcacatgatcaataagcatctgaaaagatgatcaatgttattagttattagggaaatgcaagtcaaaaccacaatgagatatcccttcacacccaacaggatggctgtaataaaaaaggcagacattaataagtgttgtgcaggatggggcgacattggaaacctcacccattgctggtagaaatgtaaaatggtgcagccactttggaaaatagtttggcagttcttcaaaatgcagtgtcagagaaagaagagtgactactaataattaagggcttcttctcagggtaaagaaaatgttctaaaatgagatgtgatgatggttgcatgctctgtgaatataccaaagaccattgaattgtacactataaatggatgaattataggatatgtgaatgatatgttaataaagctgttaaatagctatttgtcctcacaatgtgatattttcatcttttttcacacttcctgtttctcctgagttaatggcatctgtgaaagaggaaaactatttttttaaaaaactctgtcaattatctttaattacacaaaagccgccagaagaactcattattgtttctatcttaactgttttgtttgtaatttctgtatataactagaatcccttggagaagatgacataaatttcttttaaaacccttcactgttggggccaggcacagtgggtcatgcctgtaatcccagcagtttgggaggccaagacaggaggatcacttgagcccaggagttcaagaccagcctgagcaataaagtgaggccccatctctacaacataaataaataaataaataaataaataaaaatacaaaaattagccatgcatagtggcacacacctatagtcccagcttacttgggaggctgaggctggagaatcacttaaacctgagagtttgagactgcagtgagctgtgatcacaacactacactccagcctgggtgacagagaaagatcctgtcaaaaaaaacaaataaaacccttcattattgatggtatggcatcatttatatctgagtttaatggttctatttttccagagataggactacacaattcaggcgcccattgcattggtagctgtacaagtcttgagacagaggctgagaatatgaagtgtcaggtcataagcaaacacataggaatgtgctgccagcccttgaaatggtgtgagaggttatagataatttggtattcataaacatggagcagaggcatgaaaaatgtaaaccataagactgtgccaatataataacaaatttgagggtggatgagttccccagggaaatgggaaaggggtgggcagaaggaaaggaaaaggctaaggatcagactctgggggattcagtggatcatagaaggaggggtcttggggaactaggctgaggcttgggacaactagcactatctgatggggtggtgtcagatgcagccaagtgctaatgggatggatacatcccttcatatctggctaaaaggagctcattggtgaccatagagaaaagggcatccacggacttttgaggatacaagtcagattttagaaaacagaaggatatgaaggcaatgggggcatcatttgagtgggactgttaaaagaatgcaaagaggatgacaaatgaaaaggacagacgtctccatgtagggtatgaaggctttttctagatagagtgaagctatgtatgtttgaagagagcttggatacctgcatttggaaagaggaagataatgcttttgtaaactattaatacaacacaaaactaccatcctatttaatgggtctcttcttagatgattttaaaatttaaagcattgttataaactatagaaaagaaatcatcaaaagattcatcttacaggctttgtcacaaaacaatgggactagaagggtctcaaggtattcatataagctgtacaggcatgtttctaaattaatctggaagataactcttttattttccagatgattaaagaaggctatttggcagcttccccagtgacttatgatactctaataacactcacttccttttgcttaactcaaatataaaagtacagagagatcaaactctccaacgtgccaatcaggaaatgctattttgcttactataaacttagcttatcttataggaccaacaataaagaattatgtgggagccataaactgccatctcctggcaatagtctcctgttattgtgaacattagtagattgaagatgtagtttctcaaagtcacttaagtgttttggggcacggttccagggacattgcgttctgcttgacataaacaatttctgctgtatcaaagacactgccctttagagattaaaggccactttggaaaactagtaagctttcagagtgtaggtacaaaatgaacttgaccattacactagatttttctcctttaattttaaagagcagtaatcatttggaagtattcccagagcccctgcttcaccctcttaggtcatgaaggcattccttactgagaagtggcttagtattgagaaactgctgacaccttggtgagaatactatagaaccacattttggagactgagagggtccacactgtcaggcagttctcactcagccaaaagacatcttccaggcccccctactgcactactttagggattcacacatgcaaaagtgttccccacatatgtgcatttctttttagcaggtttgggttttctgtgaaacgagaacagagaagccagaaactgataggggtgaaactaattgatgaaatcctttatcaacagcaaagaagtttatgttatgggcctttatggtcttcttgttgtttttttttttttttcttttgagacagtctcgcactgtcgcccaggctggagtgtagtggcacgatatcggctcactgcagcctccgcctccagggttcaagcaattctcctgcctcagcctctcgagtagctgagattacaggtgcctgccaccatgcccggctgattttttgtatttttagtagagacgggtttttttgtttgtttgtgtgtttgagacagagtcgtgctctgtcgctcaggctggagtgcagtgacgtgatctcggctcactgcaacctctgcctcctgggttcaagtgattctcctgccccagcctcccaagtagttgggattacaggcacccatcaccacgccctgctaattttcgtatttttttaagtagagacagggttttgccatgttggtcaggctcgtctcaaactcctgacctcaggtgatctgcctgtctcagcctctcaaagtgctgggattacaggtgtgagccaccgcctcttcttttaaaatattccgtggctcccatttctaaaatgattgccaggccagattttcctctttccttgaactctttacttctcctgccaccactgtttatcaaggctcagatcaaggggtctttggaccttgtgtgaaatcatactcaagttggcatctttctgtgaagaacttcgttaggaatgtgggacacattttgttgagttatatttataattcttttctttatgttcccagactattgagaatatttatttatttatttatttaagacagagtctcgctctgttgcccaggctggagtgcagtggtgcaatctcggctcactgcaacctccgcctcctgggttcaagcaattctcctgcctcagcctcccgggcaatatttatgttttttaataaaatttttttccaaagcaaagatcagttttgcattagactattccttgactatacgtacattttatggaggaaaatgtagatttttccagatttcagttaaaggaggaattataacaaggaccagctgctctgaggctgcccctgagctattacttaacctcagcccctctcttctccatagctatttttgttttctatgtaaaatgtctttgcccatttctctcagagtatgtattagcattttccaaagctgtttatgttccctcagtggtcgtcttccacccctgaagcttcttaagtctctatttttactccttagaaacagaaaaggtacatgtggaagatttctaagtttcacatttcaaagttctctttcttttgggaaagaaaaagttggaagtttaaaaatgcctctagaacaaacctatctccacattccatcaactgtataggaggcaggaaagcatgttttatgagcaaaggctttgggagcaggaaatttccattctatgatgtactagctactgccgctgggctttagtttccttatttataaaatggaaatatcaatagcgcttgccttcacagggttggagtgagcattgcacgagataatgcatatgaagggctttagccagtgtcaggcatagagaaggatctcaataaatgttagtgatgatggtggtgatgatgataaaggatttggagtctcaaaaagttgtattgcagcgttacaacataacattttcagataagaaacgagatcacatattctgccaaggttatttgaatttgctatgtggaagggaaaattacttctctgtcacttaatggctgccatatattcttactcagttaggaggtgtgcttacacgtgtttgtgatgtcttgtgtccttgccctgatggtcagaagttttgttttagccctttaaaaaatccaatacagctttcagtattctgcagtgcatgcagtagactttctacaagtaaatgttttaattaaaaaaatcaaattatcatgcaaattatactggtagaaaagattttggccttatgaacatttacaaggcattgatttttaaagtaaaataaattagcaaataaggccttataaactacctatttctggtctatttcctagggactcacctctactcaccattgcttctcttagcactttggctgttacacaatgaaatgaagttaatggtttctaataatgaatgagccatcttcatattagaggtcttggtaccaagcaatagaaaccaactcaggctaacaagagggaatgtactgaaaggaaatgagaggacctacagaactgatgtgaggctggaggaccacacttgaggatgagcaaagagcatgagagctctggcaagttaggggcaggaaccatagccatagtctttgtagcaggaagcatctgctcagcacttggccatggggaaagaaaacccacagtctactttcttctctatgtgggtgacccactccatggtcagagtcctctgagagtgtatgactggccaagctcagataacaggctcacagccaggctataccaggagctgggggtaggggtgtagagataaaaaaaaaaaatctatcattttctgtaatgggagctggtagctgggaccatcctgcctacacagctatacagaaaagaagagagacaatttcccagaaagaaaccaggatactaccaggaaaggggaatggatgctcggcaggcccacagtggcaagtgcctgatattccacacttgctaataatctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctcgtctagtgggaacagctttctcaagagattagatgggaattcaggagttgagaatattgtagcaccagtattagatactaggatgtgctacctttatttatgcataatttccaaataaatagaaataaatttaaagctattatttactgtaaattaaaaccagccaacacagcaccagggagattctgcacattttattaaattggggcctgtataggtataatgtattcagttgccatcaaaggtaatgtttctgacacagtagagggtctggttactttgcaagtcttaggttggttgcttttttgttgttttagaacaccattcaaatttaagatattactctttttgattgattctgtttgcttttatgttctaggggaaaacatatccatttcggggcgcctttccaccagtatggaatcccattgcatatttggattacaataatctgtggcggacaatagataacatggggaaggaggtaaaatgtgtgttcagtttgcacatgacccattactgaaataacaatggcaactgtttaatatccttccatagtgcagggaacattgctctggacaccaatgcatatcatttcccatgtacccaaactgcaaagttggtcgtatttccacttcacaaatggaaaaatgagtgcccagagattatgtaatttactcaagacctcatagcaagggaaccagcataccaacccactctcttatacaaatgcctgtgtgccttcaactctatgctactgagcatttatatgacatatttttgccaagtatctctacttacagttgtctgtctgtctgtaatgccattttagatagtaaaggagagaaggacttgctgccccaaagcttctttacttagtcttaggctctgtaatatcaatttgggacataaaatggttattagctttcaataacaatgatgatgataattgtcatcattataataattacatataaatttgtacatagacatatataatattatcactactattattgttttggcaatggcattaggacacagaatccaaagaactctaccccactccctgtctctatatagaattctatgccaatcacacatttcaacacagagaccaagagacccattttcagaggttttcatgagggccttcccgagaagaggtggcagttaccatcaaacctgagaggggacttcctttctctacagattccaactgatgcaccctgggaggctcaacatgctgacaaatgggacaaaatgaccatgaaagagctcattgacaaaatctgctggacaaagtaagtagacttgaccattcaaaatttactttttatcttcccttctcgtcttttatatcttgccttgaactgcagtgcttttcttaacaacttacagaaaaaaagaggaaacctagtaatctttcagtcaatagcaatgttgagggcacctcaaagtaggttagaacagaaaatgaatctaaaaattaagaaaagtgggtgaatgaagtagaacttcttttaatgaaagcattgtgtgatctgcaataaaatcaataattgtgttttcatattattgaaaggttgcctacaaaagcagtttgaaaagatattttttaaaaatgtggtacatttacaccatggaatactatgcagccataaaaaagaatgaaatcatgtccttttcagggacatggatgaagctggaagccatcattctcagcaaactaacacaggaacagaaaaccaaacatcgcatgttctcactcataagtgggaattgaacattaagaagacatggatgcagggaggggaacaacacacactggagcctgtcaggtggtgggaggagggagagcatcacgatagataactaatgcatgtgggtcttaatacctaggtgatgggttgatgggtgcagcaaaccactatggcacatgtttacctatctaataaacctgcacatgtactccggaatttaaaataaaataaaatggtaatcccatatagatgtggaatactaggaaatgagaggaaagctagtctgtagtaataaaaatgttcaattagaccatgtcttattagtttatgtggggcttactatgtgaaggcaccataccaggcactgaggaatgggggtgaacttcttaggaatagcccctaccctcatggagtttatgtttttctagcaggcaagactgaccttgagcacaattacataatgctaggagagttcctgtaacagggagaaccttacatggtctgagggtacaggaagcattctttgatgaagcaatctttaacctgaaactaaggagttagtgcatcaactaagaatgagccatcggggcaggggggagtcagaaaaggtgaacagtgtagggcgatggtatcttccaggaatgatacacagggacaggagagagaaaggaagaatggatgaagttggggggatagtatctgccaggaataagtcatggggcaggagaaagacaggaagggtggatggtgtggtagaaatcgtaccttccaggagtaacccatagggttgatagtagtggggcagatggtatgatctaagaatgacacacagtgtcaaagggagagagggaaggttggacagtggtggtgggaggagggaatgatatcttccaaaaattacccacaagggcaagaagggagaaagggataatggagaaagatgggtggtgttttaggaaagacccacagaaacaaggcgagatggggactggaagggtggatggcattgggggattttgtcttctaggaatgagccacagggattagggggagataggaaggactgatggggcaggaagatagtatgttccaggtatgatccacaggttcagaggggagaaaagtatagtggatggtgtttgccatggatgaaccaccaggatggtgggggagacagaaaaggttgatggtgtggtgggatggtatcttttatgaatgacccaaaggggcaaagggaaggcaggaaagatggatgttgcggggatatcatccaccaacaacccagaggtgtagtggggagacaggaggtgtagatggtattaccaggatatgtcttccagaaatgagccacaaaggcagggataagataggaagagtgaatggtgtggcctggttgcatcttccaggaatgcccccacagtgttagggagtggggaacaagaatggatccctgtgggggtatggtatcttctaggaatagcccacagagtcaaggggaaacaggcaacattaggtagtgtgtgtgtgtggtggggaaatggggcgggggtggggtggggagaatgaaattttccagctatttctctctctctggggagagaaagggaaggttggtttgtgtggatggagatggtatcttctaggaattacccaaaccagaagggtgaatgtcttaggggaaggggaattttccagcaatgacccagagggatggtggggagacaggaaacatagatggtgaggcaagatgatgtattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagatgggtcttccaaatacagcacaccgatgggtcttgactctttagccagtttgccagtctgtgtcttttaattggggcatttagcccatttacatttaaggttgatattgttatgtgtgaatttgatcctatcattttgatgctagctggttatttttcccgctagttgatgcagtttcttcatagcatcaatggtctttacaatttggcatgtttttgcagtggctggtactggttgtcctttccatgtttagtgcttccttcaggagctcttgcaaggcaggcctggtggtaacaaaatctctcagcatttgcttgtctgtaaaggattttatttctccttcatttatgaaacttagtttggctggatatgaaattctgggttgaaaattcttttctttaagaatgttgaatattggcccccactctcttctggcttgtagggtttctgctgagagatctgctgttagtctgatgggttttcctttgtgggtaactcgacctttctgtctggctgcccttaacatttttttcctgcatttcaaccttggtgaatctgacaattatgtgtcttggggttgctcttttcgaggaatatctttgtgatgttttctgtatttcctgaatttgaatgttggcctgccttgctaggttagggaagttctcctggataatattctgaagagtgttttccaagttggttccattctccctgtcaatttcaggtataccaatcaaacatagatttggtcttttcacatagtcccgtatttcttggaggctttgtttgtttcttttcactcttttttctctaatcttgtcttctcgctttatttcattaagttgatcttcaattactgatatcctttcctccacttgatcgattcggctgttgaaacttgtgtctgcttcacgaagttcttgtggtgcatttttcagctccatcaggtcatttatgttcttctctacactggttattctagttagcaattcgtctaaccttttttcaaggttcttagcttccttgcattgggttagaacctgctcctttagctcggagtagtttgttattacccaccttctgaagcctacttctgtcaattcatcaaactcattctctgttcagttttgttcccgtgctggcgaggagttgtgatcctttggaagagaagaggcgttctggtttttggaatttttcagcctttctgcactggtttctccccacctttgtggttttatctacctttggtctttgatgttggtgacctatggatggggtttctgtgtggatgtcctttttgttgatgttgatgctattcctttctgcttgttagttttccttctaacaggcccctcagctgcaagtctgttggagtttgctggaggtccactccagatgctgtttgctggggtatcaccagcagaggctacagaacagcaactattgctgcctgatccttcctctggaagctttgtcccaggggggcacccaccagatgccagccagagctctcctgtatgaggtgtctgttggcccctactgggaggtgtctctcagtcaggctacacgggggtcggggcccacttgaggcagtctgtccgttatcagagctcaaacactgtgctgggagaaccactgctctcttcagagctgtcaggcagggacatttaagtctgctgaagctgcacccccagctgccccttcccccaggtgctctggcccaaggagatgggggttttatctataagtccctgactggggctgctgccttttgttcagagatgccctgcccacagaggtggaatctagagaggcagtaggccttgctgagctgtggtggggtccgcccagttcgaacttcctggtggctttgtttacactgtgagcataaaactgcctactcaagcctcagcaatggcagatgcacctctccacaccaagctcgagcattccaggtcgatatcaggctgctgtgctagcagcgaggatttcaagccaatggatattagcttgctgggctccatgggtgtgggacccactgagccaggcaccggagggaatctcctgatctgccagttgtgaagactgtgggaaaagcgcagtatctgcgcaagagtgtaccgttcttcctgggacagtctctcacagcttcccttggctaggaaaaggaaatcccccaaccgcttgcacttcccaggtgaggcgatgccctgccctgcttcggcttgccctccatgagctgcacccactgtccaaccagtcccaatgagatgaaccaggtacctcagttggaaacacagaaatcacccaccttctgcgcggatctcactgggagctgcagaccggagctgtttctgtttggctgtcttgctggacccttggctccttttcaactcataatttcttaagcaggagaaaatgttagtttctccaagagttaaagaatgcattccttcagaaattgaatccttgagagtttttttcaattgcaacagaaaaactttctgaacacactaaatcgtgttgtaaaaacatgacattctctgactcctgtacatattgacacctgacttccacttttgttctatgaacaggactgctaggcggtttgcttatctttttgtgaatatcaatgtgacctctgagcctcacgaagtgtctgccctgtggttcttgtggtatgtgaagcagtgcgggggcaccactcggatattctctgtcaccaatggtggccaggtatggtgtgtatgtgtctgttctgaaacaagagcttcatctgtgattttgctttctcccagggcagtgtctttaatagttgcttcaggattttgaaacatgaataattagcagcatgaaatgatctcaaaagattttctgaaaaaaaaatttctcatttccttttgtcactcctgaaaaggagttcacagataaagaatgtttcattttgaattaattaggttttgagaattaagttccttccttttggtagcaggtaaaattaggctgtttatgtaggagaagctaaattcctaaaataatttctaaaaaattctagaaattgtacaattattgtacttaaaatcatctctgttctagacacaaggtttctgtcccatctgtttatcagagtgattcttttatgttaactgctacagaagggaagtgactgttcttccttctaatttacgcaagtgattatggccactcttgcaatagtaaattctgccttttggattcttagtttttgctacccacttgaatttgcccagtttccatatcatttcctttattaataagtgaattcatttcgttcattggctggacacatggcgaagccagaatcctaattccccagactctgagattctctgcttcaaccctttctgttatccaaagagaatgggtatctctgttctataaatgttgtgcttggatggtatgaggtttaattagtagcagtttacttctaacttaggttctctgagttcctgaattctgagtgcacagtacaaggtatagagtctttctctgccaagtgaattattcttctcctgaggagatcaccggaaatccccaagttcttgtgacaccaagactcattgcccatttgacccttagccttgacaaatgcaggacagttgcattttttaaatgtctttacctacaggcagagatgacagattactccttttagccagtattttactttctgaggtattttgatttacatttgatatttgtttccttcattcagaggagccaggatacttctagccaaattctacatgaccttttggaaaatatggttcagatgattaatctcaaaccatggtcacaatatttttataaagaacttaggcttatcctgtaatttaattcaacaaatactagacctggaggggtggacagtgaacaagacagaaacagttcgtggtctttccaccacactaaaactcaaagtacctcttagaaaacagaccagattataagttaaatggtctgggtttcttgaggaaagacaaatcatgaatttaggtctgaaccactctgggaattttttttcctttttttaatttaatttttgagacagagtcttgctttgttgcctagcctggtctccaactcctgggctcaagcagtccttccgcctcagcctctcaaagtgctaagatcacaggcatgagccaccatgcctagccaggaatattttttataaagaactttggtgttgttattaaaacagtagccagttacaaaagtgcaaaaatcactgcgtggctgcttatgcagttttctggaggagtatgattgaggaatctgttaggaatcttctggctgggcgcggtggctcacacctgtaatcccagcacttttggaggccaaggagggtggatcacctgaggacaggagtttgagaccagcctggctaacatgatgaaaccccatttctgctaaaaatacaaaaattagccaggtgtcatggcacgcacctgtaatcccagctactcgggaggccaaggcaagagaatcacttgaacccaggaggcggaagttacagtgagccaagattgcgccattgcatgccagcttgggcaataagagtgaaactccgtctcaaaaaaaaaaaaaaaaaaagaatcttctataataggctaaaaatatccttctggttcttaccaaaagcattgtgttaaggacttaccttcttagattaagctggaaacatttccatggtgatcgtagcagaaggcagagggtagagcacttctggtcttataagggccgctcaagagaactatttaacaatatctaaaggagcaagcagatgcttagccttcaccctctgcctctgccttgaagcttccagatagttttgcaaaaagttactcaagatctgatattccgaatcttttttttttttttttttttttgagacggagtctagctctgttgcccacgctggagtgcagtggtgcaatctcggctcactgcaacctccgcctcctgggttcaagtggttctcctgcctcagcctcccgaatagctgggattacaggcacgtgccaccacgcctggctaatttttgtaattttagtacagccacagcacccggcccttcttcccattcttagaacatcatttggtggtgactagtaggactagtaggacgtgactatccctaaaagcaccctgtaactttgtctataatatggctctatctgcatccttacctgcctggacaacctcagcccagaacacaggaatcaaaggaaattagaaacttcatcctctggaataagccctgtgcctgccccttctcagggctccctccacaccctgcactctttgacatttgaagcccacagacttgctgatattccccttggtcagggcagcattggcatagtggaacatttcttcgggttctgtgatttttataaacttgtaatggcttttctttgccagaagctgtgcagggaatgatcattgaattgtcttggtcaactctgcctctgtcctaatgaagtcttctgacagttaagtgtgcagacgttagaggtgtggcctgtgactttctggaggttttctaatcagtagccagtaggattttccttccttgggctttcataatgtttcctttcttacctacctcctcctgtaggaacggaagtttgtaggtggatctggtcaagtgagcgaacggataatggacctcctcggagaccaagtgaagctgaaccatcctgtcactcacgttgaccagtcaagtgacaacatcatcatagagacgctgaaccatgaacattatgaggtaactcagtttagtcaaaaggagcatatagtaaataggccttgtgtcttttgcagtttctaaccagatataattcaagcagtagcataattaatgctgacatgtttccgcctcagtcttccaaattaccagccttggttgacctaccttgatctgttttgttgcctcacagttgcctcattttctcattttgtatgtttttactgctcaatgttgtttagaagtgataaagatgatttttcacgcctgccacaaagactgcagctcacatttgaggtaatattttgcttgtgtgtgttttagtgcaaatacgtaattaatgcgatccctccgaccttgactgccaagattcacttcagaccagagcttccagcagagagaaaccagttaattcagcgtcttccaatgggagctgtcattaagtgcatgatgtattacaaggaggccttctggaagaagaagggtaggctgctattattcatgtttaaactgtattatatgaagaaatcacagtcttttaggattattgaacagaaggtattgaacagaaacaaagtattttcaaactggtagaaaaaggattagaaatcttggtctgtcaatttcctcatatccttggccacacataatgaccccaagagcacttgttggcaatgggagggaagaaggagatcacatcagtcataaggccaccattgccctgactcctggcatctgtcctgcttcttactttttatgagcagagtgaggtcaacaggcaccatggaaagagcactgcgttgaagttacacattccgggacttcgcttgcttgctagcatcagtctgtagctgtaaagtggtgacagtaatacctaccactaaggtgttgtgagaattaaatgaggcaggatcttggacttagaaagctgcccagatatggtggctactgttgataagcattctggttatactcatcggattccctcctcccacctcttccctggattgggtcattccctccaatgcagcccttctctttcctcatgtatgctaggagccagggttatcttaccatttttgtcatgcattggctggtcataagccctttatgtaaaggtgatggagatgggtcattttctgtctgtgggtgaatagacatccttatatattcagtgtgtgtatttaacaagacatgtagggttggggccaagaccaagagtttaagtttttacttcctcttaaaaaatagtttatatatatttatgtgtgtatgggtgtctctgatgagcttgatctcgatctcccattgatttttctcctggttaagattactgtggctgcatgatcattgaagatgaagatgctccaatttcaataaccttggatgacaccaagccagatgggtcactgcctgccatcatggggtaggttagagcagggtgttctgcattttccaaattgtgttgatgtattggtgtggatgctgtcaaagtatattactttggaattaagttcaagcaatgatgaataatgctatcaaaatatataatgtttccatgtgttaaaatattgcagtaatgtttcgtatgtagcacaagaatactgggaaactttactaaaattgacaccattttgaacttgtacccatgtatgtctttctctcatacaaagcttacgtgttgaggatggagtgaaaaaaagcagctagacaggcagtatggtagccacccctgcctacaggcagaatgtccacagccattctgaaatgagaactaaccgctttattctataaaaacattctaaatgtggggtttctcggttttatccttttctccattccagatatctgctacatagcaaatgttagttgttaccctgagatataagacagctgaccaattaggaggcccagttcagaattgagccaggccttgattggatggcatggcagtttttctggtgggtcactctagttatccttcaccagtggtgcttcacttaacctctaaagtgtgcggatgacccagggcctggttctgtgtagggaaaatgagagcttttcccctctcttctcattccggcacatagctgtcctactcgttgggggctggggagtccagagaaggaagtggtgtccccacaaaggaattgctaaggagttccacagcctccctcttgcctgccttttggcctcctcaaaaactatacaaataaaaggcgatttattctaccacactgtaacaaaagaacatagcttcagtagcaatcaagtgacttttagagaccagtggtctcccctttacccctaggaaatgcatagctcttgctcagagggaaaggtgaactcatgcacatcatgtcattgaaggaaaattacaaaggcaaaaggagcagacccacatcccagggaagttagaaagcaggttgtgctgctggttactaacgagacattttataaccacttctctcattgtaacatataagaacaccagcctccctgagaaaggcaggtgcttacaacataatgactgttggaataacacatcctcttcatctctaaccctattgggcagaagaggatataggttgtttgggtagtttgacatcatcttctatatgccagagaaaagcaggaggttcaggtacaggtttcaggagaatgtcggttaagacaaatccaactatgaatggaagagcaattgatatttttcttgccctgggagttagatatagtgatgtcttctgctgtttttgggctttctttttttttttttttttttggaagtggaactcaatattttaatgattttacttaagataaatagtataaaaggaaaatgttaaacggttgtgttctgtggacagtggggctaaaacaaatataaaataataataattggttatagaggaccaagtacagaagatgagagtttccttggaaactggggaataccaaaataatctgtttcttaacttggcgatgtagtcttaaaaattaaagctaccatttattgagcattggttgtgggtgcaagtttttatgtgtacaatgcttttgggctttcttcagctttattattaactaggttagggctcaaataaccttccaggtgttaatggagttatttaggcaattcttagaaagtgatattctaatctctttcatcttgacacttgcctccaccctgctctttgctgatggccacagccacgaaaaccttgaagataggggtggtaattgcccagcactgtgtttgtaataaacttttggaaactagaaaggaccttgtactttagaactgtgaaatgtttccaacacaaagccagcatgtttaatttcctcaataaaacaccaaagtaagttaaagcttatttatccatagttgggattagatcaaagagattatttcattcatgacttgagatttgacagaaataaccaacactaactgccctttgggaagggaactgtaaaaagtatacaagacaagttgactaaaaatgttttcagataaatcatttaatcttttatcagatattgatgattaaaaaaactatatacatctaaacttactgattcttgcataaacccagaatctaactaaaataattaataacaagctataacttgaggtgttaaatcatgcaaaattatgactatatcccataaagttcaatagttcagatttcctaaatagtccacagctttctctgaaatactattctctacattaacatacatctttgcttctcaaagtgatctcaaataacagccctaaaggaactgccaatccaatttgaggaacactttaatttgtgggtagggagaggaggaaatatctgttttttgcactgatctacctgtccttttggtcttgaataaaagaaatacaaatttaaaaattttttaatggaaaaataatttcattgtcctttagctcatttggatttttgaaagctttctaataatagtataactaaggacttcatgtcacaattcaattcttttaaatatacatgcagttagtaatatcagtataataaatagaatatatttgattaaaggggagcaggcaggttataactgagttttattgagttactttatttggggactatattaggtcagtttccagggaagctgactcagagctggagatctgggtgctggaactttattgggaagtgctctggggatgactacctatggcagaaggattatgcggaacttgagctccaatgttgtcccaacaaaggcctctgccattcccttggaagttctggagctgggtggcccttcagagttgtcttcaaccgcatctaggtcagaacaactctagggaggggtgggaccttgagcgaggcattctctgctgccccgtccaattactggggaaggtttcagctgtgaggtaagagtaacgagtgcctggtcccaaagggagcctggggggcccaccgtggcctccactacagacacatgtttatatttgtttttccagctttgataaagtatttggcagaaggcaacagtcattaccagaataatcatttagcacaacattcattcattcaacatttgatttcctactatatgccaaaaaccatgttaaactttagaagtaaaatattgaataggaggtcacctgtcgtgtaggggatcacagcctagcaggggttttggacacacaggcagaccaaagacaatatggcatttgccctactagaggaggagggtctgagagagttcatttcatgctgaatagctacaggttaagaatacttcagaaagaaagggcagctcttaagataaacagctgtaacctgatcattcaatgtaacctctctctccagcttcattcttgcccggaaagctgatcgacttgctaagctacataaggaaataaggtaagaatttataactgaaaaatagatgaaaaagttagctttgtattttgtttttgcactgacagtagtagaataacatgaggaaaaacacagtacttcacaaatattctcaaaattccaacaaaccaaccttttgtattttgctacagccctcttgacctagcccttgcccgtgtgcatatattaattttacatgttcgtgtttattttacagtggttaagaggtaggatttccctgagagatggatggataaaaatcatagaaaatattagctgtgaaaaatgctgtagaaaccgaatcccaatcctctttcaaggccataatctttttctaagattctctgacatggactttctaaaaagtatattttaacctgtagcaacttttgtacatgaaaatattcactactgcttatctgggacacagttctgatgttcccttatctgaaagcttcctagtataaaatttattttaggacagtggtttttttttttttctttctttctccctttctcttcctgtcatggtatatttgttttgttttgttttggaatcctttgttcaattaaagtcttacctgaagaggtaagccttttaacatcagagttatttggctgttggagggttgcctctgggtagccctaaatcctctgctagcttttaaagaggtccaatacatacacaaaaatatagacttttctctgaatgtaatttaaaaaattaaacagctaacccattagcagccgttgctttgggagttactctgatgactttagaagtgggggaaaggctgcagaatgagttcctacatgtgcacacggatttgtttatttgaatctcatggtttgcaggtaagctttacatggaagaaactcccagtttcaattagcaggttcttctctgttcactgtaagtggtaaatggttgaatctcaacaatcatgggattcaaacaaccatgagattgtggaatctcatggttgttaaaaataaactctactcactcaatggaggagggatttggggtccagtgatggggaatgatttgttcaagcctccatagctagtgtcttagtgcatttgtgatactgtaacaaagtgcctgaaactgggtaatttatgaagaatagaaatttatttctcacagttctagaggctgggaagtccaagattatgatgccaacagattcaattcagtgtttggtgagaacctgttccgtaggtagcactttctcatggtgccctcacatggcagaaaaggcagaaggaggaaggacaaaaagtgatgaaggtggtatcctcacttggaggaaggcagaagggcagaaagggcctagctagttccctccagcccatttataagggcactaatctattcatgagagcagaatcttcctgatttcatcatttccgcagagaccccacctcaaaataccatcaccttggaggttaagttccaacatttaaattttggagggacacatacattcaaatcatcgcagctagcttgtgacaaaaagtctggagtagcatatagcgcatactttttcattacaccacactaagctgacattttcttttggatttcctgctttccctccttattaatagtaaaataaataccagcctgtaggtagacatttggttatgattccacacagtggctgaacttctcaaaagttcttgtaaggcaaaacccttactaaatatgtcattgacaaaaacagtggttcccagatctgactgcatcaaaatatcccaaaagatgtttggaaaatatgtttttataagacctatagattgtgattgagtaggtttgaggtggggcctgtgtatttgtatttttcaacaagcttttcaggtgattatgataagcaaccagatttagaaaccagtgaataagttcaacgagatgatttgcacagtggcctcttttattcatcacttaggttctgttatttttagagccaaattaatcaatcagtgcattgttttaacatccttgccttacatatcttttccaaaaatttttaattttaaagggaagaagggaaagggaaagataatttcctatgtttgtgtgaacacatccttggctcttctaataatatgaaatacagtaaataatgacttgtaactattataattgtttttaacattcatgaatgaaaactaactacaatgtgggttgattggatttcaggtttcactctgctttaataaaaattttattacacatccagaaagtaagttaagcaggcctggcgcattggctcacacctgtaatcccaacactttgggaggctgaggcaggcagactgcttgagtgcagaggttgaagaccagcttgggcaacatagagaaaccgtctccacaaaaaaataaaaaaattagccaggcctggtgacatgtatctgtagtcccagcaacttgggaggctgaggcgagaggatcacctgagtccagggaggttaaggctgcagtgagccataatcgtgccactgcattccagcttgggtgacagagtgagaccctatctcagaaataataataacagtaataagttaagtactgttgagcttttttagaataatcattgccgatactttcattttctaattaacttgaaatgtctgaattattgcttgtaacacccttgtgaagtaggtgttagaatcagtcatctcttcatagactaggcaaagagtaggctgaggatgggttttgactgaacaaatatttattgagtacctactatgggcagattactcagaagggtaatagccttaccctgctattaattagctgagcaaaatcaaacagatctctgcagctccctgagcctcggtttcctcatctctgaaatgaggggcttgaatcaggctgagagagacagacagacagacagtagtcttgagacttcttcccattcttcttttcctttatgactttttatgtataatgtgagcagctctttgaaggaagccaaacttcctctgactatcctgaaatttaactatccacctaaatatccatctaatgttgcatgacatcatctcaggagtggcatttgtctctcccttaaaccttccatggaaaatggtaacaataagcaaagtttataatctgcctcctcctcctgattttatacatatgaggtgaatgttctggaagttataaaaatggtttaagtgtgaggatttagataaatttataaggttacactttgtcccatgttattcagagaaattgggggcatgtctttaaaatattttctaatgtaattggcaacataaaattgtatatttctaaatctctatttctttattaccagtaagcttgagctccccccgccctgcataattttgtctcttcagcttttaatacttgtcttacagatttgactcaaaccttttgccacatttttaagcaaatatttttccagttgcttgttatcccttaacaaatattttagagcattttcaaatgtttaaactatattaaaactataaaaggtaaataggaaaagtatataactggatcagtgtgaacctatgcaaacaaatccagaaataaaaccattaatttctaaaacaggtgattttagtaaattagacttttaaaaaaattcaccatgagtagttgtgagtttaaaatgtatttcgtttcaaaaagagtttatataagtacaaccactaactttttcagacatgaaaataccatgttctgggctagtcatttagataatgaattatgagaataaccaaaggctgtgtttgaggtaacattagcatattttgcccatccctcagatacactttgaaatactgtggtccacagaccattctatcaagtgacaaattcctagactgaaatgactgtagatactttctgtatagcatatcttacgttatgcttaaaagatgaaatgagctttatatgtttgtaggtaattaaaacacaagtataggatagttaaaagacaccatcactcatactatagacttataaaagggatcattttagaactctacgtattccagaaaagttatatagaatcagttcctaagactggctaaacttaattgaattcatttttcccatttttatctcgagaagatatcatattaggtagtgaaagaggcaaaaatgtaaaaaaagaaaagaataattccattgaatcctcaaattaaatgactactgaggcattgaaagttaatttgagtgcggggattcatggaaatgttcatttgtgcagttacagaaggccatggattttaatttatctgtaataaatctggttgataccaagagctctagaactcactgtatttattctatacccatcagttactccttccctaactttatttttttttttttttggctctgttttataggaagaagaaaatctgtgagctctatgccaaagtgctgggatcccaagaagctttacatgtaagaaactcccagctttaatccctagcaggttcttctctgttcactataagtagtaaagcaaagcatattctgattttttgacagtcttatgaagagagtataaagcgatatgcttaacttggaggataaacttcagcagtcacaaaaggtcattaaaagctggtattaggcgcatggaatttctgacacagcaacttctttgggctgtttaaatgttcactagataactggcagccaattgtaatgagagcctagagctgcagggattatgtcaagaatgggtgagttgggttcctagaacagaagtcctgcccccagtcagtgtcacttacctgctgcacaattaaattccagatatgttatcatttgttggtgaaggcaaagtagtatgtacttgacaagatagactgaatctagagtctcttcccaggtcaaagtcatactaatttgtttttccatgtgtgaactcaattcacaactcatttaggaatatcagtgctttcaatccaccactgaaagcaattaggagaatgaaattacgtctttttgaaaaaaaaaatagaatggctgagcgctctttcaggggcttgtctctaaactgttcaaataataaactttctgaatgtgccagggaaattagagaaggttctctcatgtcccctaggaaatagttttcatcttaattgccgctttttcgtggaattcccatcatacatgtttccagcttagaaaagtggctgggaaaaaagcctttcttagacatttgtttgtcttctgcctcctccctcccaccctttccttagcaataatgcctgatagatggggaagtaaagtctgttattagggactccagagatttgagcagacctttccacaagctgaattgttgatggggtttcctatagacttagctctaaagacttcagaatctgcatggatggatggatacccctctctcccagatactggaatacttcatgtcttccctaatcaagaaaatgggaagagcaaagtatacatgttttgccacatggtacttcacaaaaggccattgcttggtactatcatgtttccccttaagtgagttagaaaaacaggattttctttattttcttaatgtaaactttttgttaaagcaacgatattattgacttgcagcatttcagctttgttttctcttttgtattttcttccccactgaactgcagccagtgcattatgaagagaagaactggtgtgaggagcagtactctgggggctgctacacggcctacttccctcctgggatcatgactcaatatggaaggtattacgcaagcactacgccaattaatccaagacctgtgccaaatttaaaaggaaaagcagagttcaatgcaaattctagaaatagttgtcaaaatccccatttcttatgtcctagataatacttgtatatttctggatgtccatagaaaaataaggatgtcattacatagaacaatagctgtcagcatacagaacaatagcagaacagtggggaggatttcagatgtgaacagtgcttgtgagaatgaagcaagctacagtgtcctccaaggggacttcgtgagctcaacttgacatttagtctcacatgactgccttaggctccttggcaccagtcaacacagaaggacattggatgtgtttatccaacacttctgtcttgccaacagagcagcatcagcagacagtcctcttcaggggaagagtcctcactgtatacagttgagatgtgaggaaatgacatccacgtggggtgggtccaccttgacctagaagccccttgctccatgggagccattatctctatgcttcataggcatagtgtccggtaccttgctcagttataagacttgctcagttacaagagacaccacactcagggaagcccaaagtgatagcctcctaccaggtatttacaattcatttagagtcctcccagcctggatgcagttcactaatgtggggatgggaggggaggcacttttagcataaatggtgttgcctccatagatggcattacaccttcatctggtttccagagaaacagagctagaaagttaatacaaggtcacatttgtccactgaaaaggaggaagtatttattaaccttttcgttacaggagtttttagtctgttttttttttcttcttaattgagtcagatcgcctttgttaacaatagcaggattgatgaactggattagttctggtatcaaagtagaagtctagaagacaagactaagatgaggaatagatgaaacccagggttctggaattggaaaaaggagtgccaacgggttgagatgaaggccatcagggtggggggcaggacatgcagcttgggagagttcatgaaactagctgtggacatggcaggagtcaaagccaaaaagttggaggggacagctgtccattcagtccagcccttctttgtaagaggagacccatttccttgctctcagccagtccccagagaagttcagagaagctaactgtacagaggttgttttcttaaagagacacacccatataatgtctcaggtctctcctttgccagaaatgatagttgacgtccctgtcttcccacctgccactgcagttcctcctgacacactgggagtgcctgcaaagctggatctgtggctgttttcaagaagagtgcaccttcccccgagaaagacaggacagggagaagaatggactgccaacaggaaacagcaaagaaatctgatttggggattgaatacatgttcttatattccagctctggctggcttggaaaagatcaacatcccctttaatgattgatgatctgatggcctgattctccctgacttgaaagttcagatcctctatgcagatccagaaagcaaaaagtggcctttcaccttgggctaagtcatacgggtgttttttaaacagtctgaatttctgtgccttctgcagactaaatgagggcagtgattggctcatttaccctgcccaccttcccaagtaactctgtgtaacctcttggttcccttgaagggtgattcgtcaacccgtgggcaggattttctttgcgggcacagagactgccacaaagtggagcggctacatggaaggggcagttgaggctggagaacgagcagctagggaggtaagcaggaaagcccaggctctctccctcccgagtcacggcaacgtttttggcatctggtcttgctagttcttgacactgatagaatctgtatgtccatttctctgcccctcactcatggggctcatctgtggctagcagggccttgaatctgtagaaactatacagcctcttttcataataccatggtgactttctttcaggtcttaaatggtctcgggaaggtgaccgagaaagatatctgggtacaagaacctgaatcaaaggtaagtttggtgactctgggcactatctctccttagaccaatcatggaacataaaactcacatctcccttcttctagcctccgatttaattatagatgcaactatcccaggggtctccatgcatggatcttgcagtgttttgttcctccttgtcagcatgagttttttgctcatgatctgtgttccttcatctaggacgttccagcggtagaaatcacccacaccttctgggaaaggaacctgccctctgtttctggcctgctgaagatcattggattttccacatcagtaactgccctggggtttgtgctgtacaaatacaagctcctgccacggtcttgaagttctgttcttatgctctctgctcactggttttcaataccaccaagaggaaaatattgacaagtttaaaggctgtgtcattgggccatgtttaagtgtactggatttaactacctttggcttaattccaatcattgttaaagtaaaaacaattcaaagaatcacctaattaatttcagtaagatcaagctccatcttatttgtcagtgtagatcaactcatgttaattgatagaataaagccttgtgatcactttctgaaattcacaaagttaaacgtgatgtgctcatcagaaacaatttctgtgtcctgtttttattcccttcaatgcaaaatacatgatgatttcagaaacaaagcatttgactttctgtctgtggaggtggagtaggtgaaggcccagcctgtaactgtcctttttcttcccttaggcaatggtgaactgtcattacagagcctagaggctcacagcctcctggaggaagcagcctccactttggatcaggaaatagtaaaggaaagcagtgttgggggtagcggcatgcagaccctcagaccagaatggggacatcttgtggtctgctgcctcaggaatctcctgaccacttgtagtccctccgacttctctagacatctagtctcagtgctagcttatttgtatttttcctctttcacttcttatggaggagagtgtttaactgagttagaatgttgaaactgacttgctgtgacttatgtgcagctttccagttgagcagaggaaaatagtggcaggactgtcccccaggaggactccctgcttagctctgtgggagaccaactacgactggcatcttctcttccccctggaaggcagctagacaccaatggatccttgtcagttgtaacattctatttcaacttcaggaaagcagcagttttcttttaatttttcctatgaccataaaattagacatacctctcaacttacatatgtcttcaacatggttacctctgcataaatattagcaaagcatgccaatttctcttaagtactgaaatacatatgataaatttgactgttatttgttgagactatcaaacagaaaagaaattagggctctaatttccttaaagcaagctcacttgctttagttgttaagttttataaaagacatgaaattgagtcattttatatatgaaaactaagttctctatcttaggagtaatgtcggcccacaagggtgcccacctcttgttttccccttttaaaaactcagatttttaaaagccctttccaaaggtttcaactgtaaaatacttctttttacaatgtatcaacatatttttatttaaggggaattaacaattgccagggaaaccagccaacccaagtttattatatcattaaccttatcataaattcaaacctaagttgctggaccctggtgtgaggacataaatcttccaaagttttgcctatcctaagagctgcatttttctactgctctttaccttgcattttagctaatttaggagttttgagaatgtattggatacgctccagtacataaggagttgccgcatattatatcagactgctttgagaaatctcatccctagtctattgcagttgtttctattagcttactgattaactcagtcctgacacaccttttgggaaatgctgatttaaacttcttaactggcaacagttggaacagtaatcagtttgctaacatatttaaagtcttgaatgttgaagaactcatgtgatttacccttttcaactttttggaaaacgatttaatttattctaattagattaaccctattaatctatggattgggtatcaaaatgaatgccagtccagatgtgcctagacacgaaattggagctgaggactctcacgatatgcaagttcatccaacgtgaagataccataagctttttctctgaaccagagaaatgaaagtcagtttaagaggctgatagatcttggccctgttaaggcatccacttcacagttctgaaggctgagtcagccccactccacagttaggccaagaattagattttaaaacttcatctgtctgtcccagttaactgttaaataaggcctcatcctccactgaagagtatggattgaaggattgtgaactatgtttagtgtgattgtgaacttggtgcctaatgttccatgtctgaagtttgccccagtgctacacgttggagtatacctatgtgtgtgctttgccactgaagtaagattttgcctgtatggtactgttttgtttgttaataaagtgcactgccacccccaatgcagactcgactcctgtatttagttgatggctctatgcagaaagttcaatggcttcttatagcaggaggtcacaatgaggcattgtccatggaggataggcttaggaaattgtttaataccgactgcaaattctcaaagttgagtttgactctcatgtgttattgaggttttctgggaactgattaaacactgaaatactgtagcctgcctaactgggccacagatgtggattctggtccaagttttctcacctagtagcttatgataacttgagcaagtcactttggttctctcggtctccacatctggaaaaggttgggttgcattagatgacttctgagcattcttttcacggcagcataatgtgatctatgcattttgttgccagcactgtaactgtttttgcctattggtatgccaggggcaaaaaaatcagtctttctgtaccctggtttactccttgtcctagattgggttccctggaaacagac

SEQ ID NO: 17315 - DNA, 84252 bp, Human
tagacaggagcttgaagagttcagataaaactcccaaaattatagaaaaaataaaaactaaaccctgatttggtcaaatttcacttgaaacaggggtactcaagtgtgtcatttctggaatgtaaaagaagttattttccacattgtctatccagtgtggttttttttccatagaaattatatgcactttagaatggattcaatagaattgttcttttgacaggtataccttcaatatgttcaagctacagatgaagccagtcttttaacagttttttaaggacctacatgattacttacattagatagaaaactctaggcacacatatatccacataagcattgatgtatatatccagtttccaattttaaaattttaaattgtatatttgtagttattgttacagggagattatcaatgactagggaaggccgggcgcagtggctcatgcctgtaatctcagcactctgggtggtggaggcgggtggattacctgaggtcaggagtttgagaccagcctggccaacatggtgaaaccccatctctactaaaaatacaaaaattagccaggcgtggtggcgcgggcctgtaatcccacctactcggaaggctgaggcgtgagaatcgcttgaacacaggaggcagagattgcagtgagcggagatcgcgccactgcactccagcctgagcgacagagcaagactccccctcaaaaacaaacaaaacaaaacaacaacaacaaaaaacaatgactagggaaagtaggccatgaaaagtgttgtttccaacctatcaattgccagtactacaagcaggagttagacgtttggaggttttcacacggtgctataaatacagtttccagggccccggtacacgtggccttcctgctctgccaggatggagagtcttgctttccacattgctgatgtggtcagactaattaaattattgcaaaaagacacattccctagtcaaccttatgtgtctgccttcttcccttgagtcacagttgttggctttacaggccaaggcaagtaagtcttgaaccctcagcagaaacagggcaccagcatcggatgcctcataacctgaacagttaaggacgccccaccacagagcttctttctgagtgtgataaactataaggcaagactgtaaaggggtggatcttcatttcgatttagggtaggtgacacctcaagggtgtttcttcccttccagcgtaactggatgggaaacctacaccaagtgtgcttgggagggctgcttgggtcagctacctgtaagtggaaatagggggtgccaccttccgatgaaaacccggatcccgtactgtcaacggagggcccttgaattcacatccctcagcccgctagaaagcccctgaaaccacgtggcctttaacccattccggcaacagcgccaattcccggaagcgagagggcaagaaagctcggcgcgacgcttcccgcgtcttctaggccgcgcgctgaaatcaaacgcgacgccggctagctgtgggccgggccgagcgctcaacgctccagcggctgggtaagccgcggccgccgcccaccccgctgcagagctgggcggggccgcctggaggcagcggggagaggccagccgaaaaggaagaagagacgccggaggcgcgctctgcgcaggcgcgcggcgccccgcctccccagcgtcggctccccggcgggcggtgcgggccctcccactctaccccgcgccgtctcacggccccggccctagcttcaccccgactacccggcgtgcgcgtcctcctgccggcctgcaggcccggggcctccgcctgcttccccacagctgctccttgcggccccgcttgcgttcacgctgtcgcccgggccggcgcggccggggggaaaaccggtttccccctcccacacctaccccgccccctccccgccttttccgccctccggtccccctccctcggcccgctgctgctgctccagatgaggtgatggcaacggccaacttcggcaagatccagatcgggatttacgtggagatcaagcgcagcgatggtgagccgcgctgccagccccgctggcccgctcggccccgtgttcgggtgtgcacggaggggacgcgggcgccggccgcctcattgattgcttcgccgggctgtgggggtgggaaggcggcggccgcggcgcttttgtgtgtggcgtgtgtgccagtgaggccggcttggggtccgcccgggcgctgctgcagttctccggatcgggccgcgggggagggaagccgggtggggaaagggcccgggtgtcgagggtcgcgtctccgggggtctctgggcgagggccgctcgctcctccccccgcaatctccagcccccccccggggacaccagcccgggagggagcgggcttcgttagggatgaccctgcctcgcgcttccccttggtctttgcattttaccggcttggcctctgacggggatggggatgggggtgggggagcgggaagaccagcgatttcacatttagagaaccgactgctggtcggaggccgagatggggggaaagagccagttccgtcgccttaaactgccgtctggttgtcaggcctccccggtttcgtcgtcgaccatgctgctttcttttttgccacttccttgggagaaaaatgtggagaatatcgcgctgagccatgaataagggtgggggagcaatgggaagaaatattcgatgggcttctccaaggtgatgagactgtaaagggaatgataggggatgggcagagtcaatgcgaggcactgctgagagagtgggggtgggcgaccggatgttgatattttcacaccctcgggagaggtaactgagaaaagtgtaaggcgaggtgaagacacatgcttcatttttttttttaagagccttaggcttatgtatctttctctaggtttctcttggggaaaatggtttatgacactagcttggggtgtggagtgagatacgccagccagactggaaataattcatattgtaaaggaataaatgcacggagggagataagtaaaattattttctttcggtaccaatattgaaagaacgagagatgtgtgataatctcgagttgagcagtgttcctgactccatctctcataccgattcctttttttttttttttgagacggattttcacccaggctggagtgcagtggtgcgatctcggcccactgcaacctccgcctcccgtgttgaagctattcttgtgcctcagcctcctgagtagctgggattacaggcgttgtcaccacacccagctaattttttgtatttttagtagagacggggtttcaccatgttgacaaggctggtctcgaactcctgacctcaagtgatccacctgcctcggcctcccaatgtgctgggattacaggcgtgagccatcgcgcctggcctcgattccttttatgagtgccttatttattaacctttagcctagcctagtcagtagtaacttggctgtcacgtccacgtgccccttggattctgccaggtttgaccaagttacgtgaagctagattgattttcatgttgtgtgtatgatatattggaagaccctatatagctaatgattttttcctccgttatatttgaagtaatttgtggtaacaactgaaaccatcgttatcctgtatatgaaaagataaattataccgcttagagctttagaaattaccaataacactaatgggaaagagataccttctttacttgggttgaggtttcttttatattttctcttcagattactttcttgaaagagtgctgttaatgtcatttttttaggtaaatacgagttcacagtataccagcaaaagtaggatttacatattattttgaagattctgggtgcaaagcaacacctgtccctggtatacacccaagggagaggaaatcaccaccttgtgaagatatctgcactctcgcgttcattgcagcattattcacagtagccaagatagggaagcaacctaaatgtccatcgatgggtgaggaatggctaaagaaattatgtgtgtgtgtatacgtttatgtgtgtgtatagacaatgtacaatggaacattattcagccttaaaaaaggagatcctactgtttaccacaacatagatggacctgaaggacgttatgttaaatgagataagccagacaccaaggaaaatattgcataatctcactcatatgtagaatatttttttaaggagctaaaatacacagaacgaaacagtggttactactggtggtggggaaggagaggaaatggggagatataggtcaaggatacaaaatagcagatatgtaggatgaacaagtttagagatacagggggaccaatgttagtaaaattgtattagagatttttgttaaataagtggattttagcagctcttgttaaagtaattatgtgaaatgatagctatattaatctgcttcaccattttgctgtctatattccatagcatcatgttgtaaacctcagttgcacaatgaaatttattttttaaaaaattagggtgcaataaaatgtgtaaattctttacactcataagtatgagtataggtgttaactttgaaatcgtatcagaaaaagtatatgatatttgatttatacattttaatttctacggagcatattttatttaaatttattgaacttgaagcaattttcgttcttttcagccttcaccttcagcctataccagaagttcccagacatacaagagctttgtgttcttacataagtgctactaacctaaagccacatttcaaaagcggtttgcctataagaaattagggaagtcatcacagtgtgttattatcctaacctatggtcatgtatctttttatgtgcctcagatgcatgatggagttggtggaaggcaggagattagtagagaacttcgaaagaacagaaggatcatttgcattggacagtagtgtttcacaatagaaattgatgtctgggagaatgcccctcaagctttccctttttcactttaaagaagcttgtttgcttcctctcacttccataacgtctatattggataaaacactagtggttattataacaaaaataaactttgcagttggaggaacactaatatctgagacagtagaaatgacatgagtaaagaagggctgcttcagaccattattaactggtgacttgatgtttttcttttggcttgctgatggcgatccatgtccctatttcagaccacgcttttcccatcagtgatactcttacactaataaacatatcccaagggcaaacaggtacactaaaatgagcttattcctatctttcaagaccatgatgaaaactatcctaatgagtcttcactgattactaaaaccagatggccagtcagcatctgaattcctaaatcattctgtattattcatgagacagcatatttccttaagtattaatgtttgggtctgtaacttttttttttccactcctctcagctcatacctatgggtacatattcttaatactatgtttttaaactgcatggggtaatgggacttactaataactaataattctttttttttttttttttgagacagagtctcgctctgtcagtggtgcgatctccgctcactacaacctctgcctcccaggttcaagcgattcttatgcctcagcctcccaagtagctgggactacaggtgtgtgccaccatgcccggctaatttttgtatttttagtagtgacaggtttttgccacgttggccaggctggtctcgaactcctggcctcaagtgatccacccacctcagcctcccaaagtactgggattacaggtgtgaaccactgtgcccagcctctaatgactcttaaattccctgaatgcatctgtgtcattacccccattcccacccccactactgggatgtctagcaaaattccttgcacatcgtttttgaataaatcatacattattggattttttgttttcaaacattttaattaatcattagaatgacatcttagctggaagtgaaaccttccatctatgctcctctgtactgctacctccctactctggccctctacttcccgctggcctgttagtcaggaactacagcgttaattgaaattgagtgatctgctaaggttaatctgacttttctggttttctaaggttatcagtgacaggggttaggcttggactgctaagattattctctgccacaggagataacctggtatgaaattggactggtgtgttttcttacatgtgtcttcctatttttctgattcaattcctttccctttttaaaacccactgactcttaaaaaaacctacaatctttctgtcgtgtagctagtttggttttttttttcttttagctgtgctgttaacagttctgtagtagctgtgactaccctttggggactggggaagaaatgggaaatgttgaacatttggaagctgcagctaatatgggattgttctttgggggcgggtctcttagtcacagtactgtgactgtattgatacatgtaatctgaagagaatcttagaatatttccaccagaaaggtttttggagataaactagttttcatttttataaatgtggaaacttgagtcccagatcaccataagtgacttatctagattcatacaacttgtcaatggcagccaggaacctgacatgcttagcatagaaatcagactatcaagaactatgacagtaaaggaggaattctctgttattttggaaccgtataccgctttttacagcccagtcaagatgtaggaaattgcttcttacttcggagaaaggcaccagcgagcagtgttacagagcttgattagaatgatccctggtaagaagtgctatgttactacaagttcaccaaacctaaaattgtgggaggaaagtattcttgtttcttagttaagtgttggtgtaaagagttccttttaacatctgaaatcaagaggcaattgaagatttcaaaggacccatcaggaattttggagttcagggcaggcaaagaaaatctttagaaaagattttaaatggcctaattctttatatgctttgccacatttttcttctgctagttcatctttacacgtcactatataggcttctggagaatagcatgtgtaaatttaagtaataaagatgaaccatgtggcaatacagttgttctttaggtacaattatgtgattgattatgggggtgggatggaataggggcatttgtgacctaatagttcccttttccctgaggactaggacgataatgtttctgtatatggatttgttagggcttaatagttttccaagtgcttcaagacatgttagctaattggatcttcacaggaactctatgaggtaagcagggtagaaaggtggcagattattggtttataggtgaagaatctgaggttggattatttgccaagatcacatggttaataaggagcatagcctgggccaaagcccgaatcccttcactcccagctctctaagtgctgctgacagatgtttgctgattatggtgtgaagttgtatactttagtatttctttctgagacatacaaacccctgtagtaaaattctttccactactaccaaagaagctcaaaaaaacttaaaataggcacttattgcttccaaaagtaccacagaaagccaggaatctgtattcattgcctagccacttgattcttatgacaaagattttgaaactctggggaaaggctatgtgtcaacttgttttatgtgtcatgattgttaaaatgctagagaaaacagcaaagagccagttaaatctgtgtctgctcaaataagacaaggggcaagagtgtggaaaatccagaacaagattccctgagagatcatctagaccccgttctttctagtcagaagtatagttgtgattaatatgacattaatcttttgcaaagtttaattcttggattcagccatctgctttaattttaacacatctgttttgtaacctaaaataattttaaggtgtttgtttatttgtttgtttgttttgagattacgattcttaagaatagatacaagttttaaaccttggataaaactaatttttattcttctggttcagttgtagaacaaatacaggttaagttgtcttccagctcttttagataaagcaatattagtggttttatagtgctaagtgaaaagagacattagaatttcaccatattaaactatctcccaagagtaatatgagtgagggaagtgttccttttaaaagtcatgcttctaggctgagcatggtagttcatgcctgtaattccagcactttggaggccaaagcaggagaattgcttgagcctatgagtttgaggttatagtgcactatgatatcattacccactacaataaaacacgaagttcagatggtcattcactagggtgtgtgatattttggagtatagaccttaagtgattatgacatatcaaaataatgtggtcttatgtttcttttttttttattgcagatttcattgaatatacttctattaacagcctgctatatatcaggcattctgataggtgttggagatacaaaaaatgaataaagcaaaaatagttcctgccctcacaaacaagtaaataagtgattcatctatagtgtgattagtactgatagaaatatgccattttgtgtgtacattattactaccttccttttgaagattaggcttttttgttagactcttgaagttatggaccttttggatggaaaatacatgtcatatatgccatctctcctcctctatgaccaatatccgtgatccctcatagcattcctgatgaatttagcctcagagttttttttgagagggagtctcgctcttgttgctcaggctggagtgcagtggcgtgatctcggctcactgcaacctctgcctcttgggttcaagcgattctcctgcctcagcctcctaagtagctgggattataggcatgcgccaacatgcccggctaatttttttgtatttttagtagagatggggtttcaccatgttggccaggctggtcttgaactcctgagctcgtggtccacccacctcagcctcccaaagtgctgggattacaggcttgagccactgcgcccggccagcctcagagttcttaatacagcattatcagccctaatagccctagtctgccaattgaaattggcattgtcattattagcctatttcctatactctagtacctatttgagttataagtttataacttttaaattgttttggtatcaaaaggaatttttttttagggttttgctctgtcacccaggctggagtgcagtggcatgatcatagctcactgcagcctccaagtcctggactcaagcaatcctctcaccttaacttcccaagtagctaggactacaggtatgcacaaccatgcctagctaatttttgtattgtttgtagagatggggtcttgctatgttgactaggctggtcttgaactcctggcctcaagcaattctccctctttggcctcccaaagtactgggattacaggtgtgagccaccatacctggtcaaatttattcaatttaaagtttttggcagaccagcacctgacagcaggtttctctctagatatcctgggtttgggtacttgtaaatagagactggctcggtgtggtgtctcatgcctgtaatcccagcactttgggaggcctaggcaggaggattgcttgaagccaggagttggataccagcctgggcaacatgatgaggctctatttctacaaaaaataaaattagccaggcctggtagcatgtgactgtagccccagctactcaggaggatgaagtgggaggactggttgagcccaggagttggaggctgcagtgagctatgatcatgccactgcactccagcctgggtgacagaacaagtcactgtctcaaaacaaacaaacagagaccaaggaagcagagcatgggaaacagcagtggatgcagctactggtggttatgtgtaatttggatataaactccttacacattatggcccgggaactgtaagaatcaggttcctccctgggctatgttttatttacttttgaagactttttctccaggtttttgtaggttttggcattaattttgaccacattttacctaaaggaaggacaagatcagcagggaacaaacttgtggtaaaatttgctgagtgtctatactgtgctgagaatgaactgttttttttttttttttttttttaagatggagtctcactctgtcacccaggctgtagtgcagtggcacgatcttggctcgctgcaacctccgcctcctgggttcaagtgattctcctgcctcagcctccccagtagctgagattataggcacgtgccaccatccccagctaatttttgtatttttagtagagacagggtttcaccatgttggccaggctggtcttaaactcctgacctcaagtgatccacctgcctcagcctcccaaagtgttgggattataggtgtgagccactacacccggccttatgcccgcattttgaccgcaacccatcacagggtcgtgtgtggaattttccactatggtgtcatgttggtgctcaaaaagtttcagattttggagcattttggattaaagaatgctcagcctgtggtggtttataactctggctgctcaatagatcacctgtggggctgtggaaaaaaacagaccaaaaaaaaaaaaaaaaaaaaaagcaacccaccacagccaatatctggttcctttgcctagagattctgtctggtatgtagtctaggtatcagtattttactttaaggcacctaacatactgatgaagcttaacttgtcacacattagtgattccagggtatagccagggttgtgatccattattttagtaaaagtagtatctcctaacagagtatctgacaagacttcttggagagtgaagtttaaatggtgagaggaagatgaccagtcggttgccctgagggcaaggaggcattctagccatgtaggcagcatggaagaagtccctgactggaaacaaagctgtcaggtgaagggcatttaaaacaggcagagggaggatgatgaagaagataagggaggaggggtaatctggggcaccttattaaagacctggaaacagaggtaaggtaaggatcttggaattaatttctaggacacttggaaactactataggacttaatctcctaagagcagtaataggagttagtgattagtgatagattagagggagcatagtactgaaaatgagaggtagcatggataagattgcatcagtctaggagggtgagcaatgattaaggaacagatgatatgcagaacacacagcaagaagaattgatgttatattgcaatatatcccttgtgctgaataaagggcagatgagttgaaaggaaaggacttaacatttgcaaagtctgagtatagcttttaaatctcttcagttttatttaatcaggctaacgctgttcaagaatacagtgtagaggactgtagagcctatcaaggtaatatcaaagagagcatccaactcaggctgcatatagtttttgccactaatatcctaaaagtaattgagtttaaggtataaatcacttccattacatgtttacctgcaatgggaatttgcttaagctataactaagtactttgccttcttagtactgagctgtagtgtgttagccaggaccctctcagaattcttggaacggaatgagaaggaaaagcagtacacaaagaatatgacgtcatctctttaagggatgaggtgttttatttcttgaaatgcagctgctcttttttactttttctttgctcttacttttggcctattttttctgtcctggcatttgccttctctttttcacccttaggattctaagtgccatttcagtattcagaatctcttaactacagtttgcaatttaggacttaaaaagaggtaagcaagggataaataggcacagcacagaggcagtgaaattattctgtatgatactataaaggtggatacatgtcatgatacatatgccaaattcatagaaggtacaataccaagagtcaaccctaatgtaaactagggactttgggtgataatggtgtgtcaagataggttcatcaattgtaacaagtgtacctggtgcagggcattgatagcgcggagggtgtgtggggttaagaattgtacgggaaatctctgtaccttccactcaattttgctgtgaacctaaaaaaggttggggaggagaggatgcaaactttaggtgttaaaagttaaaaccactcttgaaataatggaccaattaatgacaaaaaaattataatttatgaatgaggattagtcatataggtgtacaattaaggtaaaattttgccattcatttttgtcatgcatagtctattggccaatgttagaagaaaaatttttcaatgagctatagtatagtaaaaaggattcacatatgtatggcaactttagcccttttttttttttttgaatcaaagtttcactcttgttgcccagctggagtgcagtggtgcaatatcggctcactgcaacctctgcctcccgagttcaagcaattctcttgcctcagcctcccaagtagctgggattacaggcatgcgccaccgtgcccagctaattttgtatttttagtagagatggggtttctccgtgttggtcaggctggtttcgaactcctggcctcaggtcatccgcctgtcttggcctcccaaagtgctgggattacaggcgtgagccacagtgcccagccacctataagatttttaagaaatgagaacaaattaggggccctaattagtgaggtacatcttagaatttaaccacagaaagctctttgatgaaatactgctgttggtcaaaacttgcctatattgttataatgaggaagttgacttgtccaaggtcatacataaaataagtagcaaatctgagattagaacatagtttgtctgcccccaaaatcctctacatactaattcattgtagactgtaattcatttttgtgccctattaatgttccgggcattggaagtcacataattaatttcataatgcttttcttttcctttctagggtatactttttattaatcaggtgtttttattaatccaactaatatttgctgtatggccatcatgtgtcccttcatctgatttctttgaagaattagttgaaggacttttctctagaagaagttagtttgccagctacaacaaaataataagtagctattgcactcagtacaaatgctctgtggctctgtaatttgacaaagacattctagttttctccagtctcttttgctattgcctatgtttaaactctcttgctcacaagactttagacaatttaaacaggaacaaatgctatcgtaaggatgtctcatattagatgagcaacaatattgtcaggaaaatagtaacaattatagcaacttgctaaagtgctgacataatagattgatttgggggcctgtccaaatttagtggacttttttttttttggagacagagtcttggtctgtcaccaggctggagtgcagtggcgcaatctcagctcactgcaacctccaactccctggttcaagcgattcccctgcctcagcctcctcagtagctgggattacaggcatgtgccaccacgcccagctaatttttgtatttttagtagagatggggtttcactatgttgagcaggatggtctcgatctgctgacctcgtgatccgcctgccttagcctcccaaagtgctgggattacaggcgtgagccactgcgcccggccataaatttatttttataagcccattgtttgaaattattttgggattatatatgggttgtgtgtttattttttaaattatagctgatactgagagttgcctataacttcgctctaagtatatggtaagtgctttctttatatgctctttggttgcagttttattaagagtaataacattgcttttaagtgtacatgctgttttgggtttccattaagaacaatttcttaattaaaaataagtagagcttcttttccttctattactcagattttttcctttttaatctttacaggtgcttctttccccattctctttaagtattgatgttcttcagggcttgatcctacccctgcagtacttctcacatagtattctctttctgggtaaactaaatgcttctctttagcccacattggctacagacatgtactgttcgtatatgtcatggattactgcatatctccatttggatatctcataaacactcaaattcagcatgtccaaaattgaacccatcaccccttcctcaagtttacttcagtatttctcattcactctattgctccagtcagaaacttggttgtcttccttgactccttattctttcttgaccttatagccttattaccatggtctcttaatttaatgactcaagtaactcttcctgcactttttctgtacctaccgctataacttttggtcatgctagcattatgtcttgcctgtgctgttgcaacaaattcctaataggcctctctacctaggagagtaatttggttaacaacaacaacaacaacaacaacaacaaaaaacccaaaacaataatttggttaattactgtttcagagtaacctttcaggcatgtaggtttgaccctctgatcacaggcttaaaactttgaaagtgttctctacttctgttgccctttttatgaagcccaagtctaacatggcttatggtggaccctgaacaaactaacctgcctcttcagtcttattcttgctgcttatttgaggcacactatactccagacaagctgaactttcttggaacactccacttctaactaacctagctaactgctgtatctccttttgattcctagcctaagatgggtcccctgctttatgagtggcgagtcccctttgtttgctctgtcaaaaaactcattgtattgtattatatgtttgtgtctggtcagactcaagttcctttatattccccactgcctagcacaggcactctgcacactttataaattatctgtttgctgaatcagtgactaaatgaacttccagcttctctttcactgctctgtctattcaagttttgacattctaaaaaattgacttgtgttgttcatcctccaggcatcaagaatatgacatgacaaggtgtgtgtcactgtttttaatgtatacttgtaattttctctttaagtttaattgcctgttttgaatagcaatatagtcccatgactaatgaagttccaaaatgatatatatgtatgtatgtatgtatgtatatatctattagtctccatcctacccctaccccacagctagctacccagttcttctccaagagacaaaaatattactagcttcttatatttgtagagcattacctctttttcatttttcaggaaaatctctgcttatatatctctatctacatgtagtataaatatgtgtaaatatatacctttttcctacagatgttatattgtatatactggagtgtaatttacttaataataatgatatcttggagaacttttgagtagataaataatagtctcattctttcttgtactgcatttcattagtgagtaaatataccacaatttatttaaccagtcttttactgatgacatttacatttgtgcctaatctgtagctgctgcatagccaatactgtagtatttaatagccttcaactcttgacattttatacatacatgaatatatctgtaggggaaaaaatcctagaagtagaagcactgggtcagataattgtgtatgtgtaattttgatagatcttgctgatttgtcttccatagatatgaatttaccttactatctgcaaaaatgcctgtttcctcatactcttatccacacagtgtacattacacttttgaaatttgctagcttggattgtgaagttcaggctgtgactatagcatttttttttttttaagtggccctgtaagggatgacatgcttaatttatgaagtgtttatgaggtccaaacatataatagaaaacacctaagttctggtgtttatctgtcatagccaatatagaaaaataaagagtatatcctatattatgtctgattatgagaagaaagtaattttttagtgaaaattttttgagaaataaatattatagttttaacctaataaacctaaagagccctttaaagtgcacaattcagtgattttttttttggtatattcatgaagttgtacaattattaccactgtccaatttcagaacatttttatgacaaactgtaaaagaaacccatacccattagcagtcactctgcattcccctctcattccggcctttagtatctgccattaatcaactttttatctttgtagatttgtctgttttggacattgagtataaacgaaactgtacaatacatagcctttagtgtatagcatctgtcacttagcataatccatactcaagtttatcagtatagtaacatatttcagtactttttttatggttgaataatattccatttcatttcatttatccatccattaatcgatagacatttgggtttcccattttttggccattatgaataccattcatatacaagtttttgtgtggacataaaagaactgaaaattgttttcagtttttgtgggttatacctagaagtggaattgctggattatatggtaactatacttactttttgaggaactgctgtattattttcaaaagtggctatattattttgcattcccactagtaatatttgagggttccaattttctacatcctggcccaaacttgttattttccatcttttttattatagccgtcctggtgggtatgaagtggcattttattgtgattttgatttgcatttccctaatgactaatgatgttgaacgtctttccatgtgttcatttaccatttgttttgtttgtttgtttgtttgtttttaaaggatagagtcttattctgtctcccagactggagtgcaatggtgtgatgtcagttcactgcaacctctgcctcctgggctcaactgatcctccccgctcagcctcccaagtagctgggactacagatgcacaccacatccggtcgatttttatattttttgtagagacatgtttcgccacgtttcctaggctggtctcatacttgtgggctcaagtgatccgcccaccttggcctcccaaaattctgggattacagacttgagccaccatgcccagccatttgtatgtcttttttggagaaagatctgttcaaatcctttgttcactttataatttggtatgttttctctttttttttgagacagcgtctcactctgtcacccaggctggaatgcagtggcatgatcataactcattgcagccttacctcccaggcccaagtgcttctcccatttcagcttcctgagtagctaggaccacaggcacaagccaccttgcctggctaattttttttagaggggattggggtaggggagagacaaggtctcactatgttacccaggctggtcagactcctgggctcaagtgatcctcccgtctcagcctctcagaagtgctgggatgacaggtatgatccaccgtgcccagtcaatatttatttttttattgttgaggtataaaacttctggatactactgccatatctgatacatgctttatagatattttttctcattctgagggttgtcttttccctttattgatagtatcctttgaagcacaaaaatttttaattttgattaagtccagttatctattttttcttttgttgcttttgcttttgttatatctaagaaaccattgtctaatccaagatgagacctacctttatgtcctactacttatgtaggcctttccatggactatattacctaaaatgtttatgttcttccttgatcttaacactagttcttgaccttttaacatagaaaacaaattaagcatttgacagcaaatatgctgcaagtctttggtaaaggatgaataaggccttgaaataccttgcaactctagtctcaaagtcatctctttgttaccagagttgaagggtgggaaacggttgccttttatctgtgtacctacacacatatatacatatatggtataatgtatcaatatttacagagaccatagtaaacacagcacaaaaccaggcattaagagatgcatgggaaatagcatttaaatggtaaatatggtaaagattgttttatggtttttgggtttttttttttcatgatcatatttttaatgttactttaaaatagattagtggaatgtgattcaatttagtaaaaaaaaaaaaaaaaaatcagctttattaaaacatctgagaaagccgggcgcagtgactcatgcctgtaatcccagcactttgggaggccgaggtggacagatcacatgaggtcgggagttcaagaccagcctgaccaacatggagaaacctcatctctgctaaaaattcaaaattagccaggcatggtggcgcatgcctgtaatcccagctactcagcaggctgaggcaggataatcgcttgaacccgtgaggtggaggttgccgtgagccaagatcacgccattgcactccagcctgggcaacgagcgaaactccatctcaaaaaaaaaaaaaatctgagaaagatggaaaaataaatgtattagaaaaggtttttaaaaaggagaatgttaatcgagaccacgttgaaaccctgtctctactaaaaaaatacaaaaaattagccgggcgcggcggcgggcgcctgtagtcctagctacttgggaggctgaggcaggagaatggcgtgaacccaggaggtggagcttgcaatgagctgagatcacaccactgcactccagcctgggcgacagagcgagactctgtctcaaagaaaaaaaaaaaaaagaagaatgttaaaaacacataaaattatagctttatacattctgaagtaaatattgatgagttgataggatagctagaatttgtttcaaaataatccagttgtgatagaagtggcagtgggattggccatatattgaaaattagtgaagctgaatgtagggggttatcatctattgtgtaagtttgcaatttttcataacactttaaattttttttgctgggtacagtggctcatgcctgtaatcccatcactttgggagatcgaggtgggtggatcgcctgagcccagaagtttgagatcagcctgggcaacatggcaaaacctcgtctctactctgcaaaaattagccgagcatggtggtatgtacctgtggtcccagccactctggtggctgaggtgggaggatcccttgagccccagaggttgaggctgcagtgagctgtgttcatgcaactgcgctccagcctgggtaacagagggaaaccctgtctcaaaaaaaataaaataaataaataaataatttttaatgaaaattctttttcaaaatgcctctgcacagaatctcatttacagtagccacctaaagaataaaatacctaggaatacagctaaccaaggaagcgaaagagctctacagtgagaattacaaaacattgctgaaataaatctgagatgatacaaacagaaaaacattccatgatcatggataagaagaatcagtgttgttaaaatggccgtactgcccaaagcaatttacagattcaatgctatttctatcaaactaccaatgatattcttcacagaattaggaaaatctattctaaaattcatatgaaccaaaaaagaacctaatagccgaaacaatcctaagcaaaaataacaaaaccagaggtattatactacccccatttcaagctgtactgcaaagctgcagtaaccaaaacagcgcggtaccgatataaaaacagacacatagaccagtggaacaagattgagaacccagaaataaagccacacacctacaaccatctgatcttcagcaaagtcgataatagcaagcaacggggaaaggactccttattcagtaaatggtgctggggaaactgggtagccacatgtagaagattgaaactggaccccttcctttcaccataaacaaaaattaactcaaaatggattaaagacttaaatgtaagacctcaaactataaaaccactggaagaaaacctagcaagtaccattctgggcattggccttatcaaagaatgtatgaccaagtccccaaaacaattacaacaaaaagaaaaaaaatgacaaataggagctaattaaagagcttctgcacagcaaaagaaacagagtaaacagacaacctacagaatgggagaaaatattcacaaactatgcatatgacaaaggtctcatttccagaatctataagaaacaattcaagcaaaaagcaaacagtcccattaaaaaatgggcaaagggacacacttgctttcttaagtcgcctgcttgttcctcttccaagttgtactttcttttctttcctttccttactgttgtaaagcttttcttttcttttcttttctttttttgagacagagtctcgctctgtcacccaggctcgagtgcagtggcgtgatctcggctcactgaaacctccacctcctgggtcaagtggttctcctgcctcagcctcctgagtagctgggatcataggtgcccgccactatgcccggctaatttttgtatttatagtagagatggggtttcgccatgttggccaggctggtctcgaactcctgacctcaggtgatccacctgcctcggcctccaaaagtgctgggattacaggcatgagccaccatgcccaactgtaaagcttttcaataaactttcattcctgctctgaaagaaaaaaaaaatgggtaaaggacatgaacagatacttctcaaaagaagacatacatgtggccaacaggtatatgaaaaaatgctcaacatcactaatcatttgagaaatgtaagtcaaaactgcaacaagacaccatctcacaccagtcacgatggctattattaaaaagtcaaaaaaataacagatgttggccaggttgcagagaaaagggaacactcacacactgttggtggaaatgtaaattagttcagccactgtggaaagcagtgtggagatttctcaaataacttaaagctattcaacccaacaatcccactaccgggtatgtacacaatggaaaataaattattctacagaaaatagacctgtactcatatgttcattgcagtacagtttataatagcaaagacatgtaatcaacctggatgtccatcagtggtgaactggttaagctggagctaaacattgggtaaataccggacacaaagatggcaacaatagaccctgggattactagaggaaggagggtgggaaggttgaaaaactagctgttgggtactctgctcactacctgggtgatgggatcatttgtataccaaacctcggtgacatgcaatttactcatgtaacaaacctgcatatgaaccccaaaccttaaataaaagttaaaaaaaaatgcctctgcagaccaaatatttctcttggtttctgatctactttttaggtactatcccatgtatttcctgccagtatcttaaacttaccaaaaacagaatccattgcctttatccccatatttctgtatttgtattctgtctgttggttagtggagacaccatatatctggtttctcaaatagaaatcttattgataatgccagcttccctcattccttgaggatgtttgctcctggcccacccacactctcagcaaaatgaccttgcttgtcatttcaccaccaagaaatataaacaaccagtaaagaactacaagtcagccacatctacccaactaccagcatctgtgcctatatgactgccttccttcctttgctgtggacacattttttctgttcctgttttgtgcctctttcctccacttgtactctggatcttgtctcctttcacctgcccagtcacaacttcagtggtctctctgtgctgcatcaacagttattttctttactgagtcatttccatcaatatggaaatgctgttatttctcccatccgaaaaaaaaaaaatcctcttaggctaggtgtggtggctcacacctataatcccagcactttgggaggctgaggcaggcagatcgcttgagcccaggagtttgagaccagcctgggcaacatggtgaaactccctctttacaaaaaataccaaaggttagcagggcatggtagcacatgcctgtggtcctacctactgaggaggctgaggtaggaagattgcttgagccggggaggcggagattgcagtgagccgagatccagccactgcctcaaagaaaaaacaaaaacctcttgactactctctttgaggcattgctcctgttttacttgatctgttagcagcatttgacacaattaattcactcccttttgtttgaaataccttcacttagcttctgtgactactcttctgatttttcttctttttctctggtaaattcttgatctcctttgctggtatctcatttccctgacctctatacagaattttaaagatcgggacttctaccctcattctcttagtggtcaaatccactttgattgtcttaaaaaatactgtctgtattggtgttttgcaaactttttttcattattgctctgcctgaaaagccttttgactactttattgcctaatcaccccatcgcagtgaaatttctctgcatctgtttatgggttgtagcccttcggagggccacaaaccatgtaatatctaagatctgcccttccaaagagccagtttttatcaccttggggatatcacctctgctgagaatgcatgatttaaattgacaatccccaagcttttttcttcagctttgaccaacttcagtctattagagagcctacttcatatctccactgggacagatatcttaaacttcatacgtacaaaaccaaactcataatctgactttagcctttcttgccacatggagcttcagtgatctcattcttctttatgtaccttttgttctggcagcactgaatttgaaatatacattttaccctagtggtaaaagggcttagaagagtgatcatttattttcctaaccgaaattggccaggctttgaaagtagaaatttccacgactcagggccactatcatcataatcttcctgtacgtagagtggagcaggagttgggatgacagagtcctggggggaataataacattgcactaactgttgaaaaacattccacaagatccctgtctcgttaggatgtatgcataagagaagatgctatgtacatgtagctgtgaaaagttcacagaatagcactgctgtattggtatggaattcccttttgggtaaataagccagggaacaattagatagcatcgttcagtgtattcaggagaatacctgggaaagacagttcttcagaattttgaactattggcaacatgttgctttaacaacaccactgtaaaagtctttggtattctaaataggaaatcttgtattctttaacacgtaagtaaagatacatttggtatatattctgttatccaaaggaatgtagatacgaagaatagccttttaattaaggctaataggttttgagatttatttagttaacttatttagtaaacttcatgaagtgttatttctagtactgtgtggtttttttttttttttacattgttactatttcagctagaattgtaatcatattacatcgtgattttagaattttggtttttatgttctctttacaagtggttttggacggtgttttaaccttccttttccccagccccaaatatgctgaacaacatcaggaaactacagtgatttaatacttttttttttgaaatggagttttgctctcgttgcccaggctggagtgcagtggtgcgatctcggctcagtgcaaccactgcctccggggttcaagtgattctcctgcctcagcctcccaggtagctgggattacaggcatgtgccaccatgcctgtctaattttgtgtttttagtagagacggggtttctccattttgggtcagggtggtctcaaactcccaacctcaggtgatccgcccgcctcagcctcccaaggtgctgtgattacaggcgtgagccaccgtgcccggcctgatttaatactttttaatggtatcatagctactttatgacatttttcttattactgttacgcaaattctgaatgaaacttttctaaaaagctgcacaacgggcccttctaaataataatgctaccttaattgttagtgtgcagctcaacagatccgaagtttccccatcaccctatagaaactgagcactattttttacatcccttttcaaaacaatagatgaggtaagaatttgaaaattcatagtttgttttcaatatgaataaaatttgtcccgtttttaagttgtattttcgtaatgaaaatcttagctatatcattttcttttttctctccttgttccaaactttcaggtttgtgtttaatgtctaagaaaggaaatactagaactttcaatttagttaaaaaacagtaacatcttaagtgtgataaaccaaacagaaatgtctctatgtttggcaaagtcacattccccagagatttactaaacagcaacagcactgttaccagtgtcagctgagacattatttatgtccttctctaatggcttcttgttccactaaagctattgaagaaggtgtaatgctacatagtcctcatgaaggactcttttcctcactgcttagattagctaacacaacctgaatatcagaatttgagactttgaattctgctgctgatctgctgtgtgacttccaacaaatcaaattgctttctgtcctcagttactggtcagtggcacctaggaataaattgacatttactgttagattataaataataactgctttgaggtagttggcaaaaccaagatataatgtgtgactgttagtgtagttaacattactgtgaatattactgtgtagttaacttccattttctaaataatgcttttttgtagcatccttgtccttttagtctattttaaagcagcatttgacaatctttgttttcccaacttttctccattttgtggttatgataaaattataatatagacattaaagaggggaattattttcatgcgcttgaaggagcatccttttagaattcttttaataagctgaagaaaggaattgtatctgttttaaaagaccaatcttaaaactctttagacaatgaaagcttattaacatgtttttctatgacttaacttggaaagatggcagtaaaatttttgaatttgcattctacagtggcaattggtttactaagtaaatatacaattgattggaaccactattttatgtacctaattattatttaagaaaaatggggccgggcacagtggcttatgcctgtagacccagcactttgggaggccgaggtgagcagatcacttgagcccaggagtttgagaccagcctgggcaacatggcaaaaacctgtctgtacaaaaaatacaaaaaatagccaggtgtggtggcaggcacctctggttccagctacttggaaggctgagatgggaggatcacttgagcccagaaggcagaggtttcagtgaactaagattgcaccattcaactccagcctgggcgagagtgagaaaaagaaagagaaaaaaaagaaagaataatggaaaacctgttatttaatataggttttgatcaatcacctgatatgaagtggcaaaggttttaccatcaatgtgttctgaggtaatttatctggtgtggaatgacttggaagaaagtatttccttcaagcatctgtttaccaaccactttgagtaaacttatgtattttactcatcttctggaaacaacattgttctgccagacacttggtctgaatgtgtgattttgcaattcagagtaatatttctttgttcttctgagaatggatatttatgcatgttttcctcttagtctctgcttgagaggtacaggagataactagattttattagcatatttttaaaagtctattaaaaatgcttttaaattatttggtggtattctgattgaaaatggaaggggttgctagaggttttatcaagaatagacacactatatattttaatttattggcaggtaagctagattttcctattagttttcattacatggctgtatacatatgaatcaccggtgactactttttaaaaatatgtgtacaaatttttaaattatattttttgtagtaatatgttataaagcattgatttgttatatttttaaatttatcatactttaaacaaaacagatttaaacaacttcaatggatttggaaatagccattataaacaatcttataactgaagttttatttttactaataatttaagttgtgttattcttatacatatttaggttttgaaatttttataaaggtctaggctgggcgcagtggctcatgcctgtaatcccagcactttgggaggccaaggcaggtggatcacctgaggttgggagttcgagacaagcctgaccaacatggagaaaccacatctctactaaaaatacagaattagccaggcgtggtggtgcatgcctgtaatcccagctcctcgggagactgaggcaggagaatcgcttgaactggagaggcagaggctgtggtgagctgagatcgtgccattgcactccagcttgggcaacaagagcaagactatgtctaaaaaaaaaaaaaaattatgttttctgggattgcaggcacggtggcatatgcctgtaatcccagctccttgggaggctgaggcaggataattgtttgttgaacttgggaggcagaggttgtggtgagttgagatcgtccactgtactccagcctgggtgacagagcgagactccgtctcaagaaaaaaaacaaaattataaaggtcttaatgtcttaaaagtatgaagagaaatttttatagaaacgtctaaaggggaactgataaaaataatgttcactttgggggaagacttgccatatgtatggtcatataccacaatcctatgattagggtagttagaaatagaaacgaaaaaaaaaaaaaacaacatagagtttgtaatcctaggtatgtcagaaacagctgcaaccttttaaaaaactgcttggatctgaaaagaattgattgttgcttttttgtatttttcctaacgttctactactatattttcttaataaaatacatatttttgttagatttttaatattctgacttttaaatacttgtaatgaaattttattagtattcttggctgacttattttggctcttgtctcctccatttgcaaccaaattatactttatatgctagacaaggtttatgccagcctaattggttgctggcatttcttagcctcacagctgctgtgaactcagctgtgaactagaaaacatataataggatcctgttttcagagaccaaaaggcaattgtcaacatgtaaaacttgtttttgacagctcaatgaatatatgagcttttatgacaaatagcactaataccagatcttaagtaactatcttaaagattagaaagtcttgaaatatgaattccatgtatttatttttcttcactgaagcaaagatggcttaaatttgcatgtatgtgctgttcagtcatttgtggcttttttctttttaaaaatcatgtatcttgatatttaccaacagatattaaaagttgagatgtgaactgttttccctttaatttcgtcctaacaaaaagttgagccttaagtggggtaaaaatgtttctgaaaatgagctaaacatgaaatggctttgattaaagattatatttcaaaatatttattatatttatatttgatttagcagattttatttatataaatttttgacatctaagtttggggtgaacattatttttatgttaagttggaccatatgaaattgtcatttttttaggtcaaatggttgaatgtagactaaatgggaaaaaatggcagtgtatcaacacgaactccctaaccaaattcagaaatgtaactaaccactgtgaattacctttgtataagtaaaatatcatcatgtgtgatcaatacaatgagattaacaaatcagatttatatatagtaaaatcttttcttccagtataattgctttttgcccattcccactgttctcttcaacattttcttaaatgtttagggactctcagcagtaagcaaaacaggctaaacaagtatatgagaggctgtagaaatacattgaggacaagcaaactgtgttagtaaatggctcatactgaatatgataaaagcatcatcctatacctacattttgtatcactttgatacttcgcatgattttttatgtctactgtgattctaacagtctatcgattatatttggaatgtagctccaaacttttcttgcacaatcttttatttaaaatgcgaattgagttttgtcacatacaaatataaatctttccttacataaatatttgccagaacaatcttgcattgtgagaaaagcacattttaggaggttttggtattaaaaaccaagaggtgttctattgggaaaataatgattggggagctattctgcagggtttgcctgtactttccaaaactgtttgtgaggctgaggcggcagtcgctgtggctggaataggatgctgggaggtgttgagggaggaacagtggcttgtactgggagggtgtcaggaaggaacgggaggaagatggcgacatcaggggcagggcaaatgagccttgttcggccacagccttggctttcaatctgtgcaagtttagtgagatcacgctgcagaagcagtgtcaggctgaggacacagtggccctcgaggaaatgataatggacatcagctccacccagttacacacccaaaaactgcaactgccatacacaaggagctcccgttatggtggttctctgccaacaccctaccacactgacagctctccctatagtcctgcctacttatctcctccccaagtgtccagctggtgaaggactatctcctgggacaatttccctgcagagaaggggtacctgttttgcccagcatctgcatttaacaggacaagctctgactctgcccttcacacaagtatgatgaaccccagtccccaggatacttattcaggccccacacctcccagcatcctgcccagccaacatttcaggttggtaaaatggactccaaagtacctgctattgaggagaagttctcctaggtgacaagcatttgctgaagccatgggatacttagaagctgtcgtcaccctcctcctgaccccggtcctaatgaagtccctggaattaatatctttccatttcctggccagcttgccaatgttcctgtcctcccacctgccatgaagactggatgtggcaggaggtccctacctgacctcatcaatttgtactttctgccagcactgcccaccccccggaccctgaggagacagcctactctagcctgaataggggcaacagtacctccaatttgactcacatcatgactcacctgggcattagtgagggcctgagcctggacttgggcccaggtcatgatgccccaggactttgttcacctctcagccacccatccctgcagtcctccctaagcaatcccgatctccagacttccctgagcagtcctcagctccatcttcagggcatccacagtctcccctcactatctccctcttccttggcccaccatgccctgcctactaccttcctgggccagccctcactaagtaccctgccccccacttctcctcctcctccccctcttcctccccctcttcctcttccttctcctactcctcctctcgtcctccactttattcttcatctgcccctaccttactcaacctctactcctggggcctccccaccaccactgccttgtacccctcagccccctaagtttgctcacaggtccagccgatgccagaaggtcgcaacagcagctacccaaacagtttttgccagtgtcacccaccctgtcttccatcgttcagggtgtccccctggagaccagtaatctgcacacccagccacacaccccaaagtctctacagcagccagagctgccctctcaggcctgctcagcgcagccctcaggtgggtagcccctgagcaggcaattggattatggaatactacccgcctcggcccactgggcttgggcaagtcttcactggccgatgagtgacttcagcctggggaactggagcagttcagcatggagagcccataaatcagcctggtgatgggtccccctggcttttctgaagggcctggatttttagaaggtgagggaccagtggctggccctcaggattcccacaccctcaaccaccagaacttgacccaccactgctcctgctgtggctcaaggctgaacatcatcctcataggagactccttcccaggtttctctaaggagattgcagcaaccctggctggagtgcctggctttgaggtgtcagtagcagggttggagttggggctagggctagaagatgagctgcgcatggagctattgggcctggaagggctatacatgctgagagacccagtgccctgctacccgatcctgctctggagtattcatcaccatccctcttcttggccctgtcccccattactgtccatttcctcccttaccccagctagtagagacgccactctgtccctcagatcctctttgtagcatgaacgaaggagcccaaaaatgagaaaaagcaaggagtttgttcaggtggcccttgaattctgtacaggggtgggcctggaggagctcaagggagggtcacaagcacttgtaactttgaaccaactgcctggaggtcagaacctgttggaaagttggggatataaacgggaacctgggaggcagggcttgtccggattcctagagatgggcattgccagctcctcctcaccaccttttcacctctcaatggaggacagtgccacagtgggtattatttttaattaaatattttaataaaaaattgagaaaactccttgcaggtgttttttgtttcactttacccctaacagatgacattttctgtactaatttatgtttacaactagattgaaacaaaatggaagacttttaaatatgtctctggattttaagttttaaaaagccatagagtttttgaaactataagttatcttttatatggtagtattgattttatataacaatgtaaacttagaattttcaaatctgacctcattttctatgaatatgacttaggacttaaagatggattgaggcttctggttcaaaatagtataataaagttcatgtattggcatccttctgtcccaaacacataagaggaaaccaaaaaggcatagctgagctcaaaaacaagatcatggattagtaatggaacaggaattctaagagatggatgaggctgaagcaggcatggatgtcaaaagtttgattcctataggatgatgcgggagaaagagactttaaaggagaatcagagtcaggtccactgtttgaagacaaggacttgtgcggctcctcttaaaaatgctggtttttaaatgccgctgatttgctcctggagctagatttataagaaattttccatcaaggaaggcagcccagtacagttatggtagaaatacaggggtattcagccactgtgcactgggaaaagtcataccaattattgtgactctgtctgttctgattggtcagttatctcacctttagaaatcattaacaggatacctagaaaacccccatgtctggaatttgagaaacatttctaaataactcatgagacaaagcatcatgaaaattagaaaaataggtggaactgaacaataacaaaaaaactacatgtaaaaacttgtaagatgctgctaaaacagttctgggaaagaaatgtgtagctttagcggcttataaagaaaatagaataaggatggtgaatgacttaagcattcatcttaagaatttaaggggaaaaaacagtaaaatatgcccaaagtaagttgaaagaaagaagtaataatagcagaaattaagtacataataacacctaataaaaaagactcaacgaagtcaggtttattcttggaaaagacaaatgaacaaatcccaggtgagattaagagaaaaaagtttaccaaaatactaggaatgaaaatgtggacatcatatcagatgccagaggcattaaacagatatgaacttgatgccaaaaatgtggaaactttatctaaaactcctagaaaaatataattatgaaaacaataaaaactaatactataattattaaggaaattggatcttcttataataacgcaaagcaagatggtttaacaagtgcctaccaaatactcaagagttgaataatctaatttcacaccaactattctagagtacggaaagggaaaactctgccatagaaaatcattttatgagattagtataaccagccgggcacggtggctcatggctgcaatcccagcacattgggaggccaaggtgggcggatcacctgaggtcaggagttccagaccagcctggccagcgtggtgaaaccccctctctactaaaaatacaaaaattagcaaggtgtggtggcgcgtgcatgtaatcccagctattcaggaggctgaggcaggagaatcacttgaacctgggaggcagaggttgcagtgagccgagatcacaccatcgcactccagcctgggcaacagaacaagactgtctcaaaaaaaaaaataaagattagtataaccatgataccaaaatctaataagattgttatgagaggctgggagcagtggctcacacctgtaatcccagcactttgggaggctgatgcaggggaattgcttgagaccagaagttaaagaccagcgtggtcaacatagcgaaaccctgtctctacaaaaaatttgccaggcatagtagtgcatgcctgtaatccttgctactcggcaggctgaagcaggaggatcacatgaggctgtagtgagccatgatcacaccaccgtacttcagcctgggcacagagagagacccccgaactcttaaaaaaaaaaaaaaagtagctttgagaaaggaaaattgctggccagtatcagtcttaattaatgatataaaaatccagaacaaaacagacaatgcaattccagtcagaatcccaataggtagtgttttgtgattattggtttatatgatttttggaacttcacaagctgattctaaagtttatacagacatgcaaaaggccaagaagatcaaagagactcttaaagaacaataagacaggagggcttattctatatggcaagacttaataataagcaaagctataatactaaatgtaattttagttcagggataaataaactcatgcatgtatgcttgaactatgacacaggtagtattgctgataagtagaggggaaagggaattttcaggaaatggtcctggaaaggaaattgtgttatcatataaaaataacaaaatgccaacggattaaggtcccaaatatgaaaggttttgtaaaattttatttattcgagtcggagtcttgctgtgtcacccagactcgagtgcagaggcacaatcttggctcacttcaacctctgcctcccgggctcaagcaattctcctgtctcagcctcccaagtatctgggattacagacacccaccaccacacctggataattttttgtatttttagtagagttagagttccaccatgttggccagggtggtctcaaactcctaatctcaagtgatctgcccacctcagcctcccacagtgctgggattacaggcctgagccaccacatctggcttataaaactttaaaagaaaatgtaagagactgttttagggatctcaatcttaggaaaaatttcatagcataccaaaaaacaacaaaaaaaatccataatggaaaaacatacatttgactacattagaattaagaatttaaatgcatcaaaagcaccataaagaacatgaaaagataagccacaactttgtagaaaatatttgctatacatacaacaaaagattaatatcaagaatatatatagaattcctatagagaaatagcccaaacaaagaggccccaacactcaagtcagtactcaaaaggcctgaatggctaacaagcacaaaaacaggcaaaacctcattaaatcagagaaattagaaccataatatgatacattaaatctgactaatattgttttcatgaatgtggagtaattgctagggggattacaaatcattatagatactgtgtgttaggcccatctttcattgctataaatacttgagactgggtaatttataaagaaaagaggtttaattggcttgcaggtctgcaggctttgcaggaagcatgatgctggcatctgctcagcttctgggaaggtctcatgaaggctaagggggagcaggagcaagagagagggagatgccacacacttttaaacagccagagaacagaactcactgtcatgaggacagcactcatcaccaaggggatggtgcactcatcaccaaggggatggtgctaaaccattcatgagaaatccaccccagtgatctagtcacctccaccatccaatcaccttcactgggccccacctccaatatagggattacaattccacgtgagatttaggcagggatgaatatacaaactatcacacagccactatcgataggaagcatcatggcaccgaagagaaaagttttatatatgtggactcaattattctgtatttccttttttttttttttttttttttttttttttgagacggagtctcgctctgttgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccacccgcctcggcctcccaaagtgctgggattacaggcgtgagccaccgcgcccggcctgtatttcttctcttattatgtatcttagagaaattattgcacatttgtaccagtacacatatgtaagaatgtccatagcatcattgttcctaatagcagaaacataaaaacaactcaaatgtctgatagtagaatagataaaatgtatatttgtgcaatgaaatactatattgtagtgaaaatgagttatatacattttatatatacaacataaatgaattgcaaaaaatagtattgagcaaaaaaaaaaaacacacaggtcttaaaatagtgttaatccatgcatatgcaatttaaagagaagtaaactgtttagatttctgtgtgtgtgtgttacatttaaaggtgataaaactataaagaaaagccaaaatatgattatctcaaatatctgggtagttacttttagtacttttttttttttttttttgagacagaattttgctcttattgtccaggctggagtgcaatggcgcgatcttggctcactgcaacctctgcctcccgggttcaagcaattctgcatcagcctcctgagtagctgggattacaggcacgcaccaccatgcccagctaattttttgtgtttttagtagagagggggtttcaccatgttggccaggctggtctcaaactcctgatctctggtgatccacccacctcagcctcccaaagtgctgggattgcaggcgtgagccactgcacctggcagttgttatctttgggaggggaatgtatggggtttcaaaagtgttttttaacctagctggtggtagttacacaggcatttgctctattattatttttctttaatgtggaagtatatgtgatataattcacagtaaagtaaatggtgaatcagagagagtcaaagggcaatgagttagtgaagatggaatacaggagttttctcaggtggatcagagaaatgggatggtattggaaggccacatggaaagattgttgcattttctagggaaagatatttctagtcctgattagtcttattaacgtctatgcatgatccctattaacaactgagacttgagcatctcattgttctccccctagtggcatcattctcccagtcatccaggcttgaaaccttcttgttatgcctgtatgttgtcaccatatcatgattttttcctttgaaaaatttttcatgtatcttattattgtttctcttattacttaacacctttgttaacaggtgtttactacttaactttctaaataaatcattggatgtctttgttaaagaaaaaaattaaaatttaaaaagaaaaattataaatttgtattataatttaaaaagaggtatttgagtagctcaatgaaaagccatatatacgacaattaaaaaatatttaaagtcatattgggtaaagttggtttttaaaaagaaaataacattttttagagacatcttttggtgcaaataaaagccccatgctgcattggtattgtaggtagtgtagatggttctagttatctgattaattggcaaaaagcaaatgcttaagactttgtctattcatttcttattgctggaatttcgtattcacttcttgttggatgagtaaactggattatggtagagataaggcaacataattctcagtcctgccctgctcaacctctagagtttagtcttagatcagatgcttttgactctgcaaacttgtgatttaaggctttctggatgtgtacactggtggttgaggtcatagaggttccaatattgaggagactgctgatactggatgttgtctccttgatttttttttttttggagacaggatctcactcttgcccaagctggagtgccgtggcacaatcacagctcactgcagccttgacctcctaggctcaagcaatcctcctacctcagcctcccaagttgctgggcctgtaggtggacaccaccatgccctgttgatttttaaattttttttatagagttgaggtctcggtatgttgccaacctagtctcaaactcctgggctcaagccatcctcctgcttctgcctcccaaagtgctgggatcacaggtgtgagccactgtgcccagcctccttgatttgctttatcctctcattgccaatctctctagcctgtctttggagattaaagtttctgtgaatttgcgacctgtagtcctggtacgaattttgctccaccggcccacctttttttcgcacacctagttatggtacattaagtcactccttgcctagaagggtgggaataccatggtagatgcccaacaataagaatggttgtgttggtcttgccttttggaatatccacatatttttccccattctcattactgtggtaattctactggtaattgcatggagatccaccttggtaactcatttcttttttcttttttttccaactagatttgatagctaggtgtctcatttctttaacctcaaccacggcctcttcatttcctgctgagggttattcttcacagtagtctgattaaaatgcatcttccttaggctgaaatatttccttcctttctgctgataaaaccatatcagtgttttattaaactcttttactttctccaaaacctttgttgctataatcttcttgtccccactagtgggtattagtatattgtggggctgccacgggcagttggggaaaggatggctgccaggtcttagcctcactactcatgttgtagagatggtgattgatgcggggcttgatgcagcagcggtaggctcctcccagattgtgatggtgactgggctgcttatggctctctggggtccactcttcattcccactaccagttaaactcatcctctttctcatatgctgtggcagccatgcaggtgcactgcttagatgtctctctaagaaagaatttcagtttcagggagtgcagttagctgacaacctccagttgttagtaccttcagggcctttaggtttggggttgagaacttgaatttcctgggaaatccacagccagtgatagagcatggcatgggtaataggacatatccattttggctcagtgcaggactcctctaatgggcagtcttgctctgaagcaccctactgggttgaccaagactttgttagatctgcatcaaggtctgaggctttctctgctcagtcctgcttcacagccacttccttcataggtttcaaatctgcatcatggtctgaaagttttcattattttttattttaatcttaatttttttttttttttgaagtggagtctcgctcttgcccaggctggagtgcagtggagcgatcttggttcactgcaacctccacctcctgggtttaagtgattctcctgcatcagcctcctgagtagctgggattacaggcgcccaccaccacacccagataattttgtatttttagtagagactgtgtttcaccatgttggccaggctggtcttgaacccctgacctcaagtgatctgcccgcctcagcctcccaaagtgctgggattacaggcgtgagccaccgcacccagcctggtctgaaagttttctgtgctcagtcctctttcctcccccttttatctttagcagtaaacctcttgtactcccaactctctcatctgcttctcagaggactccaaatgacacatatcacttccactggttatttacctaatttgtctctgaaattgaagtaaggattatttaatttcccttttttaactcccttttgactcctcccagtatttttttaggtcatcaatttcacccacccccagcacctgcatctcctctaatgcccatctgtattagtaaaaggcaccactatttactcagttgcttttacatctttcacatttaagtttgtgacccatcttttggggaagtggggggaatggaggtggtattgtgtgagataggaatcagacaattaaaaaggagtgactttagtaaggcatgaatgaggtcacaggtaatgcgggtcagatcatgtagggctttgttgtaagtcattaataggtcattgaaaggactttagcttctactctgtgtgagatgggggagtcattggaaggttttgagcaaaggagtaatatctgactcactttttaccaggaacattttggctgctctggagaacagacagagggcagataagttggaagcaggaagactagttgggagagtatcacagtaatctaagtacaaggcattggtagcttgcaccaagatgatagcagtgaagttgttaagaattggctcattatctgggggcaagactcaagcaatgtcattttattttgtgaaagctccctaggagtttctggtacacatgagggttgagaatttgtgttaccgtttatacatttttataggaatgcctggacttaagacatatagacatcttcatcagcttaattgaagtgagtagagaagcatagtgattaatagcaagtacttttacatctgaccaaggtttagacccatgctgcttattcactgtgtaactttgagctttatttttctcatctataaatgcagttaccggctgggcgcagtggctcacgcctgtaatcccagcactttgggaggctgaggcgggcagatcatgaagtcaagagatggagaccatcctggccaacatggtgaaaccctgtctctactaaaaatacaaaaaattagctgggcgtggtggtgcgcacctgtagtctagctactcaggaggctgaggcaggaaaatcgcttgaacctgggaggtggaggttgcagtgagccgagcgagatcgcaccactgcagtccaacctggtgacagagcgcgactccatctcaaaaaaaaaaaaaaatgcagatacctactttgtaggtatatttgttatgattaaatgaaccaatgtgaattaaatgagctagtatctgacatattcatacttaaaaagtagtagcttaaagaaatctgacacatgagatgataaaagtgttaggattgataatgctcagtgttgttgagggtgtggaggaataggtcccactgttggtgagaatgtatacaaagggcggttcaggaatatctatcaaaatttcaattttcttgacccactaattctccttctagaaattttatttgtggaagcattcacacctatgttcagatattcagtgcagcatcttttaatggcaaacagttggaaataatactcctaataaaggaataaattgtgatatattcatttatggaatgctttgtggttatgaaaaataataggtaggtctatacatattgtcatggaaagatcactagtatgtattttagttttttctttaaaaagcaacaccagtatatcatttgagagtacttaacatcctcactatttgaaatctataagattatgttcatttattacttatatggatttttatatgagctcatataaaaggtaggccacaaggccgggcgtggtggctcacgcctgtagtcccagcacttatggaggccaaggtgggcagatcgcctgaggccaggagtttgagatcagcctggccaacatggagaaaccctgtcctctactaaaaatacaaaatttagccagggccaggcgtggtggctcatgcctgtaatcccagcactttgggaggccgaggagggcagaccacttgaggtcaggagttcgagactagcctggccaacatggtgaaaccccgtctctactaaaaatacaaaaattagcccattgtggtggcacgtgcctgtaatcccagctacttgggaggctgaggcaggagaattgcttgaaccccagacacggaggttgtggtgagctgagattgctccactgcactccagcatgggtgacagagcaagactctgtctcaaaaaaaaaaagagctgggcatggtggtgcatgcctgtaatcccagctgctacttgggaggctgaggcatgagaatcgcttgagactctgtctcaaaaaaaaaaaaagaaaagaaaaaatagaaggtaggtcgggcacagtggctcacacctgtaatcccagcatttcagcaggccaaggcaggtggattccctgagcccaggagtttgagaccagccttggcaacatagtgagactctgtctctgttgaaaataaaataaaaggcagtgatagtaatttcataaacaataatacttattaaattattatagtgcccatgttttaacagtattgaatgcctcattataataacattgttttctgtactatatatctgtttttagacatttaaggagctataaattatcttaagataaattatagatgcccccaaggatttctattaggaaatattgaagatgcagtatattgcatagtttctgtctctacttgagtaacaaccagatggatcggtaagatgaaaacagatgaaataaattttttaaaaagtattttatatatgtatatattctgttggtgtgcttctaggaatttgtcctaggcaaataatccaacaagtacataatgacaaatatacaatagtattcattgcagtgtttataataataataataaatggcacataacctaagtgaccatcaataggtattaaataatttatgataaacataatgaaatattatgtaataattaaaaataattatttagctctgtagttattatcagataaaacctacagtctactaagaagggaaaataagtttactacattatatataatatcttctctctacagattgtaagactggagtagttagggaaagtaaggaatagaatagatttggatagacaacatatagaagaggacattttaaatgagcatttcccaacctttttggaatcacatttcttaattttaaaattttatcaatttgcatcgtatatggtaaaaagtggtttttaagtaaaaagtattttatatcagtataatatttaaaactgctttctgaaccaggcacagtagctcatgccggtaatcccatcactttgggagcccgaggtgggtggatcactcgaggccaggatttcgataccagcctgcgcgatatggtgaaaccccgtccctactaaaaatactaaaattagctgggtgtggtgatgcatggctgtaatctcagctacttaggaggctgaggcacaagaatcacttgaacccaggaggcagaggttgcagtgagccaagatcgcatcactgctctatagcttaggtaacagagcgagactgtctcaggaaaaaaaattttgctttatacatttttgttctttgttctacagaatcatttttggctcatagtaaggacactttctaatgattagaactgtttaacagtttaagatttcaggcattgtatgtcactgtgtgaccatttatcatatatgctgaaaataaactttaggtcttacctgatttactgatttactggacttgacaagtagcaaattgatttatggccccgtggacaaagttcattccctgttcctgagggtctgtggaaatctcttgtaaggaaaagtagtgtcattttttttttaatttccaagttataaaattgtatttcacagtgtttaggaatgccataatttgtggcatttttaaggtgtatactttattcccacataggccgaatacatcaagcaatggtaacatctttaaatgaagataatgaaagtgtaactgttgaatggatagaaaatggagatacaaaaggcaaagaggtaagatcactgagtttaattttattcctagtcctgcaatcaagattctgaatataaaacaaaacagaaaagtacataatgttattttatttagtgcatatatttttattattccttgaaaactttcaaatgattaaaaattttcacttaaaggtagattcctcctgtatctcttatgtgattgcacatatcagtcttaattatttgataaaatatactattctttaagtctagctcacacagtttgaaaatgtgctataatatttaattatgtggttctattggtcactgtgttgttagcaattcatagagtcaagactataaaatgatattttaagagagattctttaaatttgtggattataattctaaatctcatttgtaaggctaaggcactgtattcttttttttttgtttttgagacagggtctcactttgtcacccaggctggagtgcagtgtcatgatcatggcttactgcagccttgacctcctgggctcaagtgaccctcccacctgtctccagagtagctgggactacaggtgtgcaccaccacacctggctaatttttgtattttttgtagagatggggtttcaccatgttgcccaggctggtctcagactcctgggctcaaatgatccgcccaccttgacctcccaaagtgctaagattacaggcatgagccactgcacccagccgagttactgtattcattaagctaaagtaatttaagagttatttacttcatcaatttacttgaaaaataaaaggttaattgtcaaaatatactctcaaaagactatgtgtatgtgttgtgaacagattgacctggagagcatcttttcacttaaccctgaccttgttcctgatgaagaaattgaacccagtccagaaacacctccacctccagcatcctcagccaaagtaaacaaaattgtaaaggttagtgatgaaaattcagagtgcaggacactgggagagagcgggagttgtagatgtgtgtgtgttctagtttgaaattggtaggctttgaagagtttaagaattgattaatttgctttttctgccatcatattcatatatatacatacatattttcaaggattgaggttgtctaattcacaattatgaccatcgttggataaggtcttagaaatttctcacctaattagtatttttcctgagactaagtttctcaggagatatagatcaaaaccatttgcttggtgtttgttgaatgaagacatatgactttgacaaaggcataatagctgtttcttaggaataataactaccaactctgatagtcttttgaaagtataattctgctatttgtttcttaaagaaagatgggaaatgatagtgtagttcacttctatattgactgtcatgatataccttaaaactgtgctaaatcctccctagcagttttatctttataaaaattaaaagcacattattcttctggcttttaaagataattctccttcctttctctcaagacctttcagtattaaatttttgtttcaaaatacaactctttttaaaacaggtagtattgcaaagttgttgaatctgcggttctttgtgttcatctcaacaagcatttgtggttttgttgttgttgttttgcttttttacattgtgccaaatactatgctggacaaaatacaaagatgaatgatgacatggctttcagcctgtaggaacttgatatctttcagggaggacatagataagcatttaaatatagtataatagaagcaacaaaactttgtttcataaactatgcagttgaacctgaggcatattttcaactcatgagtttaatcatattgagagtcaccacttagaggttattagttaccacttatacatggattattttttatattcatcttcaaaatgagggatcttcattggaggatttttgtagtttattcttcctggtatatcattagcaacctttactgtacattagaattacctggaatagattaaatcagtatattttaaaaataaatatttattttaaaaataaggatttattttaattataaataagtatttttaaaagtattaaaaatatttttaaagtattaaaataaatcagtatttttaaaaatactgatttatgggccccactcccagagattcagttttattttacctaaagggagaccctggcatcagtttccttttaatagtactcatctgatttgaatgtgcatccaaggttaagacagctacattatttgatatctttttttgaggtgaataaaaggaagtcttcatgaatgaattagaggaccaaaagtttgctgccttaatctgtacagtgtccaagtcttagaaactcttatgaaacctttttaggataactgacaatgtacattttatagtattctgatatttcagtttaacaaggggttctaagctgtctagaactaatattttataaattaccccctattattcagaaatgatgattaaaacacatattattgtgaagctacttaacctctctttgtttcagtttcctcatcgatgagatgggaatagcagtagtaatgacctcataggttgttgtgaagaaagtccttagatcagtgcctggctcatattaattcctgaatatttttggagggtaggggaaaatatataaaggaacttgaatattgatagcattaatagtaattcattaagattatagtttttcttcattttgttttatattcttacatgtctgcctacttttgtttaattgaaagaagctcagatcatgatacatatgagggagtaaagatagaaaacataatgaacattttttcctttcatagaatcgacggactgtagcttctattaagaatgaccctccttcaagagataatagaggtaaagtaaaaatttatctcttaattttggctattgacttcttagtatgttcctgacaaggtaaatcaaaagtaaacattacccttgatgttggtatttatttaaattttacctggctaattttaagaggtgcttttttgttttgttttgttttttgttttttggttttttttttgagacagggtcttgctctatcacccagtctagagtacattggcatgaacacagctcactacagccttgacctcccagggtcagatgatcctcctgcctcagcctcacatgtagctgggaccacaggcatgagccaccatgcccagctaattttttgattttttagtagagagtctttccatgttgcctgggctggtcttgaactcctgggctcaagtgatcctcctggcttggcctcccaaagtgttgggattacaggcatgagccactgtgcccagcctagtgtcttcttgatctcctaatacaatatgccagtaatactgaaaaatgattttgtccaggtgcggtgactcaggcctgtaatctccacactttgggaggctgaggcgggtggatcacctgaggtcagtagttcaagacccccctggtcaacatggtgaaaccccgtctctactaaaaatacaaaaaattagccaggcatggtggcagtgcctgtaatcccagctacttgggaggctgaggcaggagaattgcttgaacctgggaggcagaggttgcagtaagccaagatcgcacgactgcactccagtctgggcgacagagcgagactccatctccaaaaaaaaaaaaagatttttaaaatgtatgggatgatggctgggaacggtggctcacccctgaaatcccagcactttgagaggccgaggcgggcagataacctgaggtcagaagctcaagaccagcctggccaacatgatgaaactccatctctactaaaaatacaaaaactagccaagtgcagtgacacatacctgtagtctcagctactcgggaggctgaggcaggaggatcgcttgaacccaggaggtggaggttcagtgagccgagattgtgccactgcattccagcctgggcaatagagtgagaccctgtctcaataaataaataaataaataatataataaaataaaatggatgagatgaatatgaaattatgaaatgcaatttttaattcatcttatttactaaataattttgcaaattcgagaagaatattatgagaaagaaaggaatggggaaagagtcaattagttggctgatttcactagctaaagaagttgaacagacataaaaattgtgtagttaactgaagtctcccatatattttcagccaggacatgaaaagcataatgaatttattttctattgttaagtagttcagaattgtcttttctggcagtattatttctctgtgtgtggatggtagaacaggatggacagaagtattaaatgagagattggaagtggagggacagtccttcagtttaaacactatcttttgagtcttatgtaaatttatatttcttttaaaatttgatatttatatttaattttatattcttttttccacttgtataatatccacattgggaaattctctgctgaagatttgcatatttgaggagcaaagagtgggatttggaatatagggagggttgaagctaagtttttactctctgtatatatttgattagtgtacatttttaaaaatgagaaggcatgtaaaatttatattttgccgggtgtggtggctcacgcctttaatcccagcacactgggaggccgaggtgggtggatcacctgaggtgaagagtttgaggccagcctgaccaatatggtgaaacctcgtctctactaaaattacaaaaatgagccaggtgtagtggcgtgcgcctgtagtctcagctactcgggaggctgaggcaggagatcacttgaacctgggaggcggaggtcacagtgagccgagattgcaccactgcactccaacctgggcaacagagcgagacttcatctcaaaaaaaaaaaaaaaaattatattttacacacatattttaggaggatttctttgcagtttaaagttttaagacgtggagcggtttatatatacatatatattttgttttcacatatatattttaaaggattattaaaaaacaagcttggctttggcttttatgtaaattatttagattgaattttgtagctaaaattacattggtgaaagctaagtctgcacgtattactttgaaagcctcttttagcttatgtcagtttattgaacagaattattataaactatattatattttacatacataaatagaaaacctggcaacttactaatgtaacttttaagtatcaggttttgggggctatctcttccttttactaaggttagcttttactaattttctatcctgaatttaaaattttttttttttacttacagtggttggttcagcacgtgcacggcccagtcaatttcctgaacagtcttcctctgcacaacagaatggtagtgtttcagatatatctccagttcaagctgcaaaaaaggaatttggacccccttgtatgtaaattatgtatcaaggatttagtcattttaggcatacatgtattctctcttggtcatccttttaagtcctcaaagagtaaacactctaaatacaagcttgattgcagatttcattttaccactgtggaaaatttaacttcttcttattagtctgttaattgggttttttaaagtatattttggagcaaaaatttttttgtgaaattatagcaatgtttcagtttgagtttaaaattctgggcagatgataatttgtcagatgttacagaagaatgtgttgggctccttgattctttgaattaaaaagtctgtgtttctaaaccaagagatgacatgtatcaatatgtttgagtcatttttctggactctcatctgtacattgtcctattttagttttggtaaagcagctcattaagtaaagctcacgtagttgttataggcatgctttgtcactgtgtaccttttatgtgtgtgtggtgaagttatacataaaaaaagtttaatattagtactctaaaaaagaaaactatacttctacagctcatcttttcttttcagcacgtagaaaatctaattgtgtgaaagaagtagaaaaactgcaagaaaaacgagagaaaaggagattgcaacagcaagaacttagagaaaaaagagcccaggttcgtaacataaacatatattttgtttatgtaccaaccagagattagattatatcagtgaaggtgattgatgtgaacaaaataattaaggcattttttttgaagaattttaagaattccttaaattgatattgaggaataatataaactcttgtgcaaataagttaccgtaacacatttttactgcattgttcttttcatgttttattggtatgtgttaacgctaaaatttgttccattaagaaaaagccattgtgttacagaattctaatgtgtatggtgtaacatttaagaatttttattttaaaaagacctaaaaatacattgggaaaaatacccagttaaagtgcatgattaaactataaattttattattgtttttctatggttagtaagttcacatgtcttagtgaaaggggggaaattccttggattttcatttatgccacatatgaagagtggatctctattgtgtccccctcagggtcccttcagatggtagcaagactgtttaatagcagtgggaaaattgcatagaaaactggtcttttactcttctacaggtctttacatattagacattttgttattatacataactgcaccattgtgcttgtatggcatctattacattttcagaactacttttctctaataaaacatcaagattatttatttaatagtatgttcaaatgcccttaatcatgttaaactaccagttcagatgttgtgttgtggaattgtggacctagtattatatccaacctgaatgaatcagcttttatctgaaagtgacctgagaatgaccagttgggttttgaaatgaataataaaacatattatctactaatacttagcatagatgccacctggtgtttcctgtgggtacttcataatacttacacatctctctgtgatctcttaattctcacttcacagtctgcttctcagttgacataggtggtattatttcctagaagaaggttaattgaaagtaagtttcagtaacagtttgtaatttagttgcattcaaaacaaatctgaatatgatgtataaaaaaatgtgacttcttagaatgattaataatttattgttcaaggctaggaaagactgttgactattgctatttgtatcttaatctgaatttctgttttgaagccaaataaattgtagttggcattcaaaaatttgaattttaaagtttttttaaaatgatcttggcttctgattcctttaagttctatgttctgttgatttggggcagttttgtcattacttagtattttttagaaggtcagcaaaaatagaaaatgaagacaaatgaatctgtatttatactttgctgaaacactggattaaattagaagatgaatctgattaaatgaattttcctagaatttcagcttttctagagttatttgccagtggtaacatgagcattatttctctgttgctgcattttataggataattaaggtatatgtataacagatggatttttgaaataggtgaagggtaacttcaatgaagagtccttaatttggagttaacagaatgcataccgactaagagaattgtgtttgtaaaacacaattttacaaacacaaagtggttcagagcttattatgaaaccacaactgtgaaactatataatatcgtcagtttaagtttaggcttggttatgacaaatggcacaatttaattttaattttcaaaccaaatataaatgtaacaaatacattattatatttataatggtgaattctctctgtcttctaataggacgttgatgctacaaacccaaattatgaaattatgtgtatgatcagagactttagaggaagtttggattatagaccattaacaacagcagatcctgtaagattctttgtaaaccattattctggaactttttatgcttcaaataaaaacgtgtttgacacttgctaaattcatattgtgttcagctatgtagtttttcctttccttgtgggtgctcattccccatattttaagaagaaaatcaagaaattatccacattaacgcttattttccataatttggtatatgagatatgctccctatagagatgtccttctcgaagcaaaacctccctgtctttgggagggcaaagcaacacttaaaggagtgatagcagaagactcactttcctttctgactgtgagttatactttgatctcagttccaagcttatctttgtcttgggctgtagatcccaccatcatttctaatttactattggtaatttgttagttttaaatgttattctggcttttaacaataagtgatggttgttgagggctgcagtggaccagaaatctagaactggaaaaaatcctctgctgttattactcaactcctttgctgttgatgaatgagaattcattggacagggagtgcctttttttttttttttttgagatggagtcttgctccatcgcccaggctagagtgcaatggtgtgatctccgcctcccagttcaagcgattctcctgtctcagcttcccaagtagctgggactacaggcgcctgccaccacgcccggctaatttttgtatttttagtagaaacggggttcacctttttggtcaggctggtctcgaactcctgacctcaggtgatccacccgcctcggtctcccaaagtgggaggcctgtaatcatgcctgggattataggcgtgagccaccacgcccagccgggaatgcttttataactaatttgtacttataaaaataatacatctgacatagcatatacagaatgtgttagttacaaaaaagacatttgtgttagatagatgtattatatagaattgaatagaattgttgataatacttgtatcccacatattttaggccttgctattccttcatgtgtttcacttactgcattagagctcaccctttaggacaggaattggcaaacattttctgcaagggtctttggctttggagctatatggtctttgtcacaactactgaactctgtcattgtattgtaaaagcagccatagacaatacataaatgatgggtatgacatttgtttcaatcaatgtgtgtcagtaaaattttgcagaagcaggtagtagctaaattagacccacaggccatactgtgctaatccttgctttatgttaattattattaaaatgaggcatgtattgggaacaaaatttttataaaaaatacttatgcataagaattggcatatttataaaatagttcaaattatttggctcagtaatcgtctgagaatcctgtttcttgccatagttatctttgctagcaactttccctatgatcaacctatgaaaatatgtcacttagtagaatagaaatgttgacttttgttgtgtatagcacatcttgaagtggataatacagctttttttttttttttttggagacacagtcttctctgttgcccaggctgaggtggagtggcaggatctcggctcactacaacctccacctccagggttcaggcaattctcgtgcctcagccacctgagtagctggaattacaggcatgcaccaccatgcccagctagtttttatatttttagtagtgatggagttttaccatgttggccaggctggtcttgaactcctgacctcaagtgatccacccaccttagcctcccaaagtgctgggattacccaccatgcctggcatcacaacttctttttttttttggtccagagataaagtctcactgtcacccaggctggtgggcagaggcataatctcggcccactgcaacctccacctcccaggttcaagtgattctcccacatcagcctcccgagtagctgggactacaggcatgcaccaccactcccggctaatttttatatttttagtagaaatggggtttctccatgttggccaggctagtctcaaactcctgacctcaggtgatctgcccaccttagcctcccaaagtgctgggattataggaatgagccatcatgcccggcctcctcacagcttcttaatgtgaacttaatgctactaacaatagtagtaccctctacagaattatttcctaaagtgatggttttccaaataacaaaataagcaagtttccattacactcagaattttagaagtaattatatctgacaaccattaaaatttgtgcaaagctaatttgttttttaagcttacctatcatttatgctatgtataaatttctaaaacccctggaggaaatattacataatttacgttttagtgttttacatgacactaataatcactgaaataaaatactttttatttctagattgatgaacataggatatgtgtgtgtgtaagaaaacgaccactcaataaaaaaggtatggcacttaatgagctctaataaaagattgattttatcttatttgtaatgtatttttataatagcaaatcaaattggtttggaaaaaatgtaaatcatttcctttgatttgtatgtaaccattatgcagatttctatggctaaacttgtcagtttgttattgctctgaatcattgccattccgagtcttgcttcacagaaatcttgattttgtttttactttgctgttgaaatattttgtcttagtgagttgcatttttatgggatattatctttatatgtacagaacttactacttgtatcttagttcttactacttaaaataattttgtacatgaactcaaatgctgtgaaaattattgggcattgattttcatttattcttttagaaactcaaatgaaagatcttgatgtaatcacaattcctagtaaagatgttgtgatggtacatgaaccaaaacaaaaagtagatttaacaaggtacctagaaaaccaaacatttcgttttgattatgcctttgatgactcagctcctaatgaaatggtttacaggtaggtaaattcattttaaatcagaattttgttcttatgccatgtggtcatcagcaccttgaaatttacattgattgtgggatatttcttaagaggtgcaatatgctgttttattctgagtttaaacaaagagaatgtaataaatgctgtaatgaatattaacacttgttctctgtaatgctccccaaaatcatagtttccattactatttgctaattagcttattacacatatatatacatatatatacatatcacacaaaccatgtatatggataagaaatttcgggaaaatgttaacattacctctaggaataggatatgataagaagacttttaatttttaccttttaatctctgtactaataaagaaacttgaaatgtttgtttgaggcatggtcttgctctgttgcccaggctggagtgcagtggcacgatcacagctcactgcagcctcgaccttccaggctcaggtgatcctcccatctcagcctcctgagtagctgggaccacaggcatgcaccaccacacccagctaatttttgtactttttgtagagttgaggtttcgccatgttgcccaggctaacctcagactcctgagctcaagtgatctgcccgccttggcttcccaaagtgctgggattacaggcatgagccactgttatgcctggccaaaatacctgttatcagttaattattaatttatctaaatctgtatttagtatgtattgtcacttaaggcgaaaaagttccgtacttgtatttaaatttgtcatctttaagcttggagatagttttagtacatgagattcttgtatgttttctgtattcaacttaaaaataattcaaatttatctgtgttatacattggtatctcaaatttttatgccagatttagattttcatacgtaagtttgcaaacattcatttctaataattataacaccagttttagcagtattgttattttggtttatctaggaatattactgtctttgtaattgcttgaatactatatctgattgccctttttcataaaaatgcctagaaaggaaaaaattagagttaatgagactaagaattgaaggtgttacaaaggaaatacttttgagaccaactctttttgtcttcaccaagtgtactgggtagtcagttgtaaaaaaaaaaaggatcaaattaaaggacatatgaatactagatagagatatttgtgaagaatatgtttaaaggggaatcataattgttaattgtagaatttttttttagctttctgaagagtccacttttccttttcattccctctttctactcctgcctcataaaatataagtttgacttttataatagtttttaagaaattattacaaatacaggcatgtttctgtgtgtatgatttagtaaacattgtgtttttaccctatgtttatgtttcttaactttatcaatatttatccttctcctctatctcttatacttaactattatggattgaggagttacatgtttttttgtgggtagggttgggaggtaggggtttgatctacttagcaggctcatccctagttctgtttgaccagaactttttcctgctccttttgttctgtactttcttcagttttgccttttacaaaacaaaacaaagacagcagttatataaaatgttctacttgtagatctgttttccatctttttttttttttgtttttttgaggctgagttttgctcttgtcgcccaggctggaatgcagtggcatgatctcggctcactgcaacctccgcctcccagttcaagcgattctcctgcctcagcctcctgagtagctgggattacaggcgtgtgccaccacgttcagctaattttgtatttttagtagagacggggtttcaccatgttggtcaggccggtctcgaactcctgacctcaagtgatccacccacctcagcctcccaaagtgttgggattacaggcatgagccaccacgcctggcctccatcatactttttagtgtactgctcaggggaaaagtacttcttataccttcccacctttttattttaactctagcagtgggttataccaatacatttgaaatataattcaaggccgggtgcggtggctcatgcctgtaatcccagcactttgggaggccaaggcgggcagatcgcctgtggtcaggagtttgagaccagcctgaccaacgtggtgaaaccacgtctctactaaaaatacagaaattagctgggtgtggtggcaggtgcctgtaatcccagctactcgggaggctgaggcaggagaatcacttgaacccgggaggcggaggttgcagtgagctgagatcgcgccatttgcactccagcctgggggacgagaacgagacttcgtctcaaaaaaaaaaaaatgtaattcaaaccataatatttaggtatccttttcctaaattgagagtgtcaacttactaatagaattcattttcctacaagcacaatttatattctttttgcttaagtataaattacttgtctaaattcaaggtaatcaacatttttctatttatttagatggtctatagataatatttttgcagtttttttcctctattaactttttaaaattgagattaccactcttgtttattctgtttctgttgaaattataatactttgtgtttgtttttattgtatatgccttattgtgaccattatttattatggaaatattgcttgaaattatgctttaagtagtttaagtaattttagcatatgatatttaaaattcttaaatcaattcttcgatattgttatttaaaatttttaacaaagatttgtttagaatcttgctattaagttttatttattaataaaatactttgtattactcagcattactattattcatcaaaatattggtgacacattctgactgatgcattttatttttaaggtttactgctagaccactagtggaaactatatttgaaaggggaatggctacatgctttgcttatgggcagactggaagtggaaaaactcatgtaagtaatttattaaagttacattctggtacgaagctacagtttcttttccttatagcttaattctgcgaactaaattcttaagagttattcctgagtaatgtctgttctttattttctttttaaaatatagactatgggtggtgacttttcaggaaagaaccaagattgttctaaaggaatttatgcattagcaggtaactgtcctttttccatataatttggaatattcttctgtggtattattcaggtaactttgaaataaggctttaaaatattgttcagcaactataatgctatattaactgtctattatgtcaattataggttattagattgcttgaaaagaactataagattatatattcacaataattttttttttttttaagaagacaagaactgtaggctgggcgtggtggttcacgcctgtaatccctgcactttgggaggccaaggtgggtggatcacttgaggtcaggagttcgagaccagcctggccaacatggtgaaactccatctctactaaaaatacaaaaaaaaacttagccaggcgtggtggcgggcgcctgtaatcccagctactcgggaggctgaggcagaattgtttgatcatttgaacccaggaagcagaggttgcagtgagccaagatcatgccactacacttcagcctgggcaacagaccaagaccccatctcaaaaaaaaaaaaaagaactgtaagattgattttgagggggcagaaatcttgattatatttgtcagtgcattctagcacattgttggagatgagtctcagttgttgaatttctgaactgtaaaaagctactagctatggtataagaataacctcattatgaccacctataattttatgctatttataaatataaatattaatatatataaataaaagtagcacccttttatggcatatgaaagagaatagcttctattaatactattttttgtaaaattaatattcactttctcatttttattattgatactgttatcctaggtaaagagtaactgattcctctagaaatagaaaatttgagttgctttttaaaaatatttgttggatctcaattttctgtatatgaaatttttgacagctcgagatgtctttttaatgctaaagaagccaaactataagaagctagaacttcaagtatatgcaaccttctttgaaatttatagtggaaaggtaagtgggaacttttttaattttaattttttaaaatatatatataacataacatttgccattttaaccatttttaagttcagtggcattaaatatattcacattgttgtgcagcgtttaccaccataatttatgtgtatttagaacttttatattagaatttatgttatgagatttttttaaaaagtcctttgaaacttttcaacttcagtgttgagaattcttattccaattattattttaatctctgaaataattcttaaactctgggtgactcatatttatagaactgatattttaattgccacaggatctcgctgtgtcacccatgctggagtgcagtggcatgatcacagctaactgtagcttcaatctcctgagctcaagtgagcttcccgcctcagctttcctagtagctgcgactataggcatgcaccaccatgcccagctaatttgttttatttttagcagagacaaggtctcactatgttgcccaggctggttttgaactcctgagctcaagccatcctcctgcctcagcctcccaaaatgctgggattacaggcgtgagccattgcacctagcctgttttttactttaaagctagttttctaatttgaatatggtttttcataggtgtttgacttgctaaacaggaaaacaaaattaagagttctagaagatggaaaacagcaggttcaagtggtgggattacaggaacgggaggtcaaatgtgttgaagatgtactgaaactcattgacataggcaacagttgcaggtaaatctcattttgattaagaaaggaaacatcagttttagaaactttgggtacagtataacaaaatgaggatgttatctatcaatacatcttggaagtaaaaatcattgttcataaaaacttgtgttacatgtaaatgtgagtgacaattattatattgatactacattacaaatatattagaaatatgccggattaaattgtatgaatctggttctatttaagtgttataactcagtgtctcatctgtatttaaaagatgaaaactagctaaatcgatgtttttgctgctgttgtttttaatgaaaataatgtggtttgaacatgtaaattgaagtttttaatgtatcaagatgtccttaatcacattgtagaacatccggtcaaacatctgcaaatgcacattcatctcggagccatgcagtgtttcagattattcttagaaggaaaggaaaactacatggcaaattttctctcattgatttggctggaaatgaaagaggagctgatacttccagtgcggacaggcaaactaggcttgaaggtgctgaaattaataaaagccttttagcactcaaggtaaataaaatgtattttatcatgaaaggtcttttacttttgactttaattttctttactcagttgcaaaatagtagtacttgttttacctaataaaaagaggttttcaaaattcagatgcttgtaatgtatagtgtgattttattatacccagattttttccttgcacacattctttattctttttagatgggataaaggatatgtgagttagtaggtcagttctggggctacataggtaaactccagaggttttttttttttttgagactgtgtcttgctctttcgcccaggctggagtgcagtgacacaatctcggctcaccgcaacctccacctcctgggttcaagccattctcctgcctcagcctctccaggagctgggattacaggcacgcaccaccacacccagctaatttttgtatttttagtagatatggggtttcaccatgttggctaggctggtcttgaacttctgacctcgtgatctacccacctcagccttccaaagtgctgggattacaggcgtgagccaccgcgcccggcccagagggtcttaattagtcatattttctaggaggagggcaacgaaccactgaattgagctaagaaacagtttctcagaaaaacgtggaatggctttcaaaatgttaggccaggttattacatcttttccttgagtagaaaagcaaaggttggaaagactaaaataaggcattctgtgtttttttcttttggagtgccatgttaagaaattaactttttacagttatcctactgcctgtcactttcaaacactagtcatagtttccagaaatatctgttggaagaataaagtaggtttttttgctgtcattttttattttcttgaattagcatttatgggaacatctacactatgctttaaaactgttggccaggcgcagtggctcacgtctgtaatcccagcactttgggaggccgaggcgggtggatcccctgaggtcaggagttcgataccagcctggtcagcatggtgaaaccccatctctactaaaaataaaaaacagccagtcgtggtagcaggcgcctgttatcccagctacttgggaggctggggtaggagaatcgcctgaagcctggagacaaaggttgtagtgagccaagattgcgccaccacaccccagcctgggtgacagagcgagactttgtctcaaaaaaaaaataaaactgttagtagaattttcaaaactgatcagacccttaaatgttcaagttgtagtaagagaccttttaaaatatgttaattaagattatcctttataagaaagactaatctgtgagacttgttttcttaattttcaggagtgcatcagagccttaggtagaaataaacctcatactcctttccgtgcaagtaaactcactcaggtgttaagagattctttcataggtgaaaactctcgtacctgcatggtaagtttatgtttattttttgtttgttttattttaatcctaaaggaataactacacaatatttatggaaaatgtatttgttagtgacaattatttgaatccttctattttgagtgatatggtgatatttaagatgtggtccctgccactctgatagagaggattatattgcagttatataattccagcatctaggtgttattgagggctggtctttcttgattttctttttctttttctttttctctttctctttctttctttttgagtataggtcacacttttctttatggtcatatgtctggtaatttggggttatatcatgtgcattatgaatgaacatagagactggattctgttatgttcttctgaagattattggttttttgtatagcagaaatttaactaaacttgctccaaactcttatctcccctgggcaacaactggaattgaaagctttgtttagtcctttcagatttagctatgttgcttatagtttgccttgtataatatatgtctaggtctggaatcagctagggatttgggcagtttgtatataaaagtttgtcccagaagggagagtaccacactctctgcagcactttcccttctgggacaaacttcacttttccagctgctatgaactccactcccaaactatatcctttcatttctttaccagagagactgcaagttttcagtcaagttttagttgccctgtgtgacagcagcaaagcttgccctctgtcaaaaagctgtttaaaaaaaaaaaagtcaggtggagtgggggtcagtcagtactattcccttccaggtattaacctcctccatttcagctggagtttgattgttttctagtgccttcagagtttgtattttaactagactttatctgattatagatatgataacaaataatcttggagttgagatatcattaataagtctttatttttaaataaccatggtaagattagacctaaatgagctgtatgtcagtattattgtcttgatcatttataacattttgtttacctttgcattttttttttcctgtagattgccacaatctctccaggaatggcatcctgtgaaaatactcttaatacattaagatatgcaaataggtatgagagatagttctccattttgaaatttgaggggagtacagcagtacatagtataatttaatatctgcctcgtgcggtggctcacgcctgtaatcctagcactttgggaggcccaggcgggcggatcacaaggtcaggagatcgagattatcctggctaacatggtgaaaccccgtctctactaaaaatacaaaaaattagccaggcatggtggtgggtgcctgtagtcccagctactcgggaggctgaggcaggagaatggcctgaacccgggaggcagagcttgcagtgagccgagatcacgccactgcactccagcctgggcaacagagtgagactccgtctcaaaaaaaaaaaaaaaattaatatttgatagggtaaatcttactacattgttctttcaattttcaagaaaaaaatgttttgcatattattccttaagatgacaatatagaatcattttgtcaaattctaaaaataagtggaaatgggtaatttgggaagggattgataactttagtaaagttggtctttttatcctagaacaaggtttccatttcactgttttatttcctaatattttactgcatttaaatcatgcaaattcttcttattacattaagactctgaagtaaatgaatgtcaggggccagtttgtatttcttgaattgttttggtatatgttgcatattattcctgataatattaaatgctctatatggggaatctaggatttgagtaagaagtgatagcacagttctttctggtgttttttttgttttttgttttggtttttttttgagacagagtcttgttctgtcactcaggctggagtgcagtggtgtgatctcagctcactgcaacctccacttcctgagttcaagcgattttcctgcctcagccccctgggtagctgggaccataggcgtgtaccaccatacccggctaatttttgtatttttagtagaggcagggtttcactatgttggctaggctggtctcgaactcctgacctcaggtgatccacctgcctcggcctcccaaagtgctaggattacaggcgtgagccaccccgcctggccctttctggtgttctatatgggttacattttgttattcatattaatagtcttataaacattataaacattataactgggtttttacagatagaaggacagaatgcattacagactactaaagcagtttattctgtatagtcatgaaatgcctttggaactttgaattataatgggcatatttatatttgatccatagatttttttttcccactgctcttgagtgactttatttaccactgctcttattttgaatgactgtttagtgttaaatttctcttctcaaatgttaaatttgtgattttaacctagagacaaaattcctctttgtaatccatttctagtatagcagttctcttaattcaagtatagcagttctcttaattttgctggataaaagtatctgtcctatatctttgttttaatcactatggaaatgttattttttaatcttttattaaaatgtaaaatacttatgcatatagaaaagtacctaaagtataagtgattaattaaatggataatggatacttataaagtgaaaactcctgtcattggtttgggaaatagagcattattggccccccaaaaggttccccatgtgctccttcctgttcacaaatcctgaataacatgccttattcatctatctctaccctgatgtaacccatggattaacttctgtggaatacttttcttgtttttttttttcctctttttaaaaataattttactatgaatctatttctgagtaacataggtagctgatttgaacattacacaatggtattataaccccccgggttttttttgcatcttgtttctaaagggattttcttaatggtagtaaacactgttggacaatatcaacctattgagcttttgcaaaaaaagtgattaaaatataatcacttctttaaaaatgtaatagggccaggcgcggtggcttacacctttaatcccagtgcttttggtggcccaggcgggtggattgcttgagcccagaaattcgagaccagtctgggcaacatagcaaaaccccgtctctataaaaaatacaaaaattagcctggcatggtggcatgcatctgtagtcccagccacttggggggctgaggtgagaggattgcttgaacctggaatgttgagtctacagtgagttgtaattgcaccactgcactctagcctgggcaacagagcaagaccttgtcttaaaaaaaaaaaaagtaatagaactacatttctaagtatgaactattatattttgtaaatttaatccctttaaagtttgaattatgagctcctagctgcaaatccttattgtgttagttttaattgatcttggtaattaacgtttttgatatgtgggatttttatcattaatttaaaatgtttcttatttcagaataattcttgagaaagatgaggaacagcctagtgtaatagattcttgccatgttgtagaattaaaacaaacaaaacccctctgtttcttaagatttgaaactacaaaagattcctccctaatattgtgaaaatgctatatctagctgttcctctagttcacttaggtcaaagtaaaatgttttaacctactgttatatcatgtaactcacttgcaacatgactaaccatctgggacactgtattaatcggttctcacactgctacaaaggaatacccgagactgggtaatttatgaaggtttaattgactcacagttcagcatggccacagaggcttcaggaaacttacagtcatggtggaaggtgaaggggaagcaaggcaccttcaccaggcagcaggaaggagaagtgccaagcaaactggggaagagcctcctataaaaccattagatcttgtgagaactcactatcacgagaacagcctggaggaagttgcccccatgattcagttacctccacctggtctctcccttgacacttggagattatggaaattataatttaagatgagatttgagtggggacagaaagcctaaccatatcagacacataattgtttcaattttatttccaaatctctaggaataaagatttttaaccttccttgatactcataccaatgttttgtgaccttaagagtcagtaatttttttttttttaacagccaaaaataattcattcctcctttatactaaatctgccttattttttttaggccaatactttgaggtggtgggtaggtggcattacattaaaatttcatatttttaggaaactatttctgtcttaagtgtttaaactttttttgtatttaagacatagcttagtgattgaagtgttatttctcaggacaaaataggtttaataacttccttactacttaatggtatcaaagcctcgggaaagttacttaacctctctctgtctttatttcctcatctttagaatagacagctaatgaccatgtccatcttaaaggattgtttttgaggactaaaagaagtgatctgtgtaaaatgtttagcacagtacctgggatatattaataggaatagttatccctattgctactttagtgagcagttctgtctaaaaaattcagttagacagatgtgaaagcaatgttttttcatatccttatattagaatcatatactttgaaagttttatatgggaattgtgggatagtttgtaacagtacacattgctgctaagtgattaagttgacaagtctagttcatcagatgacaattagagatactttatttatttatttatttatttaagatggagtcttgctatgtcacccaggctggagtgcagtggcacaatctcagctcactgcagcctctgactccggggttcaagcgattctcctgcctcagcctcccgagtagctgggattacaggcgcccgtcaccacgcccagctaatttttttgtattttttagtagagatggagtttcaccatgttggccaggctggtctcgaactcctgaccttaagtgatctgcccgcctcagcctctgaaagtactgggattacagcataagccactgcacccagccagacaattagagatattttagaggagagtacaagggaaaactttcagagtggaaggaatggttgtcccaaggaaaaaaaatttataggatatatgagaaatagacagtggcctctatcctgaagcagagatacttaatctttgggtaatggaagaggttagagtgattgggtcttgggtagaagagtgattagagtgattaggagtttttagtaacatgtttgaagaatgtgattcttgtatgtagtatagtctggcttgggcaagagggctttggatagaggaaaaaatgtgtggatgaagctaatagggtgtctaaattaaaagatttagataagaaatggggtgggagtgaaaatagttgtttgtattagaaatttagatttttcaggccagacgctgtagctcatgcttgtaatcccagtactttgggaggccgaggcaggaggatcacttgagtccaggagtttgagaccagcctgagcaacctaacgagacctcatctctacaaaaaaataaaaaattagccgggggtggtggcacaccagtgatagtcccagctgaggtgggaggatcacttgagcaggaggtcaaggctgcaatgagccatgactgagccactgcagtatagcctgggtgatatggtgagaccttatctcaaaaaggaaaaaaaacatatttagatttttcagcatgtgtggtaaataaactttaaggataaaaggcagatgaatccaatattgaacctttgacagtagatattaaccaataggtcaaagaaagactgttagtagaggaaacatattagtttgatttatatgaagatattgatacttgtttttgacctaaaaagaagggaatttcatttagttcaacctaagagaaatgacaagaaaatcagagaatatggttattatattgaagtgtttaaataacataggctttgtactcagggctaggttttaacctcagttatgccacattctcagtgaatgaccttagagaagatactttatttctgagtcatttttctcatctataaaatcaaagatggttgaaggactaaataatataatgcctaaaaatgactaatcctaatacctgacatacaggaggtacttaataaatattttatatgggtatgaaatagggttggcccaaaagagacataaggaattacatagatggggtgagaaaagtcataatttggttaaatataactattgaagatgttagcaaaagcaatttaaatttcattgctaaaggctgttctcaaccagagttcttcatctgaatcaccaaccactgaaaatagagtgaatattttctcagttataccaaggacatttcacagctaatgccattctggatgcataggaaagaagttaattcattacaaacaatggatgccttaagacattaggacttaattcccttgtgtcctgtttggaaaagactgcaaaaatgttgaagactcatgaatgctaataaacaaatagtcatggtactgactacatgaagaaattagattgagtggtcatgtagttaggggggcatttcagatttaagtgacttagttaaacttctaggaaggattatgagaaaagaggaaaatacaccagaaaggaaagacttaggactatagagcaggggatcaatagaacaaagatgttcaaaaacctcttaaaatttgttatttgtaaaataatattctaaatacattgtcacaacaatatcaatatccttttctaaacaaaagtgaatactaaatgaaaatgtgcaatgtgcattgctgtctttcaagagcattttcttttaatttgttgctcttttggtgctgcagagtaaaggagtttggaattagtccatcagacattcccttctcacagggtagtggcagtcgccctgatctctctccttcttatgaatatgacgacttttctccttcagttaccaggtctacttcattctatacataagatgtttatttgtatactttcttttgaattgtgctttgtataaacatttcatttgctatttttgtcctgagccattttagttttcattgtcatttcatttggcaggtggtggttgtactgcatgatctgcattcttacatcttttattaatttgtttgctttaaaatgttgatttagaattcaggcttcctatttccccctcatatttttaaggatgatgtcacttttgcatacttaccattaaaattaccatacttaccatcgaattgttaaaagataaattatcttgcttaaaatgaagagattgcctttatgctgtatgatcttataagtttccttgtctgcaaggagcctcttgacatagaaagtttaccctcttttggccgggcgtggtggctcacacctgtaatcccagcactttgggaggcggaggctggtggatcacctgaggttgagaattccagaccaacctggccaagtggtgaaaaaaaaaaaaaattttttttaaagtaaggaaagtttaccctttcccaaatgtgtaagtttaaatataatgagtaaacacttttcaaatgataaaacttaaaatcttataatctttatacattataaataaaattattttacatgtagctattttaattgagcatgataactaccagaaatctgcagggtttttttgttttgtttcagcagtgatccatttattggtctaattgttattgtttacatttttctgttcatataatttaattgcaataacatcaactttgatgagccagtagtaaataaaatggaaaatttaaaaaattttttaaatcataacaagtttttttctttgaatactgaatctacatactgttctcatttaatttgcacaataattatatttgatataatataatatgaattatataaagttacctaagcagatttcctaaaactaaacaaccacttaagtgtttctacagatttcagataaattttacctataaaggtgacatcatcaatcttagtatgttaactgaattgcgtgtatattgaataggctggtattttctcgttcctctgcatgagtgtttttaactttagatacctcttatgtatttatagggtcaaagaattgactgtagatccaactgctgctggtgatgttcgtccaataatgcaccatccaccaaaccagattgatgacttagagacacagtggggtgtggggagttcccctcagagagatgatctaaaacttctttgtgaacaaaatgtgagtgtactatggttgtaaatgttataatcttagttcatttcatcagtagcagaacttaactgaaaactatcatttaaatgaggtgtcaggctgtgggtgtggtggctcaagcttgtaatctcaccaatttgggaggctgagtgagaggactgcttgaggccaggagttcaagaccagcctggacaatttaatgagaccctttctctacaaaaaatttaaaaatcatccagatgtggtggtatacacctgtaagtctagctactaggcaggctgaggtgggaggattgcttgagcacaggaattctgggctgtagtggactgtcatagcatcactgcactctagcctaggtgacagagcgagaccttgtctcttaaaataaatgagtaaataagtcaggggtcagcaaactacagcctgtgggccagccatctatttttacaaataaagttttattggaacatatccatgtttattctcttaagtgttgtctggctgctttcttacctaccataacagcagtaacagagactgtttggctcataaacccaaaacatgtattatctggccctttaaggaagtttccaactcccaatctaaaccattcatttttttcccttagatttttgtctgatattaaaatttgggaaaaatttaaagtaatacagggaaaaacaacttccaactcccaatctaaaccattcatttttttccctcagatttttgtctgctattaaaatttgggaaaaatttaaagtaatataggggaaaacaactttaaaaattacacatataataaatattataaagcttaaaaacaagccaggcgcggtgtctcacgcctgtaatccgaggccgaggtgggcggatcacttaaggtcaggagttcaagaccagcctggccaacgtggtaaaacctgtgtctactaactacaaaaattagctgagcatggtggcacacgcctgtagtcccagctactcaggaggctgagggatgaaaatcgcttgaaactgggaggtggaggttgcagtgagctgagatcccaccactgcactccagtctgggcatcagagtgagactccatctcaaaaaaaattttttaaagcttagaaacaaaagaactgtggacatatgcatctatattgaaaggatgtatgcactatattaaaatcaaacagcaaaatactaacatttgttaaatctgattgcttttctgtatgattaaaatttttaatgatactttataatttaaatttttgatttcccaattataaaaataaatacatgcccattgtataaggatagaaagagataaagaaataaaaaggtatatataatacactttcacataattgcttttaatgtattgagagggttcttttctgtgtgtgagatgtaaaggtgtgtttttaaaatgcatattctgcatagtttggtgtcattctattcccactaagtcttatcatggcattttctcatcatgttaagttagcattgattagttgcttactacatgacatacattgctaagcattttatttattatctgatctcattatcacaactcattgtagtgggtactataattatccctactttataactgatattctgaggtttaaataatttgaccaagattttacaagtagtaagtactgaagccaggattgaaatttagatcttattccagcgccaaaccttgtatcaattaaactcattgcttcctgcaatacagtattctttgtaaacaatgttagttagttctaatactttgtagcagatacttagcccaaaatattctagagtaacagatacacttactactttttgttaccatgttccaaatcactgttactaaagcagggcttaaagcagtggtccttaactaggagcagtttggcccccaaagcaaaatgtatggatattttgcttgtcacaactaaggtgatgctgctagcatatagtgggtagagccaggaatgctgctgaacatcatacagtgcacaggagtgtccccctcaccttatccccatacaatgtcagtagttccaagactggaaaaacctggttcaaactaagagttctaaactttgaaccataaaaactaaaaatgagattctggcctcagtccatcacttatgtccagaatttttaagagagactgtagttgcttttagactctttaaagtaaaccctgcattgcatctagatatgttacctcccaaagatgtggaaaaccagagcaagataagtactccctatacatatctttccattttattattgcatctattgggcctctgtagagccttaatttggagaggttagatgaccagaactaatccaggggagtatgacatcatgagtttttacagcctccatgtttgagagagtgtgcatttctgtcacctttgccacacccagggaattatcttgccatgactcagcattagcctttagttaagtattggtgcgtgtgtacatattattattgctatattgtcttaacaaagtagattaaaatggaacagcatctaagacacgctctagagatcggagaagttttttttgtttgtttgtttgtttgtttgtttttttgaggtggaatcttgctctgtcacccaggctggagtgcaatggcacgatctcagcttactgcaacctccgcctcccgggttaaagtgattctcctgcctcagcctcccgagtagctgggattacaggcgcacaccaccatgcccagctaattttttatatttttagtagagacggggtttcaccatgatggccaagctggtttcgaactcctgacctcaagtgatccgcccgcctcagcctcccagagggctaggattacaggagtgagccaccacacccagccgaagtttttttttgttttttgttttgttttgttttgttttttaatcatcatctgaacatggcctgggatcagagaagctctgacttgctataggacgaaaatatgaatatattgtatatagttgtccctcagttatacatggaggattggttccaggactgcctgaatatacccaaattgcgcatacacaagtcccacagctggccccgtggaacttgcaaatatgaaaagttgggcctctgaatatgaaggtttcacatctctcaaatactgtattttcagtctgcattggttgaaaaccagatataagtggacaagcactgttcaaacatgtattgttctagagtcaactatatgttttttgttgttgatgaagtaaaattgtgaattgtccattgaaatttctataaaaactggtataaatatattctgtagtatatttaagaaattagttagttaagagttaagtcctttacaacactaatttgatagtcatgaaagacattttctttacatcatctaaagatactatcttcatatcttttttaacaaaagaaacttaaacatgtaaattaaattgttagtgaaaagtagacaatactgaggaaatatttcatacatttacagcctgcaataactgtatttttgaaaagttgggctgttccaaaagagagtactctttcagcatagttcggcaataaagcttaggctaagtgaaaaatattccctactcatctaagttttagttgtcttattgagagttgcataaatatttttacccaaagaaagaaatcgtggctttgccttttatatatattttactagcctttaccattcaagcctcttcaatttctaaatgatatttttctaaattaaaaaaaactacttttataacatttaaaatacacactatatcataatttcttaactatttttattttaaggaagaagaagtctctccacagttgtttactttccacgaagctgtttcacaaatggtagaaatggaagaacaagttgtagaagatcacagggcagtgttccaggtaaagtaagacaggactttccttcaaaatatttcttgagataaattaagaatttgtcataattccttaaatatcacactattccttaaaaaatacttgtttgtatatatgtatatgtgtatttgtagggcatgtgacatggcaaatttttaatacaatgaacgatggctacaaataacatttctttgcaccatggtgaaacgttctactttatttacctcccgtcccccttattggtttttgtcatttgtccatttttagggaagagtgtcacttctgcccaccagtacttccttctaaatgttaggccaatgtatttgatagcagttaagaaaaactcttttaaagggttttggagcagttgaggaagtatcagttgttgcagaaaagagagactacttacttcaggagatggagagttactgctctgagctgtcagtggcaagttaagggaagggtgttatatcaccacctgtagcagtaactccttaggcattcattccattatgcattcaacctgttaaaagtatttactatatgatactctactcccctttttttaaacaagaaaatgtcctatcatggtgatatttgagggagtgaagatatcatttggacatctttatgaagactgtacaattgactggcagccgcccccaccctcctgtaatactatgaacacttcttgagaaaaaaacaataactgcctcccttgttgacttgtattccttctttgatgttgaaggaatctttgtcattaaacaaaggaacttcagctctaggccattcaagaacctggataaagggctcaaaaatgacagagaacactttatgtcagattaggatacacgttcattaaaactattagagtttggccaggcgcagtggctcatgcctgtaataccagcactgtgggaggcccaggagggtggatcacttgagcccaggaattcaagactagcctgggcaacatggtgaaaccctgtctctacaaaaaatacaaaaattagctgggtgaggtatagcatgcctgtagtcccagctactcgggaggctgaggtaggattccttgagcctgggaggtggaagttgcagtgagctgagatcacaccactgcactccagcctgggcaacagagtgagaaaaaaacaaaaactctagagttttagtcaaactgttattatgagactctctttagaagccaaggtgtttaagtagagaacggatgctaataatttaagaaaattacacacctgtaatcccagcactttgggaggccagggtggatggattgcttgagccctggagttagagaccagcctaggcaacatggcaaaaccccatctctatttaaaaacaaaaagaaaagtgtcatatgtgcccttttggaacaaggtatcctataaagaccatcatttcccactctgccattttttagataaaatcttacagctgtttattggtaaaattaggtgttctgactttcaacccagtattctttttacaattctctatatcattcctctgtattatgatctgccatttcacaaaataaggttttgttaaaccaaaattaagtgtacagctaaaggaaaaggaaagaaaaattggagtgtatgaccaggcgtggtggctcacacctgtaatcccagcactttgggaggccgagacgggtggatcacctgagtttgcgagttcgataccagcctgaccaatatggagaaaccctgtctctactaaaaatacagaattagctgggcatggtggcgcatgcctgtaatcccagctacttgggaggctgaggcaggagaattgcttgaacccagcaggcggaggttgcagtgagccaagattgtgccattgcacaccagcctgagcaacaagagtgaaactcaggaaaaaaaaaaaaaaggaaaattggagtatttttgcattttctaattaatatgtttcctaatcaagacacatacctatgttaaccagttctgtctggtgctatatagtctaattataattagtcattaaagtcaattgatgttcggaaaattgagattgtatgcatcctaaaagcaaatccacgtataagagcttttatgtccaaatagctctttaattcagaaagatctggtcttgttttgttttttgttttgagacagtctcgctctgtcgcccaggctggagtgcaatggcgcgatctcggctcactataacccctgcctcctgggttcaagctattttcctgcctcagcctcccaagtaactgggattgcaggcgtgtgccatcacgcctggctaattttttgtatttttagaagagacagggtttcaccatgttggcccggctgatcttgaactcctgacctcaaagtgatccacttgcctcagccttctgaagtgctgggattccaggcgtgagccaccatgcccagctggaatttattattacctcttggcccaaccactgtgagtccctaattggatatgttagtttgtcaggttctaggctaccatagcccccatcaaagtgctcagtagctttattatgcacattcttcccgttttagggatggatattgaggttttgagacttactctcctctttaatattgatgtatttgatgcattccctccccaaaattcccatccaaagtagagtaaagatagagaaatgaaatgatgttgctcagcccatctttcatgtgtttgtgttagattttgaggacatacagttgacccttgaaaactgcagggggttaaggatgctgacccccagcacagttggaaatatatataacttttgagcccccctaaaacttgactattgaccagaagccttaccaataacataaaagtctatgagtacatattttgtatgttatatatgtgatataaggtattcttaccacaaagtaagctagagaaaagaaaatggtattaagaaaatcgtaagaaaggagaattatatttactattaagtagaagtgcatcatcataaaggtcttcatcctcatcatcttcacattgagtaggctgaggaggaagaggcaggctggacctggtgtctcagggctggcagaagtggaggaggtggaagggatggcaggagaggcaggcatactcagcgtaacttacattgaaaaaaatccacataagtggacccaaacagtttaaacccatgttgttccagagtcaactgtatttcttaattatactgtctgtgaataaagatgttttatgtctattgacattttagagaatactatcttaagtatgtttgattatatttaacagaattgtaatttggtttctgtttcacaaagaggcttattggattatcgaatttttgtccttgtaggaatctattcggtggttagaagatgaaaaggccctcttagagatgactgaagaagtagattatgatgtcgattcatatgctacacaacttgaagctattcttgagcaaaaaatagacattttaactgaactgcggggtaattctttttccattttaatgtttgaaatctgattggtattggtatgtatattggtgagagggcttcttcgtattgcaagaggacatacgaagtgaaaattaggggcactgtttagcatctattttccagaggtataaagacaactaaccattgtggtttttctaaaagtcatggcatagcatttcaagttttctctcatattttaagaagacagtcatcttaaagagagaaaatgtatttttaacaaatttataaattttatgtacctattcagatctttagtttggtaggctgatgcttatgagaattatcttctttctgtgccttttttcgggtctcattctgttgcccaggctggagcacaggggcgtgatcatggcttactgcatcctcaacctcctgtgctcaagcagtcctcccacctcagtctcctgagtagctgggactacaggcgcaagccaccacacccagctaatttttaattttttgtagagatggggtcttgctatgttgctcaggctgtctcaaactcctgggctcaagcagtcctcctgccttgacctcccaaaatggcgggattacaggcatgagccaccacacttggcctctgccacttttttttaaatgaaggaggtgtcaagatgactatcctctgtaccttactcatgaagggaagcatgtgccttacctactaagtcgtgtctttttggttttttagttagcttatctgtgtagcttcagctatgtatttctttatgtgttaatttcttaggcatttgcacactgttggctttgtttaggtgtgagtgaccatctggatgtgtgtgtacacgcaatccaacataaaccagaatgaaattcctaatttggggcagtaaataagctgcttaatttttttaaggaggccctctgtgatgttgattagttgttttgaagggttatttttcttttaaatttattcatttatttaaattgacatcccagcctgggcaacatagagatcccatctctaaaaaataatttaaaaatttaaaaattagccaggtatggtggtgcctgcctgtagtcccagctattgggaggctgaagtgggaggatcacttgatcccaggagtttgaggctgcagtgagctaggatcacgccactgcactctggtttgggcaacacagtgagatcctgtctcaaaaaattaaagagttgacagattaaaatgtatgtaataggtacaacatgatgttttgaagtatatacacgttgagtatcccttatgtgaaaagctttgaacaagaagtgttttggatttcagattttttcagatttttgaatatttgcattataccaaaagtttgggatttttggaacacttcaggtttcaggtttttttttttttttttgtcatggagttttgctcttattgtccaggctgggttacaatggcacgatctcagctcaatgcaacctctacctcccaggttcaagcaattttcctgcctcagcctcccgagtagttgggattacaggcacgcgccacaatgcacagctaacttctgtatctagacggggtttcaccatgttggccaggctggtcttgaactcctcacctcaggtgatccacctgcctcggcctcccaaagtgctgggattacagatgtgaggcaccgagcctggctttgctttttttttttttttttgagatagtgtcttgctttatcgcccaggctggagtgcagtggcaatctcagctcactgcgacctccgcctcccaggttcaagcaattcttctgcctcaggcttctgagtagctgggattacaggcgtgtgccactgtacccggctactttttgtatttttagtagagaccgggtttcaccatattggccaggctggtatcgaactcctgacctcacgtgatgcacccacctcaacctctcaaagtgctgagattacaggcatgagccaccatgcctggccagatttttttttttttttttttttttttttttgagatggagtctcactctgtcacgcaggctggagtgcagtggagcgatcttggctcagtgaaagctccgcctcccaggttcatgccattctcctgcctcagcctcttgagtagctgggactacaggcgcccgccaccacgcctggctaatttttttgtatttttagtagagacggggtttcattgtgttagtcaggatggtctcgatctcctgaccttgtgatccgcccatctcggcctccgaaagtgctgggattacaggcatgagccaccacgcccggcctgcacagccagatttttggatgagatgttcaacacatatatgttgctgactggttatgaagttggttatttgaaatcatattttgtaaagtcagcagtgactgttgaactaaaattttcatttgtttctcatattgttcatattcaaccctttatttaaattgttttgatcatttttctaatctgcaataattcacaatcagcttctgtatccattttattcagaagacagatcctaatgcactctggtattttttctttgtagcattcaacttaattgacttcctttccttttctcaaatttcatgtgtatcaagcatatccataacttttaagaaattactatctagatatattgcattattcagtccttagaatttttttaaccacccagagataaatttgggatttataagaaaaatttgggccagacacctgtaatcccagcactttgggaggctgaggcaggtagatcacccgaggtcaggagttcaaggccagcctggtcaacattgtgaaatcctgtctctactaaaaatacaaaaattagccaggcatggtggcacatgcctgtagtcccagctactcaggaggctgagacaggagaatcacttgaacccggggcagggggcggagggcggaggttgcagtgagccgagatcacgccactgcactccaacctgggtgacagagtgagactccatctcaaaaaaaacagaacagtaacagtttgagagcaccaaatctagaagttcttaaattcatttcaaaatttcaaaaaagttaactttttaaacatcactgtactttcaaaaaggggaggaaaattgagattccaactttattctgaagtctacagagtagggtttcgtaaccttgacactgttaacatttggggctaggcctttctttgttgaggagtgttatcctgtgccttgtacaatatttaccagcatcgttggtctctgtccactacatgacagtagcaccacaccagttgggataaccaaaaatgtctctagacattaccaaatgcccgctgggggccaaaaatcatatccagttgagagccactgttattgaaagatagcttatcttcacagctgcatgtaatttgtctgacaatttactaacctatttctagtttttacatgactctagagcagtacatgaccagaaaatgcgtaaaatcaagaaatatatcatttagtcatccccccttcacaatcccccttcctcacagtgaggacaaaatgtaaatttctaaaaattcaaatatattttacatgttcatagctttaaaaaggtaaaatagggggtgctgagcacggtggctcatgcctataatcccagcactttgggaggccaaggcgggcagatcacctgaggttgggagttcgagaccagcatggccaacacggtaaaaccccgtatctactaaaaatacaaaaattagctgagcgggtggtgcacgcctgtaatcccagctactcgggaagctgaggtgggagaattgcttgaacccatgaggtggaggttgcagtgagcctagatcgcaccattgcactcaagcttgggtgacagagtgagactccatctcaaaaaaaaaaaggtagactatgtattttacaatgtgaaacctgcctatactctaggaggaattccaataaattaaaacagagaactgtaaatgtgccaaacagaacagaaagctattgaaagatacagaaaaacaggtatttctggaaatctgtaacaaaaaactttcgcaatagttgagcattctatttagttccgagtttctagacaacaaagaacaaaaggaaaaatactgagttactgttaggaaataacacagctgacttgattgaacccataaagttgtaaactcttactgcgtgtaatacaatacttattccctctttcttttctttttccaagataaagtgaaatctttccgtgcagctctacaagaggaggaacaagccagcaagcaaatcaacccgaagagaccccgtgccctttaaaccggcatttgctgctaaaggatacccagaaccctcactactgtaacatacaacggttcagctgtaagggccatttgaaagtttggaattttaagtgtctgtggaaaatgttttgtccttcacctgaattacatttcaattttgtgaaacactcttttgtctacaaaatgcttctagtccaggaggcacaaccaagaactgggattaatgaagcattttgtttcatttacacaaatagtgatttacttttggagatccttgtcagttttattttctatttgatgaagtaagactgtggactcaatccagagccagatagtagggggaagccacagcatttccttttaactcagttcaatttttgtagtgagactgagcagttttaaatcctttgcgtgcatgcatacctcatcagtgattgtacataccttgcccactcctagagacagctgtgctcaccttttcctgctttgtgccttgattaaggctactgaccctaaatttctgaagcacagccaagaaaaattacattccttgtcattgtaaattacctttgtgtgtacatttttactgtatttgagacattttttgtgtgtgactagttaattttgcaggatgtgccatatcattgaacggaactaaagtctgtgacagtggatatagctgctggaccattccatcttatatgtaaagaaatctggaattattattttaaaaccatataacatgtgattataatttttcttagcattttctttgtaaagaactacaatataaactagttggtgtataataaaaagtaatgaaattctgagaagagttttatcttaggaaaatacatatatatgcagtgtgtgtgccagtgtggtattaacaagactaatagtgcagtttgatccttaccaatatcattacttaatttgaagtgttcattagcaccccaaaatataccttttctatgtactgttaaaagaaattggcttctgatgcatgaacatttacatgtacattgaaagtagtccataatagaagttagtttaagccaagtgtagacagtacattactcccttgaaaaagaattaagttgaaagagttgactttgccttaaaaggcagatctaacccaagctccatccagtaccaaatgtgaaacttcattgttgtttggtgagaatcgccaaattctcactaatacattggtatggtgtagggcatgctactttttaaacagcagcacttatttttacagattgctactccaaggaagaaaactggccacttttcatgtaaatattttgttcaaagatttgtatatctctctaggagttttccctcagttcccaggatggggtccaggagtagattaacagctaaaaatctcccaaggatatcttgttttgatttatttactccagggaactatcagctccttcacaggagccaaaggggagctatgaatagagggtcacatgagccagattctttactgttcataaaacccagagagtagttgtgaaagatcctaatacaattgtgaaaagctctgtaaacatgaaatctaaaacaaatgtagattttcacaatatgcttattaataaatgaagtctatggaataagttttagagataatttacttcagtcacctttgttttggaaaggactcaggttttcttgcagctgtaagatatattctatttgtgtttatttcaaagggaagaggaaggatggagaactgttacaattgaccttgcaaaggatatttaaaaaaaaggtagtttttgagattaaccaactttcaaagggcaataaagacatgtgaatttgctcattttaaagcacaacagatgattagcttcaaatttattatttgcattggatgggtactgtctttggaaagtctccttatagacaaatatgctgccttacactatgatggcttcattctgatcaggtattttaaaaattagtaccagaaaagatactggaggtaatataatacagtccttcagctttacagatagtgaaaactgaaggccagaaaaggaactaaaactcagcagttcataggggtagagggaaataacctgagaaagccgagttaaatcttaaaatttttactataaggatagagatgatacaagtgaactctgcaaaatagttttgtgaaattaaacaaaaaaatctactcttaatgtatatttttcatatttgtttaacaaaagcagcttgatgcctttgttctggattatacattaagaacaagcattattttaattatgtagtaacatttactatgactttgaagccagatttcaaaatctggctttgttaaattaattggaaacactcttctattaagttaggtattaaaaaaagccaaatatcaataaagatatttttattaattttttatagaaacaaaatagctactataactctattatagtatattaacagcacttagtattatattgacttaaacatagtagctaataaaactagtttatgacatctattgaaattctcagtctgacagttttaaaatagcttaaaactaagcaccaggtatatgaaaaaggaactggaaattttaattgtccagaaatcataggaatactgggaacctgtagttatgggaaatggctgtttttctgaagttgaaaccagtttcaattacaaaaccctctgaaattttgctaagcctatagttatctccctaagaaccataaaaaaagataattttattgttaatttcattccagtttagcttcctcattttacatgttgggagtcatgccctttaatatgcctggcactg

SEQ ID NO: 17316 - DNA, 6927 bp, Human
tcaaggggcaggaggaggccttgggctgagctgggctgagaaaattacccccggatcatgatggggcccttgggagcaaggccttgggtatggagggggcatgtggcaggcctgggtgtgaataggggctggttggcctcaggacccacctgagggtgccccctctctcctggcattgcagagcgagggcatcgcctccacagtgaccagccagatgaactccgtgcagctggacgggcttcggcctgacgcccgctatgtggtccaggtccgtgcccgcacagtagctggctatgggcagtacagccgccctgccgagtttgagaccacaagtgagagaggttagtagccccctgcgcctgtccccatcgcggccctcactctctgtccctccactcagcagccccttctctatctccaggctctggggcccagcagctccaggagcagcttcccctcatcgtgggctccgctacagctgggcttgtcttcgtggtggctgtcgtggtcatcgctatcgtctgcctcaggtactcccaggcccactgttgctccatgggccgcctcgaactgccctttagcatcctagagccctcatgccacagagatgagccgccaccacttccctcagacccagggccttagccctcctggggtcggccgttgctggagaagccctctcccatccctgcctgtgtcttcatcccgccctttctccataccccattccctgaatctccgggcaggttccctagggactgagtccactgaaccccttgctcagacacccagagactgctgtgaccaccaattgtgggactaggccccaggccatcccctgtatcctctccgccccttctgtgagcccaagggtgccctgaacaaagggaggcagatgacttgtctcaggcctgccctccaccctgccaccctacaggaagcagcgacacggctctgattcggagtacacggagaagctgcagcagtacagtgagtttgtccccgccgccctccccaagctctcccagccccctgcagggctctcagacacccttctccctgcctgggacttcattccttagagataaaccctgaatgccccctcccacttccagtcaagtggcatttcctgacccctatctcactccgggtaccctgggcccctactcactcctgctagccccagaaatgactgagacatgacctctccccctaaaggcagttagtcctgtgggaaagacaagatgcaaacacacaggaaacaatttgagaacaattaagggttgagctgggtgctcctgttgtaaagggcactaagagtttagagaagaggaaggcttcctcgaggaggtggacttgagctgagccaggcgggatgagcagggtgttgggaggtgagggagagcattcctggccagaggagcctctggaaggtagtgggcggggtggggaaggagcccaactgtgggggcagcgagaagactggtttgacagctgctgggaagccaggctgggtagctgtggccagccctcggagggtcctgaaaggcaggcagaggagtctggacttgactccaccataggtaattggaaaggctctcaagctggggagtaatacaatgaaaggattgttttaggaagacagcggtatgcaggatagctcggtgggaaaagtccagaggcagagagcccagctgggaggctattggaatagtgtgagtgttgaaggcctggacaaggtcggggcagtgggaaccaggggaggcatgaatctgagagaggtctggatgtgatgagagatgagagagaaaaactaggagtagaatcctaggtgtctagcctttatggtcaccaggagttctcatgggagctggaggattagggcagcaacacagaggaatatggggctgggctcagcagggagcctgctggagctgtgcccatcgcagggagaggctggcttgacgttaccctctcacgcccacctcttctccctccagttgctcctggaatgaaggtttatattgacccttttacctacgaggaccctaatgaggctgttcgggagtttgccaaggagatcgacgtgtcctgcgtcaagatcgaggaggtgatcggagctggtgagtctcccggggcacagtagagatgagaagctgaggcgggctgggtacaggagtgagtcatagcttgtgccctgtgccctgcaggggaatttggggaagtgtgccgtggtcgactgaaacagcctggccgccgagaggtgtttgtggccatcaagacgctgaaggtgggctacaccgagaggcagcggcgggacttcctaagcgaggcctccatcatgggtcagtttgatcaccccaatataatccggctcgagggcgtggtcaccaaaagtcggccagttatgatcctcactgagttcatggaaaactgcgccctggactccttcctccgggtaagagccagcccccaggccctctccctcccccagagagttggattgggctcaccatcccctcccacaagtcagacagcccctattcaagtccataagcatttactgaggtggcttggtgcagggaaatggcagggccttcatagccataagtatgggagttcacatcttgactgttccttactgcctgtgtgacctcaggcaagtgacttaacctctctgagtctcagctgcctggttgtagaatggcagtggtaagagctagtgggtcctcatggggattaactgggatgttgtctataagatacttgacacatagtagggcagctcacttaccctcagggcactctggacatggttgcaggagagacgaggtagagtctgagtactcggagagggaaggcaggtgggcaggccatgggctgatgggagcaatgggctcacctgagcctgcttgttgcctgcagctcaacgatgggcagttcacggtcatccagctggtgggcatgttgcggggcattgctgccggcatgaagtacctgtccgagatgaactatgtgcaccgcgacctggctgctcgcaacatccttgtcaacagcaacctggtctgcaaagtctcagactttggcctctcccgcttcctggaggatgacccctccgatcctacctacaccagttccctggtacaggaagccgctgggagggagactgggggcggggcctatcagccaggggctcgggcctggggggcagcccggagtcacagggtgaagggcctgtgcccccctcaccagggcgggaagatccccatccgctggactgccccagaggccatagcctatcggaagttcacttctgctagtgatgtctggagctacggaattgtcatgtgggaggtcatgagctatggagagcgaccctactgggacatgagcaaccaggatgtgagtgaggctacgccagagtggttgggtaggtgggtgctggctggggatcatggcagtggctcactcagggtttccctgccttcggcccaggtcatcaatgccgtggagcaggattaccggctgccaccacccatggactgtcccacagcactgcaccagctcatgctggactgctgggtgcgggaccggaacctcaggcccaaattctcccagattgtcaataccctggacaagctcatccgcaatgctgccagcctcaaggtcattgccagcgctcagtctgggttagtacctctgcctctgctcccgccaagccagtagccctatctcccaccttcaagactcaccaggtccttctcttcttcccacagcatgtcacagcccctcctggaccgcacggtcccagattacacaaccttcacgacagttggtgattggctggatgccatcaagatggggcggtacaaggagagcttcgtcagtgcggggtttgcatcttttgacctggtggcccagatgacggcagagtaagtgtgcctcagatttggaggagcagggcagggggccctaggctgggcccagagttgagggcacgaggaaagggactgatcctaatttggctccacctgcagagacctgctccgtattggggtcaccctggccggccaccagaagaagatcctgagcagtatccaggacatgcggctgcagatgaaccagacgctgcctgtgcaggtctgacaccggctcccacggggaccctgaggaccgtgcagggatgccaagcagccggctggactttcggactcttggacttttggatgcctggccttaggctgtggcccagaagctggaagtttgggaaaggcccaagctgggacttctccaggcctgtgttccctccccaggaagtgcgccccaaacctcttcatattgaagatggattaggagagggggtgatgacccctccccaagcccctcagggcccagaccttcctgctctccagcaggggatccccacaacctcacacttgtctgttcttcagtgctggaggtcctggcagggtcaggctggggtaagccggggttccacagggcccagccctggcaggggtctggccccccaggtaggcggagagcagtccctccctcaggaactggaggaggggactccaggaatggggaaatgtgacaccaccatcctgaagccagcttgcacctccagtttgcacagggatttgttctgggggctgagggccctgtccccacccccgcccttggtgctgtcataaaagggcaggcaggggcaggctgaggagttgccctttgccccccagagactgactctcagagccagagatgggatgtgtgagtgtgtgtgtgtgtgtgtgcgcgcgcgcgcgcgtgtgtgtgtgcacgcactggcctgcacagagagcatgggtgagcgtgtaaaagcttggccctgtgccctacaatggggccagctgggccgacagcagaataaaggcaataagatgattctcttgccccttcttattcctcctcccaaagcaagattccctgattcagagttcacagtccctggctgccaacccttcgcaactccctggaggcattgggaaaccagatctgggcccatccaggctcagtttcccctttgtgcttggccctcactgctttgaacacctaacgcacttcttggaagtgggtcagtggcaacggagagctaactaccccagagctccttccttctaaggcagagaccttcctggggtgggggcaggctcttgtgtctggatggtgttttactgagtcggttcccagcctttgtctttaagggagctgagggtagagggggttgatcagttcccagggtcacatgaccaaggacaaagggaaggagagccactggtgttcagaggctgaggcccggaagttcggctgctcctcactgaggcttcctatgcccaggcgctgggctaaatgctccatttatacacggatcttatttaatctcacaacaacccagccaggcaaggaagtatttttaactgctttttacagaagaggaaaaggagaggttaagtaacttgcccaaagtcgctgagccagtaagtgaggcccgcggctgtgattcccacccagagactgcctgcatacttgaaaggttcagaggataaataacaagaaccggggagagggttaggaaaacagcttctggaaatgtcaaaggagaaagcgtggtggggggccctcagaggcccttcggacgcaggaacaggcgggggaggggggaagtgcagtcatgttcccagtatcgggaggcatccttgggcagcaaagctttgtgctttccgagagacctgcataccctgggtagggtccctgggtaggcacagaggcatggacagacaccacgccatgtagatgagaggttcacgtgtcgcggccccacacctctccctggacgcgtccaggcagcgcagagcttcccaggggaaatctaagcgagaggctgcacctaggggtctgcggagccgcaggcctggaagcatgcgaccgtgatttcaggctctggggtgaaggcccagggaggccgcgcggaggaggccgcgggcgaaggttgcagggtctgctgcgtggcgcactcccggccgcggaagccgacggcgatcggaggagcctgggagcggccctggcagcggccctggcacagctggcggcggcgcgggctcctcaggccgcccccgtccttcaccgcgcgctcccgcgctggggctgctcggcggcgcccgctccttagtattccccccacggagcccagccgcgccgccgcagccggcccgggggaggggcgccccgcacggctaagctctctgcgtccccggggcggacgcggggaggggaggggaagggacgcagcctctccgcccaggcctccttcctcccctagtgggggggaggggctgtgcgggggcaggggcgggcgatgcgggggcccaaggtggcccttggactaggcgccggagctgtcaacggggcgaggtgtggcgggcggccgggggaggggacgcggtgccgagtggcctcctgcacagccgctcagcattccccggctgcaggcgcaaataaagcggagggggcgcgcggagctcctgctcaagggtccacttcctactctcgaagctagggaatggggagggatccgtggcccgggagtcctgcgaagccttcctcgccatcctgtgccatcgccctgacctttatagcgggagtctgggtggagggcgcggagatgctggggtgggggctccactcgcataggtgtgacatcgccctctactgggtccgcagggagggcaagatcgtggacgtttagcgccaaggcgggaggggccctggaaaccacacgatcaggggaactcttggactgtgcgccccaggtcgaggatctcgagggatgtcttgagcccagaggtccgggggaagtaaggtactctgtcggctgtgccttgtgca

SEQ ID NO: 17317 - DNA, 42693 bp, Human
tacagccaagttacaaggctctcattcccctctctttccttcccctttttttccctccctatcttttttgacagggtctctgtcacccaggctagagtgcaatggtgcaatcatagctcactgcagcctcaacctcctgaggtcaagtatcctcccacctcagcctcccaagtaactaactacaggcatgagccaccatgcctggctaattaaaaaaaaaaaaaaaagtctgggcgcggtggctcacgcctgtaatcccagcactttgggaggccaaggtgggtggatcacctgaggtccagaattcgagaccagcctgaccaacatggagaaaccccgtctctattaaaaatacaaaattagccaggtatggtggtgcatgcctataatcccagctattccagaggctgaggcaggagaatggcttgaacccgggaggtggaggttgctgtgagctgagatcgcaccattgcactccagcctgggcaacaagagtgaaactccattaaaaaaaaaaaaaaagttagaagagacagggtttcacttcattgcttaagctgatctccaattcctggccccacgtgatgctcccaccttggcctcccaaagtgctgggattataggtgtgagccactgtgcccagccttctttctcatgagaaattaaaaattctggccaggcgtggtggctcacacctgtaatcccagcactttgggaagccgaggagggtggatcacctgaggtcaggagttcaggaccagcctggtcaacatggtgaaacctcatctctactaaaaatacaaaaattagtcggtcatggtggtgcacgcctgtaatatcagctactcgggaggctaaggtgggagaattgcttgaacctgggaggtggagactgcggtgagccgagatcccgccactgcactccagcctaggcaacagagcgagaccgaatctaaaaaaagaaaaaaaaaatctagtattttcttcccaccccacgtaattgttttgcacccaggggtgagtgccccccactttgcagacgtgcctagacctctccccacaaacatgatgactagagttggagctgggctagcgctgcctcttgttcactgggttcacgtgggcacgtggctccactccggtcactgcttcctgggcagagggatgacgtggaaggtagacctaggggggacagggttgcttcctgcccatgtccagcattctagaattgtccacatctaggcagggcgttccaccatcagtgctggactggaccacccaattcctttggacgcttgactcagcccaaacccgtgctccctccaggaccctgggcagggcagccccagctccaggtaatcggcactgagaagagtacacctgtcaccgcctggcaggggctcgctcctttctctggtgctgctcattcgcgaggcctgagacgcggaccgtcaccttccccgggcccagcctggcctcaatgcaggcctcagagagagggacaaaacccggcccgcctccctcccctccccaaggcgaccaccagtgtcctgggggtccacagggcctctccagctctgatccgagttcccggctgcagctggtttgggtctgtgggggcctcgcgcagggaagcggaggccccttctctaggctcctacatcctcctggcctgccccagcagagctagcggccctccgagacagctgggcctcgcagctcccagccgaggcctgtcgctgggagaaagaagaatgaatgaagggcggaaggggcggggaggggcggggcgcgccgcgccagctcgcggcgcccccaggccgggccgcagcggggcgtggcctctagaggcgtggccttgggcgtgggggcggggttttctggtggggcggggccgcgcagggccgttcccgccgccggccgcccgcgccccgcccccgtgccgcagctcacaggccccgcctcggtccgcccctccgctcgctccccaagccgccgcggcgccgagccggtttccccgccggtgtccgagaggcgcccccggcccggcccggcccggcccgcgccctccgcccccgcctccccgggccggcggcggtgggcgagctcgcgggcccggccgcccccagccccagccccgccgggccccgccccccgtcgagtgcatgaggttgacgctactttgttgcacctggagggaagaacgtatgggagaggaaggtgcgcgggccgcggggtgtggggcgagggcctggagggggtgcccggggcagcgtggggcacgggagggggccgggtctgccaggaggccgcgcccctgcctcctccgggatgagctcgtccttacgaagcccgcaggcccctccctgtccccctcccgcccgggatccccctccccggcccccggcgagctgccctcctgcgggtctgggggcccctggaccctttttcctcctcccacgtccccccgcgaaggactcccagacactgcccaccccgcgtcggcctccatccgcgtgctctgtccaccacccgggcctcgccctggggccaccctttatccagtctcggaagaaagagcggctggggaagccgcagccccgggtcccagtggccgccgggcgcctgcccggctctgtgaccttgagccaggcgctgacttcctggtcctcagtttccccttctgtacatttggaaactgggtagttgcccccccggtgtcggtgattgggggccagatgggtagagcggagataggcgtccaggaagccggaggccgtgtactgcgggagcctcatccactctccctgtccgtgccccaaacccggtgcctgccctcagtcttggctgggagcatgactcatcctaacctcctctttagccccttctccctcactggggcccaaggcgcagtactgcactgcagttagggttcaaggactcccccagcctaggacagggtctgggggcccctccttggatctccttcgctgacctgtcacttagatccacctggccccaaggcagggcctgactccacacctccccctgccaccaactcttcccaggcccatgaaaacctgattggggtaggggcccaccttcctgtagcccctgcctacctaaggtacctgcgtcttcacagagggtcaggctgttgtggccttgggacctagctatgtgactgggcaagccatgccatctctggggctcagtctccccttctgtacagtggagaggggcaggtctggggcattttccagggcccaccagctccaagggtgccaggccccaaggatgactaagcatgcctgtggctggctagaggaggtgccaggcctccctgggacaggtgtctgggagtacccagctctgcagccccttccccttgccaagccagggcattcattgccaaggatctgttagggccggcacctccaggcttcctgcccttgacctcccagctggcttcagcccaggatgcactaatccagccctgtccagtccctgcctttgaagggccctcttagtacttcttcctgggcaggagagggaagaaaggaggctgtgataggaatgtcacccactgccttatccctaaagccactgcttcctttctcctcatttaccttgccagatccaatgctatagcgggaggatggacctgatcctcctcctaagctgatacatagggaaacagggccagagaagcttggcaacctagtcagtatctcagcaagactcaggccagcgccctttcttctcctatttggcacagcgactgccctgcctgggcgctgcacatgtgcagtgtgcgaggattggtgcaggtgtaggtatatgtggggtgggcagggcaagctgggcctgcaccagatcacacttcctgagaatgcttcccaactcccttcccaccctgcaggaagcgagttgcccgtgtgtgcaagctgcggccagaggatctatgatggccagtacctccaggccctgaacgcggactggcacgcagactgcttcaggtagggtggggtgcccagggcctgtgttgccctaaacaaggcctgccagagaggacaggctggtcaaggaatgggggaggccgggatatgcctcctggtgccgtcccctattgtgacttcgtggccttaatttaccatttatgacatgaggtgttttgactagaaaatccctacaggccttcctgttgtcattttatttatctatttttttttctttttgagacggagtctcgctctgtcacccaggctggagtacagtggtgcgatcttggctcattgcaacctcttcctcctgggctcacgcagttctcctgtgtcagcctctggagtagctgggattacaggcgtgcaccaccacgcccagctaatttttgtatttttagtagagacgggttttgccatgttagccaggctggtctgaaacttctgacctcaagtgatcttcccacctcagcctcccaaagtgctgggatgacagacataaaccaccgctcctggcctcattttattttcttttatgtatttttcttttttcgaaatggtcttgctctgttgcccaggctggagtgcagtggtgccatctcggctcattgcaacctccatctcccgggctaaagtgatcctcctacttcagcctcccgagtagctgggattataggtatacaccacaatgctcagctaattttttaaattttgtgtaaagacagggtctcactattgagacccaggctggtcttgaacttgtgacctcaagcaatcctcctgccttggcctccgaaagtgctaggcttacaggcgtgagctaacgccttggcctctgttgtcatcctagatctctgagatctaaatcttagagaggatgggagagacctccaattgagccagtgcctgcaattcagccccctgctggcacccagacagggggaagagttggaaggaatgtccctcctgccttctgggtgttcatgctcttgcagggagggaagacaaaccaggccttaagggaaaccaggccaccctcagtgtcttccaggctgcttgcgaacatgcataacccagtcacaccagccccagtgtccagacacacacccacaggtaggaagaaagtagggtcagggttgtggcggaggataaagagtacatgaggacctgaaggtcacccagtaggaccatcctgagaagccaggagcaggggtctacctgccttgagccagagcagggccagagcaggggtctcaaaggatgtgagatttcctgggtagaaaagtagagtggaggtggggcgtggtggctcacacctataatcccatcactttttggggctgaggtgggcagatcacttgagttcaggagttcgagacaagcctgggcaatatggcaacaccctgtctccactgaaaatacaaaaaattagccgggcgtggtggcgcatgcctgtagtcccagctactcaagaggctgaggtggcagggttacttgagcctgggaggtggaggctgcagtgagctatgatcgcaccactgcactctagcctgggcaatagagcgagacccagtctcaatttttaaaaaagaaagaaagaaaaacaaatggtgtgggagagaattacaggcatagtcaccaaacagcaaggttcaggggagaaaactccataaaagggtagaaggtgaagcttctgggatgcccagcaggggtcaagacatccaccactaggactttattttaggcttctgccttggtttattttttggtttttggtttttttgagacagtcttgttgtgtcgcccaggctggggagcagtggcgcgatccctcctcactgcaacctccgcctcccaggttcaagcgattctcctgcttcagcctcccaagtagctgggattacaggtgtgcaccaccacgcccggctaagttttgtattttcagtagagatagggttttgccatgttggccaggctggtctcgaactcctgacctcaagtgatctgcccgcctcagcctcccaaaatgctggaattacaggcatgagccactgcacctggcctcggtttgtttttttgtttcttcttttctttttttttacacagggtcttgctgtgtcacccaggctggcgtgcagtggtgagatcatagcccactgtagcctccagctccaactggttcaagcgatccttctgactcagcctcccaaagtgctgggattacaagcataagccaccatgcccagcctgttttttcttttttaggaataacgtctaacgttttctaacattcagtaagggacaacccctgttctaagtactttgcatagttagatattagtgctgtctttgttttgccagagagaaaattgggacacagagaggttaattctcttgatgaaagtcacacagccagtgagtgaaatgaacacactcagtgtggctgaaaggagacagacagcatgccctgggattctgcatcaggtgctcagaaagaggccttcggggggcaagagggctctcaacaggcagaggaaaccatctgcacagcggtgggatggtgcggactgctgagggaacaggaacagttcccttggaaggaacagaataagctgagggatccaacaagaaacaaagttgagaccgattcgtgaagggccttgaatgccaagataaggagtttcagaagtcaggatgggggtggtggctcatccccgtaatcccagcactttgggaggccgaggcaggcagatcacttgaccccaggagcttgagaccagcctggccaacgtggtgaaacccccgtctctactaaatattcaaaaattagccaggcatggtggcacatgactgtaatccaagctactcgggaggctaaggaaggagaatcacttgaacctgggaggcggaggctgcagtgagctgagatcacgtcactgcactccagcctgggagacagagcgagactccatctcaaaaaaaaaaaaaaaaaaaaatagaagggagtcggcagaaagccagggaggggctggggtgacatgctgttgaagaatgccatcccagtgggccggtggtggtatctaggcagggaagggactgtcccagtaactcaagggtctgagctcataggacctgacctgggacagtgactgaggatggagagaatttcaggcagaagggacagtttttggtgagtatttgtcatattggctaccatgcattgagcactcttcatgctaatttgttaaatcttcatcataactctatgagggactgtatgtgcccagtttgcatgggagaaacagagattccatgcaatcaagtgcctcgctgaaggttgtaacatctagagctgggactaaaaccttctcactccacatcgccacagagtaggaaaggcaggggctggcggtggcacatgcctataatcccagccctttgggaggcggaggcaggtggatctcttgagcccaggagtttgagaccagtgtgggcaacatagtgaaaccttgtctctacaaaaaaattagctgagcatggtggtggtgcctgtagtcccagctactcaagggcgctgacatgggagggttgcttgagcctgggaggtggaggttgcagtgagctatgatcacaccactgcaagccagcctgggtgacagagtgaaatcccatctcaaaaaaaagaaagaaaggaagaaagaaaaaggcaggggcttcggggagggcatgggcactggcgaatggcagggtggaacctgaagccatctggttttctaacctgggcactggggagttggtggtttgttgactctgatggaattgggggtcatgttggggaggagacatgctcatctgtgttgagctggaggggacatgggctatccatggtggctgtgtcctgcccagagctagccatgggagcctgagtccagttggaggtaggaaagtcagaaaaaacggccgcctcggagctggccctgagatggtgagtgggatttgtgatagggccaagacgaatgaagggaagaactttggggacccctgtgtctgcggtgaggggggagatggagccttggatgatggagagagggtcaggagtagagccacagaagccacaggagggaagccgtgttacaggatgggtgtacctggctttggagtggcctgtcccaaatcactcaccaggagaggggtgagtccccaggtcagggcagtaaagaggaggcatgtttgtgctgtccctggtgtagtgaaactcaagaaggaagccaggtgcagtggctcacgcctgtaatcccagcactttgggaggccaaggcaggcagatcacctgaggtcgggagtttgagaccagtctggccaacatggtgaaaccccatctctactaaaaatacaaaaattagccgggcctgttggtgggcgcctgtaatcccagctactcaggaggctgaggcagaagaatcgcttgaacccgggaggcagtgattgcagtgagtcaagatcgcgccactgcactctagcctgggtgacagagcaagactccatctcgaaaaaaaaaaagtctcaatatggggaaagatccactagaagtaagagccatggcttctacctcgtggcttgtgggtgtgatactcccaacagtccccaaagctggtggtcctcaccgcgtgacagtgagcagagcagctcagagggggtcactgctcacctgggtgcatggctgaccacagccaggctggctctcagtgggatgcccaaggtgctagactctgcttagtctccctcgggccctgggcttgaggcattgggcccggcccagacctcatttcatgcactgagacctttgttccagggcccctcacccctctgaaggtgttcgggcaggggcaatgtgataaggccatgaggggtctgcagcctccagccccactggggaggtggccagtgatttccaccttcctggcccctctgcatgcccctcccagtggaacttcctagggtccctgagtcagtcacttgcaaataattatggcgtgcccactctgcattaggcccctctcacaacaacccagtaagggggtgctatttatttattaaagcgattttttttttgagtctcgctctgtcgcccaggctggagtgcggtggcgcaatctcggcttactgcaagctctgcctcccgggttcacaccattctcctgcctcagcctcccaagtagctgggactacaggcgcccaccaccacacccggctaatttttttttgtttgtttgtatttttagtacagacgaggtttcgctgtgtgagccaggatggtctcgatctcctgacctcgtgatccgcccacctcagcctcccaaagtgctgggattacaggcgtgagccaccgtgcccggcaatattaaagcgattttaaggccaaggctggtaactcacgcctgtaatcccagcactttgggaggctgaggcaggaggactgcttgaggccaggagtttgagatcaacctaggcaacatagtgagactccatctctacaaaaaaattagccaggcgtggtggtgcgtacctgtagtcccagctactcaggaggctgagatgggaggatcatttgaacccaggatgtcgaagctgcagtgagctgtgatcacgccactgcactctggcctgggcaacagagcgagacactgtctcaaatttttaaaaagcgattttacaaatgaggtgcagagttcagtcacttgccaaaagtctcacagcgcgtgaggagtagaatcaggactcgaaccgaggcagcctggcttcagagcctacagtgtaaccacagcttagtcccacacctcccagaccaacagggtccctgccttctagtgggcaagacactcagtgaacaaatgtagtgtcaggtattgggggacagcactctcaggaagtgatgtttaagggacagaattgaagggagcagtgtttagaggatgtcgggggtagggccggtgcatgtgcaaaggccttggggtgggaatgtgcttggcacaactgaggaccacaaagccagcgtgcgggagtgcagtcagtggccaggggtgcatagagccttgtgggccccgtggaaggtgccgttggctgtacagctttttttttttttttttttttttttttttgagacagagtctcgcttttgttgcccaggctggagtgcagtggcgtgatctcagctcactgcaacctccgcctcccgggttcaagcgattctcctgcctcagcttcctggtagctgggactacaggcgcccaccaccacacctggctaatttttgtgtttttaatagagacggggtttcaccatgttagccaggctggcctcaaactcctgacctcaagcgatctgtctacctcagcctcccaaagtgctggggttacaggcatgagccactgcgcacaggcagctgtgcatctttgaatgtcataacctgagcatctgagagctgctcctgtcccctggcccctgctcttgaggaagtcccacgctgataggacagacagggtcataagtgctgtgatgggggcctgcaggctgctggagggctcagccgggaccagatgctgcccctctttgtagagtgggacaattgctgcaggcccatgggacctctggtattagccctgagggttgtcactccggggcctgcccctttctgtgttctgacctcccagccccttgcaggccccgcctcccggaaggttatgaccaggcttggactggtccaggcttccctttggctcacatactgcctctgcgaggtcccctccaggaagcctcctgtgcacaacccccagggctgccgcatccctggtagcatctccttggcagctgggtgggctggccctgggcaaggagggctgagcatgctgctggcctgtggggttggagcagcggcgggatgcaacctccctttcttcaggggacctttttggcgaagacaaactgtccataggaagtcgacctctgttcccttgggggcagcagtggaagaggcagctgcttttgagcttgtccctgtccccagagaagcctgaggccttcagtgccgttgccagggccgaggctgaggagcctacagcgtgtgttcaggactgagggccagggacgggccacaggctccctgcctggggtccaagcctagatcgctcgctccccacccgcaccaaagcccaggcaaagggtgcttcagccacttcctgttgcaggctcagaccaagtcccctggcacccacgcggctgcagcctcctcctgtgcgctgcagccacgctggccccaccctctgcagcctccaatcctgagcccctgagggaggatggggaagcagctggtctggccacccctgccctcccttagacctccagagcccccagtgtagccacagaggatgctgttggcttcagccccaagaagacgccgcttcctccagagggctaagtaagtgggaatccccctccctacttgtcctgggctccaggcagggcccctggtgtaaggcctggggctggaagccgacccacctaggtccaggctctggggcagaactgaaactccttggttactgtcggctgcagcctgggagcaggccactgccaaagctgtgggtccttccaggacagtctccccatgaggccggtcctccacctgctgtttcttcacacctggtggccagggatgtggccctgggtagaacgatgattctccactcctgtcattatggaagccaccgctgtctcccagcccagccagccacctgggctgcagagcacccctttcatgccctccgggtgcctcccccttctcctgccccagcctggctttgtcctaccctgctctcagggaggggtaccctggagtggggccagggcatggctctcccccgagggagttcctctctggctgtccccagggcagctctgcacagcctcagtacctggcgcacctcccttgacatccttcttagggacagtcaggcactctgtgtggggcactcaagagagccaggcccgtcagcctctagctcctgccagaatgcaggcctgaggggtgaggggcggggcaggggcaggggcagggacaggaactccggcgtgctctccatccgcaaaggttcactgaggccccgagccccagccactgagccaccaagtcagcctgggccaggcctgggtgccctgtctgcaatggaggcagagacggggtctcggggcagttctgaggatgctgggtgcacagcgggggcctcgccggcaggaatcacttatgctctctcctgggccaagctttgtggatgcccagcctggggccgcggggagctggcaggtcagtggcagacactggtgggcagacctagtgtctggtagaacaggcatcaaggaagtggtgaccggagggaagccaagtgcactcaaaccctcgggtgagtcatcaccgccgggtctttcacagctgctgaaagtgagcaacagtgatgaaggtttgtgagtttctgcgtgagcgagtgaatggaccagtagcagtttccaggttgtggaagagcgttccctccccgggatggggacacttggttacagcaattcctaatcccccacccacccaccgcccactgcagaggtatgcgggggccctgcttcctgcaggcaggagtgaggggcactcctgtgatgtggcacccctgtgaccgaggtcatgtgtgatcggtgtaagggcaggaagcgagtcattggtctgcaccaggcgtgggggcttctgcgagggcaggacccaaagtcggcctggcctcccggctgcagcactcctttccctttcgaattaggttagagccctgggacgggaggtgccctgtagaccacccccctcaccaacttccgtcctccgccccacccccgcggtgatccggtgaactgccggccccctgctgtgcaccgagtggggcagtgaccctgacgtggcgtctcctgccgcccctgccaccgccaccacctccggtggcccagcctccgcattccccacccccatggaggaatgcaccaggcctcccttcctggatgcacccctcacccacatgcttccaaaccctggcattttctgctccccctttactcccaccccttcccctaggctcccagacaaaggggaagtggctggatcctcttaaagggacagtgtcccaccagcttactgctgaactcccctcctcaaccccagttccctagttacagttaattagcattagcagacagcccatgagtgatacccatgcaggccccaggctgtggagagtttcctgggtaggaaacagcccttaaggtccctcatctcatccaggtcccagtctttcctacctgcctctctcctagattgtggccctttggagcctggttcttctgtccctgtgtgaccgacacatagcacccaaacagtggcagagcgggacggaccccctagcctgttctctgtgtgggtctgtaccctgacccagacatgcccccccacagcaggacccaggggggcacatgtgtgcctgcgggttcactggggcacccgcatttggtttattttattttttagagagagggtcttgctgtgtcacccagctggagtgcagtggtgtaatcatagcacactgcagccttcaactcctgggctcaagcgatcctccctccccagcctccctagtagctgggagtacaggacccactgtatcctggctaattttttaataattttttaagagatggggtcttactgtgttgcccaggctggcctcaaacctctggcctcaagtgatcctcccaccttcgcctcctgaagtgctgagattacaggcatgagccaccatgcccatcccagactgacatttctatatttgttcatcctggctgggcagggctgctggtccccaccccaccgggatgcttggctgggaaaaagccgggaatgtaggtctaaccctggcctgtgttgtggcacctacagcctggcattcctccccatctgcccttcaaggccccaccaaccaggcctccttggtagcctctagtgaggaaacaggcgaaccgtggctttgatgaccctgcacacctggggattctcctctatttttctttttcttttttttttttttggagacagagtctcactctgtcgccaggctggagtgcagtggcacaattttggctcactgcaacctctgcctcccaggttcaagcgattcttctgcctcagcctcccgagtagctgggattacaggtgcccaccaccatgcctggctagtttttgtatttttagtggagactgggttttgccatgttggccaggctggtctcagactcctgaccccaagtgatctgcccacctcggcctcccaaagtgctgggattacaggtgtgagccaccgctttgggaggccgaggtgggcggatcacgaggtcaagagctcaagaccatcctggccaagatggtgaaaccccatctctactaaaaatacaaaaaattagctgggcatggtggtgtgtgcctgtagtcccagctactcaggaggctgaggcaggaggatcacttgaacctggaaggcagaggttgcagtgagccgagatcgagccactgcactgcagcctggcgacagagcaagactccgtctcaaaaaacaaacaaaaagaaaacttgttctaattcttacaaaggtgcctgtagccgaggcaggggcccaggtgaggtggaggagggcgggagtggacgtctcagcccggcccctctcctgcaggtgttgtgactgcagtgcctccctgtcgcaccagtactatgagaaggatgggcagctcttctgcaagaaggactactgggcccgctatggcgagtcctgccatgggtgctctgagcaaatcaccaagggactggttatggtgagcgccccctgccttgcacactcacctggggtgggggtatccaagcagaccccatgctccaggtctctctcccatcattgtctctcctggtctcctttttgctggtctttggagctgctttctgagcctgactgtctgtctgtatccctcagcgcccccatctatggagccagctctgtccaggagctcagcagctggccagccgggtccctgcagttgtttttttggtgacacccttggaagaggcctaggggaggatctgtgggggttgttgggtctgctgagctgggctgttccctcctcacccccgcaccaggtggctggggagctgaagtaccaccccgagtgtttcatctgcctcacgtgtgggacctttatcggtgacggggacacctacacgctggtggagcactccaagctgtactggtgagtgccttggcccctccctgagcctaggaggcccacctgtgtcacagatctgcaagggtgctgactctcccacacccgggcctcctgccctttcccatggggtgaggtttgttggggcaaatgttcatatctcctttcccatcccggcatggaaacaagtgagaaataacacacagaagtcagtgtgaaaaagcctcagacggccaggcatgctggctcacgcctgtaaacccagcactttgggattccgaggtgggtggatcccttgaggctaggagttcaagaccagcctggccaacatggtggaaccccatctctattaaaaatacaaaaattaaccaggtgtggtggcgggtgcctgtaatcccagctactcaggaggctgaggcaggagactctcttgaacctgggaggtggaagttgcagtgagccaagattgcaccactgccctccagcctaggcaacagagcaagactctgtctcaaaacagaaaacctcagacgtcagctttcttactggccatgactgcagcatggtgctggcacaaaccaccagaggtggggtggatgccacaagttaaggacaccatccccagcataactgctccctctttagacaccagccacaagttcaggggtccccaacccactcacacttctgaccgactggctacaaattcagggactcccaagaccctgccaagtttgatcgtttgctaacagactcacagaactcaggaaatcctccatttttatcccagttttattatgaaggacacagctcaggtccgaccaaatgaagaagcatctcccctccctcccctagcacatcaatgtgatcaccaaccaggaagcttcactgagcttcagcagccagagtttttattgggatttcattacatcgtcatgactgattgagtcattggccgtatgatcaagcttagtctctagcccccgttcttggaggtcaggctggatgaaagctgcaaccctcttcaaatcacatgatgtatctttgcggggctgagtcatctcattagtatcaactcaggaatagtctgaggggctcatgaataacaaagataccccattccaaggacttagagtctccctcccaggaatcaggacaaaacccagacagattctttcttatacaacactgatcaagctggattagaggacaacgtggcttgatcccagatgggcttttaatgacttcctcctgaactggatttatcctcaggccttgtcctggccgccttacaggatcacagcgagtagacagacccgaatgactcagagggacgagggctggctgggcacgcacagttcctgctcccagttccataggaagagtgaaagaaaagaaagctggccaggtgcagtggctcacccctataatcccagcactttgggaggccaaggcaggcagatcacctgaggtctggagtttgaggccagcctggccaacatggtgaaaccgtctctactaaaaataagaaattagccaggcatggtggtgcgtgcccgtaatcccagctactcaggaggctgaggcaggagaatcgcttgaacccaggaggcggaggttacagtgagccaagatcacaccactgcacttttggacaattgctagctttccttttcttttgagacagagtcttgctttgtcacccaggctggggtgcagtgttgtaatcaacagagtgagactccatctcaaaaaaaaaaaaaaaaaggaagggattgggggaagagcctggggctgggggctgcagagatgctgaaattgatgacgcccttgacactcttttcttcccaccccggcggctcttgcagcgggcactgctactaccagactgtggtgacccccgtcatcgagcagatcctgcctgactcccctggctcccacctgccccacaccgtcaccctggtgtccatcccagcctcatctcatggcaagcgtggactttcagtctccattgaccccccgcacggcccaccgggctgtggcaccgagcactcacacaccgtccgcgtccaggggtgagtggccggcctgccgaggctgccgtcggtgtggctatggctgttgatgtgggtggcagagtctggcactgggggccctgaaaatgaatgggcgagtgtttgggtacagatggggcccagttctgacaacctggtttgccagatttctggcccagtcattcctctgaataccattacaaatgccagatacaataaaaagacattttcaaccgggcatggtggcccacacctgtaatctcagcacttcgggaggccgaagtgggtggatcacctgaggtcaggagttcgagaccagcctgggcaatgtggtgaaaccccgtctctactaaaaatacaaacgtagccaggcatggtagtgtgtgcctatagtgccagctgcttgggaggctgaggcaggagaatcacttgaacccaggaggtggaggtttcagtgagccccgactgccattgcactccaggctgggcaacaagagtgtaactctgtatcaaaaaaataaaaataaaaaaaacacactcaaaaaataaaaagacattttctttagtccatgtctgatccaacaagaaagaggaggaaccaagtcaagaatgagtgaagaagctgggcgcagtaactcacacctgtaatctcagcactttgggaggccaaagtgagaggatcacttaaggccagaagtttgagaccagcttgggcaacatagcgagacctgcatgtctacaaaaaaaaaaaaaaaattaaaaattagccaggcatggtgaaatcactgaacacataaaggctgggcatggttgctcacacttataatcgaaacactttgggaggctgagatgggaggatcacttgaggccaggagttcgaaaccagcctgggaaacattgtagtcacagctacttgggaggctgaggcagaaggatctcttgagcccaggaagtggctacagtgagctataattgcacgactgcactctaggctgggcaatggagcaaaaccctgtctcaaaaaaatggggcagggctgataaagattagattactgtgtgactttgagcagctgctttctctctaggctttgggggtctgtttgaacaatgagggagttggataccttggagctttctaagatttctgtggcgcctttattgacaccttgagaagtagcatgcagtgtttctacttttgggcaattggtcacttctttttttttgagacagtctcactctgtcgcccagtctggggtgcagtggtgtgataccagctcactgcaacctccacccacaaggttcaagcaattcttgcacctcagccccctgagtagctgggactacaggtgaccacatgtggctaatttttgtatttttagtaaagacagggtttcaccatgttggccaggctcgtttcaaactcctgggctcaagtgatcctcccttctcggcctcccaaagtgccgggattacaggtgtgagccaccgtgcccggcccaagtgctagctttctctctctctttttttttttttcgagacggagtctcgctctgtcgcccaggctggagtgcagtggtgtggtctcggctcactgcaagccccgcctcctgggttcacgccattctcctgcctcagcctcccgagtagctgggactacaggcacctgccaccatgcccggctaattttttttttatatttagtagagacagggtttcaccatattaggcaggatggtctcgatctcctgacctcgtgatccgcccgtctcggcctcccaaagtgctgcgattacaggcatgagccaccacgcccggccctaccaagtgctagctttcatttgacgcagtgaatgtttcttgtacacctggcaggtgcctggcactgcataggcactgttgagatgtgaaggtggccctggggacagaaaattatactgggcttgactgtgtgtctccatcccttgacatcagccaagccagcagctgctttacatacatgatgagcagacagctgcttgaaagagatgaggaaactcccagaccaacggctcttaccagagggccaagggaggtccccacagagtcagaggctgcagctggtccctgaaatccaggcagaattttagaaatgaagacagtcagctgggtgcagcggctcatgcctgttatctcagccacttcggagggctgaggtgagaggattgcttgagcccaggaggtggaggctgcagcaagctatgatgacaccatgcattccagcttgggcgacagagcgagaccctatctctaaaataaaaatgaagaagacagttaatgacgtctcctccctgtctgcctcactgggtaagcattcgcccagccaacatctggaacatcccagttctgcaaagagccacacccttcccagaaagagcccaacttgccaaagatttacttatttgttttaaactggttttagttgaccgcttttcattttgtgtatagcagcgttttaaggaaggtctaatttatccaggccacctgctgctttagcaaaccaagggagaggatgtgagattctaaggaatttacatatgtatgtcatatatatatatatatatatagacacacaatttttttttgagacagggtcttgctctgtcatacaggctggagtgcagtggcacaatcatagctcactatagcctcagatgcctgtgctcaagcaatccactcacctcggcctcctgagtagtgagactacaggcacacaccaccacacccagctaattttttaattttttgtagagactgagtcttgctgtgtcgcccaggctagtcttgaactcctgggctcaagcaatcctcccacattggcttcccaaagtgctaggattacaagcgtgagccactatgcctggcttatttttaaggttatatgcatgcaaagcctgtatcaatgaaaatattttctttggtttttttcaacttttcatcttcgcattttgcagatttatagaaaatttgctaaaataataagtccattgaatacatacacacccttcaccaaggttcaccaattcgtaactgccatatttgggagttatatgtgtgtctctctatatatacatatatggatacagatacatatacatgtttagtgacttgtttatatttgtacatacatgtacatgttgttatttattgatcgtttgggagtaagttgcagggatcattgactcccccacaattatgctagatattctcaaaagaaggaccttctctttttttttttttttttttttttggagacagggtatcactgtcattgaggctggagtgcagtgatgcgatcacagctcactgcagcctcaacctcccaggctcaagtgatcctcccacctctgcctcccaagtagctgggactacaggcacgggccaccacgcctggctaggcattctgttatgtaattatcaattgtatcttatagttcagtgatcacattttggaaatgtaacattgataccattatctaatacacagaccatattcaaattttgcctattgtctctatactgaactactgagctgtcctttatagcaatctccccctcatccacagtccagtccatgatcaacattgcatttaatcgtcatgtgtcatcagtatcttttttttttttttttttgagacggaattttgctcttgttgcccaggttggagcgcaatggcgcaatcttggcttattgcaacctccgcctttgggcttaagtgattctcctgcctcagcctcctaagtagctgagattacaggcgtgcaccattatgcatgcctaatttttgtatttttattagagacggggttttaccatgttgccctggctggtcttgaactcctgacctcaaatgatccacccacctcagcctcccaaaatgctgggtttacaggcatgagccactgcgtctggccatttcctcagcctttcattgcccttcatgatcttgacatttttgaagtgtacaggccagtcattaaagtaaaatgtttttccttttttttttttttttttttaaaaagagacagggtctcactgtgttgcccaggctggtctcagactcctaggctcaagtgatcctcccgcctcagcttcccaaagtgctgggattacaggcgtgagccatcgtacctgccctcgcatttgggtttgactgatgtttcctcttagggagacaggctctgcaggtttggcctgatactgcataagtgatcctctgtccttccgagtggatcttgccaggagacatatgatgtcagtgtgccctttgctgaggatgttcactttgattacttgttttttctgtactgtaaggatttttttccctttgtcatcaataaaccatttgtgagatttgagtctgtaaatatcctgttcccaaaaacccttccccaaatgatttgagcatctattgatgattcttgcctgtagcgattattactagggtggctaccaaatgctgaatttctaactctgttcttccttctgcatttgttactgtaaggaagagcttctcccccatacgagaatagtctttttgtttgcttggttgtttttttgagatagggtctcactctgttgcccaggctggagtgcagtgacatgatcatagctcactgcagcctcgacctcatgggctcaagcgatcctcctgcctcagcctctcgagtagctgggactacaggcagcaccaccatgcctggctaattttttattttttgtaatggtgaggtctcactattttgctcaggctggtctcgaactcctgacctcaagtgatcttcccacctcagcctcccaaatagctgggattacaggagtgtgccaccatgctcagctaattttctgtaaaaaatgtcatagagatggggtcttgctatgctgcccaggctggtctcaaacccctagtctcaagcaatcctcccaccttggcctcccaaagtgctgggattccaggcatgagccaccacacctggccctgtttttcttaaagttctcagtctcctctctgccttacccccatccccttttccatctccaggacctagggcagagacaaagtgagcattccctaaaaagcttttatgaggcaaaatgaaaaccagctcacgcctataatcccagcactttgggaggccaaggtgggtggattacctgaggtcaggagttcaagaccagcctgaccaacatagagaaaccccatctgtactaaaaatacaaaattagccaggcatggtggcacatgcctgtaatcccagctactcaggagcctgaggcaagagaatcacttgaacctgggaggcggaagttgcaatgagccgagatcactccattgcactccagcctgggcaacaagagcaaaactctgtctcaaaaaaaaaaaagaaaagaaaagaaaaccaggtccctaacaccgaagagttaaaagaaataagtaaatttggcaaattggtctttttgtgagttagcttataggcaactgatcgagggtctctttcccgtcttcaccctgcaattgtggctcagggcaagctgccagctccctcctgccaatgcaggagcaatagagcttggcctcctcttgcagggcgagtttgggagtcagatatgaagccactaatccgggacctttttgggacccaaggcactcatctgccccaagcataccaggcaggccaggtgcaatgactcatgtctgtaatcctagcactttgtttttgcgacggagtctcgctctgtccacccaggctggagtgcagtggcagaatcttgactcactgcaacctccacctcccaggttcaagcaattcctgcctcagcctcccaagtagctaggactacaggcgcccactgccacgctcggctaatttttgtattttcagtagagacggcgtttcaccatgttggccaggctggtctcaaactcctgacttcaagtaatccatccaccttggcctccccaactgttgggattacaggtgtgagccactgcgcccggccagtcctagccctttgggaggctaaggcgggcggattgcatgagctcaggagttcgagaccagcctgggaaatgtggtgtaaccccgtctctactaaaaatacaaaaaaaattagctgggtgtggtggtgtgcacctgtaatcccagctactcaggaggctgaggtacgagaatcgcttgaactcaggaggcagaggctgcagtgagctgagattgtgccattgcactccagcctgggtaacagagtgagattctgtctccaaaaaaaaaaaaaaaaaaaattcgagaccaaacatacctgggatttggaaggatagatctgttcccccagggtggagacaatggtccattgaatgggaacagctgagcatcttgtgtgggtggccagtgcctacaagcgtgccacctttctccagctcacacctgtggcagacatcagtaattgattacagaattcctcccctgaaaccagaactcggtgttctggccatctgctacttcccagtcacacgaagtagaatcctccacctgctcaccctggatctggtgcccttcgccttggtttcctgttggggctctgagggacaggtgggcactggcctgacccctgccttacccacagagtggatccgggctgcatgagcccagatgtgaagaattccatccacgtcggagaccggatcttggaaatcaatggcacgcccatccgaaatgtgcccctggacgaggtacggtcctgagtctgtggggcaggacgggaggtagtgccttcatgcctagccccctccccactccacccccattcacatgcctgctgtccccagattgacctgctgattcaggaaaccagccgcctgctccagctgaccctcgagcatgaccctcacgatacactgggccacgggctggggcctgagaccagccccctgagctctccggcttatactcccagcggggaggcgggcagctctgcccggcagaaacctgtcttgtaagtcagcctgctcctcggttcagctgggtgctttcactcctgctggggctcaggggctgtgggacctaggtcggggagccagccctgcacaaatgcagcccaggcttgagccagggaggtggaggctgcagtaagctgtcatcacaccactgctctccagcttgggtgacaaaacaagacccactctcaaaaaaaaagaggaaacacacattttttaaaaagccggggacggggccaggcgtggtggctcatgcctgtaatcccagcactttgggaggccgaggcaggtggatcacctgaggtcaggagttcaagaccagcctggccaacatgggaaacctcatctttactgaaaatacaaaaattagccgggcttggtggcaggtgcctgtagtcccagctactcaggaggctgaggcagatgaatcacttgaacccaggagatggaggttgcagtgagccaaggtcacgccactatactccagcctgggcaacagtgtgagactctgtctcaaaaaaaaagaggatgacagagcaggatctgaggggttgaggggagctgggggctgccactagagccaggataggccgagacactgggatgggcagcctttggactgtcccaggcgggccctcccaaagcagggggtgattgcatagactggcatggacaggggcatgcaggcaggaggaggaaggggcagggccttggccgggtgctacctgtcccccggtggcacttggcaccatgtgtgccccccaggaggagctgcagcatcgacaggtctccgggcgctggctcactgggctccccggcctcccagcgcaaggacctgggtcgctctgagtccctccgcgtagtctgccggccacaccgcatcttccggccgtcggacctcatccacggggaggtgctgggcaagggctgcttcggccaggctatcaaggtacagagcatgccagggtctcaggggacagtctgggtgggacccctccatcctccttccttcccagtctatggaaacacagtggaaggggtatctggcttccagactccctggccagtgccctctcctcccttggcctcctggagctaattaggaacaggggacctcctacaggtagactgagaccttatgtgcgggaggtcattgaaaggtggctcctagccaggcacagtagtttatccctgtaatcccagcaccatgagaggctaaggctgtaggatcgcttgagcccaggaattcaagaccagccttgacatcatctctacaaaaaatttaaaaattaattgggtatagtggtgcatgcctgtggtcccagctacttgggaggcttaggcaggaggattgtgagccaggagttcaaggctgcagtgagctatgatcatgccacagcactccagcctgggcaatagagcaagaccccatctcaaaaaaaaaaaaaaaaagacaagggattaatacatcccatccacttgggtatttgggaacatcccatgcacagcctagagtatgaagccatctgcacatctccctggcagtcctggggtggagatggggcttcctagaaggcgggcttacagcagagcttctgtcttcacacctctgtgtcccacacgcaggtgacacaccgtgagacaggtgaggtgatggtgatgaaggagctgatccggttcgacgaggagacccagaggacgttcctcaaggaggtcagtgagcggaatgccctcttccctccagagggacttccaggtgctcacccctgccccatcaacacaggtcggaaaagggctctgggaaccattgaaagaagagcgagcaggccaggcatagtggctcacgcctgtaatcccaacactttgggaggttaaggagagaggatactttgagaccaacctgggcaacatagcaagaccccgtctctacaaaaaaattttaaattaaccgagcttggcaatgtgcacctgtcatcccagctactcggggggctgaggtgggaggctcgcttgagcccaggagttggaggctgcaatgagccatgatcgcaccactgcactccagcctggggaacaaggcaagaccctgtgtccaaaaaaaataaaagtaactgcattggtcgggcatagtggctcacgcctgtaatcccagcactttgggaggctgagccgggcggatcacctgaggtcaggagttcgagactaccctggccaacatggcaaaaccccgtctctactaaaaatacaaaaattagcccagcatgatggtggtgagtgcctgtcatccaggctactcaggaggctgaggcaggagaatttcttgaactcaggaggcggaggttgcagtgagccaagatcgtgccgctgccctccagcctgggcgacagagtgagactccttctcaaaaaaaaaaaaaagaaaagaaaaaagaaagtaactgcaggcaggggactgggaaaaagagcatcgctgggggtgggggcagctcaagcagagggcacaggacgccagagggtgtggcagaggcaggagaggggagctgggggttccgtatctttgagaccgcctacagcccctggtgggatggaaaagggagaagcagacccaagcacagctgggaccacacagagcccgggcccagcctgtttgtgccccgccaggtgaaggtcatgcgatgcctggaacaccccaacgtgctcaagttcatcggggtgctctacaaggacaagaggctcaacttcatcactgagtacatcaagggcggcacgctccggggcatcatcaagagcatggtgagtcctgggcagagccagccacccccgctgtgcggccccgggcaaagcagctccctctgtgagcctcagtctcatctcttcaatggggggaagccacaggggtctcaaaggccctctgaaccctgattcctaatcaaaaaggggagcgactgactccatctaaagctaggaaaggccaggtacaatggtgcacacctgttattctggcactttgggagcccaaggcaagaggatcactcgaggccaggaattcaaggctgcagtgagctgtgatctcaccactgcactccagcctggaccacacagcaagaccctatctcaaaaactaaaataaaattcagagctttccttaaggatttgaataaaattacaaatccatctttagaaataaagtgctcaggccaggtgcagtggctcatgcctataatctcagcactttcagaggctgaggccagcagatcacctgaggtcaggagtccaagaccagcctggccaacatggtgaaaccccgtctctactaaaaatacaaaaattagctgggcctggtggcaggcacctgtaatcccagcactttgggagactgaggttggcagatcacctgaggtcaggagttcgagaccatcctggtaacccgtctctactaaaaatacaaaaaattagccgggcaaggtggcaggtgcctgtagtcccagctactcgggagactgaagcaggagaatggcgttgaacccagggggcagagcctgcagtgagccaagatcgcaccactgcgctctagcctgggtgacagcgagattccgtctcaaaaaaaaagcacttggaggaagcctcacagagtcctgtgctggaccacaccctggggatccagtcctggcctccagccccatttctgtaccaccctgagaccatgggatcttcctcaggttggattaccttgtatccaaggtgtggaccctatgggctcctgctaggtgtaacttgacacaacgggttccgttgtcaggtgcaatttagaaactctgggctaggccaagcgcagtggctcacacctgaattcccaaactttggaaggccgaggcaggagggtcactagaggtcaggaggtcaagaccagcttggacaacataatgagatcccaatcccatctctacaaaaaaaattaaaaaattagccaaatgtggtgacacatgcctgtggttccagctccacaggaggctgaggcagaaggatcacttgagcacaggaggtcgaggctgcactccagcctgggtgatagagtgagaccctgtctcaataaaaaataaagatctccaaggggatgaggtttgagaatgaggcgtctcccccaaatgatttgagcccaaagccccgttctcctggcatggctcagtgctgccactgcgcaggtgaccttgctgggcccttctacctcttacctgtctgtgaaagtaggttctaattttttaaaaacctagaaagatgagttttttgtttttgtttttgtttttcccgagatggagttttgctcttactgtccagcctgaagtgcaatggcgtgatctcggctcactgcaacctccacctcccaggttcaatcgattctgcctcagcctcccgagtagctgggattacaggagcccaccaccacacccggctaatttttgcgtttttagtagagacagggtttcaccatgttggtcaggctggtctcaaactcctgacctcgtgatccaaccactctgacctcccaaagtgttgggattacaggcgtgagccaccacacctgacagaaagatgagattttatagaaaataaatatagcttgttttctcagaggaggcagattgggagctatagaggaatatccctgcttagagtttgaaatcagttctgttaggaaataatgtttgtaggggccgggtgcggtggctcacgcctgtaatgccagcactttgggaggctgaggcaggtggatcacttgaggttaggagtttgagaacagcctggccaacatggtgaaaccctgtctctactaaaactacaaaaattagctgggtttggtggtggacacctgtaatcccagctacttgggaggctgaggcgagagaattgcttgaggccgggtgcagtggctcatgcctgtaatcccaacactgggaggccaaggtgggcagatcacctgaggtaaggagttcaagaccagcctgaccaacatggtgaaaccccgtctctactaaaaatacaaaaaattagctgggtgtggtggcgcatgcccatagtcccagctactcaggaggctgagacacaagaatcacttgagccccggaggcgaaggttgtagggagctgagatggtaccactgcactccaccctgggtgacagagtgagactccatctaaagaaaaaaaaaaaaggaaataatgtctgtgagctgtgttgactcatactccttagaagcagacagttgtgggtgcccgaagaaatcggggtgttggggagcccagggaccctctaggacgcttgcctcttcctgcctctgtctcatgcaaccatccctgccatcggggcccccaccggccccaccctggccattctttctccatcccaggacagccagtacccatggagccagagagtgagctttgccaaggacatcgcatcagggatggtgagtgagccgggtgctctagctccattcataatcccaccaggaatttgcaaacagaacccacaaagaagctttgaaagagggcagagggggtcgatgggagagtgggaagaatcgtcccgactggcctgattggggtgggagcagagggagttcctggggagccaggatgggctggggtccctctgcacagctgccccctgactcccgtgtccccgtccctaggcctacctccactccatgaacatcatccaccgagacctcaactcccacaactgcctggtccgcgaggtgagtaccagggccccacgtggctgggtgtcaggagacagcaggagcccatccaaccccagcctcagggccttcccagaactggaggcccctccatgttgcctccatgacttcaatttgaggtgggggtggggggcagcagcccgtggggaagagcgcagggtcaggaggcagacagacctgggtttgagtcctgtctctgccactgactcatggtggaccatcagagtcccaggctggtaggagggtctcataaatcaatgaaggagaaagtgacatgtaagctacaaaggaccaggaccgtggtcttcatagagcacagcccatggcagagtggccatgggctacaccagacagcaccagcatctgggggccacagagtgggggcataggcgtatgggctggagtggtcagggcaggcttcctgaaagaggaggcttggccagacacagtggctcacacctgtaatcccagcactttgggaggccgaggcaggcggatcacgaggtcaggagatcgagaccgtcctggctaacatgggcactgtggctcacacctacaatcccaacactttgggaggccgaggtgggtggatcacttgaagccaggagttcaagaccagcctggccaacatggctaacacggtgaaaccccatctctactaaaaatataaaaaattagccgggcgtggtggcaggtgcctgtagtcccaactacttgggaggctgaagcaggagaatggtgtgaacccgggaggcggaacttgcagtgagccaagatcgcgccaccgcactccagcctgggtgacagagcgagactccatctcaaaaaaaaaaagaggaggctttaggtggatatttaagcaggggacgggcaggcaaagagcccagtgtctaaggattgtcaagggaggagagcccggttctccaccaaaagcacaggagcgagtaaccatgcccatctggagaggtggtgtattcgtgtcctggggctgccatcatgaagtactgtgaaccagatggctcaaaacaacagaaatgtgctgggcacagtggctcacacctaaaatcccagcaatttgggaggccaaggcaggtggattgcttgagctcaggagtttgagaccagcctgggcaacattacgaaagcccatctctgccaaaaatacaaaacggaatagccagccgtggtggcataagcctatggtcccaactacctgggaggctgaggtgggaggatcacttgagcctgggaggtagaggttgcagtgagccaagattgtgctactctactccagcctgggagacagagccagaccctgtctcaaaaaaacaaaacaaaacaaggccaggcactgtggctcacgcctgtaatcccagcactttgggaggccgaagtgggtggatcacttgaagccaggagttcaagaccagcctggccaacatggcaaaaccctgtttctactaaaaattcaaaaattagcaggcatggtggcgcatgcctgtaatcccagctactcgggaggctgaggcaggagaattgcttgaacccaggaggcagaggttgtagtgagctgagattatgccactgcactccagcctgggtgatagagtcagacaccgtctcaaaaaaaaaaaagcatcacatggcaagaggggctgacaagagacccccaaactgaccattatacagacccactcttgtgataactaacctggtccctcaataacccattaatctgttaattcatacagagccctcatgacccaatcacctcttacaggccctgcctcttaataccgttagagtcaggccaggcatggtgacatgggcctgtagtcccagctagttggaaggctaggtgggaggatcccttgagtccaggaggtaaatgttacagtgagctctgattgtgtcactgcactccagcctgggcaacagagcgagcccctgtttttaaaacagcaacaagccaggcacagtggctcacgcctgtaatcccaacactttgggagactgaggcaggcagatcacttgaggtcaggagttcaagaccagcctcaccaacacagtgagacccctctctactaaaaatacaaaaattagctgggcgtggtggtgggtgcctgtagtctcagctactcatgagactgaggcagaattgcttgaacccgggaggtggaggttgctgtgagccgagatcacgtcactgcactccagcaacagagtgggactccatctcaaaaaaaataaaaaataacagagatctgtgttggcttacacctgtaatcccagcactttgggagtccaaggtgggcagattgcttgagcccaggagtttgagaccagccaggcaacatggcaaaaaaataaaaaaatttgtctctacaaaaaaattaaaaaattagctggcatggtggtgagtatctatagtaccagctactcaggaggtggaggtgggaggatcgcttgagcctgggaagttgaggctgcaatgagctgtgttcgtgccactgcactccagcctgggccacgggagggagactctgcctcaaaaaaaaaaaaaaaaaatcaaacccgaaaagcaaaaaacatagacctcacctgcttattgggaatattcaagataaaattaggccaggcacggtggctcacgcctgtaatcccagcactttgggaggccgacgtgggcggatcacgaggtcaggagatcgagaccatcctggctaacacggtgaaaccccgtctctactaaaaatacaaaaaattagctgggcatggtggcaggcgcctgtagtcccagctacttgggaggctgaggcaggagaatggcgtgaacctgggaggcagagcttgcagtgagctgagatcgtgccactgcacttcaacctgggcaatagagcaagactccaactcaaaaaaaaaaaaaaaaagataaaattgggccaggtatggtggcttactcctgtaatcccagcactttgaaaggctgaggcaggtggaccacttgaggccagaagttgaagaccagtctgggcaacatagcaagaccctatctcaatcagtcaatcaacctaaataaatagtaaatctggtggcatgccaagcacaggacctgggtctataatcaaaattcctgtcttgatgggcacagtggctcacacctgtaatcccagcactttggtaggccacagtgggtggatcacctgagatcaggagttcgaaacctgcctagccaagtatggtgaaacccgtctttactaaaaatacaaaaattagccaggcatggtggcaggcgcctgtaatcccagctactcgggagggtgaggcaggagaatcgcttgaacctgggaggcggaggttgcagtgagccgagatcatgccactgcgctccagcctgggtgacagagcaagactccgtctgaaaaaaaaaacaaaagaattcctgtcttctctccgaaacaaagcagcatcagtgcccccgcaggtgggagggagcgcttgcaggagggagcagtgggtccgccacgacggtctggggagcaggtggggagggggcagagggtgcagcgtgtggtgggagggaggaagccacactgctatcttcaggtgcttcccgcagctccatttgcaaagagcggatgggtttggggaaggaaggggtccccaccctgtgccaatacagcgtatcagaggtatgttctctgggctgtctacgggttggcttggggtcctggggaggggcaggccaagcgggcagtactaggatcgggtcccagcatgacccggcttcaccttcccagaacaagaatgtggtggtggctgacttcgggctggcgcgtctcatggtggacgagaagactcagcctgagggcctgcggagcctcaagaagccagaccgcaagaagcgctacaccgtggtgggcaacccctactggatggcacctgagatgatcaacggtgagtggttcagccctgcccatcatggccctcacgggaagccatgggggagcccaggagagctgtaacctcccaagcccctggcccctcccagcctccttggctcttcagttaccctgtgggtcctgttgctcctataacacacttagtggcagccaggcacggtggctcacgcctgtaatcccagcactttgggaggctgaggtgagtggatcacctgaggtcagtagttggagaccagcctagccaacatggtgaaacccccattctttactaaaaatacaaaaattagctgggcatggtggcgggtgcctgtaatcccagctactagggaagctgaggcaggagaatcgcttgaacctgggaggcagaggttgcagtgagccgagatcgcgccattgcactccagcctgggtgacgagcgaaactccatctcaaaaaataaataaatagaagacacttagtggcttaaataaatgatcatacagttctggagtctgaagtccagcgtcagcctcaccgggctgaaatcaaggcgccggtagggtgagctccttctgcaggctccggggcacctgtttcctgaccttttctggctcgtggaggcttcctcattcctcctgttgctgccccctcctctgtcttcagggctggctgcaaagcatcttctcttctctgatctctgcatccatccccgcatctctttccctggctctaaccttcctcctttttttttttttttttaaagagggtctcgctctgttactcaggctggagtgcagtggtgccaccatagctcactgcagcctcaaccttctgggctcaaactgtcatcccaccccagcctcctgaatagctgggaccacaggcatgcaacaccacacccagctaatttttttattttttattttttatttttttttgagacagagtctcgctgtgtctcccaggctagagtgcagtggcgtgatctcagctcactgcaagctccgcctcctgggttcacgccattctcctgcctcagcctcccgagtagctgggactacaggcgcccgccaacacgcctggctaattttttgtatttttagtagaaacggggtttcaccgtgttagccaagatggtgtcgatctcctgacctcgtgatccgcccgtctcggcctcccaaagtgctgggattacaggcgtgagccaccgcgcctggccaattttttaaatttttaatagagacgggggtatcactatgttgcccaggctggtctcaaactcctggcttcaggcgatcctcctgccttgacctttcaaagtgctgggattccaggcatgagccaccatggccctccatccttctgatagggacccttacggtgacattgggcccacctggataatccaaaagcagccctccatctcaagaccctcaacttaatcccatctgcagagtccgatggaaggtgggacgtatacaagtcccagggatcaggacgcagtcatctttggggatcatagttctgcctcccacagggtctgcttccctcagtccatttctttgctgtcaatggtcctatatatgcccagattataggttataaagtccttctacaagcaggtgacacatgaacacaggttcagggcaggcagaccccagccatcacctcatcatagttaacctagttaaattagcctggcatgtggcgtggtgcctaatgcctgtggtcccagctactcaggaagccaaagcgggagatttacttgagccaaggagatcaaggctgcagtgagctatgatcataccactgccttctagcctgggcaacggagtgagaccctgtctcaagaaaacaaaaaataggccaggcacagtggctcacacctgtaattccagcactttgggaggctgaagcaggcggattgcttgaggccaggagttcgagaccagcctggccaacatggtgaaacgctgtctctactgaaaatacaaaaattacccgggtgtggtggcacagctactagggaggctgaggcaggagaatcacttgaacccaggagcagaggttacattgggccaagattgcaccactgcactccagcctgggcaacagaggaagactgtgtctcaaaaagaaaaaaaaaaaaaccttcctgtaatcccagcactttgggaggctgaggtgggcggatcacgaggtcaagagattgagaccatcctggtcaacatgatgaaaccccatctctactaaaaatacaaaaaaattagctgggcgtggttgcacgcgtctgtagtcccagctacccgggaggctggggcaggagaatgatgtgaacccaggaggcggagcttgcagtgagccgagatcgcaccactgtactccagcctgacgacagagtgggactctgtgtcaaacacacacacacacacacacacacacacacacacacacacacacacacacagagttaacatagcccgcaaagaagactataaaacagtcttagtggccgggcgcagtggttcacgcttgtaatcccagcactttgggaggccgaggcaggtggatcatgaggtcaggagtttgagaccagcctggccaacacagtgaaaccccatctctactaaaaatacaaaaattagctggacatggtttcgggcgcccgtaatcccagctactcaggaggctgaggcaggagagttgcttgaacccaggaggcagaggcaggagagttgcttgaacccaggaggcagaggttgcagtgggcgacagagcaagactctgtctcaaaaaacaaaaaagtcttagtgtttcctatgtttagggattagtgtgaggattaaaggttgtaaactcatttccacctagttggcattcagtaaatgagaattgacatttagtactaattgtttcgggtattttgttttttgttttttgttttttgttttttctgagaccgagtcttgctctgtcatccaggctagaatgcatggtgcgatctcggctcactgcaagctccgcctcccgggttcacaccattctcctgcctcagcctcccacgtagctgggactacaggcgcccgccaccacgcctggctaattttttgtatttttagtagagacggggtttcaccatgatctcgatctcctgacctcgtgatccacccgcctcagcctcccaaagtgctgggattacaggtgtgagccaccgtgcccggccagttttttgtttttgagatggagtcttgcattgtcacccaggctggagtacagtggcgtgatctcggctcactgcaacctccacctcctgggttcaagtgattctcctgcctcagtttccctagtagctgggattacaggcacctgccaccatgcctggctaatttttctatttttagtagagatggggtttcaccatgttggccaggctgatcttgaactcctgacctcaggtgatccacccgcctcggcctcccaaagtgctgggattacaggtgtgaaccactgtgcccggccatgtaccgattatttttaacatcattaagtagctggtatcattcccattttacaataaggaaactgaggctcagagagtctgtgtcagtttcctgaggttgctgtaataaattgttagaaacttgattatttaaaacagcagaaaatggtcaggcacagtggctcacacctgtaatcccagcactttgggaggccgaggcgggcagatcactggaggtcaggagttcgagaccagcctggccaacatggtgaaacaccatctctactaaaagtacaaaaattagctgggcatggtggcaggcgcctgtaatcccagctactcgggaaattgaggcaggagaatcgcttgaacccaggaggcagaggttgcagtgagccacaatcgtaccactgcactcttgcctggacaacaaagcaagactccatctcaagataaaataaacagcagaaatttattccctcttagttttggaagccagaaggttgaaatccaacagggctgcgctccctccagggcgatctaggggagaatgcattccttgcctcttccaccttctggttgttttgcattcctgggcttgtggccgcatcactccagtctccacccctgtcttcacagggccacctcctcctcttctgctgtgtcttctctgtgtctctctcaagagggcatttgcagtggcatttggggcccacccagatcatccagcatcatctcatctccagatccttaacttaatcccatctgcaaaagaccctttttctgacccagtaacattcacagattccagagacctgacatggttcccttttgggaccagcacagagttcatgacttgtgcaaagtcacgcagctgatcggtgcctcgaactccttgtccagggctctgccccttgctcctcagagctcccaaaggcttgctcagacctggtggggttgggggaaagagcctaagcctgggttcccatagaggttgccggcatctgcctcctgggcctggacctcccggccggggcatcctcccagctggcctggtcccctgccttttggcatccctggcacccccatgtgttcatctgctgacagtcggtctctttatccaggccgcagctatgatgagaaggtggatgtgttctcctttgggatcgtcctgtgcgaggtaggtccagggttgggtagcagcggtgttgaggcctgggctcctccccactcacccaggctgcaggctcagcatctgcaggggcctcatgccaggaagcctgcccacagcaaggcatgggctggcccccatggggtactgcagtcaggctgcagccaggcccagtgccacctgccctcaaaccacctggatggcacccagatgcccaggctgagggccccctggagtaactgccgggccttgtactggacagatcatcgggcgggtgaacgcagaccctgactacctgccccgcaccatggactttggcctcaacgtgcgaggattcctggaccgctactgccccccaaactgccccccgagcttcttccccatcaccgtgcgctgttgcgatctggaccccgagaagaggtgagtggggtggggccctggcctgggagacggtggggccgattcccgggacagccagacccaccgttccccacccacctgtcacccaggccatcctttgtgaagctggaacactggctggagaccctccgcatgcacctggccggccacctgccactgggcccacagctggagcagctggacagaggtttctgggagacctaccggcgcggcgagagcggactgcctgcccaccctgaggtccccgactgagccagggccactcagctgcccctgtccccacctctggagaatccacccccaccagattcctccgcgggaggtggccctcagctgggacagtggggacccaggcttctcctcagagccaggccctgacttgccttctcccaccccgtggaccgcttcccctgccttctctctgccgtggcccagagccggcccagctgcacacacacaccatgctctcgccctgctgtaacctctgtcttggcagggctgtcccctcttgcttctccttgcatgagctggagggcctgtgtgagttacgcccctttccacacgccgctgccccagcaaccctgttcacgctccacctgtctggtccatagctccctggaggctgggccaggaggcagcctccgaaccatgccccatataacgcttgggtgcgtgggagggcgcacatcagggcagaggccaagttccaggtgtctgtgttcccaggaaccaaatggggagtctggggcccgttttccccccagggggtgtctaggtagcaacaggtatcgaggactctccaaacccccaaagcagagagagggctgatcccatggggcggaggtccccagtggctgagcaaacagccccttctctcgctttgggtcttttttttgtttctttcttaaagccactttagtgagaagcaggtaccaagcctcagggtgaagggggtcccttgagggagcgtggagctgcggtgccctggccggcgatggggaggagccggctccggcagtgagaggataggcacagtggaccgggcaggtgtccaccagcagctcagcccctgcagtcatctcagagccccttcccgggcctctcccccaaggctccctgcccctcctcatgcccctctgtcctctgcgttttttctgtgtaatctattttttaagaagagtttgtattattttttcatacggctgcagcagcagctgccaggggcttgggattttatttttgtggcgggcgggggtgggagggccattttgtcactttgcctcagttgagcatctaggaagtattaaaactgtgaagctttctcagtgcactttgaacctggaaaacaatcccaacaggcccgtgggaccatgacttagggaggtgggacccacccacccccatccaggaaccgtgacgtccaaggaaccaaacccagacgcagaacaataaaataaattccgtactccccacccaggtcctgcgtggcgatgtgtgtctggggccctggggaaatagtcaaggtaagaggagttagtcttccctgaccagaagacaaggatgagtgtggtggctcatgcctgtgatcccagcactctgggaggctgagacaggacgatcccttaagcccaggagttcaagaccagtctggacaacatagtgagatcctgtctctacaaaaatttttttttaattagttgggcagaggccaggtgtggtggctcatgcctgtaatcccagcactttgggaggcagaggcgggtggatcacctgaagttaggagttcaagaccagtctggccaacatggtgaaaactcgtctctactaaaaatacaaaaattagccgggcgtggtggcacatgcctgtagtcctagctacttgggagactgaggcaggagaatcgcttgaacccgaaaggcagaggttgcagtgagccgaggtggtgccattccactccagcctgggaaagagcgagactttgtctccaaaaaaaaaaaaaaaaaaaattggcaggccaggcacagtggctcacacctgtaatcccagccctctgggaggccgaggcaggaggatctcctgaggtcaggagtttgagaacagcctgactgacatagtgaaaccccatctctactaacaatacaaaattagccaggtgtgatggcacatgcctgaaatcccagctacttggggggttgaggcaggagaattgcttgaacccaggaggcagaggttgcagtgagccgagattgcaccattgcaccccagcctgggcaacaagagcgaaactccatctcaaaaaaaaaaaaaaaaattagttgggcatggtggcatgcacctatagtcccagctactcaggaggctgaggtgggaggatcctttgagcccaagagatcaaggctgcagtgagccatgtttgcaccactgcactccagcctgggcaacaaaacaagactctgtctcaaaaaaaaaaaaaaaaaaaaaaaggcagggatggaggggggaagagaacacagcccagttttaggtggagctgaggtggtggcccagccaggacaagtgaagagtcttcagaggctgggtttggagggccgtgcatattccggaggtactgctttcatacttaaatgttttcttgtaaaactcacacctgtaatcccagcactttgggaggccaaggtgggcggatcatctgaggtcgggggttcaagaccaacctgaccaacatggagaaaccccgtctactaaaaatacaaaaaattagccaggtgtggtgacacatgcctgtaatcccagctactcgggaggctgaggtaggagaattgcttgaacctgggaggcggaagttgtggtgagctgagatcgtgccattacacttcagcctgggcaacaagagcaaaactccatctcaaacaaaactaaactaaactaaactaaagggttctatcgagaagatgggctgcacgtgatggctcacacctagactcccagcgcttcaggaggccgaggtggaaggatcacttgaggccaggagttcaagatctgcctgggcaacatagcaagaccctgtttttacccaaaaaataaaaaaattacccagatgctgtggtgtgtgcctgtagtaccagctactgagaggctgaggcaggaggaccgcttgagcctgggaggtcaaggctgcagtgagctgtgatcgtgccactgcactccagcctgggtgacacagcaagaccttgtctcaaaaataaataaaacattttaaaaacacactaggtattgcaaatacagggcatttaatttggttttttgtttctgttttgttgttgttttgagacaggtctcactctgtcacccaggctggacagcagtggcacagtcatggctcactgcagcctcaacatcccagggttgagtaatcctcccacctcagcttctcaggtagctgactatagatacacgccactacaccaagttaatt

SEQ ID NO: 17318 - DNA, 42693 bp, Human; identical to SEQ ID NO: 17317

SEQ ID NO: 17319 - DNA, 21862 bp, Human
gggatccagtctcacctactttttctaccagaactggtatcagctcatgctctgccttatgcaaattaagaaaatatcataccttttgggtaaattaagccaagaaagttctcctttcttctctttctctctttctttctttctctctttctctttctttctttctctctctctttctttctttctttctttctttctttctttctttctttctttctttctttctttctttctttctttctttttctttctgacagggtcttgctctattgcctaggctggagtgcagtggtgcaatctcagctcactgcagccttgaactccagggctcaagcaatcctcctgagtagctgggactataggcatgtgccacaacatcaagctaatttttgcatttttttgtggagacgggatctccctatgttgctaaggctggtcttggattcctgggcttatgcgattctcctgcctcagcctcccaaagtcctgggattacaggcatgagccactgcccctggccattataactattttcattggcttatcaggcacatgataactataataaatcaataaccagaatttttaaataaagaaaggaaggaattgtttcaactcttcctgctacccctctatccctcaaaagggtaggctgaatgttgtcctccaaagatatccatgtcctaatccccagaacctgtaaatatattaccttatatgacaaaagggactttacatgtttaataagttaagaattttgagatgggcagattttcctgaattttgcagatgggccctagtgtaatcacaagggtccttataagagacaggcagaagagtcagaataagagaaaaatacttcaagatgttacactgctggctttaaggtggaggaaaggccaagagccaaaaaatgcagtggtcactacaagctgaaaagaaaaagaaatggattttcccctaaagcctctggagggggcacaaccttgccaataccttgattttggctcagtgaaacccattttggacttctgacctttagaactgtaaataaataaataattttgtgttgtttcaagccatcacagttgtggtaatttactacaacagcaataaaatagaattaaatacagagatctgaggagttgagtaggataagcctactccagcaggttatttcgggagtatggtgagactcactaggatggcggaactcaattaaggaagtctgaagctgataagccagagagggaaggctctcacttcattttataagggttgcgtcacactaggaagatccaatagcaaccacagtctcaaaattaatgattacaaataggacacaattccaagagtcgggagccaagcagaaaatggattagggaagacatggatgatatgaaacaggaaggaggggtacaaggcagcttcctgggaagttgccagggcagtcacagttcacattcattaggctgtgggcaccaaatgcatatggaaaatctagctgacttaactgaactcctgaagaggaatgaacacctcatttattgaggagctactaccaattagaatatgtatttcatttgttcaataaccccatgagtacagtaacacaatccttgctttactaaagcggaagccaattcaaagaggttcagtgacttgtccaagctcagggaaaacactaggaagtgaatatgggtctgactccatcactgatttcaggagccctgccctttcctccacaccatgcccccttgctttcagaaaaaaaggcttgttgactgaatggttgtatgcacagttcaaagcagaaacacacgatgacatcttttgagatactctaacagtgagaacttgaaaatgaagttaaaaattaagcggcaaaaccaagccgaggctttctgagaaagtggggccaaacctgttgccgtctgactgccacgtggctcactatttatccctgtaaaaatctgcaaaagtatttgaaagggaagaagggacagaaaactccctccttttccaagttagccttatagtctagggcttaaaatactggtttaatggtgaaggtaagtgcttttcttctttttgggtagaaggattattactaacttaccaaaggtccattaaggggagggaacagttttaggagaagtcagagaaaagacattaacagcaacataaggatctccatctggtaatattgcctaattccaaaatgaagagactctctgaaaaagataactgattcaatgaagaccctagggcaaggcttgagaagccactggtaccaatggacactgtggacaatggtcatttctccaaggacgctgtgagtattaactgtgatgctgtgattagtcagactgggattggctgtggaatgaaatactgatcagaactgacaagatttgtgtttgggactgtggctaacgagtcttttcagacttctatatgaatttgaaatggtctctcaggaaaaggagaacatggccgggcctggtggctcacgcctgtaatcccagcactttggcaggctgaggcgggcagatcacttgaggtcaggagtttgagaccagcctggccaacatggtgaaaccctgtctccactaaaaatacaaaaattagcagggcgtagcggcgcgtgcacctatgcgcatgcatagtgcgcgtgccagctattcagaaggctgaggcaggagaattgcttgaacccaggacgtagaggttgcagtagttgagatcataccactgcactccagcctaggtgacagagtaagactctgtctcaaaaaaataataataataaaagaaaaggagaacatgaccaaagttatgaataagactgaaggcaagaaaattgtacgcttgtagagatcacctagcttgttgccctcattgtacagctaagaaaaggcacccagggacattgtggtcagcaccaatttctcagaaagataggcagatgatgagagggccctcagtttttctaacactgaaggaattgcttctatgttttctggtgaactcctccccactcatcttgaggattccaggccagaagaatccactttaaaaaagaaacatttaaaaccaatttaacaaccaatcaaaggcacttttatagaaatacatttcatttgctgtaggcctgtatttatggatctgagagggctagactgccaatattgtgactgtttattattattgctgttgctagtatctagaatattatacaacatataacactttgcaatttacgaggcatgtctcatacttttgttttcactccaaactgcccagtgaagtaacattatcccaattcttcctatgaaacagtgaaagccctaagagtttttgaaactttacctggtttactcaatttgggaatggcagagcagaattcagtccttgaatatcctcccactgcaggttcatgctctttgatctaggtgtaacatttactctgagtaaactaggactctgggctaacagagatgaagcaagacaggctggatattaggagaatctaagagcaatctaacgaccattataataaaatcatgagttctagacttaaaaaaagggaaaaacctgtttttttgcttatgcgtataccataatatttacattatttatttttttctcaaattcaacctatactgtgtcaagtaattttttttaatataacattttcctttaacttaatttcaattcatttttctgtgtctacttacaactttggcactagaattcacaatttttttttagaggtatatctccttaaagggaagggttctgacactgttacatgttctcaattgtttgcaaataggttaataattattccagtgtctctaagtacatatcaaccatgccagtgttcagcctccataattttattagcttctgtgcttattttggaaaaacatttcccattaccatgaaagacctcagtttaggatggtttggtatgttagcctgatttctgcattcgtctcatgcaaaggaaaataggaaacgaagaactgaaattacctattgatacaaaatcaaagtagcatttgaaaccataaaacttaagtagggcttttcatcctttctcgttagacagcaacagagaatgggaagaaaaactaaagtgatgggtttgtgatacaattccagtaacataaagagcaaggagaagtagttttgttgtgtttatgtttaatattcaaagctcaacctaaaagtatttttcattatcaaacttccttctagaataaatgattaaaacttgatttaaaatatacaaattctcctttataatacctcaaaatggagctaccccattgagttttaagcttgtgattaaaatattacgaaaacaaaggggaagttgtaataggtagaacaagcagtagtctaggcattaggggatctggtgctggctctgtgcatcatgtggtttcaggcaacttttcaaattttctacgcaaattttcttatcaataaaataaacagttgggccagaggatctctgagtctctttcagctttcagtgtttataagattggagaagttggtgggaaagctttaagtggagtgtaagtaattgcagctgcatgtacagttaaagagttgccttcagccaagccacgggatcttgcataaaaagtgaaatcaaatagaaaatggtccaaactctgggtttgaccacagatgacttcagctaggatctgagtgtagagcaatgagctgaactcctgatatccagatgttagcaagacttggaggccttctaaggcagagcaacaaccagtatctgtcctggtgctgacctgatcttactagcaattgggcctccatttgggtccattgtacaaaacaacaacaacaacaacaataaaatctccaaacacccaaaattcaaaatttagatggagagatactattcccagaattctagagatatttggaaagcagaaaactatacttgccatgctgatgaagtccaattattgctcttttaaatacatttagctacttctgaatataaaatgagtatctactaattatttacaaaatcacttggtaaatatagaaagtcacaaagaatgaagtgatcatcctgttttgtaacccagaaatagtcattactggcacttgtgtgaatcagtttctattcctgtatgtggatgtgcacagcgtatcctgctttgtacactagagtactagcatttttctaatgtaattcaatattgtcgaaaacattttaaaatagcttccatcacaataatctatcaaattgacttgccagactctcattattaggttaatttatctctaacattatgcagtcatgagtaatactacaaaggatatttttggacacaatttttcatctatgcctttctttataatccttcatcctaaggtcacagattatgaatatctttaaagtacggacaagtcttttaaattttgtgtgcaaaaacagtgcaaagccttgaatgataaaatagaggtttgatatatgtgtttttttgtttgtttgttttgagacggattcctgctctgtcccccaagctgtagtgcagtggcacgatcttggctcactgcaacctttgcctcttgggttcaagcaattatcctgcctcagcctccttagtagcagggtctacaggcatgtgccaccacacccggctgtttttgtatttttagtagagatggggtttcaccatgttggccaggatgatctcgaacacctgacctcaagtgatccacccacctcagtctcccaaagtgctgggattacaggtgtgagccactgcacccggccgatacatgtgtttttaaagtcacagaaatttcagatgtcttgaaggattttaagcaatttaaaaaataaagtcatagaagcttcaatttaggaatgaatggaaaattgatgatattcttaggatatggatttttcctaaaagaaacaaatgtatgcatccccaaagataatttgattagtatacaaatattaaattaaacatgtccatatttagagccatgaattctctttgcctgtcacaatagctggatttattcacaattgtagtaattagtccctgttcattataattttctaggtgatatgaagactttgtcagtccaagcaagtgtccacattgtgtgtagcaaacatgagaataaacattttaaacttttaaatgtaatacatattagtgttatgtaatgtcatccttcatgttcgaaggcacatggaacattgttctggtggtacagaggggagagaaacaccatcagaatgaaaggaaagaccgctctggaaccttcctccttagctcttgagcttagtttaattgtcctgtcttatggtctgctacaagcaataccactcttcaccttcgcatgcttctctgtggtttgataaagtacatgcaatttttcatttaattcttccagctgcactaagaaaggagccttatctttattgaacagatgaggaaatgaatgattagagaatttaaatgactagctctaggtcacacagctggaacttacagccagatttccttttaacaatcctgtaaccaaaagcataccagtagtgccccataaaatgtaagttatagagctgtgttgggtcaaaacttttactgatgctaagaggaggcaacattaacaaggggaaattatttgtgtattatgttttggattatgttctctccatagataaaagactgtcgtagtaaaagagattcagggcacagggaaactccaccacaaagcgtggtaccatttcccacagaagctaaatggacgggaagcctgccaccaggaaaggtaaagccactgctcttgtttgcaggctatgttaataagctgaagcttattccgacacatttacacatctctgcatcacactgacccttcgtaaagatactcccagtgtaacattggagccagctccagcccctgatcctgttgctttttccttagccccatgaaatcatctgtgagaaattaagccaaataagcaataaatcctgggatctagggagtggaataagttttgggaaagtcttttttttttttttttttgactgagtcttgctctgtctcacaggctggagtgcagtggtgcgatctcggctcactgcaacctctgcctcccgggttcaagtgattctcctgcctcagcctcccgagtagcttggactacaggcacacaccaccatgcccagatgaatttttgtatttttagtagagatggagtttcgccgtgttagccaggatggtctcgatctcctgacctcgtgatccaccggcctcggcctcccaaagtgctgggattacaggcatgggccaccacgcctggcccgggaaagtcattttaaaccaacctatgtatgaatccctactataatattctcaccaagcggctggctctttctcctgagcttggaaacctccagtaaaatggaaataattatttcccagaccaccactcttatctgtgagcttttttggccattaaaaattatttcttccattatatttttatctgtgtcttcacaggttttctctttctttcactttagtgcttttcttcaaataagcaggaaaaatccaatctatcatgcacatgggaaccctttcaatattggtctgtggttgttccattttatggggatgcttttaaagaaaaaatttgtcctttcaatatattgaatatcttccagcaccacatcacctgcaagctttgtaaaaatagttctacatattaattttttttttttttttgagattgagtctcattctgtcacccaggctggagtacagtgacatgatcttggctcattgcaacctctgcctcctgggttcaagtgattctcctgactcagcctcccgagtagctgggattacaggcatgcatcaccatgcctgggtaatttttgtatttttagtagagatggggtttcaccatgttgaccaggctggtctcaaactcctgacctcaagtgatccacctgccttagcctcccaaaatgctgggactacaggcgtgagccactgcaccccacgtagtttttttttttttttaagttgaacatatgtgaaggcaggacctagtgacacatagcaataacatttccaagtagacattacactagggaattagtcgaagtgctcatttaaagtaccatctctcaaatgtattaaaagagaatccttggatgtgcaataccttaattcaaaggcagctcgttatgtataaactctcaagctttgtgataaacaaatgtgcataacagatgggactattcacttacagcccagggaattttattgacgctgagaaggttatgtgactggctctgccactgtcatccccattcacttcattttggagcaatatgacataaatgccttacatgtgggttttctctatttatcatgtgtttcctatccccttgaaagatggccatatttgctttacttggttataagatcccatattcgctgtcttgaagccaaccaaataatttgacaaagtgggtttgtagtgctggctattttggtgaaaaaaagacaatgagacttcatgtgtcatccaaagttctatcagatcgagctgtgagagaaaggaaaagaaaggggtctcagtcaggatgctcactacatacatctgtgttgttgtctaggtccagatttctgttcattacgctatgggctggctcttatcatgcacttctcaaacttcaccatgataacgcagcgtgtgagtctgagcattgcgatcatcgccatggtgaacaccactcagcagcaaggtctatctaatgcctccactgaggggcctgttgcagatgccttcaataactccagcatatccatcaaggaatttgatacaaaggtaagtatgatggaaaatagggctctttgttgagagaaaaaactttgaaaggaaggcatagatcttgattctgtggagtatggaagtatacatttccaatgacaaattaaaactgactggaactatttttctttgagacattgcttacttcaataataaaaataagatttcattgaggttattatgattataaggtgggggaactgtagagttaaatgtgaaaaatttaaaaatggaacagtttatgtgatgtcttcaatgaaaaactaggtattacctgggcacattcttataggttactcaatcctattcagttctctgcctgttttattgtttctgagcaattttatatccctgtaaattctatataaccaatagaaatgcaaacgattcttgtccatagctttgcaaataaattttgccaagagaaaaatcagttaaaacttttctccactcacctcccagttgaattagccaattttgctgtttgtttgtttgtttgttttttgagatagagtcttcctctgtcattcaggctggagtgcagtggcatgatctcagctcactgcagcctccgcctcccgggttcaagagattttcctgtctcggcctcccaagtagctgggagtaagggggcatgccaccgcggctggctaatttttgtatttttagtagagacagggtttcactaggctggtctcgaactcctgacctcaggtgatccacccgcctcggcctcccaaagtgttgggattacaggtgtgagccactgtgccaggctctgctgtatatttaaagtctatttcagcattgcttcctgcttgtgttatgcgtgattctttgagttttcctttgaaccagttataacatcttacttacttcctccattaatcaatgagttaaataaaatctttgttgtatgtttattttacatttatatgaaaaccatgaatttacccaattaaaaaaattatcctttaaattatcttgtactgtacatttcccatgtcatccctataattcatgattaatgattttattacattggacctagcttatttacaatgagtacataaatttattgtctccagtctttcctccattatcccgtctacatatccacactgagtagattcactactcaggaatcttggacaccttcaagttgccaaacatgcagtgttcactggacatgctgtgttccttcagaatttgggcctgcttctcagcacactcacatctgctatcaatgacccatggaaagtttttgccctgagcaagccagagtccctgttagtttcttccaaatgctacaagttcacttttgctattttttccgatgagataaaattttcctttttgactttctacaaatcatagtcatttttcaagggatagttcaagtattgcttcctttctgggaccttcccaaattattattttctcctctcaaagtctctgttttatttatgttcatcctcaaatcttgattctcacatgaatcatataccttgtattatttatagtttttttgagtgggtaaaatatttcatattttatattctttggctctctactttatagcatgatgccagatatttaggggccttattgcatttattttttattttattttaaaatctattttattttttatttatttattttaaaatctatttatttttaggtaaatattcaggtaatataatttatgtaattatttaggaattttaggtagttattttaaaataattcaaattatttattgagttatatcagaagaatgtgatcttattcatttgtaatatgtgttttaggaactcagttcagccagggcagaccataattcccaaacttgacttttctttttaattaggcactgattttggttaagagttcagtaaagttttgtgtgtgtgttttaaaaaattctttgatataagagtcaagatgttactcaacttttactagaagcaaaatagaggaagtgctttcacagatgaaatatctctcaatgttttcttccatttacttcttcctattattcatctatataatcattttctttacctcttttcttcatttcttctgtttttctctccttctactaagacaagcaaattaggggtataattggttatttgggaaggtaggaagaatatagagagaaacaaaaatcaatattttatactagggtctcactaacctcaagcaactctgactgtaaagtagattttcataataggacttcttgacaaagagttttcctatttttcccccaggcctctgtgtatcaatggagcccagaaactcagggtatcatctttagctccatcaactatgggataatactgactctgatcccaagtggatatttagcagggatatttggagcaaaaaaaatgcttggtgctggtttgctgatctcttcccttctcaccctctttacaccactggctgctgacttcggagtgattttggtcatcatggttcggacagtccagggcatggcccaggtatccagatactttctcattcttggtgggatccagatttctgaattctacaaaatatcaaaggtcttaatgattttcatttcagggaatggcatggacaggtcagtttactatttgggcaaagtgggctcctccacttgaacgaagcaagctcaccaccattgcaggatcaggtaagtgtgcacagatgggtcatagctttgtcatctgttccatcccactgtgtcttatcttctatgaatcaaatggtttggggaagagagagaaaaagtactgctgaaaaattcaacaatataagacacttgcatcacaaataggaaagatgcatctgtgcagtaaagacattgaagcttagaagtagaaaaaaccattgtgagctaggtttcagctcagaaaagccttagtagtcagaaaagccttagtagtcagaaaagccttgtcggaaaaagtttaaacctttaagaattgcacacatggaaaaagatcaagtaagctatatatacaccatcttagcaatgattttgaagtgagaattaaggctaccacagctccaggtggtaaggagagaaatcaggctggaagagtttgaagtttctgtattattctaagctctttactattctattatgagctcattaattctcacaacaaccctctcatataagtaccattttaaattcttattttacagagaagggagttaaggaaggtggagattaagaaaattgcccaaatacaaatagccagcaggtggtaggtctgagatttaagcccatgcagattttagccccagagcagacattctcaatcactatgctagactgcctttccatggtatgtgatcctactcaggcctctacagctttatcattgctgttctccccagcctgtcgtgctgagagtatatactcgaagagcagaactaaaattccatccagcttctcactcctaggtccactacacagctgcatcctgcagacttttacctcaagcaaccctcctgcgttcttgcttccttccatcatagttgtaaccatctcctctatttgcaaatactatctgctgatctctctcttctagactggtttctttcaaccttcttcccaccaaaaccaagttagcttgctaaaataaagatggcacatttttactcacccgcttgagaattttcaatgtgttccttcatgcttacagagtaaagcctgacctctttattgcatgaatacaaaagttcttagccatctggccccaaccttgttccactcaactcccctgtgcaagcatggctccagtggcactggacattggctgctctccacatagatctgcactgcacttccctctggctctgctcccgttagtttatatgcctggaaagttctttgcccctgttccttgtgccaaaattccatctatcctattgcatagcttatgtaaaaacttcctaaaccttttttttttttttttttttttttttttgagacggtgtctcactctttcgcccaggccggactgcagtagcgctatctcggctcactgcaagctccgcctcccgggttcacgccattttcctgcctcagcctcccgagtagctgggactacaggcgcctgccaccatgaccggctaattttttgtatttttagtagagacggggtttcaagccaggatggtctcaatctcctgacctcgtgatccgcccgcctcggcctcccaaagtgctgggattacaggcgtgagccaccgcgcccggccaaaacttcctaaatcttataattattatcaatttatcctcagatatacttccacgtacattgtagttttattatatttatattttacatcttttttttcaaatttcagtttgggacccattagtgagtcataaaatccattgagcgggttaaaatcattattttaaaaaatgaatagaatagaatagaaattgttggagtgcattggacatggtaaagttaaatatcgattcatgaaaccatcgtttgaggcatatgtgtgtggttgtatgtacaagtgtttatgcatattggtgtgtgtgttatgttaccctgtaaaatgcatttcttactataggtctctgtgaaatatgtgtcttgttgttttttaatgtagacttccaaagcctacatggcatttcactagtgacaatcaattttattcacatttttctctccaattggaccagaagctctttgagggcaggggctgtatcttaccgatttttgtaagtctttcatttcctgcccctagcctcatattagatcatgcaagaatgcaactgtaatcacaagaaaatgctaatgggctgtgatagcagagagttactgtgacaaactaagggatttagatttggtcacattggtgttgaggagccattgaagaatcagagagtgtgttactattatttgttaattttaattatatcatattactttactggggaaaatctgtgagctattttagaaataaatactctcattgcccaataattctaagtctgccacctcactgttgggacattgtttagggaggccacgaagtctcagcctttgatattttcataagtgtttttctccctttttcctttagggtcagcatttggatccttcatcatcctctgtgtggggggactaatctcacaggccttgagctggccttttatcttctacatctttggtgagtcactttctcttaaatcctaacgcctccatttcctgagcatccattttggcacctacaccacccacattcttcctatatgaaagaaaatgtcctttatcaaatggaagatgataaaaaatgtcaacggttggtatcatttttaatctagtcacacaacctgattaacaccttcctggtggttctgggaagccacacgcacaaggtagaggagttgactattcacatggcacccaccgacttgtgatgcagtcttgtccttccatatcaagcaccttctgcagaatctctaccaccacatctgaagtgcctgctatatgcagttaagatgtcaaagatagtgaagtacattttcaatgtgtcttcatatttcattataattattatttctgtccaagatgcctttcacctgttctctaccaagttaatcttgcaaagttcaattcaaatgttcccttccccatgggcccttccagggcttaccctatcagattctggcattctctcctttatgatatttcctctctaggttatgttggtgtgtaattatttatttctccttttctttccactagactgtgaaatgcttgaggcaaggaatccattctatgttttcatcacttgggtgtcatcatggtgcctgatttttagctttaaaataaaagaatcagtgaatccagtaattagaggggatttaaagaaaactagtcctcagaatcttttaacatagaatgttcttcaaataaggaattccaataataagacaattttctacacttgattttgtttttatagccaaatggtgtcattaaatatagtcctggcctgaatggctttctcattaatgatgctaattattttggtttgtacatgttaaccaggtattgtacaaaaatatttcttttgggaatccataatggatgtatggcttgaatacaaataatactgtctcttgtaagtgcattggaaatttttccctgccacatgatttcatggaaggttgtttcgtgtatgtatgactgcaaacctgactattcagatcttccgcaacaagacaacttatgtgtgcattaagaagttgctgcctaaaatacataacactgtaatcattggagactttaaagtaattaatcagctatgcaatgccacgctcctgttatctccagagggctctgacattgacaaatggtggctttctatttgagacgtaatatctaaaaagctttaacaggtttgtagaaggattgaaagaaagaatgggaacatttaggtccttatggtagaataagcattaattgattagtgtgtagaagggagaggcatgccacttcagaggaaacttccttcccccagtaaacaaatctacctaaaaactaattttatcccttcttcccaggtagcactggctgtgtctgctgtctcctatggttcacagtgatttatgatgaccccatgcatcacccgtgcataagtgttagggaaaaggagcacatcctgtcctcactggctcaacaggtacagtgcacaccttgtacctgtggcccatgcagaggtctctagggcagggtgtggatctcctctgagaggcaccatcttggctgctctaatactcatgctgattagatctttcttttcagcccagttctcctggacgagctgtccccataaaggcgatggtcacatgcctaccactttgggccattttcctgggttttttcagccatttctggttgtgcaccatcatcctaacatacctaccaacgtatatcagtactctgctccatgttaacatcagagatgtgagtttacttcctatacttctacgaaaatgataatggtaataaggagaaacagttctgtgttacctattacattctggctttacatataaccattaatttaaccttcacaatgaccttgagagaggcattgttataattcccttttcacagatgtggaaacaggacacttagaggtgagataacttgccccaggttgcacaatactaagtgatagagctgctgcagcatccatattcttaaccactatgctatactaccacaccagctgattccaaagcttcttttagaaataatattgctgggccaggcatggtggctcatgcctgtaattccagcactttgggaggccgaggcaggcagatcatgaggtcaggaatgcaagaccagcctgaccaatatggtttactaaatatcatctactaaaaatacaaaaattagccaggtgtggtggcaggcacctgtaatcccagctattcaggaggctgagacaggagaatcgcttgaacccaggaggtggaggttgcattgagccaagatcatgccactgcactccagcctgggcgacagagtaagactccgtttcaaaaacaaaaaacccaagaaattaatattgcttttatctggagcccagagtgatgcagcttctggccctcttatctgagacagtgttcttttagtgtgaaaaaggatgctaattttcccccaaacaacccacagtatcatgggggtaagttaatggctggtctgtgtaactgacaaattttggtgctaacgtatctctataactactctgtataaacttccttccttcagagtggagttctgtcctccctgccttttattgctgctgcaagctgtacaattttaggaggtcagctggcagatttccttttgtccaggaatcttctcagattgatcactgtgcgaaagctcttttcatctcttggtaaggataagcgtgtgggcccatttaaccaatcccttttctgcacatggtctcagagggttccctgacagcatgtcctcattgcccagggctcctccttccatcaatatgtgctgtggccctgccctttgtggcctccagttacgtgataaccattattttgctgatacttattcctgggaccagtaacctatgtgactcagggtttatcatcaacaccttagatatcgcccccaggtaagagctctacctgttttttcccctcctccagacccctccagaggtgttagacctcagtggtcgccgtgaaactctttaatgttactgacattgcactaatggcagaatgacaaataactacaaatatctgtctgtggccatttttagaacaacaaatgtggcatttttagaacaacaatttccaatcttggccagtaatcattttgacaaaaaccttcccaagcttccctaacagagattgaactgtgtatgctgggaaaaggcccacacacaggtgatttggaaaagtttccatggtgttgttcatattagctaccatatatatatatatatatatatatatatatatacagtcacaataagccagctcctgtgccaagacttgccatatatcaacacatctaatcctcacagttatattaggtaggccctattgttatccccattttataagggagaaggctgaggcacaaggaggttaaatggtgtgactatggtcacataaaggcagagccaggatttggactgggggagtctggctttggagtctgtgtcctgcccgttgcacaaactggcttctccactgagcagccggggtaaagaaacgtggttcccagagagactgcattgctccctggttattgacttggtagattggtaatttcaggtttggcaaatagacattgccctgaatgtctttaggtgaatgaaaaactgcattaagcaaaatgactttgccattagagctgaattgcattaaagttgagttgctgcagaagctgtaggtggctttctatataaaatcatttataaaatcatcttcccacagatatgcaagtttcctcatgggaatctcaaggggatttgggctcatcgcaggaatcatctcttccactgccactggattcctcatcagtcaggttgggccagtttattgaacatcttcaagtggcaggtattgttttaggtgttggagatacacacggtgctctaaagatctggatggcaacacaattactctatttacatgagcctctaaatcagactctggtaggtcagatttcccagaggaagaaaaatataagcttattttctcaagatgaatagatgttagattgattaaaatgagctgttccggtgcagaagacagcacgtatgacttcctagaggtacatgagcatgaaacagttcttagttatgaccagaatgaaagacacatgtcaaggaatagcaagagacgaagacagaggggcaaaagaagatcatgaagaatatgttcagactaatccaatttttaaaaaatcacaaaagggaaacaaagtgtcctaggccagtttaaagataatttaatgtctggaaacagatcggctgtgagacattgcaaggaggcttgctcggtgtttggaaatgcaggctcatgaggaagatgaaaagacagacccaggcagggatggaaggactgacgagaaccaacttacaaagagaagttttgtttttactacatttctatgtgatcaagttcccaggttaatatttgactaaactgctaggaatccactgtgactataatgctggaaatgacttagtagggctttctgaggagggtcacacagaagaccaaagagaactcatgttgaattgagatgggttgtagtgatagttgtcaacagccaatacagaaacaaaaaaaaacaaaacaaacagcaacaacaacaacaaaaaaaaacagagaagacacaaacacaatgccacaatgccattttaggcataattttaaatgagtaatattatatgttgaaatccaaattttcagaaaaacattagtgtattttatttttgtttaaagaaataaccatctcaactcagaaccccatgtgcattttggccattttgtttccaatagtttcataaactttcttaagtaactactgcacattgttccttatattccttgtgatcaacattgcaatacacaactgggagggctactagaactggtgtagaaggaacttgtgagattgatcattttctctgttttttacatctaggattttgagtctggttggaggaatgtctttttcctgtctgctgcagtcaacatgtttggcctggtcttttacctcacgtttggacaagcagaacttcaagactgggccaaagagaggacccttacccgcctctgaggacataaagttacaaacttaaatgtggtactgagcatgaactttttaaacattttttacttctctccatattcctgaccatagactcagcagttcttaactctggctgtgtgttagtcttccctggggagcctttataagacactgatacttgggacccactccagagattctgaatgaattggtctggggtggaacccagatactactaatttttagatactccttagaggtttctagcatgcgcccggggttgacaacagctggacaaacttgaaaagtcaattcatgtggcctttgaattttcctcattggaaagtactaaataaataaaaattcatgtgaaaatgatcactgataaatatcttcatggtggggcaggttattggatgcagagaagatctgctcggaattgtagccatatgttacagatctcagcaccgatcggaactgtaaagctataatccccagaattaaagtttttattattttttatacattgtaaaacatagacgtttatttatgtgattaaattctattaaaatttacatgctaaaataaaatagaccattttcaaattatttagatccagatatttccatcagattaaacagatatttatttatcctagcccaattgcaagagattaatgatgagaaaatgaccaatacaagattaaataaatgaggttaacttagaaatcaaggacagagaagatagaactggaaggcttgtattgtgagaagaatgaatgtgaaggaaggcaatgtagacacttccagaagggatagcaatatagtttagaccatataatgaaaattggagagagatgacagagacactttcaagtgaaatgacaatttatatgggggagaaaaatattgaagacataacaagatgagaaaaggcatagaaatgtatcacatacaaggcatagaagtgtatcacatacaagagaagttccttttgagcgtagaaaaagataatttaaccttcttcatatttttcttactttcccaagatactcagataggcagcgtcaactctaacaggaattaatttggctcctaacacttaagacatatcctttagtttgtctcctcacacagaactgattctggttttgccacaacatgtctagagaagaagttcccaccatattttaaatcctattaaaaaactgcttggacaagaaccttgggttaattcagcagatgaagagaatctcctaatgcaaatcaatgggtatttttgagcaagtttttcagaaaaacagagtgtcaggccctgagggtggtactaagatgagaacattgattttgccttcatgatattgacaacacaaagaggaaagggggtttgcagaaaactaaaagaagaagtagaagaaaaaagaaagacatagtataataggtagtcaaattatgtacagaaaaaagagaaaaaaaaaacaaaaaagggtgggggacagacaacccaactaaaaaatgggccaatgacttgaacagggacttcataaaagagaaaatgtaagtggctccttaacatataaaaagatgttcaacttcattagtcattacagaaatgaaaatcaaaactacaatgaaataccactataaaattaactaatggataaaatgaaaggagatggaaaacaaaatgttgccagacatgtggagcaactggaactttcatacgttacgaatgtgaactttggaaagctgctcggcaatatctcctaaagctaaatgtacaattccagtgactcaaacattttacttagaaatgcacatatacatccataaaacatgtacaacaatgttcataggagcactatctgtaatagcctgaacaggaagttgtctgttaaaaaaagaatgagtaaataaaccacggtctatttgtatagcaatgagaattaacagaccccaatatataatagatgaatgggtctcataagcacaatattgattaaaggaagacaaaacgcacattcttttaaaggtttataaaatactttttaaaaacagctacaaccaatctgtcctgttaaaaatcagtgagcgatttcccttgtgcagggatgggggttgtggctggatggatggtacttaagaagtgctcctggggtactagaaatattttatttcttgacttggatgtgtgtttactttgtgaatattgtacatttatgatttgtgcacgtttatgaatgtagaaaataaaacagaaagcaaattcaaagtatcatccttttgagagcttctgctctgacttcgttttgaccaatggagcagttgggaaggggtcttggtccttcggtcctttgctttttttttttttttttttttttttagacagagtcttactctgtcgcccgggctggagtgcagtggctcgatcttagctcactgaaagctttgcctcccgggttcatgccattctcctgcctcagcctccccagtagctgggactacaggcacctgccaccatgcccggctaattttttgtattttttagtagagacggggtttcaccatgttagccaggatggtctcgatct
